United States Patent 8,781,750 (CELL-TYPE-SPECIFIC PATTERNS OF GENE EXPRESSION) - sequence listing, part 12

SEQ ID NO: 36247 - DNA, 234913 bp, Homo sapiens
gagcccggcccgggggacgggcggcgggatagcgggaccccggcggcgcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgcttaaagggtaaaggaaccggttccctcctttggtgtgggtctcccaagtttcaagatccagaacaacgggcaggatgactctccctgtggaagactccttggcaagacctcctgggggcaccttagaggtgctagggttgtttagtccccaccccgttcgtggttaaactaccttgcccctactcccagagatttctgccccaaaggagaggacgtggttaaatggaatcttgggccattgttgaggcagattttgggaggcgagaagagttccttggggaagaaggggaggagttgcgagtgggataagaggagaagcccgttcctttccctgcaatatcaattctggttgtttctagaggaaagtactttccttggggtcatcttggtagatgctgtatttgaaagggggcaaggaaaggaagggattcccatgacagtcagaggagaaatcacacagtagttgactcttccgtaaattatgcttattaaaattacggattgggttttctgggcaatgcttcctttagatgtctacattggaagcagaacagggcaagtggttctgagaactggttttttgagttgtgtggggctctccgtttcactgcagcagtaaggctgctgtggccggccttaagggagtatttttaactagtggtgtttgtgttgtgtacatgcaactgaccatttcactggcttcccatgccgctgttacagatgtttcagccggaaaaattttaattagacttgactaagggttgtcattttcctgtattgaaggacagtgggaatacatttcctttaagagaaatttgtctgcagttgtttaagttaaagcctccatggaaacaacaggatggactgtcagtgaccccttttatcttcttggaggagcctgttaaataaattcagacagtatatatagggagattttgtattaaattcttaccattctcgctgatgctcttttcctgagtggttctgtagctttattatatagctctgggtcaccaagtgatggtatccacttggatatgtggctgttcatttcacttactctttttttgttatgaggtgttatagtcatgtatatgtagtaaaatttgtgtttgtatggcccagatatgagaagaaaaagtaaactcaccagaccagtttttgactcctagtctggagtaaggacaagatgattgtatgagccaagcacttaggctgtgataaaatagcacagaaaatagttatgattaattcggttccatcttggccttcgtggaaaataaacccagaattccgataatgttggaaggaagtttgcttatcatggtaaacctgaccttgatcagacagcagatgtttattgccctgtgtgcaaggcacatggcaagttcaataagtagactgaggctctgattttcatatgttctcaagaggacctcatttagtccagtatttttccttcaaaaatacatttctcctacataataatatcttaatatctattctgataggattgctcctgtatataaaggacgtggggatttaattctgtggctgaagatctgcagagaggtgtgaggcctggtcagacatttgtctcatttctctgggctgtcaccaactagtgtgttcccttgggaatgtgaaaaaagaaactaagctttactttgttgcttaacaggatgccacacttttactcacacttgtgctttttctctctggttttaaatttgtttgtgattatagagagatacctctctgtgctcctcacagtatttgatcattaacacagaccttatcctattgtaaactatttataaagccttcctaaaaacagggtattaatagaattgtaattatgtgtgttcctaattctcatgttaattataagattttataataagtgatatatatatatacacacacacacacacacacacatacacgggggtgaaaataataatttaaaaatatatacaattaaaagtatttccctgccacctttcagagaccattttcttgtgtatttttctataaatcttttaggcatatgtatacatgtacaaataaacacaaatatatatgtatacatacacatgtgtgtgtgtatcctttttaatacatggaatgtattgtacatgcaatattctgaactttacttactttttatgtatctttaatgcatccatctattaactcatatggatctacctcattcattttctttctttttttttgagacacagtcttgctctgttgcccaggctggagtgtagtggtgcaatcttggcttactgcctccaccttcccggctcaagcgattctcctgcctcagcctccagagtagctgggattacaggtgggtgccaccaagcccggctaattttttgtatttttagtagagatggggtttcgccatgttggccaggatggtctcaaactcttggcctcaagcgatccacccacctctgcctctccaaattacaggcttgagccactgcgccctaccccattttcttgttgtatagaacctcattatgtcactggaacagttccctagtgatggctctttagattacattgagtcttttgctattaccaactttcttctgcatacctgtgtttacatacacgtgtttatatgtggtataaattagtaaaaatagaattgctggatcaaagtctttcccatagattttaagcaaaccccaattcttatgttaaatttgaataacattttaaatttattccctctgcttattgccgttacagtctcatatgaataaatcctttaacggtgccctgctgtataaatcatcagaaaaagcagttatgtactacatttttccagttattgcttaaaatttctgtttttgtctgttaaaatattaccggcttcaaaactcacctctttgactacagtgaaacctgtttaccattctgattggagatgcacagtttatgaagtgaaagtgatttgtaacccccgagtctgcctgatgcccagttggtggcagcaactttcagcacctcactaatctttcctctagttaaaaggtaccttaaactcatcagtatctgctgtgcactggttccttctccccagcaaatactgccttcttgtttttctctgatgtggcaggtgactacaaaatccgccttggtattcttcaaatgcatatatattcctttcttgtcagctccctctcttcctagattagaaaactgcctcattttctgctcactggatgtgcagtcccagcttgtcttcctctcctccccccctgttgcaggtgttcttttttttttttattctctccccactgggcagcaaaagttgttccacagtggaaatttaggcatcctcaagtttcttcccagcttctgctgtgttttcttagagtaaattgccaatttctgtttttacaggaaatccttttttaaaaatggaatcagtgtggtccccatctactctgcaaaaattgcatttttctctattttcaaatgagatttgttcaagtttcaaaaccacgtgaaataataaatgtatagtagttttcttttccttgggcattgcttgatatgtgaaatgggtttatgaaaaataataaaatcataacgctatttgtttgactttcaattcatgggaatttttctcagctaaactctaaatggtgattaggcaaaaagtgtgggagacagtccaaaaaaaaaaaactcaactgtacttgaatagcaatagttatgcaccatttatttatgattgccttattgctttagctcccaagtaaggaaatattactgtttcctgtcaaagggggaaaagttcttcacagtgagatctcctttcccaaaccttggagaagatggattgagacttctgcccttgttgtgtggtttataggtacatgagaccagttgtatttgacacaatttgtccccttgtgtgtgattccttttggtctttgtttatttgtttatttttttccagaggtcttgttgccagaaaaatacacatggaacagttcatacccatggtagattatgtgatggcaaactccaagggattagttatgtagaagtctgttattaaaataaagaactgtaatagggaatacagaaaaagttctgtagactttataaagtccattttactttataaaggggactttaagacttcacctgaagtcagatgggctaataattaaatatggggaaagactcctgcaggggtatggtttacatttattgaaaagattaagctaaaatattgggacacaatttttttttaaaaaaggatatagtgttcttaaatagaagatttcagcaattccacacatgaaacaagaaggtagagacaaaatatttatttatgtgactcattttgtaacattgaagacatagaggttgtttataaaaatgtgtaagttggtaatacaaattaattaaaacatacatcagcctatggtgaaatgagatgagagctgatggaaatggagtacagacttcccttcaaccttatttggaattttaaagaatattaaaatgttcctttatcgtcttgtgtagcatatactttaaaaattatagtattatactgatgactctaatcaagcaaaatactaaaaaattattagagtattcatgtaccagtttgttggctttttcttccagtaagccaatcagcctaaccactttgggagttttagctttattttcaatgtgaaaataagattttacaaatgttttcttgaaagagaaatacattcttttaacaatttctttgtttttaaacatgaacccagcaaatgggcctgcttaagcaacttagaattttttcccatgagattctttgaagaaaccgacatcaataatatatcaggcctgagttatgtggcctaactcaggcacatgatagtttagcgtttcatgattgttcaagtcgattttctcattagatagttaaatcattgaagacaagaatcctattataagcattttaccactaactcatcattaagtggggtttcagaaagttcattaattcaggaagtcttgattgaatgctagcttgagtttagttctgtggaaggccagagacatataccccataaccctgggggtacttcaggaaccgtgagtgcacagaaggacagcgtccctggaaagggggtctggtattaagtctaaacaaatacataataacaattgcagccatggtaggtaacatttaggtaacatctatatgttactaagcactatatgttgctaagcactgttcttactgttttgcatatgataattcattgaatcctcatagccactctacaagctgggtgctttcataagcttcccttcacagatgtgagagccgaggtatgcagaggttaagttctaaagacaaaacttaacgttaacttttctttctccattaattttagttatggttttggtttttcattccaccagacaaaaatgcaggcccaagacattggtaaaattccacttaaaattcctaatattctttcatgctagttcacaaatcctaagtatggttaatcacacagtattatttagtccaacaagaaactttctgcaaagacattaataaaacagaaagaatcataggatgttagagccagtgggactttggacagcgtattatattttaatattagaccttgacttgtgtgagggtggtaggtaaccattgcaggcagcctgctgggcgttgtgtgggcttctgagctggaggcattgctgtttatgttgttcagaaccctcttgctgtcatgtcccctgtgagaaatctctctgaatagggttgcaagaagtatttctctttccagtggaaattggtatgtgtcttaaatcacgaccagtcatatgagttatttaattatttctttttcattttttaaccttggttgcctgtaaactcagcccaattttttacattaaattgcagccataatggtaaaaaaaaaaaaaaaaagctctgatgtatcacttatgattgtactttgcaaatactaattcctttaaaacataaatcctttatgaggaaaattaagcttatttattcatttaacaaatgaagaaacaagggatgcagagtttcagtaattactccagggacataaactagtaagtggtagagttggaaaatctagcttcatagctggagctcttaatcttaatattttactgctttacagttataataaatcttgtagctggtaaatttttttctttcataccttttataccttcgtttcccaagaatcttctcccaccattgctatgtggaaagactcaacatttattgatggcagatgctgttacaagccaagggaagcatcattgtgggaatgggattgatcagaagtgactttacagtgaaagtctattagggctgggcatggtggctcattcctgtaatcccagtgctttgggaggctgaggcaggaggatcacttgagcccagagggttgaggctgcagtgagctatgatcatgccactgcactctagcctgggcgacagaacaagatcctgtcttaaaaaaaaaaaaaaagtttatcagtggtcaacaaactgaagaccaagctcactttttttgaaaatagagttttattgaaacaaatccatgcctgtttatttacttattatgtatggctgctttctccctacagcagcagagtggagtagttgcaacagagacagtatggcccataaaactgaaacatttgctctttggtcctttacagaaaaagtttaacaacctctgatctacgtgataaaaagtgactgtctactaggagtgagaactccttgaaggcagagatcttgcttgttttatttatctctaggaacatctaggaactgggtatgcggcacatgttcaatagaatagtttttgatagttgaactctgagcaattttgatgagctgattaactgggtatggttaattatatagactagagcttggagtaagtatagctgagaaataaaggaaagatgagtgaaaaatacatcaagggaaagggatatgaagtgtctgaggtcttaggacattgactgcagttgggcagggttggcacggcatggttccaagtgacatggtttgtagtgcagtctatgaaacgagtgccctctggagctgtgcagtttgcaaccttgagcaatcttgtgagcccgtacataggtggcaatgttgttagggaaaggagagggactagtggaaatataaatgtcactgatgttgtgaaaggcaaggacggggagctagtaaaggattctaagataggaacatgatcagatctttgccactgggtagaggtgtgaagggtagatgattagagagaagagagactaaagacagggagatttggatttaggaggctaatataggagtcacagtgagagtccacgatggtctgagcaaattcagtgaaaggggtgaagaaagaagagactcaggtggttccagagttaatgcagacagtacttgactagttggttgtgaaagacaaaggcgaggaggacctagaatgctcccacctccatatatattcaaacttaccatacacgaagtcattgtagcaccataaagagaaaataaagggaaacgagatcaggcctaggccctctactaccatgaaacaaagtattttcatttgtgagtgtttgagttattttattgctacgtaacaaattgccccagacttcgtggcttaaaacaacaattttattctttctcatgattctgtggctcaggaatttagacaggacacagtggggaatcttgtctctgcgccccacaatgtcagttgggctggaacaggcagtatgacttcttcacatatgcatctggttctgtgaccaggcactggcgcctgcagccctgtttacttgggtgtggtttatctaaatggacccactgaggaggggaataaaggaagcaaagagccacttgtctggctctgctgggggccttccaagttttaaagctgtctctcatgcagtctcctgcctgaacctgcccccgggatggagccattgaatgtgttttttttcaaatggggagactgagccccagatgcagcgactaggccttgctcagagtgagtgtctgttggggctggatcttgaacaacagcctcctgaccctggtcacatgtgttaatcccacatattgaccgtaggctaactcgaagggctgggggctggctggctggggtcacatggactcatatgtcctcgacattgcctggcttccttgattctcctttatatagtctcaggttgtcccctttctatacgtggcctctctacatggtctttagagcagcatagccagactttttccatggcagttcaggatctctcaagagcacaaaagtgggaactaccagactttcttcaaacttagcctggaatcgcatgacctggaattccatccaagtcataggcctcatccagattgaagggcatggactattaagacctacctttggatgtgaggagcatcatgtgtctgctgggaggggagaaagtggagccatctttggagaccagctaccactgtgaggcaatagatctttgagaaggctaatcagatactttaagttttaattctaacttgatcaagttcagttggcttagttctctactgaggatgcctcattgtattttgctgctgtaacttcagaatgaaaaagctccataaatattgtgtttgcatgttctgttagattcatgttagggcattgatcttagtttgtccacagttctgcatttaaagaactcacaactgtcaggaataaaatgaaagttcctaatgaagcagtatgttttgttttattcaaatatgagaatttcaaaacatctaaccattttccatttgcttttaagaaaatcagcttttaagattatacatgaaataaatttaatgggcaatcactctaatttattaactttggtatgttttaactttcttctgtatggaattttattttcaatttctatttatagcctcaaatgtatgtatctgttggtgtaatccacctcaattttttaaattaggggttatactaataagtaaaaataggttgcagttgctaatagaattggtgttgtaatgagctgaactgtactatttttcttataaatggagtagccacattatcaatagaataaaattggattaggaatatagtcaagtttgcattgtgggtgtcttatactatatcaaatcctagatttaaatttcttgtgactaccactttttcaacttaagtgacttttttttggttgaagttatcactgactctatttattcagctccctcagagcggaagagagaaagcaaaaatccctatctccaccattcccagccggagatgtattccagacagcaagcaggctcagagtgggagaactgctccattaaacaagtggtttagttcaacattttgaaggattatgaattcctagaccatcagtcatacttacattcaaatataagtatccaaacacatctaagtccaaatatagtacaaccattttatgatgttggtgttgggagacaggatttatgtctgccctaaagacacattgtctgctgtcaagtttcatggttttgaactgaagtatggtaatatctttattaataaagacaatgtattccagaggcagggtttcattttgtgtgtgtgtgtgtgtgtgtgtgtgtgtgtgtgtgtgtgtgtgtggttttttttttttttttttggtttcttcttcttccttttccggttctgtttctccttctttgttgccatcttttccttttcttctttttcttcatcatcattgtttcatcttctttttgtaagtaatttcataagctgtgctgcaaataaaatagggaggataggaatatcaaatgagagttaaaaccttaagaaaagtaaacaaggtctaagtaaaatacaaaatttttacctgggaacattggggtgttcaaaaagcaaaacagggttaaggtttttgttaggggaaggaaggagaaagcctgagggaagcaggaggagagagctgggagaaggttctggagtgaaagtcttgccagccagtggacctaggctggacagagcagatgctgggttttgaaagagattgatgacaaccccttcactcccggcagcattgggaccaggcgacctgtggccttaatcagcctcttttaggggacagagagcttatggaggagagtcaggacataaaagaaagacacttggatgccagaaaagattcgtatgaaaacatttagaggaatgcagtggaaaagcaggttaatccattgtctggtatgcacctgtgtatatggtactatgtaaagtttgatgcatcctgcttcttgtaactaatggtttattgtgtatcatttcccctgttcattcagtgctaatttgtaagattgtgtaatcagaccctaataggtttgggcctttgatgaataacttttaaaggaccttcttatttttaaatgcttttatttttgccattgaaattatggcttatatcttcttccatagccagaccatccatctttagaaaaattcatattataaattagttatagtaggacagattttagaaatgtataaatactgaaactgaggcccagagaaggtccaggaacaagtgctcaaggtgcttattttcctctccggttcgtaggtgtggaagctgagtcacgtggtagcgagagctgacctaagaggcgcgttgttgggtaatagattgggcctctttgtgttcacaccctcaagaggtggactggtatctgcaagttctctgctatacttgaaataaccaaaccttatcaatcctgtgggcatgggtgttttctttctctcatttatttgatcttaggcagtgtgattactctctcagcggtcagccctgaaggggtgatactgtagcagagttttagatcctcagtactaccctgctctcagtgggaacctccacattagaaaggattgggtgggatgggactttttgagggaggtagttgtcaatgagggtatcagtcaggtggttggaaaaagagaaatagtcttctccgggaatcggaagcatgactcctccccgcaaccctccaccacacacatactcacacttctaattggcagtcaaagagtcaaatgacctgggatcaactaaggcagttctgggtctgtgattaagcttggtttcttgttgtgtaacttgctggctcagttatccaaactatacattaagagtttatgtaataaacatgctaaagaaagaaaaaaattcttaaattcttgtgttttcctccatatcatctcacctagtaatactgtaaaacatctgcctactccaagtgacaactatgttatgagcattagctgcgtttgaataggacccaatgcttcattttcagaatgaacaccctgtcttgggcttgttgatattattatctttttttccaatgattctaggcagaactgccatttggaatatctttctctccctttctgatggggttaatgtctgaggagatgtaggcaaatgcttttcagtgaaggacttgatgtgcagcctttaagtagacaaatagttttttaatctttcatggactgctggtgcttcacaccccagagttgaggccactgacctcaagtttgcaaattttatatcccattaccaccctgtgagctctgtgctccccagggtcacatagtcggtgttttagctggaatctgagaaagtgcctgaacatttcctgaagagttggctaggaatgtttggcagtttggtcataaaaacccagagctagtggctggggtatatgttataattacctcacactatttcctatttgagcctggctgtgggtagtggggtatactggtattgattgtgggaccatattttaaaggaccaaggagtcattttcaatgatcactaataacctttggccacactttcagggaggtttggaagtgtggaaatagacatgctttgggtcaaaccctggctccaccaccttctaggaggaaacctcagacgagtgatttgacctctctgggcctcagtttcttcacttgtaaatgcgattaaattactcatctttctgtgttgtcctaagatttaatgggatggtacatttcaagttcttagtactatgcctgacatgtttagctatgatgatgagaatgattataatgctgttacagataaggaaaatgaggcagagagtcatccaaagaggctgttttttatggctaaagcaaaaatctagataatcatacctatctggataccacagtctccactttctcatcatagaaatgattatattaagaaacaggaggcaaacctgaattttaaaatgttcaaaagtgtaattttaatggacttactatatctgtggagatctggttatacttaaaggcagtttggggataagtttttatttttaaattttctctttccctaaattgtgttgtcttcattgggaaacaaacttactaaatattattccttattaatatgcaccccctcaactcttccaaaaaagtttgcattttttaactggcagatctgtcaaataggccttgcctctttcctgattagcacattttttaaaaagatactttgtgaaaagaatttaaattttagtaaatggaaagactgggttgaaaaccattctctttggcagcagtgcagagataccctgggagttagaattgtttcatggcaaggtggtgcgctattcttgaaatgtgctttaattgcctctgttggagtaaggatttggttataattgggtagcccagatgaccacctacaattcttagccacactgcctttcaacacataatctcagaggtaaagagataagccctcttttccagattgctcatgtcagatctcgcggagaactccagcactgccccagtcacacgcccttcactgtcgccaaagaaataggacactccagctggtcaggactgagccatgtgttagtcctgcctgaaccatgtggaatgggcttaggaaacgaagagtttggttagcagagaaggggaagggatactggatgggcaaacacaacacatctgcactcacagggagaaagctcccttttccatagcgtcagtattccctccacccactctgttatcactgtcctctctaggtgctttgtgggcaggccttgcttgcgtgattggggacaggctgactcagattggcagcccctgagaagagccactttctagttgagcgttcccttcctttggcttcatgccatgcagcaacataatgctcatttactacaaagagattcttatttgttcttcttcttctgtgtcctctttctcttgagaaattgaaaatctttttatttttaaattttctcttaatgatttccattttgattttaatgagagttgactttcggagaggtcttaaactattgaacatccgtgagagtggaacaaaacatacattatcttaatttaggcatagctttcgtagagttcctatacgctgcaccctacatgccagctctggttaactgattggcagtaaactctaagaagttgcggttgcttcatattcattcacagcctataaaaataagagtagagtgttttaaataaggaacgatttgaacagataatagttacttttctatttgccattgaaaatgttcaaattacttaatgtctctcatccccgtggggtaaatcacaccatcaccaacagaaagtttgtaaaaaagtaagaatataaaatcaaacaaatgaataccaggtactttcttttcttttcttttctttttttttttttttttttgagatggagtctcactctgtcatccaggctggagtgcagtggcacaatctcggctcactgcaaataccgggtattttctgtgctctaccgacttcctgggaaaaaaataaacctcaaataaaataaacttttccttttaaagttttgaaaacctttcaggtattttacaaagataggcaaaccactttttctccttttgcttgtaagcagttctaacttaatccagacattattgaactttgacagaagacagcagggtctaatttgactgcagactgactcatctgctcatttgcatttgggaccttccttgaaaataggttgtttgacacacattctcacacattgaaaggtcagaagacataccaggattctttgctaaatgatttcctccctccatttcatatttcccatgtccataagaattcttccacttatgcacagaaaaacccaaatttaacctttttatggacctgatacacaaaaaccccttcccccaaaacacatcttttgttaactgatgggtttatgtttgtcataaagaaagataaaatgtctttatgaaaatgaatcatgtcaaaaaggacctgtgatgcccaaggggatccatcccctggaccgacatgttaattgtttgcacaggtgtagtgaagtcatttgttcttggattcttcatctagtgaactgtaaccttatttagtagctggatacttagtaggaacactttggttagttcttgccactgatttaacatggtacacatgttgggattggactgttgtctcttaatgggggtcccctccctctcaggaatgttgagctgcgtaacagataaaggtggttcttcaagtgaacgaaaacagaaaacaaaagtgtggcatgatggcatgtaggagactgtggatatcaggatggactaggccaggtgctgctgcaaatttgtgttttttaaaaagaattttatttaacacagatgtggataatttcaaaactagcaagaaggatacaatgatgatccagcttcagcatttatcaattaatggtcaatcttgttttatctacttcttctctccctcattgcatttattttgaagtaaatccttgaaaaatcattttacttttaaatatttcaatgtgtgtcctaaaagataagggccctttaagaaacataaacacaataacattattctgtttaccattaacactaattttctaatattatcaaatattcagtgaatatttaaaatttcctaattgagtcataaattttatttgtttttttgcagtttattcaaatcaggatccaaaaaagtccatattttgcaattggttgatctgtcttaaatatttttgaatatgtagattgtccccctgtcagtttttccttgtaatttatgtattgaagaaattggttcctgtcctctacaccagtgcttcttaagatgccagtccacaaactcctgttactggtccatgatgagatgagaagccagggtgtaaatccaaaatatgtcactaagcacactatttagttcagctgatattttatttctagggagactttctcgatgaaggaagcagtgagatggtttagattctagcttaaactccttatctcaatatagactagtaacgtctagtttgtagaacagcactggccagtccttggaccacacatggctttcaccactggagagtttcttgcagtccagtgatgactgcattccagtggtatggtcctaccatgtttctcagtcccctgtatttgttgtgaattgctagttagagctagatgcttgattcaactcaattaacttttttttcaagaagactttataagtggtatgtgtccttccattaggagggacatcattactactagtctctctttttgtgttattagcattcattgataatcgttttctagatctattagggtggcagaatggggatattcaaattctgtcatttcctattgacttactaatgctgtaaagttttactcctagttttgaacttaggctcaatgcttcacagccagtaatgtttgcaatatgctgggtctgatttttcttatctgcgactttgttgtagaaaaattatttaatatctaacagtaaggataggctattatgagctatgaaattgtggaaaattcacacagaaggagcctggcatttgaaagggaagaaaataattctgcaaaggtccatttatcccatgatcttttgtgagtgtcaaggtggaagcactcaatgtgtttttattttaaagtaagggatttcaggcaagaaccttatgaaaagttggtaagattttggactatgagggtaataaagaagatatctgcagagattttaatattcagaagtgaatttttgtaccttcatttcggcattgctctctcaggaatgctcttttttttttttttcttcaagaaattggaacaagtacaaccttagtgattcaaatgaaagattctgaaaattactggtacacccagtcccctttggggaaaggaaggtagggacaagagctgccccaggagcacctccccgactgtttgtaggggatgatacgtgcgcatgtgcatgtgtgccaggcacatcacccgtgtgtttcatgtcagtgaaacatgtccgtcattctctaaggcctcatgtattcttacttgatagaaaactcctgggtgaaatgacaggcttttggaactgctttttcgtcagtgggtgctgctacagagatttggaagccctttaggtatgcgaggtggatgtatttctgtctgttttgacatcatcatcaccacttcagaagttgtcatgttgaaactttgtgctggcatttagcacctgctctgcttaattatagcttgaaacacaaatactgtgacatcttccctggagctggaagggtgctgagaggacagtgctggcatcactcacactgagagggaaatctttcgggttggatttcagggaagagctgtgctggccattggaatgaggacagtcaccactttctctgtgtaatggacaatatcccagcagcctctgaattaagtcacagagacgtgaaattggagggttttttttagaagatcatctggatcacccaggccttcgagcagctcattgtcttcctaagccgggtcagacagttgcctgcgtgtcctgatggttttgctttgagctacttttcaaaagacaagccacacccatgttgaagtgtgtgtactaacacattccaatgccagctctgagtaggttttgaattatccacatgttgaatctttcttgtgctctctacacatccactccctcaaacgttgagcatgttaagagctgactaatgtttttaccggagggtgcaggacagaatactcattctctgttgggaaatgcagaaactatttcagaaacagaagtgccaatctataggagtgaatgttcctaaaatgtgttctctttacattgttttcctttgctaatacacttccaaaacactgtcttatttatttattttgcaaacctagtaaaaaaatcagagcacaaaaaatgatgtacaaattagtttatacaaaaaagagaatacattctctttggagtatttatggaaacatctttctaatctctaatctaaaaatctttaacactaaccttggaatgttattaataaagtcttttggtttttaattagggatttatgacgtttccattgtgtagcctttgaaaaattacttcacttctcacattttcagtttcctcatctgagaatgagcacaccaatacattttcttgatagggtttgggggaagagtaaattttataaattaaagctctctaatagttgctaattattatttttattccactgaatgacttcatgtggactaaagtactgatttggttaaattcccttaaatttaaattagactatttttattaaaagttttccacatatctaaatgtttaaaaaataaatgcttacaactttgtttcaatttcaaaattaaaaaaaaaacttaagtttttgactgctaatattgtgaagtgttaatttcaatgaaataatctcagcaaactgcatgcttttacctaacttcctctgactttatagaaacttaaaatctgttagtgatttatttatttatttttgttcctgagcaacaatattgtccctgttttgatgggagggctagatagagaaatgttttaaagatccatggcctgttgactgctatgaaatatggtttgagctacaagatctctgaagcttttgtagctataaatgtttctaaatgatgcaactgaaacatggaagaatttcactctcgtactccatgtattccacttatgggtaattgttgttatgtgttagattttttccttttaattttctaaaatttaaaaaagtagatgaaatgatactgatttcttactagtaattatacttttcattttttttttttttttgagacagggtcttgctctgtcacccaggctggagtgcagtggcgtgattgcggctcactctagcctcaacctcctgggctcaagtgatcctcccactcagccttccaagtagctgggaagctacaggtgcatgccaccatcttggctaatttaaaaatttttttgaagatatagattctcgctatgttgcccaggctggatctttttttaaaagtttcttataaacatatccacctttttaaataaattaaatactcactactctgatagacttctcattaacttatgttgtcttagtggtaaatgaaactctaaactctcatttaccacttaagattcaagtattgtgttaggtgctgggattgtaaagataaatctgaacttgctatatttaaggaacttgcatacacacacaaaaaaaacgctggtaatttccagttttaggagaggtgaaattcttgaataattttggtatgagactaaagtcaccaaataggattcaaaacggacttgcttccttgcttcacgtgtaagccactcgtgctagaaatagctcactgaagtctatctgtgagccagtccaggatactgattttatgttatagttgctaatggggcgggatcttctggcctttaaaataaatcaggtgcatcgaggatgagaactctccaggttttaagtctctgattcatggacctgtggatgtcctgtattggccctgatggtctcatgcagggggtccagaagggtgtcaagcctgggctgggacggctctgactctggctgccctctcaggactgtgtggagttgcctgagtttaaggtgttcatttctcacagatcactgggcagcttactaagctgagacatggtgggtttgagtggccaagttttcctctggttgcctgccgtggaatgtgttttcccatagaaacaacattttaagttgtggtcaggttcccagaccagcccacaatagcctattcagctgataatgcagctgagagactgctatttgactggtctggagaccaaaccaccacctattaacattgtttctattggacaggccattccaagttctaaatactaatatagaaatgaaattttggagctctacctgtttgtcaattgggggctgacagcattcggaactcaagtatcaaatcaccctgcactctaggttcctgaaagacctcattctttctttctcctaagtctgaccccattggctgattttcctgtctcttcctggggctgccagtacattcagaagatattatctccctggacagagctcttggtttgagaatttctgggaagtggcaagaatcatggttttagtccccagttccttctgtgggtggtaaaggaattccacaagctccacccccggctccgcctctggccggcctctctctgtgcaggctcagaatcccctcaccacttgttttgtgttttcaatcatttctatgatttcgttcaccctttggaaaagtacagtgtggcttcaacttgaataaatggaatgaatatcccagtcaaagaaaagctcttgatagaccctgagctcactggtgaagtccaggggtttcagagtgctgggaagcagttctttacacaggcaacatgttctcatcgtgtcattggccatatcctctcagatgctccagaagcaaacatttgagataagctggattttctgtttggaagcaatgcttcctcatccttagatggtcaaatagttgaaacttcatgaagaaattcacctcttcccatgtatgggagcaacttttacccaaccaaccagacatgtgacgccagtaggccagatacagatgccctcccttggagaagtgatccagtacacactaggacagcaagttattcaaatcattgccttcagaactttgaggagtccattctggtggtgtaattttctaagcagacaagcagacttagtgttcttagtgctgcttaatccagagttccagaagcatgaagtgaagagtgctgacttgctgcacacatgatgtactttaaacatctgtgcctctggtcttcatggttcaattgtctagtttcctgtagagtgcatcccatggctttttgagcttcaaattctttttttttaaatatatacactccacctataaaagattccaataggatttaaattggctgtcagtctaaaaatgatgtcccagatccgaggaactgccttttcagctttctatttcctaattttcttaggctgtgcgtgtgtgtgtgtgtgtgtgtgtgtgtgtttgtgtctttgtgtgtgtgtatgtgagagagagaatgtgtgtgttggggaggagggtgcatgtgtacatgcccttgaagggggacgacatttttggaccataagttcttgggctattgcttttgatcaacacaaaatctccatgaaaagttgagggtacacagtgaatgaaactgttgatgcaacacctttgtgctgcttgtgctgtgagttactccactcagcagtgggaaaagccttcatccaagcagcacatccaaagagacctatcaaggtcactctatgaattttgtcatgattgtctgtaggaattggccgcatgaggctggctccatctatggccttgatcagttgcagcaatctgccataataaaatgcatgccaacttgtgagctgaaaaccttcacttagttgcttgtgggattttttttcttcttttgccaaagaaataaatagaatcaaatgtttacatatgtgtgttatttgtctacattgattttgtattttctcaaaggaaaatattgatttctgagttataaacatgggtaacttcactgatcagaataagttaatgacaggcatgtcagtgaaataatcaaggcacaaaaccaccatacatttctgtttaactgcctatgtagcctttcaaagacgtgttaaatagtcttcttttaaatagataaatttataagaaataattctatcgcacagattttaatgtcggtggcatattccatctggcttacttttggcactgaggagatgatattaatctttgctaattgtacttcgtactcactattgcctttagtcaatattatcttgtgtgcttctaaatagactccaggatagtctaggcataatagacattgtttctgtgcctgaagaacaatttattactctgggagtaaagggggtggtgggttgggcttcagggatgagatctagacatataattgttttaaatatataactacagtatagcctatgtaggtttttgaagatatgtctggaattgtgtttgtagtgtgaaagatggatggattcatcagggaacactaagggagatggaactacatattgaaatggaaagatggaagagctgatataaaaatggaggaagtgtctggttttagtgtgtgtcagagatagcagtgcgtgcatgagtgagggctgagacggtgaagaagaggagctgagtaggagggtggaagttgaaggtataggtaaagataagagttgacaggtagattaggcctacctggtagatatctgaacctaataatgagatgtttaacattatagagagtgaaggtccatctttgggctgtaggggaatagaaataagcacggtgaatatgaaaagatacttacccatattgtcctaatggagtagagagaaactaggaagccaggaaaaaagaacatgatattggtccaacaatgaaatcaccaggatttggacaagggatttgctaatggagttggagaatttaaggggaatttcatcagtgggatgaaataaaactagtgactccccttagcaaccgggaaacatcaagtcatagctcagatagtcctcttctgagcttaccatgcatgctgtggctaaaggcctttgttctggcctccctgagttccccaggcagaccttgatgttagtgctttgtctgttgtgtagataatctttgtgtatgtgcctgtgttcctagactgtaagatcctcaagagcaaagactgtgtgtcttagtcactttttaaatatagctgttttatttataattgcattgggacaggattattattattttaccttaaaataaacttttcactttagaacggttttagagtcacagaaaaattgagagagttgccatatactctggacactttactctgttgttagcatctcatactagcgtggtatattttttgtaattaatgaaccaatttttttcttttttttttttttgagacagagtctcgctctgtcacccaggctgaagtgcagtggcacaatctcggctcactgcaagctccgcctcccaggttcacaccattctcctgcctcagcctcccgagtagctgggactacaggcgcccgccaccacgcccggctaattttttttttttttttgtatttttagtagagacggggtttcactgtgttaggcaggatggtctcgatctcctgaccttgtgatccgcctgcctcagcctccgaaagtactgggattacaggcgtgagccatcgtgcccaaccaatgaaccaatattgatatgtagttagtgattaaagtctattccttattcaaatgttctgagtttttacttaatgtcctttttatgttcagaatcccatctaggataccacactgcatttagtagtcatgttttcttagacttgacttagctgtcacagttctcagactttccttgttttaatgaccttgacagtttttagaagggctggtcagatattttgtagaatggcccttagtggaattatttgatgtttttgtcatgattacattgaaattatgggtttttgggaaaaagaccacagaggtaaagttccatttttatcacataatattaagggtttatagtatcaacatgattttccattgttgctgtaacccttcattgcctggctgagataggatttgtcaggattttccacttcctccccctccctttatactgtactctttggaagacagtcagtatgtgtagctcacatgtaaggagtggggagttatgcttcatctttttgaaggcagagcatctacaaaattatttgaaagtcggaagcacaagagatttgtcttttctctcccatttatttcttcaatcatttatttatcagtatggacttatggatatttattttttacttggtattgtaatccaatgctgcttttgttattttgttgctccaaaagggttctagctttggccatttacacttccttcatttggcttctgtgtcccttgccatgctcccctcagtgtggatgtttgtttagcacttccttatactttctgtcactgcaagatgctacagattcagcttgtctatttcctgcccagccctagaatcatctcccaggagccctgattccttttattgaataatagtattagcaaccaagatctaggcattaggtgtgctcttcttggtcagttttatttcttatctaacacagtgcctagcacataataggctctcattaaatattgctgaacagccagcagtaatggaatgttgagtaactgatggtacaaatgactcaataaaatattatgtatctatcaaaaatgatcattagatttatacaataacataagtgaaaaagtaacaaaaaatgaagattgtaataacactcatgcaaaacaagcagagactcgtgcaaaaaatgctaacatggggagctagatttgaattttggctccccagtttattaacatatgaatttagatggattaatctctatggcccagcttcctcacattaattataatgcaacagtaatgataaaagtaataacttatttcatagaagtattgtggggaggtaaatgagtgctgtgactgaaataggataagcactcaatagatatgattaatatagtgattattgtgaggctgatggaactatggtgttttgtctttgtttcccaaaccctcaatgatgtgtaacattacatacatcgtcatctcttcatctctcttcccagtcttctgtaaggaatatctggagctggatcattccagccatgatagtctcactctcccttcctaagaattcccatagtgcttcctatttgaaatgattgctcagcaatgtttttatgttgtctggggttcatcactaccctttgtacatacatgctcctccagtcccccgaccatggctctcaggaaaggggcagcttgagtccctctcatgagcccttcagcgcacaaccaaatgtatctcaataggttaatttaatttttaaaacatgttgatttggcattcatataggtcgaagcatgtagagtatccagacttcaataaatgttagttcttctcctgtttttttttttttaacttttattttaggttcaggggtacatgtgcaggtttgttatacaggtaaactcgtgtcatgattgtttgaggtacaaattatttcagtttgtttcttaatcatattttatttccatagtcacaaaaaaacaagaaacttaaaaaaaacctttgggttggtaaaaaaaaaaaattgttgaacagctttgtgcttgtgggcaaggtgaatagtcctgatgtatccggttgtggacctggcagtgaacttactggctacacaggaagaggagctattgatcttggataaattgagtttgagatggtaacaaaacatttaattctaaatgccctgaaaacaggaactgaagagagaagaaaagagacagagtggaagaaaggcagataggaaaggggagatgaggaagggagggagagaaggagggagagagaaacagatggaccatggcttgggaggaaaacgtaatagagtcaccaatctactggtgatggagaaggcaagaaggggataaagctcttgaaaaccagaataaatctattattcattctgttccttttcagattactttcatctaaaaaataaaaaaaaatcccaaactgcacaaagtaagttagagtggttggctggcttgcatcctcaaaggaggaagccagaattgcccgtgtcccaagcagtgtcaactcagacaatccagaaaagagtctttgggtctacagcagtggtctccaaccttttcggtatcagggactggtttcgtggaacataacttttccacggaccaagggtgctgggggatggggggatggtttcaggatgattcaagctcattacatttattgtgcactttatttctattattattacattgtaatatattatgagataattatacaactcaccgtaatgtagaatcagtgggagccttgagcttgttttcctgcgactagaggatcccatctggtggtgataggagacagtgacagatcatcagtcattagattctcataaggagtgggcaacctagatccctcccacacgcagttcacaatcaggtttgtgcttctatgagaatctaatgctgtccctgatctgacaggaggtggagttcaggtggtaatgagagtgatgggagcagctgtaaatacagaggaagcttcacttgcttgcctgccacttaccccctgctgtgtggcccagttcctaacaggacatggaccgttactggtctgtggcccaggggttggggaccccagtctagagagtcaagctgaagcttagggaggtcatggaagctgttctcattaccagggtttgaagttttgttacccaggttgcattgtgactggcagatggactgtaacagtcacatgaggtattcacatcactactgggagacttgacctctgacttcagtgaagagggccagaataaaggcactaaaataaagagggggaatatttgaaaggttcgttagaatagtatgggccccttcatcagacagtactcatgatgttttttctttttttatcttgataagaaaattgtcaaagagcaaataaaatcatgatgtgtagttcacaatacaggcagctcatttatgtattgtaattgtttcatgatctatcacattttttatagtggaagttattttaaccttggaacagtaggatgttaagatattaacatgggacacattacatgggaagttgggtgtcctttgttgtgtgagggcatgtaccttttgatcccctccagatttatacttaaggggctaaatcatagtttttttccttaaaggttaaaaaaaaaagcagttaatggagcagggtcagtctcattagcccttacctagtacttgttctccttgcccaagagtttaatcactaacaaatatgttgagaaactaacatatatgaaataagagcctcctgaccttgtttttattaccttaaccttttctgaaaaggagtttgcactttgcataggaaacagaaaggctatcttgctgtaagaggccaaattgcagaagtgggctttggctaaggaatgtggacacactgcagacatcttgcacagaggccaagtcttgcaatgatgtggtcagacgtggtagaggccagctgtttgctccgttgagagaggcttttgccagtccacaggctctctgagggctatgtttaactgaatccaagtatcaaacctgctgagactcactcatcccccagggtgtttggagttgggttcttacagagcacaatattgaaagtaactggtaagagaagttacagataaagacttagctattttaaaaaaatgtaacatacagtggtgaagtggaatataaatgtattttccctctttcccctataaactattggaatacaggtaaaaacagtttatgctggctgggcacggtggctcacacctttaatcccagcactttgggaggcagaggcgggcggatcacgaggtcaggagttcgagaccagcctggccaatatggtgaaaccccgtctctactaaaaatacaaaaattagctgggtgtagtggtgtgtgcctgtagccccagctactcaggaggctgaggcagaaaaatctatcgaacccgggaggcggaggttgaggtgagccgagatcgcactgttgcactccagcctgggcgacagagcgagactccatctcaaaaaaaacaaaaaagcaaaaaaaaacccccaaaacagtttatgctgtgctttatccttggtctattgatggacattctgtgatttgtgttacttatgtcaccatgaatactactggatgaaatatcatcttgtcctctaagtacacttttgacttaacataaggttaggagagcgtactctagaatcaggaggcttcttgagttcaaatctccattagacacgtctaagctatgtgaccttggccaggttgtttgaccttcttaagccatagttttttttttagtgttaaacattataacaataaaaattacctcaaagagttgttattaggatgaaataaaataatatatctttagcacttagcaaaaagttatttcccctttgaattttaattttttaaaatttgttgaatgttattgctacttgcacagagctttaaatccgactttgtgtgtgtgtgttggagtgatgggggttgatggggatggctcatgaagtgaaaagagaaagaggtatggatgctatactttcattgacccgaaagagtaactttattaaagatttaccttccttgtacaagcattttgtattgaaaccttataactaaatcttttattatggaaataatccagcatgtctcatttagagtttacatattttggttctttccagcttcaataagacattcatttatttccagaattagagctgttttttttctgtgtataagtaaaacaaatgtcatgcagcttgtttgaacgagttctaatagtttgcagtttctcaagaccaaaagcagcagaggagaaatcttacatgtttcaaatactttgcgttgagccataccacatagcatttagaatgatttaagaatgaatggcaacacaattaaaacaatcattgtcatttgaaggtattggttgaaacagctgaaattaaataacatgttacttgttaatgataaagttttaaaactcatagaaagtcagaggatgcaaataaaataagtccaacccaaaattataaagaaccttaagaaatacagtgaaatgaaaatgtgatgcactaatgaaagggaatggtgaatgaataaaacaagaagtattctgtttcaaagataagacgttcatacttcgaaagtctagttattgctttaagtgaaagacgatggaaatagaagagcgtatattttaaaatgaacagttgtggatgaatattagataagaaagcaagagaactctctctctgcttccccgggttctcatctcttaaggtaactaggttgaaacatttctgttttttgttcttctcatgtaacaccatctaccatgtttgtacctctgtatctagatttaaacagtacccactggtttcttgctttgaaagatggggacttagctcactaaagtatctgtaccctctttctctcttcttcttcacaactttaaaatatagttttagtataacttttatgtattggttattttaaaacacagtgtaatatatataagactctgtttctaggatcagctgctttattgactgccacacctttcctcccaaattgtttcccgagttatgtcatctgtcccattacttttactcttgtgaaggtttacaacatttacattttcttttgtaactatagtaaattgtaaaatcttccatgttttggctgtagattgattctaaacattaaaaaaagaatgtttatattaccatgctttttcaaattccttggaaaatctttagaatattttgctttgtaggactgaaattgttattctggatcctttgtttctgagcttcttcatcttgtgtatgtgttatgacatacatatttttgtcagacactatgactgtgacatattatgtcagacaatgtatgattgtagtaaaaaaaaaaaataaaaccttgttatgtcaaccacagggcaccctgcaaaggctcaggagtgctctgacactattccaggatttggtagggattggactatctccagcggagctgttctaatgggctgttgctggagaaggtttgaggtggttgactttggcctggattgtcatttcaaattgagagaacttttataataaaagtttggaaggtttgtgcgttcccctctaccccagctgtctaccctcacttcctctctcattttcctttccgagaatttgaatttccccaggaacttctggacactctgaagtttcaggcattactttgtcatggagggacaaagggttgagagcctttgacttaaaattctccataacatctttcttcctttattccttgtgtttccactggctgagtaacctgggtcagaagatgattccatcaggatgataatgctgcattgcattttcatcatctttttcatatatgaagctttcatgtccattatttgacatatatacacacaagggagacatttcattgtgccattgtacacagaaatatactgagctcacacaggctctaacatcatgcacatatttcacctctatccaatcatttcctctctatccttagagaaggcctgggctgctgggtatggagttagggccctttccttggctcctccagctttcttcctaaatccctttctgacctcagcatctgtcagtgtgaagcatgtgtggtgccctgcagggtgttccagattttctggagcaacaaaaggggtaaaggacatagcaaagaccttatgttggttcccaaacctgcatgatgttgaagtagtgagttcagaggaaatgtgggaggactctgtactgtttcacgtggtctacatatacaaagagaatgtgggagtgcaccctaactgaaaatacattttagctatacagttgtttttaaaggtttatgcttttgggtttacagtgtttataccagtaagctttggaattgctcctagtttgtgaaattgattgcaaaacatttgaccttccttattagcccctgatcgctagcagctagcatcaatgcttaggccctcaggatacggcaaagtaaaactaatggttgcttctaggtctctgtgtattatagtctctgtcctagtttccagtgtagaagtcattggatccttacttagttgctccctgaaattgttaaatgtggatcatctggattctgaatggagtttctactccaagacatgtgatgaactgtctgtaaacaagaaacccagagtgacactgattttattttcttgtaactgctgttatcaagtgtgtttccaaactttttgtttttggagacagagtctcactctgtcgcccaggctggagtgcagtggtgcgatgtcagctcactgcagcctctgcctcccagattcaagcgattctcgtgcctcagccccccaagtagctgggactacaggtgcgtgccaccatgccaagctaatttttgtatttttggtagagatggggtttcaccatgttggccaggctggtcttgaattcattacctcaagtgacctgcccacctcggcttcccaaagtgctgggattacaggcgtgagccaccgcgcctggcctgtttccaaacttttgctaaagaaatatttacatgttttggcctttatttttttctgactcatgtcagagtttgcgttcctgtaattttagtgaaagggagaatatgtaaaattatagaggtgagatgggccgtaggaaaatatatatatatatatggcttcaaagtgtagaaatgtgaagtcttatgtgcattagattttattacaaactttcttaaccatattggtaagaaatttattgtttaagtttattgtctaatttaagacttgtatggcttcatgaattgtgacagaatgtgctacattttgtatctctggtttttatttccctgatgggccatatgcataggtgatattaagggatgtccctgttgatatcactatgttagtgtcccaagctaccaacccagcattgagtctcatgagtttgctttatctgtctgccaggattcatcttgcttttataactcaggaattttttttccttttatttggccatctcttcctcttcttcttttttttaaagtatggaattcttctgtttttgttttagacccaatgtctgtggatcacgttataatgcttactgttgccctggatggaaaaccttacctggcggaaatcagtgtattgtccgtaagtaaatagaaaacttgtcattctgcatgtccttcttttgttgtgttggttgcatggggagccttagaatgtggccttttgtaactgtactattaatctgttgatagtacagccttccagctttaagacttttctacctttccagtttgggaaatacatcaacttggtcaaaccctgtcaaagtttagtcacggggatactttgcttgaggttgtgtcatttacatatgttgtgcctggctacacagactatctaattactttgatgggagtttgaatgaaagggtattattgctgcttttcttattgtaatttctaactttgttggccactcacgggccttaccaaaccctgtacattgaatttgggtgattgagggaccaagagcagacctgactcttagacagaggggaaaggaaggagatagatcaccagacgaagatcagtggaaagactaagaaagatctcaaatgataacagaggttcctctattgatttctgctggcaaggcaaacttccagatttccccaatatcccacaaatgttgagtgacaaatcgcatgccagacaaggtgttctttaatggagacaccaaagtcaaatttagtcatgatgcctgcccttcatgagcttttacagttgttgtacctatgaaataatgtccagttttcagaaaactccagtagtataatggggaaatttagagctgaagggacattaagaatcacttagttcaccttctcacttggctgacagtggtcaatggagtattcaatagactatattggccaatatttgcttcatgacctgaaaaagtttaactgtttctcaattcttgattttgaccagaaagcatctcctttatttggcacattatggtctaagaccaaaattggatcactaaaagagaaatataatggtatttggatttttctcaatgaactttataatagaaccctttcttagccttctgtagagttctctgagaaatgatgtctccagatatttaaataaatgtttactggatctttgacagtttgtttcttagtcgtttccagtttccatcctaaactctttggatgtttgaatgcactttctatcaagtgtactcttttagccttgcatatcatgtttgcacttgcaagattgtgcaggagcttgaggaaaagatcatgcctgtcatgacgaaaagtagtgaccaagtgctagtctgccgataaatataaatcatatgccatttaaacttactgttgtgaccactagcagagcatttggtaccagcatgatattagtctctgggtggtatgcaaatgttagtatttctctaaaggatgaatggcttcctgactgtagaatcagtactctagcagtagattccagcattcttctctcagactgttgatggaattcagaacaggataaaaattaaacattaaacatttacaataggctggacgcggtggtttacgcctgtaatcccagcactttgagaggccgaggcaggcggatcacaaggtcaggagattgagactgtcctggctaacacagtgaaaccctgtctctactaaaaatacaaaaaattagctgggcatggtggcacatgcctgtagtcccagctactcgggaggctgaggcaggagaatggcatgaacctgggagacggagcttgcagtgagcagagattgcgccactgcactccagcctgggtgacagagcgagactccatctcaaaaaacaaagcaaaacaaaataaatttacaataaaattggctcccaagagtaataatgtaatttttatatcattaaatcttagagttaatataataatatatttcttgtgatcatataaatatgtttagatgcaggatttaatttgtttgtttggttttctcttcatagcctgtcctgggcttctgatggattgagtgctgtggactaagcaaagagaggttgagaaccaccgtgactggataaaggagttgtggattttaaagccagagtttatttagttcaatagacttgttttgaaaatgagtacacctgaggcttaaggtcatataagtcatgatagcaaagtttgtgagggacctgagaacccaggtttcctcatttgaggattggtcccctataacaaatcgtgttccaaatccatgtgctaacagacctctggtttattcacagccatttgccggcattcctgtggggatggattttgttcgaggccaaatatgtgcacttgcccatctggtcagatagctccttcctgtggctccagatccagtaagtctaacatgtcattatatataatattattttatgtggttataccccattttctcctaaatttgattttggctttcctctttcctgcaatacattttttcactagaacatctgccttctctgttctgcccaaaatacttggaaaggctttccttcatctggcctctcatttcccttctttactctttataggaaaattacctatggggcatagttactatgaatagtataaagcttatggccttttatgtaggtatcgccttattcatctttgtatctccagtgtaaacaccataaaaggtgctcaatgaaatggttgtttaatggacatttttggctcaagaaatctaggcatgcttccttgtggtactgaaatatgaatctgattaaaaacttatttaagactcaagacccctgctttacaagaagaaaatgtaagaagtcattatggaagtttctgggggtgatttataatgaagcataaacatatttttcctttcagaatgttgccactttctgtgatgccagatgaatatccacagttcattcttcagaaccttttcttgcttgttctgttgtttttcttttgggggtttgggcaagtgagtcataattggttgtttaaaaagctgaagttcttgtttgtataaacagcccctcaaaactttgaccgtccccatggcaaaaaacgtaggtcccttttccgtttctttttgtcctgtaagaaaatgcaccccccttattgtgtgtcctattttgacaaagttttaaagaaaaacattgtggaataagtgcattctcttttgtttactgcaagtagagacttcactgtgtcaaggctcattacctgttaagagtctgaacatttgagtgtgtctctcacaagccaattaacaggttagggcaaattgtcctgtgtagcactcctggtgccctcttgcctcccttggcttcatggatgaacacgggggactcttcctgagagctttgtatacttttctggccagagagcatgccaggtctgcatgcagggcaagctggaagtgctgggggttagtggacctggaagcagacttttaaccaacaacagatggagagtggttggataagtgcctcagcttccttgcctctcagtttggataaccatgaggttcactctgcactgtctcctgaagttccccagtgggaccgagccctcgctgttcacagtgataatagatttgataatgtactttattagcttccttctctttttgtctcactttcccactctcctatgagtgtttcctagaattactttcagaacaaactacttccatttaaattattgtctcagaatctgcttctggtggagcccacacagtaacagccaccttttactaaatacagccagttacaattgggatagaaattgccctatgggctgggactcttgcttattgcactgaatgtgtagcatagttttccttgatctcagcttggtgtcagacatgcatcttccgagtaatagcaggttcattctacgtagcaagagcccctgaactggaggaatagaacgaggcagagaagccagctggcagcacatctgggaacatgcgggacatctccgtctctataagggtgacttccaggctgccgctgaagcataagcatctcagggttggaaaagaagtgcagttataaagttgggaatagaccccatctctcagattggtccctgaaccaactaacaacattgcactcctctgggggaagaaatatagccagatggcaaaactgggtattaagttgggaaggtcttcaatgataatgtgaactgataatgacttctctatcgagtagaaatcatgagatgtggagacaggatgttaacaagaccagagggaaaagccatggtcctggtagaatccaagttaactgtggggtgtgacgagtatagtagtaaggtcctggggccagatttagtctagagactaaaatccaagactgtgggtggtgctttctgaggaagtctgagtcatatctatggtacctggacgttagacaaagtccccaagtagcttgtggatgagagtagtgtaaggaggaggttctggtttcatcaggatctttggggttacttgaaatctttaaaattgttggctttgattctctctgcactaatattgtctaaatggcttgcaaaattaaagatggcaaaatattttaaattaaggatagctggggatgatcagaattcatttctcatcttttggagtgatgttctagggaacagctgtgccattccacagaacatcctgatcactttgctaactttcctgctaatagaaggacaattctactcagtgaaatgtttgcattcactacatgtggttctactaaaaaggatcaatttagatcactgaacgaatttttcctctgaaaaattttatactttttatatgatagggatcaaggaggtctaggcaagtcgtgggacctcagagaggcttagttttcccacttgaatatgaacagaatggaagaagtgttgttctttcaggtggtttttgacttgagtgtcctgtgactctgagaatagaaaatgatctcttagtgacctgaatgagagattgcatttccagaaggttcaaagtaccagccagtgattctcttggacaacaggaagttgtggcttcccttggtgctggtggaactctcgacactcgtcattcagcaccagggcaaaaagaatgattggctagacagcgtcaaaacagtagtttttctagactttaattccagccctctttaggactgttctttgctatgtcagtctctgagggtacagatggattttgagcaatcctaattgtcataaagacctatcatggtttactgatgtatgaatttactcattgttctaatatgtgtatacacacattcaaatatatattagcttgtaacactgggattaataaactctataactttacatatatatttgtcagtttgggcttctataacaaaatactgtagactgggtcatttataaacaataaaaatgtatttttttacagttctagaggctgggaagtccaagatcaagaggccagcagattacatgtctggtgaaggccttctcctcctagatggtgctttctgtgtgtcctcacatggcagaagggacaaacaggtctcccaggccttttttttttataaggatactaatcctttcatgagggctctgcctgcataacttaatcacctccccaaaggccccactgctccatactctcccattagggactaagtttcaacatatgaattttgtggggacacaaacatttagacaataatatatatatatatatatatgtatatgtatgtgtatatatataattgtctaattatatatataattatatatgatacatgataaaagttgtttcctatagtttatattttgtaattttgtattttctattttgtaattcctacagtttatattttgtaattttgaaatcttctcattctgttttactctttacactttaagaatgctaaaaattaaacttcatattctgagataattgtagatttacaaacagttgccttagtctgttttctgctgctataacagtataccacagactggataacttataaacaacaaaagtttatttggctcgtggttctggaggctgggaagtccagagcatggcaccaatgtctatagagggccatcccatggtggaaggcatcacatggggagcaagtatgagagacagacagaaaatggggctgaactcccgagatgaccaacccactcctgagataatggcataaatccatttatgagggcaaagccctcatgaccttatcacgtcttaaaggttccacctcttaataccatcacaatgataattaaatttcaacatgagttttggaaggaacattccaaccatggcagttgtaagaaatcagaaatatcctgggtattctttatttagttttccccattgtgacatcttgcaagactatagtacaagagcagaaccaggatatcacaaaatcaatacagttaagatgcagaacatttccatcaccacaaagagcgctgatgttacccttttattgtcattttcttcccgacataattctctctttaattctgacaaccactaatctgttctacatttctataattttttcatttcacaaatgttatataaatggaatcacagaatatgtaaccttttggaagtggcttttttcactcatcagaattctctggagagtcatctaggttgttgcagtatgaacagcttgttatcttttattgctgagtagtagtacatgctatggatgtaccacaagtttgtttggccattcacctattgaagggcatctgagttgtcatcagtttttttttctttattatttgaactaagctgctatgaacatttgtgtacaagtttgtggtgtgaacacaaatcttatgttctctgggataaatacacagaaatgcaatttctaagttgtatgatagtttcatgtttagcattttaagaactgtcaaactgtttttggagtcgccgtatgtaccattttgcattctcaccagcagtgtatgaatgacccagtttctctgcatccttaccagcttttggtgttgtctttattttttattttagctattctgattgctgtgtagtcatctcttactgtggtttcaatttgcatttccctattggatagtgatgtcaaacatctttttatgtgcttattgccacctgtatatctttttcagtgaaaggtctctttatatcttttgtccagattcttatttttcattaaaataatttttttagacggggtcttactctgtcacccaggttggagtacagtggtgcgatctcagctcactgcaacctccgtctcccaggctcaagttatcctcccacctcagcctcttgagtagctgggactacaggggcacaccaccatgccccactaagttttttgtatttttggtagagacagggttttgccatgctgcccaggctggtcttgaactcctgagctcaagcaatctgcatgccttgggctcccaaagtgttgggattacaggcatgagccactgtgcctggcctcttttgcccagatgctaattgaattgtttgttatttcattgttgagttttgagaattctttgtatactctaaatactagctgtttatcagatatgttatttgcaggcattttatcacactctgtagcttgctttttaatatttttaatgggatctttcatagagcaaatgttttcaaatttgagtaagtctaacttatcagttttccctttactggatcatgctttcattgtcaagtctaggaatgctttgtctactcctagattctgaagattttctccaacttttttctgatggtttcatagttttatttttatttacttattctttgagacagggtcttgctctgccacccagatgggtaggcagatcttccccactttatcctttttttgttttagctattctagttcttttctgtaaaaactgtagattaatcttgtctatatttacaaaaccttttaggattttgataggaattgcatcaaacctgtatatcaatttggggccctttacacttttcaaaccccttatagtttgatcacattttctcatttaatttacttcaattcaatgagagtgtcagcaggaccagtcgcagacaaaacctctcggacaccggttttaggaaggggctttaatcagctgggagcaagagtttggggcatttgtactcccaatgcaaatctgagctctaagggtgtaagaaggccagcagaacaattctagaccagtgtgttagcaagtttgagggagtatggtgcaaccatcctgaaagtgtggggacattcagaggaagggaaggtggtgctttagccagtctggaagaagtcctccttgaaaaagcttttcagggaagtgtgggatttatatggactgggaggagaagcatgcatggaatctactcagacttgtccttagaaatggttgaactctttgctttctactccaccctttatggaagcacctttatcactactgtcatttaacttgtccttctctacagcttttccagcttggctagattttgtttgtttatttgtttgtttgagaattttagtgaagtttctcttccaagctgtgtgtctttaggcatccccagacatctgttcacttaagggaaatgccattgctgttatccctctaaatgaaaattgtttttatcctgcagtgactctgattgtccctgtggactcttgtctcaggtgtagagtccagaagttagtctagctgtttaatttgtctgtctgtgcttttcctagtacctaaattaaaatcacatgttcgtcatacaaatgcttatgtgcaaattgctcccagtgttcttcctgccagttgtgcctgccaagatgatggcaggtctttagaatcattccaaacctaatgcatcccaaagaaaatcattacctgaggtattgagatccaggtgccagccctgcctctctctcattcccatagcgtgctcacattgttcttttctgatgaatcatttaagaactaatctgtgctgggctgtaatctaaagaaaatttcttctgctctttctggccaatgctgccaaatgaaagacgttcagtaagtcactgttgaatgactgaaatgactgactgacatctgatatgaacacaaaattaatttgggatcttttatggatatggggagatggcaacattttctgttagctctgggttattgagccttacatgaaaccctttacggctgtctgctcgtcttcaagggcaggtcctcactgggaccctaggacactcagggttcactgcatatggctggatctgtgcactttgattcccctagtgttttcaatttctagtaaaatcttaacacagattgagtttaggaatatcttctgacttggggtacttagtgcatccagtaaagaatacagcatcattatgggtgtaggaggaacccctaggtttcagttggcttttttaagagacgtagaacttggtctcctaattatgatacatctagaattcttgttcaaatcagtataaatttagaatatgcatcaatggcaggactgaatccaaaataaaaccaatttcggtatatattctctgtaaactatttcctgcgtgtacagtgaaactacgtatctagttctttcacttccccacagaaatcctgagcgactgctcccacctttatcggaatgctttattccccactaaagatctaagactcacaacgaatacagtttcccatggttaacacggtggcaaagcaagtgattcagagcctattacctgtgctgagcctgcctcctcctggcttcccccaaggattcatgcatatggttccttgatgtcttcttgtttcacaagtctgaatgagtgcttttattttttaaagaaagaatattttatgctggaaaaggtttgcctgaaagacagggtaaaaaatatatatcagggagattttttattatattgcatttaattgtaaacttaccattcttgccagaaagaagaattcattctgattttcaacttgaacaaataatgtaaagtcactaaactactgttagcttttttatctcaaagtagttaaatggctttgttgctcatgtgggaatggaaattagctcttggcatgaactgctttaattgaaatcagtttgaaggctgagttcctatgctgcttgacagatgacatcatttcctgtgcttttcccaatcctcactgtttttctaagataggatgaagctaagtttaacttcaaatttaaagcaactatacaccttttcatgacctacttagaatattattcaaagttttcactaaatcattttttttctttgtatacgtatagacagatttttagttaaaaaagcatcttggctgagatgttttaacggaatcataagagcctaaaataactgcaatcagtttccggggttgcttgatttcattactccaacaaaggagttatttctgcattcatacatggggaaacaaagataaaaatatttttaatagcaacctacttagtagggctgtataagtgcctcggacacaatggacaacttctaagtctcagtttggtctttgggcatggcttttgatgtcatcatcaggcagcatgagttaagtaaataaaaattaatttagcacagttttatacagcacttacatataaagcaaggtgctactctaggcacttaagaggtattgcataattaatgctctcccactccccactctgaagaagtttttaaacaaatgagatggggcaaaataagtaaaaataggctggattatataatatatgcttcaaaagagaaatatgaagtaattggaaaggagagagggctcacatttggtttgggagatatcagaaaagattagcggaaggaagcaatatttgaaatgggttttggagatagataggatttcaggtttgggggagaactgtgtgtgtgttgtgttggggtttaggagttaggggcaaggagacaaagaggcaggtaagagagagggttctacagagggactaggacaaggaaagtgccgggtgttttgcatggcacatagtaggcactcagaaatgttcattgagtgaatgaatgactgataagtagatcaggggatggagtcataggacatagtgggcatgtgccaaggagcctcgaaagatacctggggccatgctgaggggaccgtgaatgtggagagatggaggtggctctagttcagtagaaacaggcctttgatggtgtttcagtgtgtggcatgttgttgaaaaggcatttaactttcaactcaacctaacttctttgtgctgtaaaaggaagggtatagaagatagtgggttctgcactttccttccctgttggcaggctgagatttgtgtagctccttataaaaattgtccctttctcctgaagtcaagtagccacttttcaataccgtggctgaggattcctaacaaggggtaatggacagggtggctgttgggaggaatcttctatttgctctgaagagaagatttggcccctgtgcttcaggaagagtgagcataaacagcagatttctgcttttgtgtagaaagaagatattctcttctccttagctaaaattatcgaaccttcttctctgagaatttacttccacaacttggaggaccagacagaataagccaaacctccaaagcccaatcctggcctccatgtgtaggcaggtatcaacaaggattagtggttaattcaatcaagctttggactaggaaatagcctaggattttgaaagtgctattagcattcctaaattactgacctagagatagcctgaacactggagaaatgagagcacttgcctgcgctgttgtcattgctcactatgagcccgtggctgtcttttactccagcttctctgagtgtctcattgtctggggtctaaggctgtcagcccatggtctttctaccctgggccccgaaatgaacacttctgtaggtgaaaatgaggatcttatttagtttgaggttacagtttaaacaagcagctctttctcaggcaaatccagctgtccctgtcgtcaggcagtgttgttattaaatgtctttgtaggtattttcttttttctctattctgcctctaaaatttcttttaacaaaattctttggaatttgctactcttaactgttcccctgtgccatctacctgggattctaaatcttttcacgggaaaattattgccatcataatcttgtctcatatggttactcaaggcaatactttcttgttggtataaattacagaaatgacattgagttgtaatttctgttaaattaaagaagtcatttagcactattaaagtgaatgccagagaaacaattgcattgcatggtaaatgatttttttttctttctttcgctcgctctgtcactcaggctggagtacagtggtgcgatctccgctcactacaacctctgcccccccaggttcaagcgattctcttgcctcagcctccggagtggctgggattacaggcatgcgccattacgcctggctaatttttgtatttttagtagggacggggttccaccatgttggccaggctggtctcaaactcctgacctcaggtgatccgcctaccttggcctcccaaagtgttgggattacaggcatgagccactgcgcctagccggtaaatgattttacacacacaaataatatgtttagcattctcaattaggtcattatcaggtaaaaatagatgaatcctgataagctatttgattttctcttcaaataactacaaatcaactcctgtgagctgttgcaatctatgcatttaagttgcaaaagtgaattcttcttcttttttttcaagtacaacactgcaatattcgctgtatgaatggaggtagctgcagtgacgatcactgtctatgccagaaaggatacatagggactcactgtggacaacgtaagtacactgtagttataagtattctagatgttaacctgtttgtagacaagtagaataaagagataagtgctgatggattttcttcgattacctgggacacagcatgtttacaagtgtccagtgacctttacagatgaacaaatcacttactcaaaaaacttaacaccaaatttccaattggaaccttgattggttacaggttgtttgattcattttcctctcatttaccttcaccaccttgcttgcctgatctccttgatttctagtcaccaccaaaggagcagaattcttgttcattccagacacataccttccacccacttgctgaacttcaacacttggattttcaggaagcatctcaaataaagtatttcaaaactcagcctcatcattctctctaaacatgtcctttatcttgattggtggtatctgcatccctctcatttcctaatctagattctgctaccgaagtacttatcacatggtgttcagtttgaaggttcatttgcacacaccatttattgtatctactttctaccagtccctgtgctttgcagaagacgaacattctttttaaaaaccttgttttttttttttgttactttaagatgagcatatataccctacagaaaatttggaaaagtttaaaaatacaaaaagtaaaattattcgtgatttcatcattccagatagtatcttctagacttgtaatgcatatttggtacatgagttcttactgtatatatagtttttgtaccactttttcacttaatactttattcaaagtatgctcattacacattttaaaatacattttaatggttgcctagtactctattacctggatgtttgactgtttatttaatgaatcctcaatggtgggcgttattcagggcgtttctaatttttgcttttgtgtatatatttattaggattaataatgttattataaataaacaaaaatgtagagaatgccctagtgaccatctgtgttagtctgttttcatgctgctgataaagacatacccaagactggccaatttataaaagaaagaggtttattggacttacagttccacatggctggggaggcttcataatcatggtggaaggcagggagcaacaagtcacgtcttacatggatggcagcaggcagaaagagcttgtgcaggaaaactcccccttatgataaccatcagatcttgtgagacttactgttatgggaacagcatgggaaagagacctgcccccatgattcaattacttcccacctcccacaacatatgagaattcaagatgagatttgggtggtgacacagccaaactgtatcaccatccacacactgcagtgggagaagaatattggttgagttttgtgtagcccagcctggagagaggagaggcagcctccgcagtgtgggtgatccttgggctgagtcttgagggatgggtaggagcttacctgtcaggtgatggggaatggacctttttgggcagatggtagagcatgaccaaagcaccagcacaagacacagcaagggatgtgggacatagcaagtgctttggtgttgctagagcttaaatgcagaggagagtgaggggaaaggaagtaaggtcagataggatgtcatgggccaggttttgatgcctttatacatactatgttttcttccaaagtagggctaggaaagaagagtgagaccacaacaataaacaacactaacaacatcaataacctacatcttttcagttactctgtgcttactgtgtgctaggcacattttagaactctatgtgtgttaactcatttaatatgacaacaactctttgtattagaggacataaatgttaccctctggcagatgagggaactggaacacagggacctcagtagttcctctaagggtatatagatggtaatcggcagagttggggttggaacccaagcagtctgactccatagcccatgtgtttactcttgtgaaataccaaccttattacccttcacttacgaaggtttacagtgagaaagatcacagtgtggaagcgcaactggaggaggacaaaacaggagcaggaagacaagtcctaactaaggctatggctgtggagatggcgagatggggctggatcccaaggcattccaggagaatcaggaggggctgctgggcatctcttctgctccccttggtgctccctgagggagtttagcccaatgcccaacacacaagtgcttaattaacactggcagaattagaaaacttttcctaaacttcagcttcctcatctgtaatctgggagggttggcttaggcaagctcaaaatttcttttctgtttagaagctcttcattctccctgactataaatcaagaggcaaagaagacaattaatttacataaacctctctggttatatgatgagtaatggcctcctgccataatttttggttaaaaagggttgtgtcagttcaggtcctcttatgccaagaaaatatcaagacagaattagacataaaagagaatttattggggaaaagacccgtgaagaataaaggaaagaggaagcagaagtaggagggaatggtcttcagaccatgatgcctgtctgatcctgtgcaaggagggagggaaggaaggacaattgcatagaaggaacttcagcctgtagtgcagctccaaaaagccatagccaggttgatggagaacccagggcaaaaagtgcccatcaaagagttccatgatgggtggaaatagccaggctttagtatcctaatgctgtgtttagtcattggctgtgagcctgcccttgacatgaacattgcagcagatctgaaggtacagcagctggaagtggtctgccagctaaacttgcaggagattctcttgagggaaagtatgagtggctcaacttcatggctgctatagggtaatgtatggaaaaatgtatagaaaatatataaggagcaaggaatttgaatggaggttttgggggagcctcatggagcagtaagatttcagctgggctttgaagagtgggtggaactgacatatttggcagagaagagcctgccacgcatgacgaagatgcctagaaagagcccatgcatgcacgagttacaggaacttgtacaaagaggagttgttcagcacatgaactttcaattcttattttaatgtcatttctaacaagcaaaatatcctgccctgaagcatctctagatttactgcaccaatagtttccgtaagttctgttataactctcaattggattttcattatggtacttaaattactgaagatcattagtagtattttgttgtttgcagttaattgtgcaattgaacttgctacatttctgtaatggtgacatcagaggggctgatatttcccctcatgggagccctgttgcaattaaacgtaaatcataagcaaaagagtctttgctaacacacagttcccattcagtgacatctcttagaaaccactgttttcgaggttaaactgaaagcattgctcagatgcttcacggaatgagaccatcagcattaacatagatacaaactcatctattccaggcagctttacctaagagtggactgaggaatatctgagtatgtgtaactgtagagtgaccgtccaaaacaaacaccagggtgactttagacattttattgttgtccttccagaggaccacaagtgttacttcattagcatttattttcaggtaaagcgtctcagctctctccttattttacagctgtttgtgaaagtggctgtctcaatggaggaaggtgtgtggccccaaatcgatgtgcatgcacttacggatttactggaccccagtgtgaaagaggtaatggtttttaaaatcatttacgtaaagacatgctggtacctaaagctgttactaatttgcacagacattgggtctgcatggctacttcctgaatgttgctgagctttgaggggatttctcatttgtcattgggaaggtccctaggatgacaagacagcggccctgaatctatgcatgatattcggcaatgtttgtcagtccaagtttacctaaattcagttatttgctaatttggtggtactcagttatgagtgtatacataattaccagttggcatcaggataaaaaggggagaactttcttctgtaagggtaaggattaagctctttattatgccagtgaattaagtggtcttgaacaaaacatatgtatggaaagggagaatttcagtatgaaaagcacacctaaagatctgttggacctgttgggggctgtagaggtgtacaagctcagcattcaacactcaccatagatatattgagtgtctgctgagaagctactttgtgtagatggtttattcagtactcatcgcagcctgctagagtgtgtagaattatccttaattttgcatatgagaagatgaaggcacaaagaggtccagggatgtccccaaggccacatacataagaaacctttaatttgaatgtgtgttttgtctcttcaagtctaatgtttactgctgctcttaattaaaagaaacattctacctgatttgcctacctaaaaatacaagtatgatattgagatatgtgtggatatgcaatattcttaagtttttttccctgaactttggtcttactaataatcttgtctctacatttatagatttttttctcatcatccctagttttataatgaaagtttagaagttttatgttacacaaaactgtaattgaaaatttgcatgaacttttaaactgcagtaatcacttttagccaaagttgtatagacatcttattctaagatggaaagtaaagattcagtagcagatgttgaatatgtcatttaaaacatgtaatagaggaaaacaaagagcagagagtggtttgtgagaaattattttctgtctgtgtttataatttatctaaattcagttatttgctaataatgcagtaatacctatttgagcaagaaattccaggtcgattactttgattactaggtaaattacattgtatctctattaatgggaccactgcatggtattgatgtgtaatgcataatagacctttacattgcatgttgatatcctttaggagtccctccttaaactgcttctctttacaacttgcacagatgtgtttttattcgctaataattataatggtccagagtactaaaaactatttcttctaggcaatatcattctgtggccttattacttaatcagggaagttgtaggagattaaaattgttaatgtgtagcttgaggagtggtgtgtgaaaataatttctcagatgataatgctgggcataatttgttttagaaaaatcactaataagatgaagttacagggcattttacctgtaacattttacctgtaaccattttaacaaagtggttaaagatttgctgcaaagactattgatgctcatagttgatattgatgataacacagtctaaaataaagggcatgatattgaaccattccacagtgatttcttcaaagatttgatctttgtccaagattaagaaatgtcctgaatgggttaaattactaagctactaatcaaaactggcatgttactcagaggtttctccaagtttgggggtgtcttcaactgctccccttcaggaaaaagggctatcctgaaatctgcactaaggtgtaaatatctgttgactccatagaattttcccagtggtgattttcaaaatcaaattcatccccaagtggcagattttcaggcatttgtggtagtggagactggagagcagaaggcaggcttgcccgttagtagcagaagggtagtgccatctacccactgcctgttttacccacgggtacagtcccagaccttcaatgggagaagaaaaacatgggtgtcatttcccacaccacatgggagagaggagtctttttgattccagaattctatttccatttgtagagtcttcactgtttgctgctcttatgaaagtcacctgcttacctctttgaagaattagaggcagtagattctcttacttagatgtatgttcgtgatttcaagagtgatgaataaaaatctgataccgagtcaggacagatccatcctgaagtgtggggaagtattcagggtgacttccgatggtgggttggtatacttattgtggtgcttattactggataagtacctaggttggttgtattctgttttaactgggatgtgatgtttattttttaaagtgcagatccgggaggcctttactactttcctttctcccttcatctacattttcccttagtactctctccacatctctttttatagcatttactgcattgcatcaaaacagcaagtttccaatctccctcactagagcataagttttcaggagcaactatagtttcttcatcttcttaattctagccttactgtgtgatgcacagtacacgacccatagatgatgaactggattcatttaatagcatcaaaaaatctggagatataatgatcggatatgaacaagtatctcctggaaataattgctgtttgccaacagtcctggatattgatttcattggtttcatgctaaacagagctgattacaatgttgatatctaattgaatttggtcccatctttcagaagaatgatctttcaggtccacaagactgtcatttttcagttaacagggatgcaaaaaggaggaatgttttgatcaaaactaagtggcaataaaaacaaaagcaaaaacctcttatcatgatataatacacatgtaagggaacatttagaatgtcagttacaagtacttctcaggataaagatctatgtccctgggagaccttggaacttttatacattaataactacctcagagacccactatgagtgtgaaatacgcctttgggggtcatactggcaggatttgtatcacattaagccaataagtcaatcttaatcatccatgaacatagtattttggttttgtgatggagagaagcagcagatctcatgcttgaattatgaatcataatagtcatataacagtgtaataagattataaagcaattagtcttacttgcagctttttgtcattaagataagtttgtttaaaaacattcttggctggccagcctcatccccagtgggcaggtagcaatgatatattttaccattgccactaccattgtttctctacacccagaggataaaaaatagagacctgtggcttatttggcctgtgatgtctactttttaaaagctgaataggaatacctttaaatacatcttctagtttgtcatagtccccaccactacctattgtcacatcttgctcaagttcattcatttagcttaggtattagcccttgtgagcattcaagtttgccacctcctgctgctttctctgtcaaagattgtgtctttattttttttaaccacaagtttctttaatttttcttcctgtcacttttttttggtaagttcacatttgtggttttcttgttgcctcctactccgaccctttgccttctctttgcttgggccttgagcaactagtagaacttaatcacttcttagctcagtggtacagtatgttagcatttgttatcagattattgaagtgaggtcagtgcctgttttggcaatgacaatacaagctagtcgtatattgccatagttactgctaacaaaaaaactgtgtggaatccctttctcttgccatcttgcctcagaatgcacatttaaaatcttgttaaatgcctttgtattaaacacagtgaatcatatgagtggatgagacttttcagggtcatgtcaaaagagaaaagaatgatggagatagacctgaacttggagatgggggtggggtgtgatgatgaataggcttagggaagaagagaaacaaagagatacagcaagagaaccaggagagcattgaaccaaacaaacaaaaaggagttcaagaaataacttggcaattgttagactcatcgaaggtctgagaatgagaatcataaagcggccattggacgtaagaacagctgacatgtactgagtacttgcagtgtgccagggggtgtgctaagcacttcactttgatgatttgcaacaaccttatgagaaaagtcctgtaataagtcccatcttatggaggaataagcagaggcaaagagagatcaagtgccttgtccaagaagggacagcttataagtggtaaaatagaggcctgaacctagacattctggctcctaagcctgtgcacatagccactgtgtagtacttggacttcactggaaaggggccactcgtaactctaaagacctcactggaaaggggccactcataactctaaagacctcactggaaaggggccactcgtaactctgaagacctcactggaaaggggccactcataactctaaagacttttctgaggaacggtaagaagaaacctagaactatgaatcttagaatggaagtcaagatgaaaaggcaaaagaaaggattcttgcatattcttggatgtttcaaatgtagggttttggaatattcctctatttgattgatttcaacgtacgaatctgctcttggaaagagagagattcctgtgtgtttacaggacatataaatgtgctccaaaggactgaactaacatgcctggaagtagacatatggaatgaatattgtcatttagtgcagttatcatggaaagttatatcattttcttgtaatattacaacagctcaaaatgtgtttggaactcttttttggaggtgcctttacagaatcagcaatacattcaaatcagtgtgtgatttttttttttcccttttgaggaggcatttgagttttcagaaacagcctacagtaatttactgttaattctagtgactacagtgggtaatcacacattttagctgtttgggatcaaaagcagacttagatttaaaaaatactaaaaataattttctcatgtggttcataaagcacatggaattggtttaatgttttaatgtcaaactttatgtgagccagaggatgaagccttttggaagcataaatgcaaatagcaagaagttttctctcatttctccatctgaagctgctcatcatgtatcctcagaatattagcatgcacgtggactcttctaaatcctggtgcatttgttctgtgttaaattcctacccaagtctaaactgtgaagacaatacttggatttctgccaacttaagaaagtctgttggctgttatgctggctatcagtagataaagtataggggaaagcattgttgaactgatagccttaaggaaaaggaacaattggggccaaagtggagtagaataaaaatgagaggattgaaataatccttagttcattagagaagcagaacagttgaaagtgaactagctcttcatgcaggtacttgcttcctaggaaattacagtcttaatgaagctgaaaaggtttttgtatttgttagcacaacaatgaaacagaatagaacaaacaacagctaggttgattgtaattccacctccttcttatatgtgcagttgacgtttgagaaacttgtcctcacaccttgtttctctgatgatgtaaaaatgattttgcacagatatctttctaatgattttattgaatgactttcaaaaatactacattaagcagttgataaacacatattatataaatccaaaaaggcagcatctatactgtgtctagtgaatggaaaggactaacatgtaattatccaaatatataataatcagatagtccattttggaaacacctgcttcgaaaaagaaagtaaaaactttaccttatctcaagacctgtttagagagcttcatggaatcaggagctgattttcctgtgctttttttctcctggtgtttttcaggaaggtattaataaaatacagattcattattattttttctctatgtagaagtaagttttacagagctgcatttctgacacgaattttacataattttaaattgtaggtggctatcactaaagttcccaaggtaatgccacaggctaactcccattctccatgtgcctttggaaggcagagctctgtgaactatgtatattttcttctttccaaaagcaaaaggcagtaaactgtcattactaaactacactgaaggcctctatgaacctctcttttggtatttagtttcaatggaaagtaacaatgtggcagggcgtggtggctcacgcctgtaatcccagcactttgggaggccggggcaggcgaatcacgaggtcaggagatcgagaccatcctggctctactgtgaaaccctgtctctactacaaatagaaaaacaaaattagccgggcgtggtggtgggcacctatagtcccagttactcgggaggctgaagcgggagaatggcgtgaacccaggaggtggagcttgcagtgagccgagatcacgccactgcactccagcctgggcgacagagcgagacgccatctcaaaaaaaaaaaaaaaaaaaaaagaaagtaacaatgtgtagatagcaggggcacaatgccctaaatgttactgtgcgtctacagtggtattgcaacatttgtggcagctggtggatcactgaataaactagattttcctagaatagttccaggaattgcatcttttgacacacacactcgtttttttgtggctgggtaactgtatacactgagggcacacatgctcctctgtctcgcaggctgcacatatgtggtatgaacaagcagtggggatgggatgcaaccagaaagaagcttgatttttgtctcccactcactgtccctctcggcccactttgtaggctacttcttctcctgctggtagatgaaatcatctggtctgttttggactttctcccctatagttcctttaatgggggcagaggcatctgtgttctgactgttgctgacattttcttcctcagtcgctgggcatccagtggtacttccagcctcttgagttctctttgctgctccaaggagccatctgggaaaggagctaggctcagtccacatcagctttctttttggcggcccctagcttgttggcagaaaacattcatgcattttttctgccacgataaattgctggagtgcaaactattgacacgttagcaaatgctcattggaaccattgtccaagcatctggccagacagtttccaggcatttgacagtccctagtccacagtgtcctccagacttctggggataggtatcatgcaatctgaggagtctccctgaagcctctctcatgacttggcatcataatgtggcccttcaccagtttcccaggaagggctagtaacagcccagctctctccagagtaacccgcttcccatcacttgctactttggacatttgaatactcttgatatgcataaaggtttaagaggtcatcatcacccactttgcaaattatgcatcaaaatatcacacttgacttagaatgtggcatctgttcccttggtggttcaattgaaattttgattctaacattctcttgtgttatcaaagctaatcatttagtacaactgttaaatttagtgtcatggtttcatcttcaaaaacagtttttttaacttcatttttttttagctcttatgaacttattaaaaagataaaactaatttttatatgtcgttagccccacatttaatatttgaaccacttttcgatcttagatgttcaaacagtagaacagtactgaacaatagaaatataatgtgagccacatatataattttaacttttcttgtagccacatgaaaaagtaaaaggaaacaggtgaaattaattttaataatatattttatttaacccaatatatctgaaagttttatgtcaatagatactcagtattaaaaattatctatgagatatattgtattctcttttccattctaagtcgttgaaatccaatgcatatattataccacatctcagtttggaccagctaatatccacatgtggctatcatcttggacagcacaactctagaacttccagtaatacatatccaaactttacccaaagtatctactagatttccagttttctttcttttccttccttctgctgcttctccagctcttcagaaagcagcatcttagaaaatcaaagagaggctgcattgatatttgaaaagtaaaccattaaaaaaaagaactggggcctcagagctgagcctaatttctcaggttctctgtcttagtagaagtttgatcaaatataagtgataaagctcaatctcatgttatatcatgtcaattagatataacaactacagcatatatttaataaagccttggcactaagctaggcatgatgatagaatcatgagaggagtgtatggctcttgtcatgagggccttaaaataatttttggaaagacagacatgcatactatattggaaacagttaagtaaccaagcagggccaggatttagctaggcagaggagataaaggaaagtactacaggtaaagggaagagttagtacagatttagaggcttgtattgacctggggaaaagggaggaccctgctgtgtcagctttcatggtactggagcccttctgtgggagaagaggcaaaggcacaacgtcaactcacataactccaaagaagggagggcctattgcaagcttctccacgatgcccttccattctattgaactgtgcttctgtacaatttctgtctgaagcaggatattgggattaaaaaatgcccctttgtatgtataaattagtgggaagactggtctatttctgaaactgttttcactttcttatagacggcattcaggaaatccttaccaattttatatgcccaactgagagtacttcagaacacttaatgtttatgttcccagtagttatggtctctagagagtctatgctgtttttggtttatgaacatatgttggacaaatacatggggcttcatggtcccgacgatgtgccaaagtactttttgtagaacatcagtcccatgaggggttccatgaaattaagttgccatggatataatatcatttttggaaactccatcccatgtcttcttggggaggcatcgggtttgttagctcttgggagtcctgcaggaaggaaactgtttttacttagtttaactcacatctccaagcccatgaattttagaatttcttctttccaatttgttttcccttaacacctttaatgtcttcatcttggagatctggattcttattattttgacagtcattttgaaagtcacttgacatctgcatgacaacattttcatattctagatagatgttttgaatccatgtatgatcctcattttaaagataaatatttgcctaaatgtctagaggtttttggaggaagatcttcattatttaatcattcaccttttgggttcctaagaggattcatttgaccataaatttaaacacagcatgagacactcatcctttggggtttggttctcaaatactttaaagaatcatataggagagctggactatcccattaaataccgataacttcctagtttttaatggcttgatgtggtcagtgtgcatgccatcctggttctggttcttatcagccactgggggtactacttctagaactaggagtatgagatattcttagagctagagctcccttttctatactggttagatccttttctttcaaggtcaagtttaagtctcattctctccccagtcacttcctgactgtaggaggccagcccccaaacccccaccccaaccagccccatcagtttctatgcaactttgctgacatggccacctctggcctcccggaccccacccacatttcagttgctcagtgaatctattaaatttttggtttttgccattcactttaaggattacatcagacattttagcatttttattcctccaatgaattcttgtttttcttgcattttattacattttaaactgattaactgacccagtgcttgtctctggggatatgtactcatgatttttaaatatttactaagaggtaaagaatgagcatattcaccttgtcaaaaaactttttttccatgtgcatttattgatttttgtgttgaaatacttctatcagcataaaaccatctagaattctgtttcatggcttcaggaagccttatcagcaaattgcaatatttaagtttccttaaaaatattttctttactaagtgaaacataaatcatctattaattttaaaatatgaaataattatataggtattatttcagtattttctttaaaaagtcaatttggtttatgagtcccatcatctgggaattacacaattggctaatctgcttttgggactactaaaatagaggtttatgtatagtctttcagtcagactatggtactccccataggtcaaagactagaaattagatctgatacttcttcctatttcactaccaagcttagagctgtgaagagagtaggtatctattaaatatttgttgatttacataatttaactgtgggctcttgaagtcgatgagagggagtgtttaaatgttaaatacatctgtttaatccaacattctaagaaaagacattctggacaacaatatttataaatctatgtgtatgttatatggaaatattagtgtagttatttataactgaaatattgtaggaagtgaacgcatgaaaaaaaatgttctccaactttcctgccatattccctcggtgataatcttttgtctctgaactgtttgagaagagctttataagtaaacaatagattgggatatttgttttctcaggaaataaagaatgttctaatggttgagtttataagatagatccatttctatctctgtccttagagagcccttatcttgttgcctgccctctcctaggaggcattgttgacctttaccattgtaggcactgaaccacgctgaaagagaagccttacaggatggaggcaacttttatccaaattgaaaatgtttttataaacatacattagctcttcatgaaccatttgtttcctgaagtcccaatggaaatgatcatattctgttagggattccaatgatatattctttaaactaagactcgtgaacgttaaaaggcaaaagcgaagccagaagtaaattttgactcattctttatataatcatttgaaaacttcacttgaaaactggagaaaattttggaactttcttgttctactatggagaagataaaagcagaagcatccacagtatcttaatgatataaaactggctttggaaagaagtatgtaatagaattcagattgtccttggaggaaaacaaccctaaatcaccatcgaaaattctttatttatttattttttcagacggcataatttggagtgggattgggctatttcttttcagaccttatttaggcctcatttctttctacagtgttctccacattgccaagcagaataagctatcacaaaactaaacaaaaggcagtgcctagaaggcatcccatcccttgacggagccaactgggagtgtacccaggactttcctgttctcatggctcctggggttgttattctttactttttatgaatgagacaaaatgatagtgaaattattttcagaactaaatcatatctcaaaggagtcttcattccaacttgtcagtatcacatgacaatcattttaatgttttcatttaaaatatctaattaggaggagttgtgtttttctaattgcctagccattcctagaaaactgatcacgaactcacgctctgaggataaatcttgctacttgctggattggtggccttgagcaagttactgcatgtctctcaggcacagtttcctaatctatacaatgagggtaattatagtatttatctagtaagattgtcaggaagattaagtgagatcatccacaaagtacttagcacaggatctggcacataatacatgtataagaaatgttaactattttaaattcacatgaaaatgagggtaatcttggttgacaagtatcatttcattaacagtatcatgaaatgttcacatatccctgaaattacacctaaacttaaaggcctcattttgaccattttttccacttagaagttttgttattttacttgaacagcgtattttttggatcccctattcagatgaaacccaacattcttgagctggatatagaaaggtcaacatcaagaaagaagcacatcaaccgtgtgcttttctttagtacacattcaactgttgcagttgtaatgaaggctaaaactacaatagtgcaaatagtaataaagaaagagaaaatgaaggggtaaggggaaaactatttccataaaatgtaatggtgactgtgtctgggaagcatttgttctcccaatagctaaccaaaaattcctgaaagatttgcttacttttactgacatacaggtacagaagggaaaatgaacttgtctattcagaaaaggccaataacgaaatataagaggtacttagctattttagaaatgcggcattctaaaatcaatgagaggtaatagacacttacccatcagtaaaataaactgaacatctctgtaaagtatacagtttccaggtggctgtaagaccttaagtctacaaatacggcctggtcaggttggatgggagtgggggatgcttttactcatggaaccatgtgccattcttcttttgttgcaaaggactaaaagtgttagtcccagaggactaaagttagaaaaatcaaaacatttggttattttaaacccacaaatttcaagctgcccttgttagtgttcagttttgttaagtctatccataaaaaggtgtgatgttatgctgaaaagaaattgttctaagacgaagagaggaggtgtgagtttatctatcatgcatgagtatttctcaggcactatgctaatgactggagatgtataataatgaatgaaacacacgcatcccgccttctggagtcacattcctgtggagagatggaagcagtgcttagaagggcatgtgtaggaaggctggccacacattgagaggtgtgcagtggtgctgtgactcccacgctgggaataggagctctgtacatttttctatagcacattagaagtttgatggctccggctgaccatgagactcttcccagaggagcctctggaataccaactttgttaagatgagagagctcttcttataggtttccaatgcccttcaaagtcagagggatcttgagtcttttgctgcttagattgcttttcctctaatccttgtgctcccacagggactctgatccctagctttcccccagaaacgttaatgaactggaactcaagtgtccaaaaaaatgcaagtacaccacaaaaatggtttgtttaggcgtcaaacattttgagataatgcatacttttgaatggatgcctgcagtcttgtccctggggaacgcctttggatgtcatgcaatcctggcttcagtaaatcatttgctgtttggacaagtcgtggccaccacgtcagtcactagatacatttgtaatggtttacgtgaacaataacaacaaccacctagcaacacactgtttggtcatgtcatttttttctaataccacatgtggttttgtgggctttagaagaataaattcttactgcatctaaaaggtcttgaaaattaaacagcaaatattgttggaggcctactgtgcacaataggtgaaatcacactgcatgttgtaagaatgaaacatgggtctttgctagtttattagtaattttatactccacacgggagagactatttctgttctgttcaacattttaggtctaatgcctgacacgcagtagcccagcaagtatttgttgactggaaaaatgaacaaatgagtagttttcaggcatagtttatttcttgaatttcctgtaattcaaaaaagaaatgactgatctaccatctgtactttttagccgatagttttttccctcgactttttaaaaccatgaacacaacagtgtcaggtagagccaagtgtattctgtgaagtgttaatacctcagagatgccacatttatgtcatcccttccatttatgcagcacttatgaacatataccaccttagtcagtccttggggcaacccttcatattttatagcaaagagtgagattgaaggggaacctctgtgactcggaattctaaggcaggtgtctaggaatgagacttatgtcttctcagtcagcccagactatggggcatctatattctccaacatgtatttgcttgcttttagagctcactgtggtcgctagcattaccttttgttattattaactatcttttaattttagctctatctttgttctttcctctcatttttcacacctttttgattttcagtcagactgctgacactttgctatttctgttctctgtgtctcttagacactatgtccatttttaaaatttcaaatttgagggaactaggcaatatttagaattaattttgtcaaggagagcttgtctttaattgtaagtggatattatgtggtgaaaacacttggcttagctgaaattgagctgtgcatagaatcagaagacaatctggtcctgaaggagtctgagaacacacaggcatggataatccggatgtgtgaatgaatgaactgctgctgtgtcacgctgcccgggacatccttctgttggaatttctgtgaaagtagaccaggcatattgcatattggagtgtgtattccaggaagagttgagaattggttttcttttatgacctctttgttttcttgctgcacgtatcaggagatttgcagtttctgtcatataaaaactactggaaatttagaattatctcctctgagagcatgagccccttgagaacagggagttttgactgtctaattacagtggctagaaaatgtctaacacagagtagatggtcaatacatatttgttgaattaaagaatggatctggcatatatacagctgatcactttttgcaataggacatgggttgatggtgtagtgcatgatttgttggtgcattgctgtgatgatgttctgagctcacccagcctcagttactcaatgacagcaagttcaagtcatgtcagagttggtgtttggctcttgtctgccccactatacaagtgcatgcagttttagtctctgttttggtgggtagtttcctacccctctggctcgctatacttgattatgaaattataattggctttcgtttatctctttaggatagaatagtaactgtagctaatctgtggctgaaaatagggagataagaatgaaaataattaaaatggatcactctgggtagcctgaagtgacatggattaatgtactatcagttttttccccctgagaaacatttggtcacaaggaagtttggctttcagaagaaattcagatttgggtgtgtggcttttggcatagtctagcatcactggaatggcctaaagtagatgtttctttttttcccatgccttcctgtgggtgctcagaacaacccggtcttttgactgtagggttatctgccattcgtagactgagcattatcttgccaagtcatatggagaagccagttaccgagtgcacttggagcagaagataatacttggctgaagcatcctagaaagcctaaaaagcttatgtcagagggatataacgtagagtttctaaggagaggtggagaaagagactgattgatcgattgcttgatctccaaagggcaggggctctaccacgtgtttcatagtgctaggaaatggcaaactttaaaaaggtgttcttcagttgccccaagaaatacaaatgtcacgcttgtctgactgtcagggatgaatggtcctagtgcatgcatgatgactgtatattcttctttgatagcgccatggtgtgggtaggtatgaggatctgttggcttagaagcaattggaaaaactggacaaggaaggaaaagaaaatgaaactaagaggctggattgagaaataccaagaagggtggaaatttcaagctttttttaacttcagtaactgtaagagagaaagaaagagaatgaaacagaaatgtctgactgtgtcccttcaatttcaaaacatattttgtagctctccactgactctggtttattcattatttatttaatagactcctttgttaacttcaggaagttaatactagtggcaattcttttagtcgtattgggttgctaaaaagctgtggaccctaccacataccacagtttagattaattgaatctaagtgtgcatgagtttgattaaatagggatttattattaagagcccttcttaggacatatgagcttggaagagcctgatttataacttagtagctttttcactttgtgaagggatgggacataaagtgttcttttccagagtgatgtggactgagataagatttatagattagtgaaagaagtccacgtctcagtcaaaagatttccagaaatgttctcctcattattcttcagagacctgagctattccagatgtccataggtttcagaaaggtagcttctggggagttgagactttctaaaagatgaaaatgtcaaccttcttccttccctgcttttttgagatggtagtagagctatatattcaactgtatgtagatgaaattgtaatataagaagaaaaataatggccattattaaaattcagcagtaggccaaacaggaattatataactgttttgcttcatagatagaattgttcctaaattcagctgatatggaatttttaagaatttattttttggggggtcaagaaatgttctgttgtaagcatgcaaggaaaaacttcttattctctgctctaattgctacatccagatatttgttatgacatacaagcaagattcagtgctcgtggtgaaatctctgtgcctcaaattgcatttgccctgcctgccctcctttcaaagctgtgcttaccactttggtataaggtcactgaaagtgtctgcgagctttaacaagttggagatgcatttctttttttttttttttccccttttttatttttatttttattattatactttaagttttagggtacatgtgcacattgtgcaggttagttacatacgtatacatgtgccatgctggtgtgctgcacccactaactcgtcatctagcattaggtatatctcccaatgctatccctcccccctccccccaccccacaacagtccccagagtgtgatgttccccttcctgtgtccatgtgatctcattgttcaattcccacctatgagtgagaatatgcggtgtttggttttttgttcttgcgatagtttactgagaatgatggtttccaatttcatccatgtccctacaaaggacatgaatgcatcattttttatggctgcatagtattccatggtgtatatgtgccacattttcttaattcagtctatcattgttggacatttgccattgtggaagtcaatgtggcgattcctcagggatctagaactagaagtaccatttgacccagccatcccattactgggtatatacccaaaagacttggagatgcatttctacagctgacatttttcacttaaaaataaattataggatgcgctttggagagcacacgcctaggagtggaacattaacaaaggatacgtcaaaccacagacacttctagtggatccagttcacagtattgccacacagcctgaaaaaataacattagtaccagcaaaactatcatccctaacattcagtcattatccctgtggacaggcttgggaacagccatgtggatgtagctgctttgtgcttcttcccatgcagatttgatttttctttccactttctcccttttaatgaatgaactaaaaatgaatttgaactacttgccaaccttagaaggtttgattttaaaatatattttcttctcaaatacacgaaccagtagcatcactttcaattccctactcccattctctgtccaaaaatacatatgccaatcttcaattttttttttgtagattgcatgtaaacgatggttggtttgtataaagataaatattactttagtaacaagcacatagtaacagcttaatttctttttgaattgttaggctgcacaaatcaatcatgtggtgccagctgaagactgcttttacaacaagacatatgttacaaatatattaatcttagcggcatatggcacctgagaccttgtaggaaggcgttgcaaaaaggacgatcatgccctattagctggctcacttcctaacttacattaattcgtgcattatggaacgtcaccaacacatgaaacaaaaagtagaaatggcactgctgagtaatcacaagccattgactaaagaaacttcagggaaggcggggcaatgagcattctttgaaccacttaattcaagaaataacaggctttgtttatttaagaggccagtctgtctgttttctgattgcattcttattgtgaaaatgccagagcatattacaatggataaaatgagaggaaaaaaagggcgatttaagtaggccaggaaagagtggtggtagatgtttgaatgcccccccttggaattaatcagtggtttataaacctgaaatactttttaattttgagaactgagtttctgactcaaattatacaagagaaaatgttacttggcttgagaaaggaaaaactttggttcatgtaaatatgtaccctcatgcctttatcatgggggaattgtaattagggattcagaatcttgagaacactattgtgacctagttatttctgtacagcaagtgctcacaggaggtactggctagacctgaaaataatgaattaagagattccagctgggatgtgatgaaagcatttttgggaatctctgtatcttggctggaccacatgggttataacttggagagacctaaacgagtagtagtatatgacagatttatagtccaattgatgttgggcatcagaaaaaaaggctgaggttaaaaaaaatgacctgagaattatgagttctaaaagaattgctattggaagggatgctaatgcaggaaagcatgaattccttatatgagggcaataaaaataataaaatttggtgctgaggcattgaatgggaaacacagtagcttatttttcacagagacccctcctccaagatcccttatctaccttctctgctgtacagttctccacaacacatcctccatctaacatatagtatattttctgtctgacctagttcttccatgacattattaaactccatgagggcagacattttgtttgccactgctcccaccatcccccacactttgttgtatccttagctacaagagtggtgtgtgacacttagtaggctcttgataaaaattgttgaatgaatgaatgaatgaacgagtgcatcaatggtgtcatttttaagccagaaattcattttagtccctctcttccctgcatctatctctccctccctcccaccttcccttcattcctccagcaggcactggatgtgctaaggcacaaagaccaataaaacaaggttcctgccctccagcttatggtctgttgggatcaacccatgggtaaatgaaggagtccagtacagagtgataatgctatattagacatgtgcacaaagggagatcagagtagagggggaaaaaaacatttaatcaggctgagaggtcaaggacaatttttttccagagaattaaggattggaaaattaaggatttgtagagcctaaaagaatatgtaagagttgatgaaaaatgaaatgacttgcaagaaaggatacgacctggaagaagaagacaacgttgtcagggaaacggcaggtagttcaccatgaagggagggagatgatgggagcagatggagtttggaggtaagttaaatggagagtcatttcaaaatcattggttttccaaggtgttttgttgtgttcattgagagtcaacaatactgagacttcataatacttcagacaagtaggtgagaccactccatgtgagttttggtcctcttgctcttctgtttcccagtttactatgtgccccttcccagcttgatatgtcaggctaagaagtaagtggactttctgtttctattcttttacttaggataatgctttccagttctaaccatgatgctgcaaaaaacatgattttattcttttttatggcagagtagtattccatggtgtgtgtgtgtgtgtgtgtgtgtgtgtgtgtgtgtgtgtgtatctcacattttctttatccagccctccattgatgaatccttatgttgattctatatctttgctttgggaatagtgctgtgataaaaatatgagtacaggcgtctttttaatataatgatttctcttcctttgggtagatattgttggattagttctttgagaaatgtccatactgttttccgcagaggttggacagagccaaatattacatgttttcacttataagtgtgagctaaacagtgggtacacttggacagagagagtggaatgatggacattggagactaccaaaggtgagaaggtaggaggagggtgaaagttgaaaaattacctattgggtacaatgctcacaattcagataatgggtacagtaaaagccagagtttgccattatgcaatatgtgcatgtaagaaacctgcgcttgtaccccctaaatacatacatacatacatacatacatacatacatacatacatacatatgtaaatacataaagaattgagcggagctctaaagctggtttaccatttccttgccagagcattatttggagtgtggagactttaacatttaatacgagttgcaagactctaaagtccatgctagagcaattgctctttcatcctcattttgttatctgtgattgtgggcaggggccatctctgaaagaatactcctgtctttcatggtatttacttgagtttatacttcgtgtcacacgtgaactatttcccgtctctaatctgcaaatgttcccttctggaacccgtttttatgtttaacctataggaatgcctaactgttgagtaaaatggtgcttttgtgttattttcatctaacataacctcagaattttagtagattttagtattaatatctttatatgtgatgcagtcatcatcaatatttgttcttttaaattaacattcaaaattaaatgaacaaaacaacagtgatattcataaaattggatgctattttgtgtcaggcttgagtttccaaatggaagcctcctgattgtcctgatctgatgtcacatggaagccactgcatactcttgatcttttctatgtttctaatcattttattaacatttcttggaatcttttctagcttattgcatttatattggctggttttatagtgataagaagattgagagctgtttaggatatagatgttatctgtacgtggtgcctgtacaaagtaggtgcttaatatgtttttttttttttgaatgggcaagtaagagttatatttttaaaacatgcattggatcattaaccacttcctactgcctttaggaaaaagtccagactcctttgccagagccaccaggccatttacaacctggaagcagcagaccttttcagccttatctcttgctgtcacaaacaacaatccacaatctacagtatatgtttgcagtgccatgcttcatccatgctgctccttccatttgacattcttactgatttgtcagatgagaaagcttccattagccattcacagaagaatcacttctctatttccaaaacattgtttgtacttccaggataatcacactggttcatttcactgtctatacttatctccccatctaggttgtacactcaagacagaggctctgtcttacttacatttgtatctttagggtctaatattgtaccactgaccattgcaaggactcaggaatgtgctctgaattaattaacaaggtaattaggccagtgccacagcctgagtatcacacagcttcatggtctctgctccacaccatgagaacaggacccgtgcggtcgggacaaggctaaagaggcctaaccctcagccagggctctgcaaggctgcaccaaggctgggtttaatctgggacccctcattcatccacagtcagtagaggagtgaccatcactggcttctaaaaatccatggcgtcctggcctgtctgcacagcctaccctcatcagagaagagttctttgatggtactgcccagggtctcttgatagcagaggttttcctgggggagcaggctcagtcaaagcctcagtctggttctgatggttcctttaattgtttgccaagaatctggttaaagggaacatgacagacttcaagggactgatgagaatccaagatctccttgctggccacaaatcattaattgagagctatgccttaggagggtaatatatattttctttcttatgaccatgattttacatgtgctgaagcttatttagtctttaactctccattcacttagccttgtaagacctgttttggaataatcttaattattattgttattttaaaatttagccattgtccttttttatttttataacactataagccatattgtttaatttacaatttattatattctgttgtgatatgagatcatagtgatggttagtacaacaatgtgatagctatcactttatgcaccattttaagattaatgggcatcatgatatgagttatagatatgaagttccaatgtataatttgagctgtgttgtgtattctgggccataatcatcacataactcagcatatgtatatataaatatatggaaaaacacaaacttgcaaaaacaatttgagacaatcccaaaagatagatctcaaagaaagatttctttcttagttgaaacgctttcttagcctcctgttttcggataatgctcaaactccttagtggaccagacaaagcctcccatgagctggtctttcccacctcgctggctcatccccagcaggtgcccttcatttatctgcagaaccatgcccacatcctcccattgttcccccttttcacacttaacagatgttcgcaactagtctacttgtctctgtttggagcccttcgcctcttgttttttaaaaaaatttaaatgcaaaacagtgcagtgactaataagacaaccatatttaaactgtctacctggtattaacaaatgtcaacatttcatgaattttaaatgaacgaaccagagcatctcagataaagcttatgtccctctttttctccctagttcctttgccattcctctctccagaggtgactgccatcatgaatttgtgctagagtttttaatcttgtcaatttactatgtgtatgatttcgtggccatttgtaactgtgtagattttacttgtacactttctctccaagatttttttaaaaatgccgttttagacaatccccagtactgatccttgggggctctttgcttcctattctttgaggggtctttgtttttttttttaacaaactaattaaattgttgcttatttcttaaaaatttttttactgtttctggtctggagcttcttcagtgattttgtgacagtcttggaaaatctaattttaattctcccctttattgaaaacttggttggccttttctttttctgacctcctcttgcccctacaaaggtagagatttaataatacatgatttctttttacagaaagcacattacttatttattagcttggtagtttcagcattgagaatccttcatttataatgttcagaatttttctcaaagaccttttaacatttcgatcctttacttaagaaatcctgatatcaaagtaatccatattcataatagataatgtgaaaagtattttttttaatttagaaaagtgcagagaaattggagaaaatactcataggtccctgagtgactgctattaatgtttaatatgctcatttaagaaagtttgggaagtagcgaagaaactacctaccatactaatataatcacagttaatatttgcctgactatatttccttctagtttctatttttctttacatagtaaatttctttgcaatcacaacataaattcagtttgtattatatgttttccacacatacacattttaaaatactatataaccctgtgttttcattttttaagcatttgggctctacccttagctttaatttttttctgttatttcgttatgtgtaacatctttgaacacagagtgttttttgtatttagaatggagtgaaattgttggaggatggctacaggcactttaaagcccttactacctattatgaatgtggtcacgtgtgcacctgcatgtctaagttttggtttcacctcattcttgccatcatagggattttttaaataataaaaaagaaagaaaaatccttgcttattcccaacaatagacatttactctttattgaaataggttcttaaatctttttttaatcttctttactttaaatatttttgcaggtatttaaatttgtattagtgtacatatatttttattttcattttacatgtggtccttttcctcgtgatttatctatggcttttaagattagaaagtctttgtgctttcaaagattcaataaatatttttattcatgttcttccagttttttgtggttcgatttttaaatatatttgatgctttaatctaatttggatttgttgtaggcctaagacagatctaccagggtgccattgttctgctatacctagtttaaaccagtgataaatgctatcagtggtggatggatgaattccaagattcatttcacattttgtacctgactctttgtaggagtgttatttaaatcaggctgatgggtgttgctaaaatgttggaccagccttggacttctcatacccatgctgacctgtggctcagtgggaatctagcatttgtccctgaacgtgcattgcccttggtttctgaatagcctccagctagtttatactagatctttggcctttctctggggcttgtgaactctgctttccagcaaacaatgtaccctcactattagtcaacagaccattttccttaggccctggaaggcctataacacaagctccttcatccacaggcagaatcccttccaatcacctttcctcttggatctgcccacccatcccctgcagcctggccagcagatgccagtttgcctgggctggtcagcacattcacaccagctctctctccttagctgactgaaaggctttcttttttagctccatgactgcagaataaataagagcaataacattgctcttttgttttaaataaatgagtatggggcaagtgattcaatcaataactgagcaagaattgacttttccagtttaaatgtagtgagcaccctatcacctagagtgttcaacagattcaggaaaacattttaagaaatgttagataggggagtcatgaatttcatgaggatgactgtctccataatcttctcaccctaaggttctgaagttacgtgagtatctcatttcacacctcccttttttttttttcaaagttttcccaacatttacagtagcagaggcacaaaacaaattttttgcatgtgtatttatgtatgtgtatacatccttttattgatctcttcatgaaaaggtaaggaatgtgatatagatttatgtaaagaatcttatttgctagaacgtgatgttaatgaggtcataaccgcaggtttgatccttagataagccaactgtgttaagtcctaggattagtttggaaaaaatggcttctaaaaaacaggaaaaatatgattggaaaacaggtttagtatctgccccaggtggttagatatataaagcttacttatccagtgagtgtaagaaaccaaaaccaaaacaaacagaaagagtattaagtccatacagttgagatagaagtagaatatctgaccacagacttgtaggttgtattagttgacaacgtgtgcatctttttaggtaaatataagaattggtttgtgaattgattttttttttcaaaaaagcatcatggaggtgtaatttacataccataaaattcacccatcttaagtgtataattcaattcaatttaattcaaattttagtaaatttagagttatgcaaccattaccacaatctagtttcagaacatttcggtcatcccccaaaagatttcttacacctgttggcaaaaaatccttgctctctcccagagccctgggcaaccactaatacactttctgtctctatagatatgccttttctggacctttcaaataaatagaatcttataacacatattattttatatttggcttttttcacttggcataatgttgtagcatgtagtttattcctttttattgtggagtaatattccattgtaaggatatatcatattttgttcatacattcaccagctgatggacattttgattgtttccagtatggggctattatgaataatattgctattaacattcacatacaagtctttgtctgaccatatgtatttcttctcttgggtggatatttaggtgtagaattgctggattatatgccaagtttatatttaactttttaagaaactgcctaattattttccaaggtagctgtaccattttacattcccattaaacaatgagtgagggttctagtttctccatattctcacaactattttactgtctttctttttcattataaccattctagtggatgtgaaatgatgtcctgtggttttcatttttattttcctaatgattagtggtgttgaacatcttttcatgtgcctattcatgtatcttctttggtaacatgtttactctaatgtcttgccggcttttaaaattgggttatcttcttattgagttgtaagagttccttgtagtttttaatgcaagttctttatcagatattggaaatattttcttccagcctgtgacttgtctttttaattttcgtaatggcgccttttgaagtataaacatttttaattttgatgatgtctaaattatcagtctttttcttttatgaattgtgcttctgatattttatctaagaactctttgcctacccaagatcttaaaatttttctcatgttttcttctagaagttgcatagttttagctcttatatttaagtctgtgatccattttgaattaatttttgtatatggtgtgaggtgagggtcaactgttttgcatgtacatatccatatccaatgttactagtactatttgttgaaaagaccatcttttctcattgaatttccttgacacttttgctgaaaatcagttagccgtaaccagaagggtttatttctggcctttctattctgtttcattgatctaatctctgttcttactctagtaccatagtctcttgattactgttgctttgtagtaagttttgaagtcctccaactttattcttcttcttctaaattgttttggctactctgggtcctttgcatttccatataaattttaccttcaacttgtcagtttccacaaaacattgcattgagattttgataaagattacctttaatctacaggtcaatttgtgaagaaatgttaacagtattgatttttccattctgtgaacatggaatgcctctccacttatttaaagatttttcgacttatcttggcaatgttttgttcagtgcacaaattatgcacttttgtcattagatttattactataaatcttattccttttgatgtaattgtgaattgaattgctttgtaatttaattttctgattgttcattgttagtatataaaactatgactgctctttgtatactgatgttgtattctgtgacttttctggactttttttttttttttttggtagattccttaggattttcttatacaggattatattgtcttggaataaagatagtctttctttctttctttctttctttctttctttcttctttctttctttctttctttctttctttctttctttctttctttctttcttatctgtatactttaatttcttttctttgcatcattgcactggttagaaccccaagaacaatgttcaatagaagtaacaagaactgatatccttatcttgctcctgatattagaaagaaagcatttgttatttcgccattatgtatcatgttagctgtaggtttttcgtaggtacccttcaacaggttgaggtagtttctttctgtttatgttttgttgagagttttatcatgaatagacattggatttcgtcaaatgcttggtctatatctattgagatgatcatgtggtttttgtctgttattctattaatatggtgtattacattaattgattttcagatgttaaactgaccttgcattcctaggacaaattccatttggtcatggtgaatacttctttttatatattgttggatttggtgtgatagttctgtgttgagggtttttctgtctctgttcattgggaatattggtctgtagttttcttttcatgtcttcgtctggctttggtatcagggtaatcctggctcacagaaaagttgagaagtgagccaatttattttttttaaactggtctcagttagggggaaggaaggatggtacacaacagtgtttctctatctatgatgaaatttcatttaaaaatcatttcttatcttgtgaattgatactttaaaaatataataaaactgaattactagaaaagtcatacaaaaatatacaaataaaagccccactgatgaattatattcagcctatattaaattactccatgaaattgataaaaacgttcctaaaggtttactcttaatttctgtgtttacctcatcacagactggacacaaaacagttctcacaaatctgtgaaccagcttttagtctggtgtaaagcactggtgtaaacccatgcttctcaaactttaatgttcatagaaatcacctggggatcctgttcaagagcagattccgatttggcaggttgggggcagggcctgagtctctgcatttccatcaaactcccgggtgatggtgatgcggctgctgctgggccacaggtcacactttgagtgccaaggctatgaaaaacaatgcagacagcaacgtaaatgtgatttttaaataaccctgtcataaattgctttgggacatattttggattttccaagattgttggattgttactcagctgtcaggattctctagatatcagttgtttttcttggcctgtgacctttctgggtctccagctgttcctctataaatccaaggggttgaactagaagatctctgaagtcctttccagatctcacagtctatgattttaagcatccatgtcaaaggagaattatggtttcatttgcattttctttttgtataaacctaataaaacatgaacccaaagttttatgctacaacagttcttaacataatgttaaaaagtaacagtaaacatgctttactaaattttggatgattcaggaagattagtgtcaacattcaaaggtttttccatgttgaagtcttgaagagaaagggtgggggtcttgtttaactttatagttggaaatccaattaaaaaaataactggcttgcttaaagtgtggagacacaagtaaaataggtgtttatattatgaaattcaagttgacacaaaatagctgaaaggcttcaatttcagccaagttgaaatgatgtcattgtcctttatatttcattttatttactgagatacttgaaactttttcccctgttgcttaaaagcaaatgaaaagggtggtaaatctgtggtggaaatgtgttgtcaaaacctccaggggctgtatcctcagccttcagcacatattagtgtgattctgctattcttactacagatgattacagcaaactctgcaatgaagggtggaggcatttggtcagcctccaaagaaagtgactaatatttgacctaatgtacagagtacatgaataacatattcttagggtaagaaaaaaattctggtttacagggtgtgtaagagttcatatttctttttcaattcttccaaaagatttaaaatactcagctgctctattaaatttttaattcctcaggctcaaatgcaaatcatgcattagatgccattattcaattcaatttaagaacagactcttgccccaggaatttattaaaatagtttagaatcttgaagataaagagtatcagttttgtgagtttgtagtaccctcattcttcaaaacagctttttcgttttatacactgttgagtaatggtttccctgggtacagacatttgaagtctacaaaatatataggagtttttatttgctgagattagtggaaagttagcattttctttttctttttttttttttatcacattgaacatcatttaaataatatacttactgtatttctgttatttttggcacaatattttacttggtgggtttccttttattcatttagtaataatggggtcagcttggcaggccttttgtttttaattaactaacacatgattgtgttatgtgttaagatatgttcattaatgttaggaaaaacacagatgaaaatgtttacagtggttcactctgggtggtgggattatagttgaatttcattttctgatttctaattttttgtgtcttttgaatgttctacaaaggccacataatttttttgaattagaaaagaccacaagtataaaattaataaaagcttagaatttctagctttatttctctctggagaaagggaacttttcatgtatctatttaatatgtatgatgcacttactatacaccatgcactttgctgggtctggggaggaataggggaggtgagagacagctgtttcccttaagctcagttctagatctttatctgaccaaggtatggtgggtggggagcaataaatgatatcccccaatgaattattaccatcgtaaagtggtaatcattttatgcttctcgcctggaatttaaagaggatgaattgagattctatatgtaaggcacttggtctaatacttggtacataggaaagtaatcatgattactgtgctttgcacattcatggtgatgaactcattacctctggagttaggccggtctgtttagatagcctgggggaaaggtgagaccagatacccaggtgacattcatctctgagatacctcccccatttctgcagttattcttccacgtggcatccttttaaataccaaccactaaaagtttggtttattaacttaattccttccaagccaagtttctgttgggacctttctctgagaatgcagttctagttttatcatgaaggatagtgagaaactaggatttattatgtagttgtgcaactataaatatttatttcatcgatatgtgagggccacctgggatttttgctttttaattaattaaattaattttatattaatagacaataagcatttgagaaggcaaagatatacctagacaaaaaaaaaaagtcctgaatcactgaaagcagtttagacagagacattgagtccagaaacttcaacttaattctccccaaagtgtcttttctgtgaccccacaacaaagcacacacaaaaccgcattggctttgtatcacagaaatgctttcctgtcccagcagttgattctaataagtttgttttattgatctggttgcaaggggtgctgtccaacaaataatcctatacaataaaaagccttctcaagtgactgttgaatagtcagggtggtgttggtgtctgtgtgatgatgaaggtgatgggtgagcaaagttcagctaatcacagggttattgttctatggtgaggcagccacagcgtcactcttgagctttctgcatgcctgcctcccataccaaacattacagccttcccctaaaacttccagaccacccactggaacaatatagtatataaaaggatccagatgcttggaaagagaaagggtgaagtgcagagcatgcgtgatacctgctcgttggcccttctagattttgagcactgtttttacatagctggctcactaaagagatcaaacttcatctccaagtctcattttcagagcattttttgaaatatatcaagattaaaatgtatcacaaaaaatctgcatttttaaaattgttctggattcaggggtgactgtgcctctacggctctgcacctttcttcagtattccccagaaaacagggggaaacaaatcgttgtaggatgtgcacacacgtggagctctaaagctagacaggatgtggggaatagaggagagagtagagagtgtcaaataacagagtgatacccacgaggaaagagtaccaaatacatggggagcgcccgtttgcagaatggcacaggagagttggctaaatacacataacttacacttgaaggcttaattgcttggaaatttttaaaatattttgttttataaatgtatatatttggaacttaggctacttggtagctttgcagtggttcacctggtgaaatatggcttctcaatctgtttgttcaaaacagatttaatagatagggtttttttccctcctccctgcctgctccctgcaggacagctgatttacaagaggcaatctccttcatatgatactcattaattaatttatttacctaaccccttcattttctctcaccttcctctccagtgttgcttccttagtttctctttatcacattaccattaaaaatatttacctaaaagtctctttctctctctcaagttagcttcagaaaaggagagctggccgcctgttttcacccatatcttcagtgcctagaatagtgtctggcagacagtaggtactcaatgaatattgatgataaaacttagttcatgaagaagttctagacaggactatgagtaaaacatcttggttcatttgattgttcatctgttcattcattcactgtctctcatgtatctattgaagacatagtctgtgctaaggactgtagtactaggtactgggcatataatcctcctctaaaggactttacaaatagataaaaacatcttcttttggtacaatctcttcatttaaataaaagactaatgaaaattagatttagaatgtttcattacaaattttagagtcctccaaactattgattaaaacaatacataaatgtttcccttccagtttaaattaaatcagaaagcttgtgtgggctgttctccttgcctggtttagactggaagaccccagctgtagggaagatgctttcctcaaaccatgggcaggcagagctttcctgccagcgagcaagttggcatgctggtgtttgagtggcagtccattagttggcatcaccacctagtgcaatctctaaaaaatagcaatctttgtccttgaaaatgaaaatactttggttttaaaaatatgtttctgtttttaatgaatccaagacttgagttaatttaaaggcactcacatttccctttgctgatggcgacacctaaaacgttcatgcccatgcacaaaagggtattccatttggagttctcttacattgactcaattccctatttgtaatacacaacatggccaccattgggcaacaaaataactttattaaagcaaagaaaaactgtgggttactgtgttacatgctctttcagaattgtaaagtttccctgaagtagatatatcacagtaatccatggcctctttgtggcctacggtctgccaaaattactgaagatgtcccagcatcacagcacggacctgtggagaggaactttatagcattctggcccaatctctgctttttgtagagggttctgaggagtttcggtgaactgagcttactaaccaggggtcacagagctaattgatgggagtccaggcttgattccattcttctaacatccagtccagtgttgcccaaaatgtgatctactgacaacttacgtcatgattggcagggttactcagcaaaaatgattcctggcccccagcagaatcaaaattattgagggttcagtccagggatttgcgtttcaataagttcctcagtggttcttatggacactaaaatttgggctttttaccaataagccttaagaccccatttccagggaaagctatgtgctaaatagttcttccagaatgcttgcccaagagaatgacttgccttcatatttgctctgctgtgtatattgacagtataaaccatttcaagatgagctttaaggatgagtaaaaacatacgctaaattaggagctgaaatctttaatttagagatactttttccatagtctgagagtaggaaaattttcatctgaaggttgtttattcagtggatgaatcaaaaattgttgataaagtctaaaaaaggtaaatatgattctttaaaattttgaattgagtgtaatggagcttgaattgatatttagtatgttctatttacttgtgttttcataaaaaccttgctggatgaatattcagggtgccaataaatttgttacctgtttggccataggaactgggcagagggaagttatgggaagacttttcagtgaatattttctatgcttcttgatttttgaaccctttgaatatattgcctattcacaaatttttaaataatataaatgtttaaagcattaacattcattgtagggccttagtaggtgattgctctgactctgcccaggctacaaaaacacatactctagaatctaggtgtccctgtagcagaaggtaatgaacatttccaaagggcagagccaggaagggaaagactgcacattcagctagttttaaggaaatcactaattggcttgaaaagacaagtcattttgttttagcacttatactcattattttaaagcccctccctgacagaccactcatcactggggttttgggtgaccttgggcaaatcactcaaccctcttgagactttgttttctagtctgtaataatactgatgaaaactccctgtatttcagttggctgacgatttctgaatacattacttagttttcacaacaactctgggggttgggtagtatggcatgatccctattgttcagatgaggaaattatgacccagagaggttatatggtttagagagggtcacacaggggtgggacatctaacttccagtactgggctctttccactgtggcatgcaggggacgtggattaggcaatttccagggcctcttctggcatccaagtccttgagtatatgagctatttggggctccgtcaacatttgttgaagtcttttggaaaaatccaaaggaaattgaagccatgggtttgcaattttagaagctcgcattgtaattagagtatcaaaatgtgctcatacgaagacaaccgaggaatacttacaaagccaacacataccaagttatgcaaattacaaatataccagatctcatatcacatagcacaaactctgcacctaactaccaaggggatggggaatcccaaacctcagagaataacatttgactctctcatcctctcctaaatgatactagcaactgctctttgagcacccagtaaggcaagcatttgttacgtattatcacatttaatccttaccacatcctctgaggcaggtattattatcccaattttataggataaggaaacaagacttagagattaagtgatttgaataaggcttgtaggtggtaaagcccatcaccaaccagggtccttattattattgttatttttattgctatctcctacaggaaagttaggatcctttattgatttaaggtgtgtgcgctttgtctcatgcctggctcgtcttcttgtctaagagtacacgtagcgtggtttcagataagggtatgttgaagagaaaacttaacgtacctctgccaatacccagggtgagcctgatttcatgcagtagcaatttgagtcgcctttagtgggcccatgagtaaaggaggcccatgaattctgccttcttgcctcaaaactctttattatgtgagcctggcttctcctgtgtagcatctgttacttcgttttgccttccacatgtactaagtagaaatagacaaacttaactcttgcagataatagatgactgaaaacagatgatgggcacacaaaacaggctttgtctccataggattttgttggtaaaatacttcgtctttcacttcaatatattttgttcattgttttgctgctgcttagatatgaaaactttcctctatcgtcctaatcttctgatatgccatcatctctttcaacctcttttccgatgccagagtgaatccagtctgcccttgaatactgtagaaacctcttggcagttgttaacaagccttagcatttactcagtcattctgggaagagaggggaatttacactgtttccttagttcacatagacacaggcgaggtaagtagcctggctgggttggcagaggttcttgaggattgtaaaaactgtgctttgctccggaccctggctcctcacagaggtctgcctgcttgtccttggtctgtgtcctccgcaggccttttacttgagtcagactcctctaatgagagagttcttgggtttcagtctgggggaatccagcctccacccgccagacttcctggagagctctctgctgatgctgaaagtgcctggagccttgaggattggatcaagctccctttcgaaggggtctcaaaattctttagacataatatatttgtggctacaatttgttaagaaaggaaacaggctgtactagccaataaattgtcaaaggagcacatacctaagatagagagaatggtttgcagcacacaacgctctcactcccttttctagtgctctgtattcagtatttacactaacttttagtagcagctgatttctaagaagacttctggcttctgctctttgcattgaccaaaactcttggggcatgtgttgagtgagggaatacctttttattcacctgcttcctagtctgaactttcagataatcggcacttcttgttcccagtgtgaatccaaagagctgaaacagctttctttgtgggaaatcaggtaagtgggatttctctacagggatgcagatgcagatctgaatgcatgtacagtgctccatagctcactgactaagctttaaccagcaagtcagagctatacagcacctataggtactcccacgatacttcaaaaattttcatggaattataaacattgattgtcagaaaaacagacctagttatctcattttgcaggctttgcgtctttgaacacatttgatatccattcctactaaattttctctctgaatctgatctgtctgctattcatatatttctgttgttttattagtatgtgctgtagccagatattttgctaatttgtgtgctttttctttgctttttcataattctgcctaacttcttaggtatagaatttccaaagctagttgttagtgtgccaaaacagccaaaacagctttaacaaaaaaaactatgctttgcttgactgggctgtaagatgacttagataatttatgcttcccttcaccatacttgggggagtacctgtttagaaagggttttatatcctggcttggaataggtctaataatttaaaccctctctcctggaattaccaaggtctaaaactaaaccttatgctaataatgttgaagttgaaatggttttcaaaatgatacccaagtgtttataattttttatgtgctgaactgttttgtttagataaactggaagaagatattctgggataggaaatggctgaaggaaacaaaggtgtgtgcagagaaatacatgaaatgtgttgtaggatcaaagatttaacagtttatatggaacaaggagacctcaaatagggagaggggaaatggagttggatggtaacttggcctggctgagaggacttggagtgctgattattatttatgcctagcttgtttaagagtttttaaaaaataggaaaccacatgtgaatgggagtgggggaaccactctaacttttaacttagccacataggagaagcctacttattcagacctcaagccttagtcctggcaaattcatctcctggtgatggcttaattatatttcaggcatagtattcaaggtgagtgttaagtttttatttttaagtgagaatcttgcaaatgcaagcatatcaactgatagccagtgtcttagggcccctgcacaaacagctaagtatgctcagagagccctactgtggaaaagatgccctagaggaacacccagtcatcctttcctttaaccttcatctcatcgttttctcttcccttccccaacctggacctatcttgcccagccttctcaatgaatacttggcatgaacttcattcactcaactttgtcgctgacacgcccgttgtactgacagaatcctggcttgaatggcgcttgctcagctgtgctttagacagacccttctggctgacctggtttaaacctggctttcttgacgccatcctcagcgtgttccaaggtgaaaaaggactctgctgccccttctgttgctcctctgcaggggaaaccagttgccacttggcaccaggatgtatcaggccggcatccagagtagtaacatgatttagtgaaaatagtactagaccaggaggaaacttgagtcctagtgctggtttgcttttcagtggctgtgtgaccttgggcaaatcattgcaccaccccaatctcagtttttttcatctatgaagtgacgagctgttctctaaaaacctttctgatcctcaaagtcaggaattcacataggttaccaaattcttgaatgaatagagatttgggttctaagtgcttttcttttcatctactgcactgcctttttacacaaaacaggggccatctctatattgttttgtagtgtgcactcaactcccctctcaatcttgggttcaggtaccaaaaagaccttccttcacctgcacagttcactacaaagaagggcattcgaaaagtctgtaagtgggccaggtgattcaggatgtttcgcgttactttaagaagctttttcttgaattaaatcactctatttttagcaactcactgggtgatgcttttaaaaatatcactgataaaaaatatgtgcttgagacaattacaggtatttcacatataatatttcacccaaatcttaacaaccttaaattctctccgcttgacacgtgaggggattgaggcttactgagattaaacaatgacacagggctaagaatgggcagggttggaatttaggtcagaactttctgtgtccacagcctgaattcaactctggcactatgttcactatgaggagtagctgccattgctgtaagaatacctggcgttttgtgcaggagatctcagggaaccctttttgttaggtttcaaagaaaatgatttctaactgcatttcagatgcctggaatttatgctgtgccaagcacttttccacttaattctaaatccgtgggtatttcaaggggaatttaacccatgtggttctgattcacttgtacttaactcatcaaaaaggattgttttgtaaaccttagcctcttcttatgaatgctttcgagctcatatttggctggcattggctggatttcgaatctgccatggttgaagcttggttcttaaatccttctttccaacaactattttgtggtagtttcatcctgggagtggatggaaattgaaggtgagtcatgaaggctcttccaaaactttaccaggattccagtggtatagacagtcactaacctttgaggttcgtgaggtttgttgcactcacctacagccttaccccattaagtagttgaattgtgcatggatgtgatctatgagggtaaaaaattaaaatcatagatgttgcattttcccctgggatggtgtagagaaaaattgtctttgagataaaaggtatttgtggaggttaggtatattactactttggaaaggccttttagcatagagtcttctatttgggagacattagagttatagagctagtggaaagtttctttcagaaacccccattagaaatgtagaaggcaaaagcctatttattatctttgcatttagatgagttgggtacattcagttctgataacctgctgagttggagaattaattaacttgtctaattaacttcacatgagctcatctaaggaatgtgtgtagttgtgtggcccaggggaagcaagagcaatttttatacctagttaacagtttggtttaagaaagatatattgagtgtcttctattccaggaagttggggatagaagataagagttcagagataaacaagactctctcctcctaaggaacctaccatttggtaggttataacctatatgcttctctttggaccatggccaaatggtatgactggcaaatagtcaatgtacagcaatacaccataggagctcagaagatgaagatgttcattttgatatatgaagctggacaggcttttcccaaaatgcagtgtttaagtttggtcttgaaggataagaaggcttttaaaggcagggtcaagggcgagacaaccagacatgttcttgggtaatacagacaatgccaaatagtctccacagatttctgctctgtttatagacgtggagtggggtgactctgcggaggtgaatcagagcgttagaagctcatgctgggcgaaagggggttgtgcacagtcctcgataatgagcagctgggattaacatgacagtttttaaccgagcacagattttcagggctgggacagtttagccttggatcaagaagaaaacacaggaaagggacaaggaagggaacaagatgtgaaggaacagtatgtgagatttacacatcatcactgcatgccatgtttaaatagaacatactgcataacatcttaacatgcccttacatttctatagtgtacaaataatggcttattctgtctcacgttgaagaaaccaattaaatgatgcatgttgggtataaaggttttttctattgaaaatatcattgtcatagaatagaaagagttacaatcagacagaaaattaaatatcttaaatatttctcttgtatagtgtttacaaacaccctattatcatccctatttataattaagaaaactgtggatcagaaagtaaataatttgcccatggtcacataggtatataagacacttccatttcagtttgcagatataatgtgtatgtgtgtatgtagcttaccttttctatttgtcatactttttcaattcactatatgacacatttacagagtatatgtcatgtatgtgttagttacaaacctattttaaaaatgaatactgcccaacctaagcagtaaaatatgactgatacccatttaggattccccgtaccatctctttcctgcttctccacagggaggtaacctctatcatagattttattacatatatttttttagctgacaccaacattgcttctgtgttaccatggtttacagtgaatatatttacaaaaacaaaattgggataattttcatttcttgcaaacaacactccaacactgcactgaaggctttgttagctcaagatttaggagtatgagaacaaggtcctgaaactgatttgaacgttgcttcaatctcgactgctgtgatttaatcctggggagcaagagggcaaaaatgaggccaaaggggaggcatgaagtaaccaacagggcctgatctgggatttgaaagatgtagattgtcgttccatctgccactaatttgttctgtgacattgagaaaataactttgccgctctgtgttttgatttacccttgtgtacattgtaccgtcattttgaggaaggcaaagtagtggggaaagcacagcttttagaatcagaaacaccaaaagctgaattctcattctgccacttactgtttgtagaaccttgggcaaatttcttaactttactttgagcctcagtttccttctttataaaatgaagcaaaagtcttcctcagagaattgttgtgagaattaagtgagacagcatgtctcccttgtagccagcaccatgctccataaatgctcattttctttttcttcttctataagtttccttccaattctaaaataggagattccagtgctcatcttatacataaacgactgaagcacaaccagctcataattatggaatttcctgtattaaagggctcaacatttctctcaaatcagacttgtcattagaagactttccaaggtctggatgaatcttttgaaattaacaataacatctggaaaaaaaaaatggctcatctcacactcacagagtagagagaaaggagtgagaagtattatataagttcatttactacccttgattctcccgttccctgagccaaaacaatagactataaagctgcgacttcatttttattgtttcataagccatctgcatttgcataaagtgtcagtaccgttaccctatttaaaggttgaatgtcactgtgaatgcaatacttaccttttactgtctcccgggaacctacctaggcatttacatagttctttgctttcttttcaatccattcttattgacgtattgtttgaaattggccactgtttgggaataactccaaaattccattatttccatgtgtccactctgtttatatttttatgattgttatggtaagcaatcaaatatgtaacatttgggaactgaggggaggggatggtggtctttactttcaattgacggtagtatatagggcatatcacattcaaaatatctcaattatttaaaaaatagaatagagaaagagggtcatctaacagagatattagtgagcttatttaaaaaatagaacgtatcttacaagtgagaactggcagtaatcttatgatggtaatgatgcatatgaccatttatttgatttaattggaaaaatatgtgtacatcagagaacagtggattaacggagatgatcagagttgagtcatgtctcaacattagatatcttactaggtttcgaggaagaaaaattaagttgatttggggaatatgagcttaggaaggaatatctggaattctcatttgcatttgggtaaaatttggttatgcacttgacctactttgctcaatctctttgctcttaatttttaaaatacaagctacataaaaattccagaaatgtagtatcttatgcttggattattcactcatatatatgtcaaatgacaacataatttgtggacttggtgtctcagttagaaatgagtttggatgcaaatgatgcaaaacccaaccacagtgacttaaacaaataggggttaatttttcttatgtcaggaatgaatttggaggtatatggtagctggtggtgattccactgctcaaaaatgtcatcaggccagccagtggctcacgcctgtaatccctgcactttgggaggctgaggtgggaggatcgcttgagcccaggacttcaagaccagcctgggcaacatagggagaccccatctctacaaaaaataaaaaaataggcaggcatggtgacatgtgcctgtagtctcagctatttgggaggctgaggtgggaggattgcttgagcccaggaggttgaggatatagtgagctgtgatcccaccactgaactctagctagggcgacacaatgagattctgtctcaaaaaaaaaaaaaagaaaaaaaaagtcattgaaactgaggttcttctttctttgtgctttataaaaccacaatgagataccatctaacacctattaaagctgctattaaaaagtcaaaaaataacagatgctgcagaggttgtggagaaaaaggaacacttatacactgttgttggaagtgtaattagttcaaccattgtggaagacagtgtggtgattcctcaaagacctaattacagaaataccatttgacccagcaataccactaccgggtatatacccaaaggaacataaatcattatattataaagacacatgcatgtgtatgctcattgcagcactattcacaatagcaaagaaatgaaatccacctaactgtccatcaatgagaccggaaaaagaaaatgtggtacatatacaccatggaatactatacagccataaaagggaactttgcaaggacatggatagagctagaggccactatacttagcaaactaacacagcaacagaaaccaaatactacatattcttacttataagtgggaactaaatgatgagaacagatggacgcatagaggagaatagcacacactgggccttttggagggcggagggtgggagaagggagaggattagggaaaacaactaatgggaactaggcttaatacttgggtgatgaaataatctgcacaacgaacccccttgacacaagtttacctatgtaacaaacctgcgcttgtacccctgaacttaaactaaaagttaaaaaaaaaaaaaaaagaacaaggtcttcatgaatccaggcttggacttgatctgcatgtcacctttatctttgctctatattgcaaattcaactgttgtttttaacaaaaggccaggcaagggagtagagataacttagaacaaatctcttagctcttcagaatggattaaaaggtgtgtcttgcagattgtgggtcattgacgtcatttgtttctaagaatagcgggatgtattggttatgtgtacccatggtatgtgtgggaggagaggaaaaatagaaggaccagggactatggtaggtattttgtatacttatttactactcatacaaccccaggaagcagagaaaactgactcaaagggtaactttattcactgccacattgataatcagcattccagaattcaaatcaagcatgatagattcacggaattataagtagttaattacatcttgagcaaagggaatgaatagttcaaaagattaaggatttagactaacttaaagatatgtcattttgcatcctccattcattcattcattcattcattcattcataaatacttgagtgcttattatgggcccatggggatattctaggccatggagatgcaaagtttaaagagacaaaatatgtatccttaaggctcacaatctgatgaaagacaatcatataagtgagagtttaccatggagtttggttagtgccacagaggagggaaggagtaagtcgtcaggggagacttccaagtggaggaatttggtggaaaaatagggagaggaaaggcattccaggtagaggagatggcatttgcaaagacgtgtggaagagaaacagcaccgtgagttgaggaactgcagttcactcagtgtcaatggagggggaaggcatttagggaagaggccagagaggaagccaagtagggagcatttcacagagcgttttagggtctaactgaagttaggttcactccagcagggcaaagggaaatgagggtctacactaaagcagtagcaattgaatttcagaggaggggcaataaagaagctgttgaggtggtaaatttgacaaagtttgcgggtgattaggtgggggtgtgagggatactctgtaatccccgctgccctgagtctgtggccctgtgatgtgggctgtggtgatgccctttcccaaaataagaagtgtgggaggagcaagtctaatggcaaaacaagcttctatcagacatctttctacacgctctgcccttcctgcactatggaaacaaccttctcttcctaacctagctgaagccatcctggctcaggccagctgaaaggccacgagggcgtctgaatggttcatgatttgaccacttgaatgccatcagagagtgatgtgtctaactcgagacgaacagcaaattagttgctgagctgagactggcgtgcaggcctcctcacttttaggcttattgtctttaggttctagccctgcactgtgttctgcctaaatgggcaaggtaacattatccacaaatgcctgctgccgtttggggaaaactaaccaggacggtatgtgttactaaaagttagctatcaatttatagagggcagtgatgactttcatgcaggtttatgtttctatgtggctccctttggaattacaagtaaaggaaggggagaactggagtcgtttttttgtctgtgcttgtgtcactaactaggagagtttttttttttcttttctttgagaatgaacatataaaactctagtaaatcagagtaagttatctaagtaatgccaaattcttattagttacttctttttaaatagtgcaggggattattaccttttctgagccatggacacttttaagaatttgatgaaagaacacgttcttcttccaaaaaggaataaatgaaggcactgtattgagtccaagtgcattggttgcaagtaatggaactagcttaagcagaagaggggatttactgtaaggaaatcccaggttataagaaacccaagggcaggtactatagcagggctttacccagggctggaagcaaaaaccaaatgctctctccaactctttctggagccagctggtctctatccctgccccatgcaggtggactgctctgtgcatcatgtacatgccgcctccctgctcccaaggtaagtcacctgaggtctagccagctgcagaggtgaacaccagtgctcgtcaatcccaattccagatttctggaagagaatatgtgattgctcacttaattgtgttcagattcatcgaacttgcagatgtgatttatgtatagtttcagggcacctttagacctaccaagtcccaattgtggtcttcaagttaagaacccataactagagaaatctgaatgcccatagaccagcagcactaacttttagccgtacaactactgcagaaatttgaaaatacatttgaatagaaagcatttgcatgagcatagttcctaagaacacttgctttgtgcaggagttgtgaattttaaatattagtagtgaaatcccaggatggcgaatatgatgtattttaaattataacactttccaaggtcattgatattctattcctaacttttacccttaaaggtttggaaaattccattttaattattgttaacatgcttcataaatatccaagggaataaaacatagacctgttaatacatccagagagctaaaatctggctcaagttgttttttcttccacagttggagaaaattgtggtgtttggcttccctcttggggcattttaaaccacttttaatgctgtctcttattattttctaaccatatacactttccgaacgtatctaactagctgccttagatgaaaccccagtgtctggccaagctgatgtaaatctctagtaagtggtaagagggaacagagtaacacagtgccctgtcagtgttcagacagtacatgatttagtagttgtaggacttatagtctcaggagcaactttaaatcttttttctagttctatagaatggaagtttctaaggcatatactattctgccactggctccactgggcaacacttagctagaactagagtggcctatctgcccatgggatagtattaagatttaactcttcacatcatgtgtacctggggtgtctgggaaataactattaattccaaagagcaggatgaatatttgcataattgctagtctgtgccataaaacagttgtcactcaccagtggcccagaatatcgaaatctgtatgtttccagtggagctgccaagagaccccatgtgattgtcccattagtgatgtgttctcactccacttagcaggtctgaaaaatggacgaccataaaataacagtgaaaactcagttctagggtctgctgccttagttgttggtgtctaagaatatggatcatctgttgtatttgatatctgagcacgtactgatttttgtcaggaatcttctcttgttgatgaattaaatctacataatcgggttttggtgctgctgcctctcccaccccctcagctcccatgcctgtcttttgcacggttcactcacgtgttctgagtaatgcttgtactttcttccaacttgtctttcttcagctgagttcagtgccagactctgagctggaaacagtctcaggaatttttcattcatcagacattttcttccaaagaaaagttctgagaagaggagggccaccttgatagtatgttagcatgcttctgtgactgtgtgtgtgtgtgtgtgtgtgtgtgtgtgtgtgtgtgtgtgtgtgtgtgtgtgaaagagagaagatatacaaacaacctatataccacatatctattagcacatggatatttgataaaaagccaattctagaaataacatttgccaaccaatgtatcaaaaccatctccctgccgtttatctgtcttgatattacagaaagttcatatttatagaaggcatttctcagctgtggttaataatggctgaacttttgtccctgctttaagttttccaccagatctctcagaattgatgctatcatggaatgtgaatgtggtgtgtctccatttcctgtagaatgaactcagggctggcagctaaagctagtggtcttggattcccatgccctgtcatttacgaaaggggcagtggagttcctctggaggaaatcccacccaccacgccaggattccatcacatattgttggtctgggccgtgggtacttcatacttggttttctgtgaaaattcaccaagtgtgtttgaagtaagaatctcaaccctaatgtttatacataaatgtctgaatatgataggagtaaatgcttgctcacaaaaaggaagggaaggaaaagaaatttataaaaaagcaaaaacacacaagtcagggtataattacattatacacaggttttgtttttgttcattttgatagcattaagatttacagataatatgattttatttagggacagcctcactaattcaagttacctgttctacaccaggtaccttattgtgagaatgggaagaacttgttaacggattattagtatttacagcctaatcttccctagtttccccgtttcagcaaatgaccatttattcagtgatggaagccagaagcccgggagccttccggtttccctcacgcttcccatctgatccatccacacgtgctgttggttctttggcccaaggacgtcccctacctgctggccttccaccctttctatgccaccactctcgccaactttcacctcaaatccttcagtagcctccctgaaaccctttccatttcaactcctgagcccttaaaggagcacacttctcaaataacagtggcttttattttcagtggctttttattgagctttgagccagatccagactcctcatcatatcccgagatgtcctgcataatccagcccctgccaaaggatccaacctcatggcatgccccttcccctttgcactcaaagctctggtcacagcggctttcttttaatcctagagaagccaggctatctgccagcccagagccactgttcttgctgtctcccatacttagaaagcgcttagatgttgcacagctggcttgtgctcatcctttaggcctcagtttaaatgtcacctcctcaaagaagtcttttctgataacttttaccaaggcaggtgtacccaattattctctatgacagcagcatgcttgtttcatttgtaactaaattacaacctcaaatctaaaactattttaatgtgttgatctatttattcactacctcctccacaagattgcaaactccatgtgaacagaggttttatgttgtgctattcactgatacagggttgtggctcaataagtatttgtcgaatgcattaaggaaacccatgattctgttttacagttgtaaaatgtaggcctttacaactgtaaagcattgaagtcaaagtgtttaatttaattttaggttgtggaatttctttctttctttctttcttttttgatacagggtgtcactctgttgcccaggcttgagagcagtggtgtgatcgcggctcactacggcaagcgatcctcacacctcagcctcttgagtagctgggagtacaggcgcctaccatcacacccagctacatttttgtgtattttttgtaaagatggggttttgctgtgttgcctaagctggtcttgaactcctgggctgaagcgatccacctgcctcgtcctcccaaagtgctgggggtataggcatgagccactgtgccagctagaattttctttttattgtgttaaagtatacataagataaaatttaccattttaaccacttctttgtgtacagtttggtggcattaagtacattcacattgttgtgcaccttgtcacccccatccatctccagaaccttttcatgttcccaaactaaaactctccattcctccctcccctaaatccctggcaaccatcattgcactgctgtctatgaatttgactgctctgggtacctcatattagtgcactgcaatcgattgatattttatatcaatttatttttattgcctctttaccaacatatgccttcaccctccacgtacacaatattcagtgttaaaattggcttgctactgaaaatctcatttctaataattatttaatgataaaacattctattaggattcttcatgaacttaattcatcttttgtggaacttatttttggaaaataaacaatattacaaggtacttttatgatatacaggttaatttaagaatatgttgcccctgacaatttttatatttaatcataagaccctttcctcttgggctactaatcttgtttttggattggagagaatattttatgcttcatggctttgaaaaaatataaaagaacaaataaattgttatacaatattattgtttttgtcttgctgtttaatagctgatgctctgtggtcaaacttcagtgtttggtttaacgtggcatttcatacaagctgttttaaaagggaatgaatcagagccaactggttctttaaagtggaatttgcagaccattaagaatgaaagtattctgtatgattttattatcttgatggtaaatatgtcacccaaactatgatttgactttaccgattctcccagtctttttttttctagtaaaagtagagataactttacaggaagatgaaagtcagtaatgacttgtaggatttatagtgaaggaacaaataatatcaggtaaatgattatttcaaaatgagatattcttttactctgaacaagatttctaactgttttcttcatcatggaacagaataaaatgtggtaacaatttgctgcagttgaattgctgccacacataattgggtcccacagaactatggcctggattttggtgaattgcttagtctgcatgttagattaaaaggtgtacaacaaatcaccttgtttctgcagttttgaatgacatttacatttaagtcatagtggtaatacttttcatttatggaataaagaaaataaaatcagggaaaatactaatgtagaaatggttttgtttttttcctatatggtttatttctaaagtgctttttaaaaacatttagttacaattaagccatacctcagaagcagtttgttaaaggtaaacattttgcataatacagtttggtaaattttgccaaaaggttgtattcttttaataacactgtatagaccatgttaaataggtaatcttgtgtgcagtattttatataaatgcatggattggaaagtatattcaaaccttattgtgtcattttaaaaatgccatgtagcttaaataagatgggagaagcaacattgcatagtaaaagtaggcctgaaaggaatttctttcccctgaaattttattataaaaaatttcaaacttaaagttgaaggaataatataaagtatacacatatactttccacttatattgaataattgttcccacttttatacacataatagctctctatgtgtatgtacacatatgtatgtatatatgtgtatatagaatatgtaaaatatatattaaaatatgtatttattatttatttacattgctgaattatttgaaagttaagttgcatacatcatgagacgtcacctctaagcactaaggacattcttgtatgtaaccacaataccgttatcacacctagaaaaacaacaattctgcagtgtcatgtagtatgtagtccacataagatttctgaaattgtctcttttagaaacagtatccagttgagttttgattattatgatttttaatctaaaataatctctgtacttcttttggtgaagagaaagtaatttgcttttggaaaagttctagacaattgccttagaaaatatcacatgttctgagttttctggttgtttccttgtggtgtaatttaccttgttcctctatccctatattccctttcagctagaagtttggtgtggaagtttgattagattaagccttgacactttttgacaagaaacttcatagataatgtgcactactttatattttataaaatcaggagtcccggaagaatttcagacgatctccgtgatagtgcaattctggaatgaatcaagagttgacttttggtgttactgatgctaaataggccttgtatttgggccccaattggagaatgcccctggaattccactcagatacaagctgcagcagtgggtaggggttggatgtgagagttcctgacagcggcatgagatcatgtatatcagtgtgctttgtaaaactagaaggaaagagactggaaatgggaattctactaactattaggacactgcagtagtggatgatcaaccttcctaaattttgactttgttgtttgctttgatgagctggtagttagtataattaactataatataattagtaaagaacataataaagtgcctcataatcagtgcagcactgtggaaatgaatagtattttgccatgattaggatgtcagtcctagttgagaaatactgggttatgtcgagtggcagtgatgccagtttatgggctggcttatgttcctaaagttagactttcagataagtagttgttatcttgcagagatctccaattaatcatggcacacgagtactcttcattaaaggaaaagagaaagaaggaaaaaaaatacacacacacacacacacacacacacacacacacacacacacacacacatcttagagtcctagagggcagaaataatcttggggagcttttgcaagacgtatatgcctgggccccatgccacatctactgaatcgggttccatggggaaaactgggggaggacagggtgggacccaggcatcagcattttacaaaagctcccccaagtgattctattatgtcctaaggttaagaatgattgcagtaagaagaagtaacagcagttaggaggctgattatgataatggaacttcttaactttaattttccttagactaaaagttctctgaactccttcctcagaaagttgtattgaaattccacacattaggagcctaatgttccccaggccaacctacctgggagaaataagtgtgctgtgaccctctatgtcatggataaattgatatctcattcttttgtttgtcatttttatgaaaagaaggatttaaaataattggagcctagtgcccaaaattatatccttgtgccttccctgcagtttgtggtttagtgactgggcaggagggacgagaattcattgtaccacagaatattctttccctgtaaacgatgcatttgcttcggggtgaagtctgattacaaatgaaagtgaaataatgctgtagaccacagcattctgagctgcagagctgggcatgagctgaggatcagaggctgcagacacatgttggtcagagcccaagccttgaggccaaatctaacgggactggagagcaatccttgagctaaccactcagaatgggaacatggagatgcagaatttcccatgaaccagccacactggagtaagccagttaaaaacaattagagtcgcactttaattttggaaagacttggcctgttgccctagttcatgaaggtcttataaggaagtgattgtagagcaatttgcaaatagaaagcatttctaatactatattttagttgcattaggaataatgatttacactgaagccaggaatgagtcagacgttacacaagctttgagttaagcacactccctgtctaatgctgagactatctgaaaaaaaaaaaaaaaagagtatgtaaatttagcttaatatcatgtaagtgctatgggaataattgtaaataattggattattagtaaggaattgggagtgtgggcagatttctttctgcggttggagtattggactaaaaacagcataaccttggcaatctaaatgaagtacaggacgaaaagcacatgccgccaaatcggaatgacatttgaaaaccatgttaatacagcatttaccttccaagacatttttagatccaattttatttcatccagattatgcctctccctctacaatcagcaatttttgtttaaaatatggatctacaaatacatttatatccacttgctaatctgtactgtcaaataagccagtttgaatttgtttccaaaataactttgtctatagtgataaatatctagcacagaaatgtactaagtccatagtttctattctacataaagtattcgccaaatatatagtatacttaataaattggatccctgtggactgttgggatgcctaatatagattgtcagaattaacaactaccatctcgattctatgtatttcatattgaaataagaataatacgttattgaccctggaaaagtcttaaggggtttttttttttaatgaagatcttccaatgagaaattcacatgtgaagttatgaatcagtggcagacagaactgaatcagatttgtattagcattttgtagagtgtctggattttgctggtgtcactcacaaaacaccatatttgtatctatcctgaaccttggcaatcctcatatataagataattccatagagtatcttggcaagaggaggtggaaaaacaaatcccaacagtgttgaagagaggattataaattaaaattcatgttgcgttatgctttttaaaaaggattgaatatggcaagctaacctgaatctgtttgattaaagcatttgcacttgtctcagtaaattaacagaaagaaacaagcctaaattctctttcttgttacctaacatggagagttttatttattttttaaataaaagattacactgctgtgatctttctagtctcagatgtaggatatatatagtcataaaaatcttgatgactgtttttatcctgaaaaggattcattgtaatgtacactgaatgctatgtgtaataatgaagaattagaggcaatttaaatgatagacagtaagaaaattactgaacacattctgttataacttgatggaaaattatgcagcaattaaaatcatattgtagaatagcatttattacatgggaaaaagctttggcaatgttaagtgaagaaaatccagcaggattcaaaagtatatttttagtataatccttattttatgattaaaaaaataaaacacacacatgcatacacacaaaatcttacgtacgataatataatcaatacgttatcaagggtttctttaggtgtaattacatttgtttatatgctactgccttttctcaattgtctaaagtaattacttaattttgaattaaaatacataataaaatattgaaatagaaaggaaagaccaaacagcaaagatgtatttattaaatccctataggtatttgtttgggagaattgagccaaaaaaataaagatgactttggtatttcactttgtccacatagttcctgcattttaaagagattttgttccaaattactgcagtgctgagtgactttttcttcatcgaaagaacgaaatgagggctgagatttattcaacagctcagtatttaatacttgtttatatttttgtttgaattcagtatctgtggaagaagatagcaggttttgaataaatctggcatacaatgtaaaatattaaactatacctacagcttgactatataaaactaaaaaaacagtagagtaagaaatgcataaacaaagtaaaaaaaaaaagacaaatgataaacagagaaagtgtcaggagacagggctggaaaggtgggtggggctatatcatgcagagaagagggacacagaggtcttaggcttgtcttttggcatggtgagtctggttgcatgtagatatcactcacacaatttttgacctgtttgcatatcacctgtactagtatttaatatttttaaaaaattgaattaaaaggtttttcaattcatcatcctcatagcagacataactgtgaaatcatgagtctgatatatttatgctgtttcataatacacattaaaattaatatgtgactactaaaatctaaaattatcttgcatcctgtgagtgggacataacactggcatggagggagggagctggggaactggggactcggcatttggaccatcctgtctgtctctccagtgctgccatagcttggatatggtagtcttctttacatatatgactggcatggagttttgtttttggaattcttcagaaggttgatcttacagcatgggcatcagagcagtgctgtttctgcaacaccattgaacagaggtggttcattgcagatagcagaggagagggaggaagagcacgtagtgatggggagcagatggagttgaaattccaagggaggggttggagtggagatgcaagaaaaagaaagcaagagagaacacacaggatagagggatgccagcagataagattcagctattgccaaaacattgttacgatccagaatgttgactcttgctggtactgtaatgaaaagttgtccttttttccttagtaaatagcatgtctgcgatgtcctatgagctacttaaagaaagaagaaaataatgaaagcatcccagtagtttcattagcacagccagtgattttcataaaactgttgcgttcacaggtgaaaggaacttactggggtcattgagtccatttttagactcacagggatcactgcacctaaacacttctgaaaatgacctggaagcatgcaaatgttggtttgtggatagaagcccatgagtcttaccccagcccagcctcccttgtctgtcaaggtcattgtagaaccacggaaatggatattatggccctgatttctctcacaaggggacaacctgggtttggtcctctgtgctcactacgtctttatctttcttatttgttgttggctctctctctgtaggaaaaaaaaaaaagaggcagatcttatagctggtggtagactgctctgattggaaattctcttgtggacttagcttatccctgttttgctttaagatggtccttttgcctaggggttacaatgatttcagaccagtgtcctcactctttatattaaaacctaatgtgttttgcatggacaaaattttaaattcttgtttgttggtttgcttgttttgtatttgaaataagatgaccccaactcaaaagaaacagataaccatttcttttattgaaggaactcccaggaagaaggtgccatgacttgcctcactgcaagcttcaaaattctttgctttctcagccctaaataacaatagactggaagctctgtgaggtcagggatttggcctcttttagtcactgaagcatctgtatcaggcataggagctgattcagtgtaggcactgatatattttcttaagtaatgagtggataataatattaccatgttacatttgtatagcaattcacagttgtaaagagttttccattagctcgcctgatcctcacaatgccgttttcaaagtgggtaacaactgatgttttcatccctattttgtaggttaggaaatcgggttcagaagtagaatggtctatccaaggccttacacagggacagtgatgcatgattctgtccctgaaattcatttctcaatttggagtcaagcaagatggagcacagctgttcctctgcatgatggttcctgcttttctggattttcatcagatttttattctttattttcagattacaggacaggcccatgttttactgtgatcagcaaccagatgtgccagggacaactcagcgggattgtctgcacaaaaacgctctgctgtgccacagtcggccgagcctggggccacccctgtgagatgtgtcctgcccagcctcacccctgccgccgtggcttcattccaaatatccgcacgggagcttgtcaaggtaaacccgggctgatggaattattaatggattaatcttatttgctctggagagccattctccaatgaagttgaagagaatggaaaagtagtgtcagctacataacttcacaatttcgctgactgcatgatatccaactaaggcattaggaacgtggctctcgagagagcagctgaagtcttactgaatgttttcttgccaaccattccccctttctgaccccagaggtgtttgtatgtacctctgactccaggggtggtgtgattctgtttacagcgatgcagtgcattatggcagtgctgtgtagaaacacaaagcaaggtttgtgaacaaggtagtttatgtttttcttaattttttttcttcatttgaaactgttgagttcctctctcatgggttgtgcttaattgacctgaagaaaattgtttctctcgacattttgcatgctacattttgcatttttttacaagtccaaaataaattaggatttgtttcacagttttaaatatccccagatgtcgcctgctagctgcttctcctgcctcccgtagaagcccttactctgtttttggcttttactcctgttcttccagctgtacaaattcttttattgtctggatgtctggcaggaaacaggaggaagtgaacagaggcagctccacactaaactgatgggattgaaaactctcagcctgtatctgtttcctttagacagcctcaggactttttatagcaagttgcaatattttcagaaacttcaggatatgcttttctgaggcaaatagataatactttggcgttgttttgtatgttaattctaagggtaatgtgcaataaaacagaacttgagcttagtcacacagttttgtgggtctccattacattccacttcaataaattccacttctgatattgtcattcctggccttcagctcccatgtacaacatacagctcctttggatgcccttaaatgtatccctctgaatgtcaggagaagaaataagtcaccttgaaactctaaaattatcaagggatggattgtagtattttacaaaagtttagttgttttttggtgccttcttatttttcccgtttttagaaaatcccagtgagttttgaagaatttgttcatcttgggattacaaagttagctaatacccatgaacttgttgacagtgaccagagagctagacttttaactgcctcagctgcccatcagtgacccattgtcagaggttagggtgctaatggaattgggggggtggggataatgaactgccttctctttagctttgctattcgtttcataaatctggatctttccagcatttgcttcctgtttctttctaactctgctattcaacatccaagaaaaaaaatgttttttataagaaaagttttgaaaacccattgaatcacaatggcagttatattgctattttgagagtgaaattcttcatgtttggttgttgttgttgttgttgttgttgttttttctaagagattctgccaccaggttgtggctcttgctccttgctggtgtttccagtccttgggtcagatgtgaggggctgtgggcaaatgggttcataaaggagcttattctgtcttcagacctggagtatacagccagtggagaattgccttgtctatattttctgttggccagaaatcatgatcaacaagacagctagttctgcctatatgtaaaaatcttgattttcaaaaacattttaaaaaatacattcaacacatcaagagaatggaaaattctggtctaagacaaaactgaaattggctagaaaacataatttaatgattttccacatataatcatgtatctgtgggttaagatatttcatttaaaacagtaagtgatacttttataataaactaaattgttgtttctttaatatcccttttactgcatgctgacttttctcaagaacacaggttgagatcttataaacagcaatcacttttttctttactcaatgaagagtgaaactaaagagcacattaagcttccaggtttcaaaaagaatacattagactgtttgcttggggattctttattaaatcagacttttctgttatgaacaaagagatggagagaatgtacatgtactttataatctttataacaaaagtagtgagcctgaaatgattaattttgctcctggaaggttaatatttgggcttacacataagaacccaagttagtccttaggtgctggttatacaacagtgaagaaaatggacaaagtccctgctttctggaagcttatattgaagacattttgaagacattcaatttattaaataaaacaaacaggcatgtattaggtcagtgggtggttagtcctgtggaaaaaaataaacagggaaggaaggatgattagagccagcagccaggtgttgctgttggactgtcaagggaagggctcgtggctaaagtggcattggagcacagacctggaggatgagacatcgtgggccatgcagctctctggaggaagactattccgggcagaggggcagccttacagagctctgtggcaggtgcatccttggcatatttgaggaatccagtgtggtgggagagataggagggtggaaaatgggtaaaagatcagagaagtcatgtcgaactccccaggacatagtacacacttgcacgttgagctggggaaagacatgatctcactgacatttacaaaagtggcttctggtggccactgtgccagcaaggtaagtctgcagctgaaactacacactcactcacctaacaatctctctcacttcttggcctaattttctgagttgtttaatttttactgtgcaaggcacttctccagaatgtgaagtgaacatttccacttcatttgcgcaaaaacattagctgtctcgtgtagtctgagtgaccttcaataaattccgttttaactaaatcactcagtacaactcttaaaggtagtttcattgtagaaatgtattgcattttgatttgcaagattttttgaataactctgattattactaccaatctggagataaaaatgaggccgtgaataatggccttttaaacgtatctttatactttgctgcatatgtgctaaaacccgcaaaagttaatgcactctcctctacattaggaaacatggaaggtgggaaaacaaaaaatacttgtgacttcttatggaacattattaatcaaacgatgtattttacataatgcaattgtgagaaacagtttctctaatcatattccaaatattgtgatggacaaataactcaccgatataaatatggtaacataattgtggacaaattatcacattttattctgcaatgaatttcatatgagttttttttttttctctctgtcttctgtaatctgacagatgtggatgaatgccaggccatccccgggctctgtcagggaggaaattgcattaatactgttgggtcttttgagtgcaaatgccctgctggacacaaacttaatgaagtgtcacaaaaatgtgaaggtaagaaatcttatgctttgcagttggggggtgtagtgggggcaggcaaaactcaacattagaaacaagcttgtttgcaaattattcctaaatccttctgtctttgtcatccctgtgaatgtgtaaatataatatttttaacagtaataatatgcctttgtgctattggaccagaaaaaccctgtagctttttccacttttatagacccaaaacaagaggtccatctgaatcaaattaaatattaaaaacatgaaatatttttgaaccaacatttggtttaaaatgttcaacacacatgtttttgcatagttctagagacatgaatttaaatttggtcattagatatcattcagaataatatatcttccgaagtttttctagttaaaaggtatgtttgattttgtgtgtggggaggcagattgatctattaacccttatatttatgctcctagtacatgctcatgattttcttttctgggggatggtaattgcctatcaaatgaaaagcttttaatgttagtcaaacagaaaagtaatttgagataatttttatatttacatttagtttatagattgaacttctacaaatatatatacagaggatgtgtttatagtcaccactactgctactgctctttgccgaaatgaggcctgacttccaattacagtcataatttcttcgtgagaggggagcatctagaaaatatgtaggcagcattggactctcttttctttgatgagtgcatgtaacttatatatagtaatgtccaacaatagtgtaacagcattctcagggctacatctctcatcaagatcagaagagaaaactttttccttcatcctcaactcaccccaccttgaggtttcacttagatggatgcatttttattgaaaacagatgctgttatatttatgcccctagactctaacagtgagtacattctaagttatttgtctgggctggataattaaccttgtcagttgccactgtatatcagatgagcaaaagacagctttaaatttaaggtgcaattcataagttacatgtaagacatttaatatctacttgccctgaaactgaataatctaactctgatagaactatctttatgagttggaattgtttttaggttataaatcatcattgaatttataattgatactgcattcttgaacatgttatacatagttattcggggtagttgtgaaaaaatagttctttctaaagacttcttaaaaaaacattttaagtttcaaagaacaataaagttgactcttgataggccaatgtattttagaagttgtactgtagatctaaatttgaagcagagaatgttggcactgaaaggggcaaagaactcagctatttccacactctacattatatattaaggaatggtgtcttgggtgtattaagtaccctgtctgaggccattcagacaagactgctcaaatttacctctttaactcacactctggtgcttgctgagccatattacattgtcctctttcctagatgaaagttattattctggaatagattttcgggccatatacacacacacacacacatacacatatatatatacacacacacacacatatacacacacacatatctttatatagacacacatatatctatatacacacacacatatatatatgacattaacttaacaagccattaaagtttatcacatgcaaaacctacatcaacgataggttgtgttttatcttttaggctttctcagtttaatatattcagcttcagaatatataatcagcttcaagattgaggggagtatagtccttatgacttgtccagtctgtgttttgttttctgaaattatgatggcttccagcctgagtagaattgattttgtctcttgcttttcattcagacaagtcaattaacaggaatggtctatggatgtggactagacagaagattctaatttaatgctcagactgaaagaaaaatcattcgaatctttttattgatgctaagaaacctattatggtggtgtatccagtggaccaaaaactcagtctattacttaatccttttccacacacaaaaattttccagctacatgtgaaagtcagcagcaagataaaaacagactattttggctagatttttttttcctttgccatctactattacattaatttagataatggttttttccttcttttccttctagtatcaatgcaaaattgatactagaggagaatgtcctgttagtgctatacattctctggcctggagactggtgtgaacagggttgacctgtcttactctggtaagaaagtaatcaggaagtaccctgagagctcttggcaagccgggttcactttttcgacgtccttgctcttttccggttacagtgtctcactgtggaaatggcataactctgggcatcggctggtgtctagatggccaatagagggaacccaggaagtctggcccgtaatcactgaatatgttccctagaaagatgatgagtataaccatggggttctgtgcccttgtgaaaatgtcctggtacctttgccattgctttgagtggctttttaaaggtagcttcctttagacttggaggggaaggaattgagtacttttcatagaattttttcaagaaaaaccaattccatcaaattggctttagcaaattcacaagatgctaaccctcacgctctcagatctgagaatgccattattcgagttgctttccatgagatcttcctcttgcagaattctcacttccttcctaaaatgtccctctttccaaaaactaaaaaaaaaagaaatgttacggaaaagtgttttataaatacatataattggaggacattttgaaatgtaaattaacaagttgaagggatttaaataacaattattaaattttcatacatttaagaaggaaaagattgagatttatagctgtgatttgagaaaaaaggaaagagttcatgcccaccttctttgttgatctttccaatgactgtagagtacgcatgctgaaagaacacatgaacatttttctttggaaaccaagtccatatttgcataggttactatgggaggaaattaagaaataaaaagcgtaattaagggattaagttttatttctggaagaagtccgttggattcctaattaaccactaatattttgggatttagattatcgccagcccagcctttagcaattataatagcactgcatgatgcacaggacctttttaaaagtgtagcttttaaatccatgcactccataatatgtgagccaaaaacctcaggacttcccctttccaaaataatagcatatttatctcatggctacttactgttaggggctcttatcctctcaggagctaaggagaattcccggggcggcttaacccactaccatagatggggctccatcctctttcagctgtttgcaggccctagactttcactgttcaaggtaactggctctctctatacaattagttgaaaaaaaaaaaaatctctgcggtgaaggtcaaagagccctggaaataaggcaggcctggctcccgtccttgatgccccgtggtcaagtccctaatgctttgtgtgatcttagataagtcaattaccatctctgagttacttcagctttcaaatgagggggttgaacaagatgctatgtgggggttctttccagttccagaattcagactccattttcaagttgtgatcgggcggcggatgcagcatgaataagaattcagactccattttcaagttgtgatcaggcggcggatgcagcatggataagaattcagactccattttcaagttgtgatcaggcggcggatgcagcatggataagaattcagactccattttcaagttgtgatgaggcggcggatgcagcatggataagaattcagactccattttcaagttgtgatgcggcggatgcagcatggataagaattcagactccattttcaagttgtgatcgggcggcggatgcagcatggataagaattcagactccattttcaagttgtgatcgggcggcggatgcagcatggataagaattcagactccattttcaagttgtgatcgggcggcggatgcagcatggataagaattcagactccattttcaagttgtgatcgggcggcggatgcagcatggataagaattcagactccattttcaagttgtgatcgggcggcggatgcagcatggataaaagctggcgtacgtgatgtgactataaaatagtatggctgacgtttttgtcaacatgaagagtcagcttgtttagtttttagtgatacattttacactgggttgagtttgtacaatcaaagttaagctcacaggctcagtggcattcatgatcattagtgtgtcacatgttacttttaaacagctgccacagtttttagtttttttctctcattgtattagtatctaggcagtcaggatcaggttaactgtcaggatcaggtttctcttgtcaagtccacaatcttggatggagcttctagatagccaagtaatagatggtgatgcctgtcccagaacagacaccaagctccatccatctgccctccacactctttcctcccattctgccagaggagccctaggatgaaggggcttaggcatgggaagaatgctctgggagaacagatgagactgaaggatgggaaggagcagaaacaaaggacaggtggcgaataaggaaggaagagatctgccatttgtgactcttcttaaggtcacagcaagaagccagtggggtcatggacagctaccatgggacagctactccccagcagctctgcctccttttctgcctcaaggaagcagggagaaatgtccagagcacggaaatagctcttcccagccaagcaccactccccagcaagcgtccccacctggtttgctttcatggctggcatttgacacagcctgatttatagaaactgagaaagtgaccgttctcaaattccctcttaacttgggatgcctcaaattcaattaaaaggagatgaacacagagtgggaagaacttggagaaataataaattcatatgaatgagtttcagagtgtgagtcaatcctattcaaacaccttattctggcctttgctgtcgggaactttccaccacagcctggtaatagatagaactcttgcttttatttgttacgaagccatgccactgagaaacaaggtggtttaggaaaggggaaaggcactagacacctgaaggcaaaagggtgtgtcactgagaaggggacatattaaggggaatttgaagtcgtttaagctctttcaaatgtaacaatttggcctagtcccattttatcttaatctatgtgaactcagggaggtgtgcactatgacatatttcctgacctgctggctttcaaaggcatgtacctaggtggaaactccccacacccaccctaaaaacccctgccagttggagacttgggtttagcctcactttataaatgatgggcctctttgctcttatttcaggtttgattcatgtcagttttctgaaggcctcagtgtaatgcaagaggcgtacctgggcaccagaggtatagaatcaggcccacagtcctacctgcattataaggattagatgattgggtacacataaagcattttgactatgtctagcactcagcacatgcaaactctcatcattattgttcttgttattgttatcttcaataaagggcccaaatctcactcagccagcatggaaaagatgtttcccccattctgccaatgttaattctattgtttaaacaaatttttctgacatgggctgtcatttaaaccttttagatattgatgtacgctaagtggccttaataagaatggtagctgtcatttatattaatgggttgagaaaaaatatttaataccacattgtctcctcatgcgatctttggcaggtgttgtaggactcagatactaacttttagggacactttgaaaaaggtacattcttcttaattacaattatagcttcctctatccttaaatgaagctttgaatcctgtaggctctttgacatacttgctttttgtttgtgttaagtagaagtgtggctgccttgagatattacgtgggtaaccctaggctctgtctgcccttggcagtttctctacctgaccctttcacagactctaatgaaatttctatctgtcagaatagaatatgcacctttaccgttacataattttgcaatgacagtgctgtttatgttagcattgactctaatataagcagtgaaatattgtttggtttagcctctagcctagcatggaagaatggtgattttggttttaaaaaggttaaactgcatgtaaacactgtcattgctgccttttttactaacaaggtgaacttgagtcagaagatacttgaatctggttcacttagaactctattttgtcttataaatgaagagagtacttagcctgtagaataaatgttcttattgggggttgtaagcctttcccagttttaacggtgtcagcctggccattgtaatactcccaggaggcctggctcaaatgtctcctttcccaaggtcagtgcagaaagctctgctggtctcagagaggaggccatgcagattccctgtgccctgagtttacttctagcctaagaaggaagctgtcatttttttctcttcttctgctggtgccgtatctgttgacatttgtcagtgtgtgggtcaggctattgaaaacctctccttgaaggaaatggccatatttgtcctaagggaattttactgcttccttgatgggaaccagtggtgtcaagccctgagggctaaccccagctttggcctccatagcattcaggatgtttattagaggatgtccttgggatcaacacctgcagaagagaagaggaagaggcaagagcgtgcagagaaggcaagctggggtgcagcccatcaacagcctccactggccccagaaggaattggggaatcggaggggccttcagtgttgtctcccattggggcaggatgcaccagactttgatcctccttcacaattgcttattgggtgtcgggtgcctgggaagggtgtgacctcgggcgaggtggctctctgcgactcaggcaatcttagaaggggctgagagccaaagaccgtgtgttgacagtattcccagcctcctgggcagcaagtccctctttgaaggggacgttggttagggcacccagtgtccatcacagttcattcaccaaccacagaagaccatcataatggtagtttgggtgccactgagaacaccaagttggccaagttgggatcagcactcagaccacaagatctcttctgtaggattccagtatccgcgttgtggaaaatagattgaaaagcagcgcaagaagtgatacagaatataaaataattagtaggagagtttaacttaatgcaaaacatggaaacaaaaggaaaacaaaattttaaaataaatgacatttgtaacattaacatgctatagttacttggtgaaacaacagtacacaggtttagattttaaaggggggtgatttcattttgccctaatctgttgaatttggtaaatcttttgggtaagtctgtgttgaaagaagcagcatctacctttgaattgactgttctccatgcggtttttactttttaatgatggctgtttccagggacatgatttgactagtgttaacatctgagtccttctactgacgaatggttttatattgtgttctacaaatgctgagattcttttttttatattccagatattgatgaatgcagcaccattcctggaatctgtgaagggggtgaatgtacaaacacagtcagcagttacttttgcaaatgtccccctggtttttacacctctccagatggtaccagatgcataggtaggtttaatgacaaacagcatgcatggtttgtgtaagtcagttccataacaaacaactttctaaacaagcttgttaaggagcacatataatttatcaactgaggtaaaatgtacatttttggaaaaatgttaaacagttgactgccctcttaaagaacagaggcaccttgtggtcattttggagacgttttgcctcccataaaagagggatgatccaggagaccttacaggtatcttcagtctattaattaatgttgcagtcgtgcagcattaaaccttgaagccatcccaggtgtctctctctttttacccccaccttcagtcattccccagaacctatgttaatttggcctgaattttttcaataatctcttaattggtctccctgcttcttggcttctctacaatccatcttgtcagatttatcttcctaaaatagtgcttcgattaaataacactcttgctcaaaccctcggtagttttccattaggacttagaaattagtggttttcagtctgtgtccagtggatccttcaagtgtttcaaagccctccagggctgcagggattgcggagggcacagagaaaagggagagagctgagtggaaagggctcttgtccccccacactcccacacacattctaggcatagcaatttcactttatctgctgtgagtgttagacttccatgtcaggtatcaattaaatcaggggttctattgtttaaaaaatagatttggctgggcgcagtagctcacacctctaatcccagcactttgggaggccgaggcgggcagtttgcttcagtcaggtcaggagttcaagaccagcctggccaacatggtgaaaccctgtctctactaaaaatacaaaaatttgccaggcgtcgtggcgggtgcctgtaatcccagctactcaggaggctgaagcaggagaatcactggaagccaggacgtggaggttccagtgagctgagatcacgccactgcactccagcctgggcgatagaacgagacttcatctgaaaaaaaaaaaaaatagatttgacagctgctggatttaataattgttaagacttctttaaaagtgcagtgttctagattaaaattcaagttccaaagtgcacagtctgatatttaaggattttaagagagcttcaaactacatgaggattaagacatatttacatatcagatggttcacattttaaaagttactttctttttatcaaatgtatccatactaactttttacaaaggaggaatggaagggaactaagattcatggatcacagggtatgaggtgttttatgtaaattatctgacttgatgttcatttcacagcagtattgtagatgggaagcagctgagattgagagaggttagataaataatggcccaatagtttaagtgggtagtgagagagggatctgggattccaccgtgacctgagtgcacagcccagatttccctcattttgccttctacccctcaactctggatgcagttcactctttcttgccagatccctaggcaagccccgtttcttctttgcaactctgttgtgcccataattagacacttgtcatacaaaatgatccaagtgacctttctgccttctggtgctcctatttccctccatggtaagcaacagagacccccaaaattatccgtagtgatgagaaaatacaaatagcccctgacagtataaacaaatccaaggcttgttcgtaagacagttgtttggaatgagtaggtctcaccaatagaaaacctcctatgtagatagtggtatgcagtatcttccgtgcacatttcttctaaccgtaaaattccaactgtcacctgctgccaccacattctgagactctcagacctcccagccccgagctccctttgtgttctaagctcttttagtattattttatttcttgttctgtgatcttcctgtggcatttgtaatattgcctgtagggttgtctttttatattgttgtgttctctctcttcgactcctaggagtcataaagatgtcctttccctagtttgagcctcacaactcctaactcctggttgtacacaaccatgttcgtgacaggttaggagaagcctgttgacaggctagacgacctgcaaacgcctatttaatccataatatatttgctttgatataatgtgatttctgggtcctgagaataagggccaagtgattcaaaaggggagaaaagagtgagatttcctcctcctcttcgccagatgtcttggccagggcagatttaaaatggaaggtgtttgtggttccttctgtgtccctttatgtccccttagcttgagtcctgaaggtcttcaagttattctacagccaccccttaccctctgtacaaagtgacataccaccacaacggttcccccccccccccagccacccttggtgtggcactgctgcctaacgaagtgaaaaacttcaggctgctgtgtcctggaggtcatttactccaaatggtttccaattttcagttttttcttcctttacttattagcctgtaggttttcattaaaattataagttatataaatgtgtatttttaacaaaggtgcttcttcagcaaaaaaataaattagaaaaattattattatatgtgcaggtgccatctgtaaatcagggactgccagtaacccaaacttgatttgtaattttttttacccccaacattcaccattttgatcaagagtttgtgatccattgatttaacatataagtcagccagatgggcaataacatggtatcatagttgatttgcaaaataatagacattagcccattaagcttttgtcattggcaactgtaggccctagttttgctctgaaagatagcccatgctgaaaattatatgtacaaattccataatttggtcaagtgtttacactgggttttgaccaccgaattcatttgaagctgggatataagccagttttgaatatctcttcccattctgaacagtctttggtttccatgccccaaatatttactaattcccaagtatataaagtattagtggttttaaggcattacaaattagaatgtaggaagttcaatttctctgccctcttgacgggggaggtaccacctgaggcttcacagagagcatacttgtctatactccctctccagccgtttatcctggaccaggctggaataaaacttgttctgcctctttggtgaaactattagtctgaccagaggtacaggaactggaaccacaaaaaaattctggaaagcacatttatactggctagtggttttaagtacttttcggaaataatcttgtatcctttaaaactgacccataattttcttttatggtttgtctaggttggttttagtcttcttcacttgatgttaataatttaaatgtttctaaattagccttgtttttattttatttcattttattaatttattgaaacctcaagacatgagggctttgtgttcttaagaatgatgtagatgataacaattacaggtatgaccctctttgagaaaacttgaaatttaatattcagacttacaggaaacccagggatggatttttggctatgaaagatctttgctttacaaaaggatttaacccttatattcctttaaatcagtggtccccaacctttttggcacaagggactagttttgtggaagacaatttttccatggactgggagaagaggatggtttcaggatgattcaagtacattacatttattgtgcactttattatacacaataaagtgtattatattaaattaattaaattaatacacaatattaatttattatacacaataaagtgtattaaattaattaatacaagttaatattacatattaaattgtaatatgtaatgaagtaattatacaactcaccataatgtagatcaatggaagccctgagcttgttttcctgcaattagatggtcccatctgagggtgatgggagacattggcagatcatcaggcattagattctcattgggaacacacaacctagaaccctcgcatgcgcagttcacaatagggttcaccatcctatgagaatctagtgctgccactgatctgacagaggcagggctcaggcagtaatgccagcaatggggagtggctataaatacagatgaagcttcactcattcacctgccgctcaccccctgctgtacagcccagttcctaacacgccacagaccagaactggggattggggcccctgggggttagagacccctgctttaaataacaagcatattgacgatattatttgcttttcaaaatttaattttatatgatctctgtagagatatagtttacttgaagagaggtacaccctcagcacatgtcaggcagtaaaagtgttttgcattttgcttacctgccttcactgtttcgtggtaatatctcaaaggcatatggagaagttaggttttcctatgccacaaactctttccgtaacccagagctgcgctgcagtgtgtcggatgtcatgacaattagacatgatgtaacccaataaaagtgatatagaaatgcgtcttaccatgttgctttgagaagacactttctgccaaaaacaacaacaaaatccttctagagctattgtatcctataggactaagaacttggaatcaagggccattttgaagttataaataactagtaccttataaaatctgttagggccctaagacaaaaggaaatcttgattaataagcattggatctaaatgcaaagtgactcattcttcaaaaataacaacaacaacaacaaaaacttatgtctgactctcacagttgcagactggaaaataagaaagatcttttagaaatgtagactaaatgttgttttaaaatagatttacatattttcctaaaatggctcgaattaagcagtttgaaaccagggacaacccagtctctcttcagcatagagacatgtctttataaataataaactgtcactgctagtgattttcttagtctctcttttcctatggcacacatggttttaatcactcgttcccaccttgggtatggaatgtgggacttcagccaagtgcactagcacacaggggcaaaaggtgtgagaccagggatttctgactgagcactgttcctgtgcagcgctcgcagcttcccttccggggggcagaggtgtgagttaatcctgccgtagccccagtgtgaagtatggagctgctcgggcaggggagtgttgttacaagtattatctcagcgatgtgtgtgtgtgtatgtgtttctttgtcctcagatgttcgcccaggatactgttacacagctctgacaaacgggcgctgctctaaccagctgccacagtccataaccaaaatgcagtgctgctgtgatgccggccgatgctggtctccaggggtcactgtcgcccctgagatgtgtcccatcagagcaaccggtaagagcccttccagttatctgcagaatatcccatcccagccctcacaagcccagtggcaatgtgcatgatgcagatgtaatggaaacttgggtaaatgagtagtctccaggaaatataagagatgacgtccagggaaatttccctagaaaatgcacaggaaaaaaaaaggggtctgtacaaagagtactgttttcaggtactgctttttacttagctggcttattactactaaacagaaaccttttggggaagtacttattctcattttagtacttaatggctctcatggagtactcaaaagctcagtagagtaaaactcagctttcagaatttttcaggtaagttgttcaggagacacatttcctttttcctaacattggactctttccttcctgctaagtcctgcttgttttttttttccttcacagtatctcttttatctgtccatttttttgtttctattagaagcgtattttctctagtctggactgttccagtagtctcctaactagtctctgaaatccaccattgccatgtacctttcccaaagtatgagtcagtgaagttcagtttaaaaaattgtgtctaggggagaaaaaggagacaccttttgactaattgagcctatttcaaaacaccatgttgtacacaatgaatgcatacaatttttattcattagtttaaaaatacataactaaacaaatacataaatacagcacactttcgttagtcgagaaagatgtccaaaaatatttccccaggatgaactcaggcaatatttagtggccaattcactccatttcttgcaaagaacatttgctacttagcacagtatttagagtcccaaatctaatcccagttcatctttttaattcttgttctttatagtagtttaaattatatgattgagttttcattgcacccaatccgagcatttctgaattcaagttggcttttttttctaaaacttcttgccagttcaggctctttctccctactcctgccatccttgcctgttatatatcctcttttcttgttaaggatctgctcaaacatgacctaatccatgaatatcccgaggtacctgcagctggaagtgctcccttcttccttgtgctcctgtggttctggctggtactatcactatggcatgagtgccatatgtgtgttcacatcttgctcttttactggttgatcaatctcattaggaaatctcattcattattgtagtctcatatttctcatgctttttacacttccatagtatttagcaaaatcttgcttataggaggcattcaaatacagagagcaacttattaggcaacatctttcccaccaattgagcatatttcaaaacatcacgttgtgcacaatgaatatatacaatttttacttgtcaattaaaatactaatacataaataaacaaatacatagatgaagtttaccttcctgagtccagtaggggaccatttagtagatcactgtttagaagcacatgacttcctactaagacatggcttaggtaccaggagaatggcttttaaaatgcatatgttaacttaggaatcagcagctttgatgtggattccttcctgtgttgaggctttgaatagagaagaggactagagcaggtttaggtgcctgcaggaagacctactttgggacagttggagcagaagaccaggttcctgtgtgtggctttacagggagctgtcctcccaggtataccactgagagatgcacagccctcagaggccttgggcaaaacagatttatagagcaaaataacttgcaggtaggtttttgtttgtccaaatgttccagtactggtgctacagagatctgggctcttacagagagtgatgcaggaaggattttagattggccagcttttcactctttaaaaaataaatcagcatcatcttgggttaagtggagataggaaagatggacatcagcttaacaaaattagccccacgttgctgatcctgaatgtaaaggggcaatgagaagattactaaatctgtaaaaaataggaagaaatatcagattcagtctgatacagtttcctagagaggttaagatgaatttaatggcattcttaaagtaaaatacccacctaattagcagaaatgctgataagctattaaatttcttttatataaattcaaaaagtcttaaaaagaaaggccgaattggtacctacaaatgcttggaagcaaagtgagttccttaatgtaactgtcatttaataaaattaacacatagttaatgaattcctgttatgtgcaatttgcagggcaaggctgagagtgggaactagtcatgagttagagatgatccctgacttcacagactacacagtcttagtggtgggaatttggtgagagcaggttcccagggaatggtggatatggcacgtacagatgataaatctataggaagaatcactgttggttgacaaacaggattgagacatcttgagtcagggaagcatgaacaacatagaattcctttacaaatacattcaagtacgtcagtatctctgtaatttgaaattccagtgaaatcgtaattaaaatgctgtaagagaattatctgaaaacataaacttgacctgagatggaaatgtcaaatatgaatgaagaaattttagaaatggaccagaaagtaccaacagtactttcctatttaacctcatgtaaattggcagaatgtcccgtgaggttgaaatatgaatgcatttcagtaagacctattactgtctgaaaataagttaaattttagtctgtaaggaaaagaaaaatattagtctaatttctattaatggctgaaactagcatagaaggtatccatgagaaaatcactgtacaactgtgaaaataaaattaccaaaatcctagcaaaagaggaaaaaaatgaaatttaaaagtcacataggttacttatagaagggaactatgaaaaaacatggctatttgtaggcaacatgaaaataaataaaataaatacatccttggaaacctggatactgcttaaaaacacctttttggaagcccagaacaaatgtgtggaaacctaaagatgatttatttgataaagacctgacactgtgaaaaatagtaatcatcctaaaaatgtagaatcatagggaagcagatgatgaagtcaggatgtcctcattcagagggtcactatgcagcattcatacccgacccacaccccttggtgtttctcctcccttatgggccacttctccattgatattgctttcttttacgaatcagtattcttcagggttctgtctttgcactcccttctcttccccttccacaccactcttacatgagctcatccatccccatggctttgagtatcacctctctgtactgatgactctgaaactcacgtctagccttgattcgtctaagcttcacactgtcttttacaactgcgaagtgatagctccacttggatgtctgatatctcaaaactcctatgttcaaaatggaacttggtttctacccaccaaatctgctatcaccatgatttttcccgtccaggcaagggcaccaacattcacccaattgctcaaccagaaaactaggagtcattcttgacttcttgtgtcctgagctctgacacttactacttcactgagcactatacatttatctcaaaaatctacttcactgaacactacacatttatctctaaaatgtgcttcagatttgtccacttctgtccgattcaatcactgactcccccatccggacatcatcatctcccccttggtcttctgcaacagccttgcctccccgcagtaatgttcttcatatgttgtaattgtaagcatgatcttctgaaaatggtcatctgatcatgtcccacccccgttgaagacatccagtggttttgcactgcgcataaaataaaattcaaattttttaatgtattctgtagagccctgtggaatccacaggtgggactggatggagaaagtagtacttttatgttttccatgaggtgaattttgatacagataaagactctgaggttttgggaggaacatggttttggatttgaattattgttccagagtggttgctgctgcaggtattaaaaatgggaatccagtcagttggttctttttcttttctccagttgacctgtgaattttgaggatcaattttattcaaaaatatctttaaaaaaataaggatgacttctgtgggcctatgatcataagctacagctcagctgttgtgttttgttttgttgtgtttttctagaggatttcaacaagctgtgctctgttcctatggtaattcctgggagaccagaatatcctcccccaccccttggccccattcctccagttctccctgttcctcctggctttcctcctggacctcaaattccggtccctcgaccaccagtggaatatctgtatccatctcgggagccaccaagtaagaattcaaaaatcatctagttatttttcttgcattgttcaagttaacatttttttattatttatttatgctactttagtcattaaataagtttgtaaattgttatattaatttttggtttacataatgttatctatatctatatcatatgtatgtctcaattttcctattgcatagagaaaaacgggaggcttcctattctccagagattaatgtccttttgttattggtgttttcaggcaactatgggagagttatgggcgatagttaaatctgattcacagaaaggattaatagaggaggtataatattagactttaggttacagagcttgcaaggcagttttataagtagttcaataccaatatctctctgcctttgttatttctgcaaactagaggtttgagagtgaggtggtgaagagggcagagaaaagcaggctgcagctgggttgtgagctccccagtgctcacagtgcaatgtgatctctgttggcagggtggaaatatgctctgttgtcaccagacgacctttgcccaaagagtatcctctttcctttctgattcaacatcttgttcattattgtcagattaagtactgatgaaagataccatagttaaaataattttaatggggcttaatgttcttctaggggtgctgccagtaaacgttactgattactgccagttggtccgctatctctgtcaaaatggacgctgcattccaactcctgggagttgccggtgtgagtgcaacaaagggttccagctggacctccgtggggagtgtattggtacgtgatccatcctaggttggcaccaagggtctgttgtaattctgttccttgactctactggttttctattgctgctgtaacaacttaccccaaacttggtggcttaatacaatacaaatttaaattatctttcagctctgtaggttagtagtccaacagaagtcttactgggctaacatccaggtgttgggagggctgtcttccttttggtggctcttgggaggaatccatctctttgcctttttcagctactagcagctgcctgtgtccttagctcatgaccccttcctccattttcaaagccagcagtgttgcatcttcaaatctctttgtctctctctggctctctcttgcaattccctcttccacatttaaggatatttgtgactgcatttggccacctgtataatccaggagactctccatctcaagatcactgattagctaccttaattccatctacaactttaattctcctttgctagctaaacatatccataggttctgggaattaagacatgagcatatttgggaggtcattattctgcctattaaagttacttttaactttcattgtaaaagatactcaaatcatttctggtaactccaatttaagacaccctaccaaaagccctaccattaaaagaaagcgttaaaaatatccccaaattatggaattttgcacattatactagtctaaatgtgtagcttaccaactctcttagactagttattttaaatggaagaaagaaagtttaaattgctgatgaggcatttaagctggtgaagggaggaaatgtaatgaaagaataatcaatttttggattggataagaacactcagctcctatcaacttgtttttaaaataagttcacctcttagttctgttatgaattctacttttataattataaatttatgatttgtcagaaatgatgagttcttactttcccaaactatttaatttcctgatgatatgaacaccccttctagaggtcatccagagctgagtagaagtgggaacatctaactcagggttgcggaatgtgaggtcaaatctgtatctggcactaagaagcatgtggacaagtgggttatctttgctaaattttagcttcctcttgtttacaagtagggtcatataaaccagtttatctctaaatgtactgataattctaagtgactgtaaaactagtgtgagcctgtgtattgaacacatctggggatgggggagactctgtggtgattgagaactgccctttaaacaacagttgcttcatgttttgttctaacattttagtggaactcagcagggaatgcttggatatggttagaccttctttttattggaaaaaaacagagcttcaagagatactcggaatcctatccagaagccacttctgaaatgttagtctgtttggtcctcttagatcagactcaaggaagaaaaaatgtttattagatcagattgttgagttgctacatgtttggaatttttctctgcaaaatgacacatgaaaataatacactttaactgctcaaccagtcttcaaatggctaatgacatattgtagtggaaagaaaaaagatccttttattatgttatttatttctcaaaaggaaaatgttttatatgtataaaaggaacccagaaagtcttagaattatgaggtattgctatgtaattttgcactaaaatacattgtgctttgcagatgttgatgaatgtgagaaaaacccctgtgctggtggtgagtgtattaacaaccagggttcgtacacctgtcagtgccgagctggatatcagagcacactcacgcggacagaatgccgaggtatggtcctggctcctgacgtggaatgtgggacatatatgctaactgggggttggcttcaaaggagttccatggagtttaaataacccatgccggaagagactaatacagtcccgtggcttttttgaacttagttccacctattgtcattctgaaagacagtgtcataaaatctggcaagcattgaagttattttataagatgcgtctatgcctgaaggaaaatcttattttcagtattgttgtctcgtcactattattgcctcttaagttttcatctgagaagtagagagtggaattgtcctttatgacacagcaactgaggaaaatttcagttgaaattatgtgcaattaatttcttaatggaaagttctaaaagatagggatgtcactctaagcccttgctgctttttagtgtggtcagcaacagcatctcctagagctgcttggaaaggcagaatctcaggttccaccacagacatactattgcagaatctatattttaacaagatcccccagcaatctgtatgtacattgaagtttgagaagcactgctataaatgtcccctcataaaaaatttcccatcaggtttattaactaatttattaagccacccaatatgccttttattaaatgactcttatgtactgagtttctaaaacagaaataaataagatacaatgatcactgtcagggagcccaaacatctatctccatctctatctctaaattaagcacaaaatgaactgtatcattaattcagtaaagacagaaaaaaaaaacaggcaaatactctgttaaagttaaataaaagggcccatcaatgatagactggataaagaaaatgtagtacatgtacaccatggaatattatgcagccataaaaaagaatgagatcatgtccgttgcagggacatggatggagccggaggtcattataattagtaaactaacataggaacagaaaaccaaatactgcatgttctcacttttaagtgggagctaaatggtgacacatggacacatagaagggaccaacacacaccggggcctattggagggtggagggttggaggagggagaggatcaggaaaaataaccaatgggtagtaggcttaatacctgggtaatgaaataatctgtacaacaaacccccatgacagaagtttacctatttaacaaacctgcacatgtatccctaaacttaaaagttttttaaaagttaagtaaaagatagcgaggtttatatcactttagaaaattggtagccattgacaagagttaatcttatttgcctcttttagcaaaagctcttcatgagttgaagacatatagaagttttaatttttatcagtgaactggcttcaaaatttatgaattttgttctcacgtagagatttcttgccaccagtgtattttagtgcactacatataaatgaccattttaagcagaaaaaaactggagcaaggactttgaactcactaacatttctattaattagttataaatatggataggttgaacacgtaactgagttgagaaccttcttaatattatgactattgtttaatataattaacatgtacaaatagcatactaggcattttgcaataacagaaaataaaatgaaatcaatgtccagagactgcactgttaaataagcaaagagaggtggttattgagagcactcagctggggcaaggaccagccagtataaactcatgtatgtggttgttatcaatctgagacttagtattggagactgaggatgacctgaatacttaaagcactgccttctttaagagctagcactaaggttatcctgaaaataagaagttgagaacgtgctcacattattttgctgatgaaagttgccacagaatggtccaaaaggctgtgcacataactgggaagtaagtgaggggccgagtagaaggggatagaaggatgggcagaaacacagtagaggagaactttgaatgacaagctttaaatttgtcttatagggcaatggggaaccccatgacattctgaaattgaggaagagagaaaaatatgaactttttatcctgtttattttaaccttgggcctcaaaaaattatgggatccttaaaaaaaaaaagtctgctcaagaatatgtggtttttaccatttttttttgagtgtggagcaagtctgatttttagcaaggattaagaaataaacgagagagaaaaagatcgtaggttgttggcacaaagatcagacagaagaaaagcccagactgcctcagctcgtccaatgacttgtgtggaaaccactgcaggatctgcccagaaagaaagtgcatctgagggccaaccacaagacaccacacagacacagggtaaacagtcagagtaactgacatgccatgaacgcacgtgctcattgttcaggggatatttagggcacttatactcagacaaatgtgacctcaactctgcatagataggaatgctcgcatccaactccacatagtttcttggtccctgtcttctgggaataagccctggaagtgattgtgtgcctgtgtagacaaagaggtttgtgttcatcctctttgatgtttatccaggtttgtagcttctagaaactgagagaaacagataatccagggaaccatgctatccactttgggtagattgttaatatttaagggagaaatcagatacaggttgtttcagttattgttattttaacacttccgtgtcaagctctgttgtgtaccttggcataatattaaccacaatagaaaaaaaggaaaaataccctcatagaatcaatattttatttggttggtagaatactcataaagttgttttttaaaagactaagaatctatcagcagtaaccctgcacgtaaaccagaattggtataaggaagatggacattttagagatgtgattgacggttttcaggcagaattaaggtgattgtttaaaaaaatagcatatgttgtattgttctgagatagctataaaatatgtcttttaaaattatatgtttaaagatgccagccaaatttcagtataaatagtgatttatactggttaaatagatgtgcttggaaaatggtgaagaagaatctattttgtttacagacttcggatttaaggagtcttattagaaattagagttacatctaatgccattatacaggttttttatcatgtcttttcaactctgataaccctaaatatcacattatttgataaccaatttatgttggagaatattattaagtaattaaaaccaaaagccaagatcatgagtttgcaaatggagggagggggaaataaaataattttaactcccctaaataaagctatttcttctttttaaactttgattttagacattgatgagtgtttacagaatggccggatctgcaataatggacgctgcatcaacacagatggcagttttcattgcgtgtgtaatgcgggctttcatgttacacgagatgggaagaactgtgaaggtaataatagtatactaatgttagtcctctccttccattgcagtttcaatatcaggggtctttaacaagaccaaataatgagtgaaatgtcaaagtatcaaatatgttttatatattttatctcaaaaggaagcctaattttccatgatattcatttcttaatttacatttgtgtgaatcaaataacattttaatatgctaggagagcttgccatttaaagatccctggtgtgatgaaacttctgtggcacaatttcatactttctaattttttacaatcagaatttgtacattttttaaaaataggacacacctaagtctgtgtattatctagccgtttataatctttttgtttaaagtgtctgcctagtaataaaatgctactaatcagtatctgaaatatatatctaaaatagatataatgtaaaaatacatgttatgtatattttctatatatgtaatatgtgtatatatattatgtatatatgtatttctgaatatgtaatagataatattcataaaatacatatttaaatataaataatatatatctaaaatataaataatatatatttaaaatacattatatatgtctaatatatatattatatatatctaaaatatgtatatataataaatcactttggtctttctaaagcctgtaagtgaaaacactgtgtctaaaagagcaagtgcctcccaagacagctttaatatcaaataaaataacatagtgatgaatttaaagaaccatccccaatgtttaagggatcttaaaggttcactgccacagctataatccatagttgagccatgtattctaaaagtccactttttacctgcccctatttaaaattgcttcaaactacaagttatcttctggttttcatctttaaaagaattaggatgtagcctaaatacatttcaaattccactaatcttagttttgacttatgttcatattcagagcattagaagtaatatgaatctgtgaaataaatatacccactaggctattagcacatttttcagtttgtaaactattattcctaaaaaggatcctgataacttctatggagtcaaattttataaatagatatacctatacatctagccctagagtttgcatgcacatgccaaaactcaagaacttgagatatgtatttcatatgtcccatcttctccttccttagatgatcttatttggatgaaagttagccttaggctgtaataacaaaaagaaagaaatacgaagaaacagaattattttcatccagattggtttccttcgtaagcttactcttctggtcataagaaaatgtatgttttgtattttcagatatggatgaatgcagcataaggaacatgtgccttaatggaatgtgtatcaatgaagatggcagttttaaatgtatttgcaaacctggattccagctggcatcagatggacgttattgcaaaggttcgtgctataaaaccctagatcatgttcttcacgtgccttttctcctccttatgttgtttagaggtactacctttctttactgattctccccacttaaagtaccttgaattttggtttgggaaacctgactgaaactccttcttaaatccagccatccaaagagctacagtttatgcccagaagactattgttatttcagaaagggtatttgaggtcttctcaaaggagtcaaaagctatgtagcaaataaataatccaaactgcctattggtcttccaacagatgtgggcattgttctcaagaagctgagttctacctcttctttccagttagggaataatggtggttaggcttcttggtggctgttatttgccacctcttacatctttacctggacagaatagtgtagactgttatttgcaatgatctcttcctcataatttcctctaggcatcttaagacacagaaattttttttaaggataatttatttcggctttatcaagttacataagcaagaagggaaacaggattaagcagaataaataaacaaccaagaaccatttttttagtttggtaaaccattttgaaataatctcattgccccaggtatcgaagcaaaaatgaggatttttatttttgctgttgagaattggggtcctaagaaaagttactggagacaaatttgtgcttagtgtctcctgtcttatgtagggatcagtgattactgcacttggtccaggatctgagttggaaccagacttcttaaagaacctcatactcaaagcaggtccagaaaatctgctaaaatgctgcacttagagcttctgggcatagtttcagatgcagaagtgtagagggtcaagctattcaaggtagaggaaagcagaataaagtcctatggtgcctcttctctgtgtgcccctagtggacagctttggtaaacgtgttatggaagaaagccttgtattaagtccttggcaagatgtgcattttctccaggcttaaaagaacttcaagcccttggttgtttacctacattctctatgaccttcacatcaatggctcttaatattgtgcaaacctgtcttcccagcaagagaaaacagttgggtgtttcaaatttgaaggaggaaggtggtttctgtacttttgagccctgtgctaggaggaacttatatgagaagacaggattaacacatagaaatattctacagtgtaaaatagcataaaacaaagtgccaaattgtgcaaatttagcactgtacaagtaaaaaagaaaagggaagagaatgattgctggaatatttggaattaggcttccaaaaaaaaataatagaaagagatatgaaagcccctttgtgagcagacctaggagaatacataatcttcttgatgatacacagagcacactaagattcactcttcatgcctctaggctcctgctgacccaggccacagcgtcccaacattaagtatggccaatagataatgctgtgacctcatagatgaaaccaggtttggcaaccattggcaaccagtgaaatagtatcctatcaataaattggttgttctattaatttgaaagtgctgatgatatggatggtttgttctgactttagcattctggcttaaggatctgagagagagagagagagagctccacagctctgtattattatcaatgtcttatttttttctagcttatagagcatagagtacacacactgtaataagactaaaggatgaaaaaagaaattaatcccatgtatactggatttcttcctttttataatttttgtctttatgccatagggtaagattttctcctagccctgagcacttagttctgagcccacaaagatgtgactgttcaaagctgaatcatcaatgctaattcagtctccacagttaactcatctgatcaacaacatggcttctctgttcactctctgaaagttgaagccactaactttgaccaaggttacctccctttggatctaccttacatctccgttcttattaaaaaccctttgtgttacctttcaggttgtagtctccacgttttgctgtgtgtcacaatttgaataaaaagttgaccagaataactaaccaatttgagttcctgtatttaaatataactgctgtttcaaatacaatctgtacacagaaccttggaccacccgaatatattttgtgccaaacaacacaagctaagtaaaacacgaaggtgttttactctcaatttgcctttttaaggtcaggagaaagttaatagtcccatacactagttgtatattataaaaggagttgttataaaatcatttgcttttttctttttctttttttttctaagacacagtctcactctgtctcccaggctggatggagtgcagtggcacaatctcagctcactgcaacctctgcttcctgggttcaagtaattcttgcgcctcagcctcccaagttgctgggattatagccgcatgccatcatgcccagctgatttttgtatttttagtagagatggagtttccccatgttggccaggctgatcttgaactcctggcctcaagtgatctgcccaccttagcctcccaaagtgctgggatcacaagtgtgagccactgcacctggcctaaaatcatttacttctaagtgttgtatgttttccaaaccacaattttggtgccttttgtacttccccatattaaggggggaaaaaaccctctgctattattaatatgtgtccgataaagtcttttaccagacctccttaagtatacacataaaataccataaagtgtttgtaaagtttaagaaagatttttctttgctgggttccaactgcatacagtgctgttattggccaagaatggtcatgaaaataatctatattcattttctgttctttttctgtggtgttccatcaaggctttagttgtatatcctttaattttaggcgaattttcccagagagccaagacatgggtgatactagaagtgatgccagtctgggtgatgaataccaaaaggaaagtcttcctgtagtttactattaccctagatttctgagagccctggaagagctaccctggttatacatttcacaaaaccctttgtcttttagcagccattgttctccttcctctgattctgtttttgcctttgtgattattttggatacaaaaatctcttgggagaatatattaaagttactttttatggaaaataagttccaacagttgatttctcttgattttgttactgttctttcaaaggaaaatgagaatgccatttgagcttttgttgctgatgctgcatattatttcctatcttccccattttcaagggttaaaacataattgtcaacatgttataattttagataaatgtcacttcatttttaataagtgcctttctctgccacagacattaacgagtgtgaaacccctgggatctgcatgaatgggcgttgcgtcaacactgatggctcctacagatgtgaatgcttccctggactggctgtgggtctggatggccgtgtgtgtgttggtaagaaaacatcatggctaaccttatgagagaggttcagcctctgtcactcaataaagcccaatggtaacaaacgctctctactgtagcagataagatataaagaatatttgcagagcaacaaaccaacagggtcagttctctttttgtgtaaattgaacattaatttgaggattagaaagatgagctaagtgaaaagcaagggaatccccacctatccttcccccttttcttccctaatcccgtagctgtcttcagttttctccaggcctcctttgttgatattggtcattgaaattgatgtgcatatgctattatctcatgatgaacattttaatagagaattgatgtccatgggcagtatagaatgcaaaggagaatatggataatccagaaacctgtatgatagtagttttatgaggctttataaaaagtatgagacttgttgaaaaattgataccaattttatccagattatttttaagaaaggtactcagtaagccatttgaattggaaaaggatagggcatagcaggagactgtcttcctggtggtaaagataacacagcttagttgaccaacatctacatatttatataacgaaccttttacagattaaactttctcctttttggaaagtatacctaattcagacattcagtaattgcgtgtttattttgggataggccgcatttctaataaaggtcttatttagcaggatgtgagattcaacattcatccatcattaattcaacatttattaagtgcctgctctgcacaggcccgagaaagacaaaataagtgagatataattccagcattgaagggcctcacattttagtaaaccatgatactccctagaaaactgaagcaatctggccattggtttccagtgcttagaagctgaacgtgttttgtttttctgtttttgtttattttttcttcaaatggagccccgatatcagaggcattccctgtgagttacaccagggatgatggataaataaagccctcttcaactttgacttggggggttctcatctgtttgaagtgacagtgtgatgacagatgcttcttcctgtttagacacacacatgcggagcacatgctatggtggatacaagagaggccagtgtatcaaacctttgtttggtgctgtcactaaatctgaatgctgttgcgccagcactgagtatgcatttggggaaccttgccagccgtgtcctgcacagaattcaggtatgtggtatcatggagatgccctcgtactgccagccttctgccaccattgaggtctttgcatttgtggaattcacagggaagatgacattttgctctccaggtacgccatgtgccttcttggggtcttggcagaggccagccagtgtctagtcacaggtacttatctaagcctcataattatttggaataggcattgcatttgtgcctctcgtataaactctcctacctcaataatactcaagctgtttgcaatacatgcaccttgccttgttttctaaagttgtttcatgatgtttgcattttgcagaaactattataaaagcagacttttacacagcgtaaaagtaaataactgtcatattacttgactatttccactagctttccaaaaggccatttgtaaattttgtttacatcccacgtattgattttggtgtggttttctttttctttcttcttcttcttcttcttttttttttttttttttgagatggagtctcgccctgttgcccaggctggagtgcagtggcgcgatctcagctcactgccacctccgcctcccgggttcaagtgattctctgcctcaaactcctgagtagctgggattacacgtgtgcgccaccacgcccggctaatttttgtatttttagtagagacgaggtttcaccatattggccaggctggtcttgaactcctgacctcgtgatccacctgcctcggcctcccaaagtgctgggattacaggtgtgagccaccgcgcccggaccggtgtggttttctttaatgatttgatttaacctgagagaaaaaactatttttctccagttgaagtgacatggcctaatgaaaagagaactggatagcgagtcagaattctcttcctccatcaacaggcagccaaattacttaatcaggggatttagttatttgtgtattttgcttatttctgaattttcctcacctacttttcaaaaggatttgaggtggcttatattaataaacataattataaaatagaataatgcagacaagctatccttagacacttcatctacaaaatgagttgccttagataatccaaaaggtcctgtccagttgtaaattatttctatttataaaacaagaatagattactgaaattaaaacaatgttctgccagtatttaaacacaattttaaggtagcttggcagtggacctctaatgtcctaaaataaagttagacctaatattgaaaatatgtagctctggttggttgtttttacatataggatttagtcagtttatttctgccctaaaggaaacaaattaaagagtaaatcataattttaaaagatttgttattttaaaaatgatagtatttgaaagtaacagttggaaattaaaatacactatgaaaagttagagaaagttaaatggaagactttaaaagaaatggggggccaggcatggtgcctcacacctgtaatcccagcactatgggaggccaaggcaggtgtatcacttgaggttaggagttcaagaccagcttggctgacatggtgaaatctcatctctactaaaaatacaaacgaacaaacaaacaaacaaaaagtcatgcgtggtggtgcgcgcctataaccccagctactcgggaggctgaggcaggagaatcacttgaatccaggaggtggaggtttcagtgagccaagatagcaccactgttctccagcgtgggtgacagagcgagactctgtctcaataaagaaagaaaaaggaaatgagggatgcctatttaaagaaaaaaactgctctggctaatgacttcacccggtgaataatatagaaattatcattttatgtatgatcaccaatcagttcaatatgtgtttataatacttttattatatacaaataccattctgttgaagacatttgcctataactttatagttgtatattattaatatcatccttttgtgtgttactttaacttttcaaagtactttacttacctactttgaatttgcaatacagacaagtatcatgaaagctggcacacaagagtacaggtgacttgttcacatgttgaatgattggaagagccaagatttagaatccaggaaccttggtgcatatagttatttgcctttgtattttcctctggaccaagtgcacttccaaagaattcttaaaatccacagggaaattatgtgggtttataaaaaggtgaccaaaagaccagatttctttaagcagttgtcttagtccagtttttgttgcagtaacagaaaaccacagattgagtaatttataaagaaaatgcattaatttctcccagttctggagcctgggaagtccaatatcaaggtgccagcatctgtggggggccttcttgccaagtcacttcacagctgaaagtggaagggcaacagagcatgcaggagtgagagaaagctagagaggactgaatgtgcttttataacaaagtcactctcatgataactaactcactcccataataatgacattaatccattcatgagggtagagccttcacgacctaatcacctcttattaggcctcacctcccagcattactattgaattggggatgaagtttccagcacatgaactttggaggacacattcaaaccaaagcaacagtaaagcttaaagagagttaaatgtaaggcccggttccactaacttttgtcttatatttgaatgaatttacccaaaaaagggtccacacatggaagtagtttcattcatttggtttctccacctctttggtcatgaaccatccgaatgtaggatatccctcatttcaagaatggggggtaggctgtttaaagtactgaaaatattcaaaaggaatgtcttcagtcagttgagggagagactccaaatatacaaaatctgaagttcatctttgtggtctgcaagtcaggcaagctacatatgaagctgtttctcactggttgctggagctgattcacattgttcagcaagccctcttgtgtcctcagccttctgacaatgacatttcacagacatggatcagttaaacccacgggagtgtaattggtcagttaaacccacaggagggtaattcggggggattttctcatggatccctcatgtcactgtctccatggcactacgcggagttagctcatcaacacctacccctcactatgtgtttataatacttttatttacttatttttttattcagggcctgagctgtgcacagtacacgttcaatcattaaacatgtaatgttaattctgtacagccaccaggtgaaatgggagttgtcattccaaatttatgggagaagaaactaacagaggaaaagggctgcttccaaaactcccagcaattagcgttgtcatcggtattaaaacccatgcttatttgaactcactacaaaaaatggtctagtaccagatcctgcctaaatggaaaacaatggtgacaataatttgcttccatttaggccaaacatcagcaaaattgtcattatctctaaaagtcctttttataaaactggtatgattttggttttcttgttttattacttacagtatttcatgcatattttagctttttgctgatacagcagaataaaaaagatgaatttctttttgttcccacacctggctttcaaacacaccttcccatctgttgtttttttgaccccttctaagatggtttgaaaattaaatcatcactgctttctcaaattcacatttgttagaagacatgataatctttggttgtataactcatttacctccaatgtcatcaggatgcaattctctggcatgcaggggataggaactatttgcttcagcagtgaggtgcagtcagcctctacaataagccccagccctgatatccagttctccttccacttaagcacagatgatttacatatgaccatgagactgtgtttgccagaaaccattggcaacttaaggggacactagtttcctttccttggatagtgtgattccagttagttctacattttcatcattcactcttatgttaagtattgttggaattgtatataaaacatggtattaattttaagaaatagaaatttgattctatctcaaatttggggacatattctttatacttcagttttttcaatatgatctcacagttttaacattaagcaatactttctctatggatataccatagagaatgaatccagtatcctgatacatattaactttaaaaatacacttaaatgcaagagtaggtattctgttgttgctcttgtgagaggaggctagagaatttgcagagagaaatgaggaaatgttaagaaccaattgtactgaaaaaacagctagcactgagaaacaaaattatccccaagatggtgggagaaagttttattaacagttaagaaaccacattttaacaggcacatttcaccgtaagtgtaaagtgttccctggtgaacaaaatcaagttataggaaaaacaccttttccgaaagggctttgcacaaggaattgctataacttgcctgtatccttaaaagttgttttccttgatgatgtgtagcctttaaaatgggagcctggtgtaaaggtgactccctggggagatacctccttttccgttaccacttaagtttggttctactcactttggaggaaatgatgtgtgcaaaaccaagggcaggatctacctgttctgcaaacaagggaatcatttactatctgttaatttattgcagcggaatatcaggcactctgcagcagtgggccaggaatgacgtcagcaggcagtggtaaggattcctttcaaaatttactaccttcagtatgtgcagaggcagcatcaggctttcttgtgggtttccagttgatccctttacactagtctggcctgactccctctctggccatcactgtgccatgtatctgggatgctcagaagccttcagtggcagagcagccggggcactgtgggctctaggatttctgggtgtggctgtgggacttggccactgagggggtcaggtgctctctcagtgtggttgatgggtgctcgcagatgatgtgtaatgacttttgttgctcatgcttgagaaggggcagcctgactctcttgtggatcttccactatcaagtaccactcgggatgatgggctagttgaaccattctccatctgcattctgaaggattctgaactgttaagtgctcagtattataaaatggcaatagagagcagtgacaacaattaactgagttaaaagagaatgaaatatttagctagagaaatattggtgccatgcaaggaattaaagttaaaaaggagaattggaacaagtatgacaataggtgacaagaaagaggaagggattattttattaatataaagctacatagtttgattcagggagatctgaaagaacatggactggctgaattgattgtcagttcattcagtatgattagtttcatcattgtgcgtgaatgaaaatgtggaggggatatttagaggaggaaagaggagaggtaaggaaacttataacgaataaggagttaatggggaataagtaagttgtgatagggacttggaagaaaaaaaaaaagtcaaccctaatttatagaagagtcaggcaccaggatttgagactatccattcactggttgtcattctgcacctgccttgactatgagattccctcctcagttgtgagggtacagaagagggagggccccacctcaggtgggcagagcaacggaggctttttcagagcatgtggtgttggagctggcttttgacctgtaaataggcctgctccaagcattcctgacacagagtgaagagggcattatatgttcatagaagagtgtgaagtctgggataagtaaacaaagaatttatattttagttttatcttgaggatattgttgaacctatgaaagtttgaaccatgagaacgatataataccttgtttttaggatggtaagaatggttgcagtgtagagtagtgcagggtagatggaagaaagaggggctggtggtagggagaccagttgtcgggacttgggatctgctgtcgatccatttttccatcttggtgcttggactaggagaagtccaggaggtctccttcagcttgattaaggattggttatcttgtagttccagctgagatgcaaagttcctctcaggaacttgtgggagaaagattggactcagaatatcttacagtgagaaaaagagacagagtgttctctttccagtgaaatcgatttttttcctcctgtagctcctaaggtcattacatttattgtagtgttatatttttaacaattcattcagtatttattttataatcttaattgattttgaccttttttgtggtgcagatataaatgaatgtgcactagatcctgatatttgcccaaatggaatctgtgaaaaccttcgtgggacctataaatgtatatgcaattcaggatatgaagtggattcaactgggaaaaactgcgttggtgagaagttttacccattttctgaaacattgcctgcataatgcattccttctttcattgctgggagaaaactgcctttgagtagcttagaggactgggcaaatggacactttatacttcggatgttagcacagcatatacatatctttagtaacaaaaatttacatcactgaatcttcacagtttatgaataacgatgtatcagattcactccttgaaatgatttgctccttaaaataatgatgtatcagatttcactccttcaaagagaagctccttagatataagatgcagagattctgagccattctcatgtgactacaaagtcaaccttgattttactgagagagaagcagctcttctcccaaccatttattagacttaatcagaaaaaaacacagcttattttcaggaatacctgctctcttaaagttgggttttgcttcagacaggcatattattcagctaaaagcaagcagttttcctgaggtccctgaatcatgaagctaaattccccatgacaatcataaatgctacagattactttgtactttataatcatacctggagacaatttgaattattataaggaagaaacacccattctggaactaacacatttcaaagttggaccatactttctaaatatttatttagttccttaaatcaataaggttaatccttttaattcgacaaaatgaattaaattatataaatttaattatataatgtaactctataaagattaatgatttccagcaaatctgtattttcttcctgctaaagaaataagtgaattaaatagcctagtgactttaggctttgtagatatttagtttagatacttagtttaaaaccaggtcaagcctctgttttcctaaaatgagatagtttaggtaaaagctaatgctacaggagttttgcctttttgcttgaattgatcacgtcgttatgactttaaagatctaatgtaaaagagcaaagtagatacaggcaaagtttgggccctttttaagtgtttattttcattgactttgcagatattaatgaatgtgtactgaacagtctcctttgtgacaatggacaatgtagaaatactcctggaagttttgtctgtacctgccccaagggatttatctacaaacctgatctaaaaacatgtgaaggtaaaccatatttttgttcttatactgtgtactttgctatcttttggaatgccattagaaaaccataagactgaattagagtctcctgtattttagacagttatgccagtttagttgaaattctgtggttctacatggcactagtatgtactttgtaagccacttatggtatttacttgtaattggcattttaattgccatcatttaatagataaagaaaatgttatgtgtctgctatttgagctattcattcagaaatcacatacacatttactccagattttctaaataaaaagattcagccaagtcccgtattctatactatagagatgtactagtctatactatagagttattattttggcattccatctagtgtaggaaaaactatttagcccagctttactgtgtgggattaaggatatgtagtagcaattggggtcaaagttgaagtactcttttaggcccaagactagattttagcagtaatgtagacctgtttttgtttcagacattgatgaatgcgaatcaagtccttgcattaatggagtctgcaagaacagcccaggctcttttatttgtgaatgttcttctgaaagtactttggatccaacaaaaaccatctgcataggtatttatctttctgagaatgatttttctatgtttatcaatgttgttatacttaatgtcagcttttcctgcaaaagaatttaagtatggatgaacaatattaaaaacttcattattccttgtttcaaatgctatttttgtctataattccaaggtgtatgtttgaatttttatatagattctattaaatattattccctcctctgcagaaaccatcaagggcacttgctggcagactgtcattgatgggcgatgtgagatcaacatcaatggagccaccttaaagtcccagtgctgctcctccctcggtgctgcgtggggaagcccgtgcaccctatgccaagttggtaagagaaacccatgctgtggttcctataccactccaatggtctttgcataaaaaggggaagcctagtatttcatttatctaggctcacatgagaattttcaaagatttaatcctgatggccccgaacatattgctgaatgggaaataagaagtgtcaaattttatgtgattttgttcatttattattttctatcttcacattgtaatgtggttagtttgtgttgcttccctggagcaccagtgcctgccagctctcttgggaaccttgtggttaggggttctgagctttttataggtacagattatctttcaaaaagctaattgatgtaaagaaaccggtattcatgactaaacttcataagggtttctggtgaacttctaaatctgttgggaacttgaggtttgagaaccttgctcatggttttgctgatttaatgtttaaatatataaatgtgtaaatttatgtgaatgctggaggccatgagatctccaaattatagacttgagttttctatattcaggttaaagtaattctatagtgtgattcctattttcaggtgaacagcaagagagaaagctaccttcagtttccctcttagctatcactttaacatgatctatagggcacgtctgtgtcttttggagtatcttagtggaattgagctttatttgaggagacatttcattactgttcttcctcacctatgcaatcgcagaaacattttgttatctcatacttatagcaacacaatctacttcatgttccaggtcatctttcatgtttcttacactatgtcagaactgcaaagtctggatattgttatctcaaatttgttttctgttttgtttttcgctttttattacagatcccatatgtggtaaagggtactcaagaattaaaggaacacaatgtgaaggtatttctgattacttataaaccatacatttttgtgtgcataatgaatgtttgtgttaactcggactggataaagctgtcatataacttcacagggagaaatatgcagcagagaaaaaaaataatgagaactacaaaacggaacagctgttaatttcacaagcatatatatactgttgctagtgtcagaacgctatgtccaaaggacagggtgggtggctgaaaatgttttaggttgatcgcagtttagagagactgcactttcaaaatgctatcaggaagagaaaaacaggaagtttttgatgagtctgtaaaatttgcctttctttggtttgtcctggcattttttatttgtttgtttcacagtcatgggtgatttagaaggacacattctgttttctctttgttgaaagtctgcatggagtttcttcagtttgctgtgattctttctcctggagtttcagatagacataggtcatggtgactaacacaacctgacatgacacagcagctgaaaaattttaaaaacagcaattagtcccatatgtgggatgaaatgaagttttttccctgttaaaacaaagaggcacactacaacccccacccaaggtcttgctttccaaatgatgactgaatcctttggcctttctctggtccagacccgctgttaataacttatctgacctcagcagcatattttgttgtacaagtggccaaaacaaaacaaaaaacccaaaaaggtagattccaccctctccccattgatctctcttacaaggaaagattcagaatattttttcaacattcctgttgtggaaagttatttcttctaaatagagacacagtgtgtatgagtttcttagctaatgttcccccctcttttttttttggcattggcaagtaagtgcctttcttttgattaacttggtggtgaatacttttccaaattaagtgcagagaacatattgctctccattaggcaaactgggaaggactggtacatttgagagagattggatgaatgatgaatgaatgaacatgagtatcttttaattcccctcaacccaagctgagaccaaagcatggacagaacagcctgagaccatggctgagttagaattgattgtacattttctggtgatttatcagaacttcttaaaagagacccttcactggcccacatattccttggtgggatatttttctatgctgaacttcaagctgtttcttctttgctagtttgaaaaaccaggtttttgcttctctactcatttccagacatctggtctcataaagcaaattatattgctgggaaccttacctgaaatgtccgcagctaccagagctgtctccaagaactcacaccagctgcctgtctctacaactcaaaagttattccctgaaaccaatggagaaactcttacatatttagtaataggtgggctcgttctggttgctattcaggcaccctagaaattctacacaaactacttgtaggcaaactagttttatgaacttaccaggttcaaaatggggaataattatgactctatgagtagaataaggtagaatgatattataaagatatattaactttatactttttttttctttttagatatagatgaatgtgaagtgttcccaggagtgtgtaaaaatggcctgtgtgttaacactagggggtcattcaagtgtcagtgtcccagtggaatgactttggatgccacaggaaggatctgtcttggtaaatactgagctcattatttttctaataataatttattaacgattattaaaaatgaagttaacaagatatagctgagcacttagcttcaggtacagacacacactccaaaattcagcatgtccgatagggtccatggccactcctttgacagtctttcaaatagtaagcagcaactgtagtttctgttgatatgcaactattccttaaatcactagcatcacagttatttttccagagctcttaaatcggccccatatgccgtgaactataaaatacaagctgagtggtggagaaaagaacaatatttgcacatatttggaaactgtagcccatgtcttctaagcataccctgacattggccagaaggacaggtccttgcaaaaacacctgtggagatcaggagtgaagatgccactcccctgaaaagtgaacctgagaaagctcagcccagggtaggtatcactgctagtcatagtgggatattctgtgccaactgctagagcccaaatgggatcctctagccaaattgtctcaccccaaccctaagtccttagaactctaagtcctaagtccctatgggctcgtgatagtggcaagtttgagatcgcacatctcatgcatctaaggtctggcagacttattctggtgttactactatggcttctgcctgcctagagtatatcccttggatcactggtttctgagttcatgactctggaaatgatgcttacctgtactttgcatctgaaaccacattactttgaagtgtaggctcagtgaagactattgtaggtagttaaaaaagtgggccgggtgcgatggctcacgcctgtaatcccagcacttcgggaggccgaggcaggtggatcacgaggtcaggagatcgagaccatctttgctaacatggtgaaaccccgtttctactaaaaatacaaaaaaagtagccaggcacggtggcgggcacctgtaatcccagctactcgggaggctgaggcaggagaatggcatgaacccgggagttggagcttgcagtgagccgagatagtgccactgcagtccggcctaggcaaaagagtgagactccgtctctaaaaaaaaaaaaagaaaagaaaaagaaaaagaaagtggtatacagtgaaggattttgatcacttacgaattagaattaacaaacctttaaatattgaactttatagtttatagtgtaaataaataatatggaatggaaccgggaattcaaagccaaaagtatttttgtaattaaggatgtcagttaatgctattctgagtcttagtttatttgtttaggaagaatcagtatttaatgagaatcttcttctaggttcttcagttgaaagatgcttcagtgtttaatttaggattcacttaaaaataatttatcttaatatgggcagtctgaatataaagctgaatataaagacttcaaaaactttctaacgttagaggaaacccagggagttagatatattgttaatgaccccattgtgaaggagaaagagaaggaagatacatcttacatttcaattacacttcattattttcagatgcataatctcagttgagcttcacagaaccttctgagagatgagtgcaacatcctgtaacagatgtggaaattcaggtttaggataatttattgaagacaatccactgagttacagaagaggaccaaaatccagctcttctgacctctgctctgctaggctttctgctcttctttataatcccatgaatttgggtttggggctagaggtatcccacaagtaccttgaagaatgtgcccttaagcacgtgtttaggtgaaagaaatatttgagaagtaaagtgaatggcttttctttgcatttttctctttaatctcaagtaaagcagtcctctttccagagttcatcattccacctttccaaaaatgaagtgggtcggaggaaaaggtgattgcactagggcagacacgctccaacaataaagagtacagttggcttttagctgtggaggacatgccaagacatcatggcatgcacgcatcggtgataggtatttctgtacaggagaaaaacatctcccgaaagaacactgtgggatctctcagaataccattccttatgtagaattatcagatgttgaaagggaacttttcagaagtaggaggtgcaaacatgggctgacaaagagagtctttattaggcaaggatacttaccccagagcctggggttttttttgaggaataaaactaattccagtcaataagtatacagcaaattattatgtgtgcagtattttacctaacagagtgttggcagtttggggcagtggaagccgtgtggctctatttaacctcccttgattccctctgacagatatccgcctggaaacctgcttcctgaggtacgaggacgaggagtgcaccctgcctattgctggccgccaccgcatggacgcctgctgctgctccgtcggggcagcctggggtactgaggaatgcgaggagtgtcccatgagaaatactcctgagtacgaggagctgtgtccgagaggacccggatttgccacaaaagaaattacaaatggaaagcctttcttcaaaggtacaatgttacgttttccatggccaattgcctccctttttagacaaataggatgcattttcatgatctcagcactctacttgatcatcccagcatggactttttgctttctgaattatataattatctttgtttagaaaagtatgaactttttgtttttaactgtttggtccaagaagtcctgggggttaaaattgttctgtatggagagatagtttcagatagtttctaggtggccctcttaaatgtcagttacgtaaactcaaaggaactttaattttgcttccaaaagctatggtaattcattgctgaagaaggacttggtgttctggagatttaatctcccagttctgtcttacatgtagaaattacttgcgtatttcttgagtgtttggtcttgttttggaaaaaggccctgtagtgggaaactcaggtcacatgttacatgtatgcagttttctagtgtacaagaagctctttaaattatattaatgagatcttgagctggatgcggtggctcatgcctataatcccagcactttgagaggccaaggtgggcagattacttgagtccaggagttcaagaccagcctgggcaacatggtgaaaccctgtgtctacaaaaaaaaaaaaaaaaaaaaaaaaaaaaatatctaggcatggtggtgcacacctgtaatcccagctactcagatggctgaggcacaagaattgcttgaatctgggaggcagaggttgcagtgagccaagcacaccactgtactccagccttgatgacagagcagatcctgtctcaaaaaaagaaagaaagacatcttaaggtatatacattaagaaaatatttttaaattgtacaaattatttgcaaataatttaaattataaattatatctttgaaatttttatatttttggcatatccaaaaaagcaccaaacagtattaagtgaatatctcattctgctacacagtcaattgatagctgtaggataatatattctaataatgttctatgtgctttaaatatagatactagtggtttagaatatattatctattcactcagcaagtagtggttaaatattcactatgtgtcaggcagtgtgctgggccctagaagtctgaatagacacattatttgcttctttaacaatgctttataaaatgtagaaatttgaaaggctagaaatgtttacaaagtcatatatctcatggatcatcacacattcttggaaatgtatactgccaagaccttaaatcaagaacttccaaccttcatgatttaaaatggtgggcattgagacctcctgactgcttgctcataaacttattttgccccacattttcttattcttgaagatatcaatgagtgcaagatgatacccagcctctgcacccacggcaagtgcagaaacaccattggcagctttaagtgcaggtgtgacagcggctttgctcttgattctgaagaaaggaactgcacaggtcagttaatgagccttaagggccaggagaggggacgtcctttaaaactctttatctttaacatattgtcgcaagaattaaggctgtcctgagactcatttgctgccacttgctgtttttgtgcagacattgacgaatgccgcatatctcctgacctctgtggcagaggccagtgtgtgaacacccctggggactttgaatgcaagtgtgacgaaggctatgaaagtggattcatgatgatgaagaactgcatgggtaagtttgggatcatttgatcaacacagaaagagaaggattccatgaagctttgatggctcatagcctatgttccaggttcttcctgctgccccagtgcaaccagtgaagttaggaatcagtctgcaacagagggagactgaggtagaaagaatgagggaattcatgctgtgggtttgtgggtgatggcggagaccagttgtgggcccttgagaagtgattttaacacctgaaatggatacccaggcggaagagaggacaattgagacagaagctgtagtagaggtccctttacaagatgtctgtccaacacttctagaaaaggtgattggtaaacttgttgctttaggtctggtttcctagaaacaaagtttgaaatggagattcttgcaaaagtggtatttcttactgtgagcaaattctctcagaaggtacttgtcaggaagtaaggagagcagggtagtgcaggagaagaaaataaaccaagagtttggctgcattttggttttagtctgatcctgcagggagatctggtgtatgaatagcaccagagagttgtcccaccttgagacaaggaggtcaagatggacacccagcaatgggtgggggaggagtgcttggtctggtggaggagatgaggcccccacctttaacatggtcatttccattttgcagatattgatgagtgtcagagagatcctctcctatgccgaggtggtgtttgccataacacagagggaagttaccgctgtgaatgcccgcctggccatcagctgtcccccaacatctccgcgtgtatcggtaaggagaaagactttcacaccatttacttgtggtcagttgtttgaatgacatcattgccaaagttggaagcttatgtttgggtgtttgttcttcttattttcccgacagacatcaatgaatgtgagctgagtgcacacctgtgccccaatggccgttgcgtgaacctcatagggaagtatcagtgtgcctgcaaccctggctaccattcaactcccgataggctattttgtgttggtaagttcttttttattttattttattttattttattttactttattttatgttatgttatgttatgttattttattttattttatttcatctctccctaaaacactctatgtactctgagttttgttttcatcgctacttttacttatctttcttgtttccctgcaatattctttttatagtggctcacgatctttggatctcatctccattatctgtttaaagagccagttaagtgaaggacataggatgttttagctctaataagcataatttgacccatgccgtttggatagggaacagtagcagcatgtgctttgtctacacacatgcataccaatgcacattaacaaatggtaactaaccacctgaaataaactaaacacggtgagtgctgtggaaaagagcagaaagctgagttgaaatcactgcccttatgtggtttagatcagctaaaagatttcaaaaaaataactattggaaagaagaccatggaatgttcatatcttacactgcaattgaggctatgcctggctctccttaaagatgggtttttgtgggacaagaattttgctttgtggtcagccctctgtaggtttagtcgtgctgtgaagagtggcacagacagtcctgtggctttattgtgccccgagtcaaagtgaaactttgtagaaactgccagtttttgcctggtttggggtgtacaccatgtggaactgccaagtctcacatggtttccacccaaaaccataaatcagcccaaagttttctgaaacatggcccaggacaactcagaacttcaactcaggttattgaaaaagattggaacctcagccaatcaaactgaatttcaagtttataagtgaatctgtggccaagagaatttcatccacgtgcctattatcataactgagatgtgttctcctagcacccaatacttctcctgcattgcaaatggcacatcatgcatggtgcaattaattgttcatctgtctcctggccacagtgtaatcattttgaagtcaaagattgtgtctgtcccattcactattagagtctcatctctagcatatagtaggtatgtcattaacatttgttgaaggaatcagtgactcagttgccctagaatgctttttcccctttatttgacgtatgcctggaaatgttaaaaatgtgccatgctcataaacacagagggaggtgtgttagcccatttttgtgatactgtaatagaatacctgaaactgggtgatttataatgaatagaaattattagttcacagttctggagggtgggaaatccaatatcaagaagccaggattttgcatggtccttcttcctacgttatcccattgaagaaagcacgagggtgaaagagagcaagagggggctgaacttgatcttttataacagcaccgatcccaccatgagggtagagccctcataggatgattacctcttttaaaggccctgcctcttaaatagtgttacaatggcagttaaatttcaacacgagtattggaggggacagacatccaaaccatatcagaaggtgatattattttcatttcttttagacattgatgaatgcagcataatgaatggtggttgtgaaaccttctgcacaaactctgaaggcagctatgaatgtagctgtcagccgggatttgcactaatgcctgaccagagatcatgcaccggtgagtaggttctagcctcatgttgaatctctcagtaggttcctaagtaaagtagtttagggcccaggctttggagtcaagcaggcttgagtccaaacccttgtttgtcatatattttaactgtatccttaatcaagatacctattattagaatcctcatctataaaatgaagttcaaattgcctgcataaaatagtatttacagagcttaccatagtacctggcatataataaatggaatataaaatacattttccttcattgaccagacttttgaagagtttgatgttttggcctaattcagtgcaactccaggtttattccttgaaccattggcaacagcatcacctgagaacttgttaaaaaaatgtaaaatctcaggccccattccagatctaccgtatcagaaactactgaggtagatcccaggaatttgttttcacaatctctccaaatgatttggatgcatgctaaagtttgagaaccagtggtctaatttacacttccttttgtatcaccctggctgcgagagctgtgagccaggtagaggtgagaaacaaagtgggtaataacataggctttgattttggcttggcttaagaagagaatttggatttaggaaccaaaattattttactgacctagaaaaatgtcccttaaaaaatctagatataaatttggctacaaaaattgttgaaaataaggccaggcacggtggcttacacttgtaatcccagcactgtgggaggctgaggcaggcagatcacctgagttcaggagttcaagaccagcctgaccaacatggtgaaaccccatttctactaaaaatacaaaattagttgggtgtggtggcacatgcctgtaatcccagctacttgggaggctgaggcaggagaatcgcttgaacctgggaggcggtggttgcagtgagccaagatcgcgccattgcactccagcctggtgacagagtgagactctgtctcaaaaaaaaaaaaaaattgttgaaagtaaatattattactaagagcatctaagtaggtatggttatttcaagtaattcttaccttaaaatattgctaaaacagttgatagaattcaggcatttataatttgacaatagggaaaataagatttataataatttttgaatgataaattaaatgaaagaaagattttaaataaataatagacttttaagcaggtgtggacgttgcccttgagcagtatattataaatattgaaaaatattttttccttttttaccaaggataacccaatgggctagtttatgcaaagcttcatttggatttgagagttaatagtcttatgctagtaggctaagtttatttgactgcggtcagttaatgttttctcactgaacagtggaaccaatatcaacaacctgtggttgttggttttattctttgcagacatcgatgagtgtgaagataatcccaatatctgtgatggtggtcagtgcacaaatatccctggagagtacaggtgcttgtgttatgatggattcatggcatctgaagacatgaagacttgtgtaggtaagcaaagaagacagaatttttcatcttgtcttgttagtcataagcactgttaaattacataaagttagtttgggtcagtgatagaaagattccataggaaaagtaaggatatttagaggcacaatactcatattttaaccagcattccaaagagagctttcttgtggctattaaatggtactcttgtcagatatgttatgaggactgactggccattcgtcagctccagatggacatttcttttatgcctatccattacttttgtccacttaaccctccttctgctttgactatcatgtaggctttttaaatccttgactaaaggcaaacaaaatttacttctgacaagaatgcagtaaactttagaactgatctatttgttttgtatagtttctattgttatgccttcaaatttgataaacttttcttctacgatctctaatctgcctttcctcacatacagtgtatttttcatctcagatgttgtagttttcacctctaaaagttcgacttgggtattttttcatatattctgtgtctctgcataagttcaatcattcctctagctgtttgaacacatggaatacagttataacaacttttagtgtctttgtctcctaattctgtcatctgcattggttctaggtcatttgaataaattgactttcttccttattttaggtcatattttcctgcttcattgagtgactggtaatttttgattggataccagatagtgtaaattgtgccttactgagtgctagatatttttgtattcctagaaatatttttgaactttgttctgaagtgtaaattacttggaaacacatggatccctttcaaagtcttgcttttaagcttttaagctacacttagtctaggggtaattttgctctgttagtgaggtaagacccttctggatattctacccaattccctgtgaattatgaggctttccagtcaggctggtgggaacaggcacaatcccagaccccctgtgaactttgaggattgttccctctcattttcttgggtagtgctttccccagccttgagtagtttgtttccttatatgaatgtgctggtcactactcatctgaatacttgcagaagactcttagcaaatctctggcattgctttcttctgtgtagctctctcctgtcctttactctgccctatgaaccctaactacctcagccttccaggatgcccagattcatctcctcaactcaaggacagtgcctggctccatctggtacctcctccttatgccatgaagttaaaactctcctattcagtaatctcgggcaattgtaggattcacctagtttttctttctctcagggatcactgtcttttgttgcctaatgtccaatgtctagaaaaccactttttaaggtatctattgtctattttttttggttgtttcatctgagaatataattttaattcctgttattctatcttggccagaagcaagagtctggtattgattatatttacatttttatcacatttatcttctgaaagcctttactgaaaatgtttgaagtcctagaattaaaatgaatgtcataaaaaatgaataatttttaatttggaaaagaagtgaagtcttaaactacttacactaagacaaccagttcatctatcctttctttcaaaatatgaaaactaaattgttatcatcatgcagactgaattaaacttttcatcctgcaatagagtatgctgttctaaaaagttttctagactgtcacataaacgagctctaaactcagcatggagcccatctgtttatttgattaactggcctgctgcttatgggccagatgaaagccagtctgaataatgagcttgcaatgtaaagaatgaagagcaaatgtaaattggcctctaaaatttaacattgtttttctgagggaaagcattttaccttttctaatgtatttgtcatagttattatgtctcgaggggaaagtactcaatgatatcaaatagctacatatattaatagtatatatgttttacagatgtcaatgagtgtgacctgaatccaaatatctgcctaagtgggacctgtgaaaacacgaaaggctcatttatctgccactgtgatatgggctactccggcaaaaaaggaaaaactggctgtacaggtgtgtttgttcaagtagaacaataaaatattaagtagttaagagattggtatcataattatagattgatacatgttttaaaactcatacattttaactatattataaaacattttgcataacatttttcattaatttagcttccacttctttgaaatttgtcatcgtttatattggatccaagttgcaggtttttttcttgacctgtggggggaaaaaggtgtattgaataaattaacactgtaaatagcacatttttatgaggttaaaaatcacattttcatatcaaattagtgaacatgctaattaccaaatattcatggcccttcaccgaagcaagccttttccaataacctcctttgccaacacttcatttaaggtttataactggaattgctctttaaaggaaaacatcctacaattcatatatttcatcaattctcactagtcttccagtgccttaaataggagtacttttgatgtattaagtcatattagtccaaggaagtctttattcatgggacttagcaaatcttatgaagtgataatgaaaccatttgcaatgttgtctgttaccaatagcacatgagaaaatgttttcacaatatttgtaggagactatcctattaaatgccaaatggaagaagttactctgtgctaatgacattgtgtttagtttataagtgtttagttggtattttcaaatatgaggcaatgacattaagtccatggaatgatataataaagttttactctagttacttatattaatttgacagattatggcatataacataatttaaaacataatggaaaccatggtgagcttgaattaggtaactgaataatttcttaataaataacagtctttaattccaaaaaccagtttggcaagctcttatgacttaaaacaaatattaaaatatttgcagattggcagtggggcaaatgtgcagatcctcctcttaattatatcaacatatttcaagaaaacaccaaaatatatttattattgtttcaaactggccaataatgctatttcaaatttattgatatgtaggataagggcaataatattattgttggttcaaaaataacagatgctagccaaattatgagaagaagcatgaagctggaatgttttcattttcactatgctactccttacatgaagcctgtctaggggtccattctgataaatggcacagtgtttaaactctcaactcctatacggcctctcggtacaaatggtgcctagctttgtatgtctatggttcaagctttatttttagcttccagtataaatataggacttggtaagggatgatggtctggcagtagtgaaaagaaaggtaagatagttctgtattatgttttaactaatagaggataatactactgttttgttaagctgagcacattgaaattcaacccagaggcagtgatgcttatgaaagaagttaatctcatggaacaaccttcattccccataagaaagaggtctctagaattcaatgctccaaattctagctaactgggtcatgtgcagtggctgattattttaggccttaccctgaagaaagcttaaattttcatgttatttaatgtagttttaggtaaatgacatataatgtatacaatgctgttggcgcagtgctggtcaataaataaaagctattgtcaaatgaaacatagacacagtgtctagaggccattttagtgaaagccattgcttctagtctatatctattgtccattgttttgttgtttcatttgagaatttaacagtctagcaaaaattttatgctactgtttactgattcatgcttgaactcagtttaaagaaggaaaatcttactctttatattgaaaggcttgtttttcgtagttgaatttgcacagatactaagaccatggtaacagagctgtgcactacagttgcatgaagtgacaccagctttacgttaagaacagcagcctttgagtcaatcacatgaacatagatttgaagtcaaagaaacatttgatcctcttcaaatctttttcatagatttgaagtcaaagaaacacttgagctcttcctccagttttgaaaattacagcctaaaatgattttccaatttgctaaaatccagctagcactgtaggaagacttgagttttatgcccctttgataccagagtaacatggcatgtgatattctcatctgaaggagtagtaccctgaattgtgttcttagtaaatccactcattcatgatcttgaacaaatcaccagggtgctctgcagttactcaaatgttctccttgggtaagtaacagccctgacctgtggaagggcatcacatttgattggaaatggcttaaccaaacagtaagtttggtatacttgaaaacgtgtttttaaaaatctggggcaaaatgttttttgaatgccatgtcactaaggctcttttagctgcttttagtttaaaattcgtgtcattcacaacttagaacaccgtcaggttaccttggtgatggctttgctaataatgttccaggcaactaatgtaagtagagataggtatcttgcctaattggataagcaagcagacaaaaggaatatgtctacttatttatctatttatttatttagatagattattgtttaatgaaaagaattatgaaaatatgtatgctattttataaggagaaattttgcttcatgagaactaagaaaaagacctctgggctccattacagttttgtctaaatatttcagctccctgtcattactgagtatttccattttaacaaataaacatgttttttcccccaatcactttagcaatgttcagaatccacccactgacttacattcccagcccacacagatgctaagggtttctttttactccgtaagctttgttcagaccctgggtattgccaagggggaatgttccatttaatggagagagaacacatttgcttgaaacgcagaacacagctcttctatccttggcttaagtgggctggattacaatttttctatgacccaatgtaaggcttctgctgcttgttctacataattaaggccctgctaggtgtcatctttgatgggtggtcctggctttcacaagctaattttaagaccctacctcccatcatgtgcttacttagttaatgaataaagcaagcataccattaagtggaattaaatcagacttgttttcagttaaaatagcgggatttctgggtaattccatattggaaactagctggtttctttcataagagaaatgtctctggtggatcttggttcataggagagaatcatatatttcaaccaccaacagtcagtgagaatttgtgttcatttccttccagtttcttatcactgctaattttccttcactggctgtcggcctgtgaaaactccatgggtgttcagttaatagtgttggctcaaatttggatccaaattaagaaatccaagtagccttcacgtttggcctctccattcatggtaacgccctcttcctcaatgcctaatcaaggagtttctgcagtgcacagctctgccaggttaggatccaggagacagatgcccagatggcagagaaggcaggtgtttgtgtgggtgatacagcctctccctgcgtgactgtaagaggaggccacagcagccccgggcacaagcccatacttggatgacatacttgcatgggacatacccagagcctgtgagcagggtctgctcacaccacacccttgcccttcaagagagccatgcaagaggacctttgagtctttgtgacaaaggtttggtggggttaagaaggttgcggtgtcactttaagtttgaatttctttgcttttcttggcttatgctattcttaatcttaaacaggaattttctgtttgcagcgaacttgtgcaggaaagagaacatttttacagaaagagatattcttggcaaacatgtactatgtttccttcatgttattgaagagtgtttcaatacagcatttttgtttgcttgttttccttatggctcactttccccttctgtttgcttttatgatgaattacagtccaagtctgccacagaaacaattaatgaatgatagttggtgcatgcatgcacacacacccacatgcaaaaaccttttatttggagatgcttttatactttatgaccacttgaagtctctccaattgttacatactgagagtgtaaaacattgagataataacttatacaaatagtcacaaaatggagaattgaatattggctcctgagttactctctcctattacccaaaagcccatgatacacagcctgttgtaaatatagtttcttttcaccttgaaaacattgccataaaactgaaaacactttctaaagttgtaaatttctattagcatattactgatgatttttaaaggagactttccattaaaaagaaatgataattttcttaattgcaagattaaacatggaaggtaaaagccatatgaaaatgataatactcataaaataagagtacctctggtcattagaaaactggaaagaaaaagattacagaattactagattaataggttgtggtcatctctgaaaattatgcttagtagaagatattagtgagtatttctataagtcagttaatattcaccaatattttggtaactccataaagcaaggcttagaataaaatcctgatatgactaaagaaatgcgctcagctgggcgcagtggttcacgccttaatcccaacactttgggaggccaaggcgggtggatcacctgaggttaggagttcaggaccagcctcaccaacatggtgataccccatccctactaaaaatacaaaaaaaaaaaaaaaaaaaaaaaaaagccaggcgtggtggcaggcacctgtaatcccagctactagggaggctgaggcaggagaattgcttgaacccaggtggcggaggttgctgtgaaccgagatcgcaccattgcactccagcctgggcgacaagagcaaaactccatcaaaaaaaaaaaaaaaaaaagaaaagaaaagaaagaaagaagctcagctaggcagctgtggcccaagggaaggagtgccaatcaccagatggggaaactgagtttcaggaggtcctggctctgcccctcactgacttgtagggcccaacttctttgtcttcttctgagaaactgagattgggagaatggaattacgagttctttccacttagaaaattccttgattctataacatctggaggctttgatacttatgcaattgaagctttttgtgtccacataagattatttgtcagagatcatgacaaatataggagagaaatttaggcaaaactccacaaaaatggtgatttgttgcattacctctgaggggagcaattacctgaggcagaaagaagtttcgacagccctgcttgggagtatttgtgctagttctgcgggatctgttaggtcaggtatggaaagacatacattcttgaattcctgtgcctacttagcactgttatccctgaattggccttcctcctcatttccttggaatgtgccatgctcaattatttagctggttaaagctcccagtcacagtctaaagctatgtgtctctcttgacctgcagtaataacttgataggtccatgtggctgccaaggttacactaaaatccacctatacaatgtgtcatgactgaaaggacattcttccaggcatgctgcttcatttttatgatcattagtgatattataaagttcttttgtaggagcaatctgttcttatttcattttgtgtttgctctagaagttatgaagaagccaaagatcccaggaccatttcagagcttcagatggaacacttggcagatagcatgtttgcaaacactttcaaatcatttaattgggcttcataagtaaacaaaaaggcaaacatgaattacttgcccagtttctttttcatgccactattcaagtgttcactggaaattcttgcagtgttttgtatggcaaaattgttcttcttgacctaagattggtgttagatgttggtttccatatagagtaccatatttatgagttcttgttcttagttaatgacaaagttgattatgagggtaacccattatagaatgggctcgttttggaaaattttcacttagtactttatgttcttttctgtaacatatttatgttagagagtctatcttggctaaagttgacaatagaattttggagaatagagcattttggaaaatttggagtcttttagtaatgtgaccctaatctggtattccttatattctgacaaaatccccattggattaacttgagttttacatgaaatatacaagaaggcttggctctccaatgtgctaggactctaagaagctagggaaaagatggcttatatactgtcttaaggaacattttctgcaaatgcttaaattagcaatacctaaaggaaagcttttgtagaaataaagcataattaaataagtgttttaagtttaagaataaaatatattttatatatagaatataatgcaaaaattttctaatttgccaacaagtttgtattttttgtctatacaagatatgaaaataatgtgcatcattactccatagttgacttactaaaaatactagcaaaagaaaatatgtgacaaggagtattaaaaccatagaaaattaagcaactcattttttatggtcttcagctgtaaaaagtcactttgcagtgactggaaacttacattaaaatacggaaaataattagagttaacaatagctagtacaatcatattgttatatctttataatttgaaatttaaagctgtttgatatatgtagagtttatatatggatgcaaaaccagtctatactataccatgggaagtttgaaggcaagtcaacttttgaatattacttattttaaaaaccaaaagacatttgtgctgagcctttttctaaatcactgctcatttttccagacatcaatgaatgtgaaattggagcacacaactgtggcaaacatgctgtatgtaccaatacagcaggaagcttcaaatgtagctgcagtcccgggtggattggagatggcattaagtgcactggtgagtaggaaagtaacagaggttgcttatcaaggactgcatagattacacatatgaaaatattaattatgtaaagttattttaatttgtgtattattggttttaaataccaccctttctgttaataatgatataacctttttctataagatctggacgaatgttccaatggaacccatatgtgcagccagcatgcagactgcaagaataccatgggatcttaccgctgtctgtgcaaggaaggatacacaggtgatggcttcacttgtacaggtatgttcacgctggaaacaactgtgtcaacactagtcagagaagccaggcattccacatttctcaggctagcaattcttttttgaagactgggtcagttaatagaaaagattcatcatttggcactagagctctgtgggaaaaaaaaaattggaaccaggtcaattagggagacctcaaaagcttctcgataggtagatacgtaggtagatagatagatagatagatatttaggtgccattatcacatcatttacagtgatctgtgctctaacataaaatgataccaaaaaagtcataccattctccacctcaagtcagctaggccttataatagttacaattggcatatatatcattatatgactgtatataatgatgtcattagtttaaacaaatcatacttccttttatatgcctagcctttatttattattattttttttttgcctatttctcaccaatgacttcctttctgtaccaacacaaggataagcttgctgtagggaactatgtaaggagaagggattagatgttctagattagaagaacagtatgtatttctctccaacaggccatcatcatcatcattatcgtcatcatcaacattccatattggtataagtaaaaatttcaaacctgctatggaattcattcacttccagttttgcaataatatattaatgaaattttctttttggctctaattaatagccatagaattaacataaacttctatacacatgtaaacatacatgattagacttgtcattacataaattatacatatacttacatgtgcatatatttacagacagcactttttatatcagagctctggagttaaataaaataataagatccattagccattaggtcgcatagctgctcctataacttaaaacattgatttatcctgagcactttgttcataaaaagtcatttaagcacaatagaggctaaggctcattaagtgatttacctggaatttttttttattccctgaaagttttatctcagatgaaatcatttttgcctaacttattgatgttttgtcatcaaaaacctcccatcattttgagaacatattcaaattccatgtattaggcatgtgtggtttatgtgtttgatatttaaatgcctgtgattattaagaaaactaggtagagattaagcagatggaatttttcttctccctatggttgccattcttttgcacttttggtgcccatctaagctaagcctgaaacttgagaaatagacacaaacatgatgtgtcatttcctgtcatgggtgtgccctccatgcggatgacccttcttgaacaggccttagtttgcatgattccttcggcttattcattttatatcattcagggtaaattatcattcaggattctgaatcagccacatgtaaatttcatattcagtgttagcctaccaaagagaaaaataaatgactttaaatgtgtcaaattgaagttatgccaaaacattgctgcactggaaagttgatagacctgaggaattagaaagcccctaaccgaggaagagtaacgtgtgtttctttctggctgtagaccttgatgagtgctctgagaacctgaatctctgtggcaatggccagtgcctcaatgcaccaggaggataccgctgtgaatgcgacatgggcttcgtgcccagtgctgacgggaaagcctgtgaaggtaactgatggggaagccactgggagccttgctgggcttgatgagattaggttatttaaacattcctgatgcttttttttttttttttttttaaactgaggtgtgttttagcttcatttctaagctggtcagttcagtttgtagagggattaggtttccagctgaccatttctcttgctgcacagaaaacctcagctgactggccacaagctgtacatccagccttggccgcatggtctgcaagggtgtatccattggtcaatgagggtaaccaagtgtggttaaatcagtgcaacccatttatccctacggagggggatgcaacctgttaatccctactgagggagaaaagagctgaaagtgcaagttccctgataatgtcctgttgtgggattatcactaaatatggaaacacaggttttaatctccactgtatttggtttgtagaaataaaagcagagcaaatagtcttgtccatacgtagaatggtatgtctcacatttgctctaaatatctaacatatatgaacatggaacagttttgcaaatctgttcaataggggacccttgggatactgccatatggcatggtatcgctcagctttaggctctgtcattctgataagtgttggtcagacacgaagagtcctgggaacctgttagctaaggctggatcccattagggaacacaagattcttccctttacccacatttgtcaaatttaagcacattctccttcattgaaaagaagatttcagtagaaataaacaaatgataacgattgtcagtagaagtttaaacaagaccctgattaatgtattagttaatagttgttccttgttaacaagacgtgaactcaaaatcagtcattagctatgacatgtatactaattccctcatgtatttttatgtgaatacttttctttgttatggaaccgttgggtgttctttatacagtttatattaaatatgcagagtttgatataaaactccttggagtcaagaaaccagattatgctcttgatcatgtgcctaataccttgtttacttttgttactccaaatatccaaggaaaacaggtactgtgccacctctggtgacacaaatagtcacagtgaaagttttgcttctcttattgctataagagaaggttttgtttgtttgtttgttcttaatataaatcatggctggtggagtggtcatggctatttaaagctagtctcaagcctgaaaatgtgactgtgtgtcaactgcacacgaagaatgttaacaggaggcagagacagaggcctggaagaagcgtgtgcggttttccaatctccgtcaacaaaggcaaacacatgccataggactagggacactggagattatgcaactaattatgacagttccctgaaagacattgtggcttgtgaaattttaattcacaacaaaaacagtgactacatagatagattaaaaaaaaaaaacgaatttagcgtaaggtggcttgcttgcctcttactttacgaaagtgatgtggacctacgtggaacactacaaatgagatatgtatctataaaatgctcagcccgctgcttggcatgtaatagagactgaggaaaagtaacctctcacctacgagacttcactgtgcatggcaaatcatctaaaagtctataggagaagtgcccagattggtgttagatactctgcattttcttagtatttacattagttgcctaattatatttggcaggttttttttagaaaaatataagttaagttttttgcttttttctccctccccccaagatattgatgagtgctcccttccgaacatctgtgtctttggaacttgccacaacctccctggcctgttccgctgtgagtgtgagataggctacgaactggacagaagcggcgggaactgcacaggtaagacctccactggcatcaaaatcagctccctggtgtcccgggggacccagctattggagcctccctgggactacacaagggccgtcacagaagacaagaaaagcaagggggaagtattaagaatcacagataccttttctcagacctggaactgattggaggtgaggatccagaggaaagagtctaagacaattgaaggagcacagtttgtagccttgaaattgagtttgtggctacaaaggaatgttctaggggtgctctagtggtgtagcttcccagccatttccttttctacttgggtacatttttggagagtttcgttttggaggccatgccccgggatcatgggttttctccttgtacttcgttgttgcaatacccaccccactccttcctacccctgccctgctcgtggtcaccagagtactgggtacacagagctcagccacctatctctagtgtataaatcattttcttgttgagccaaggactctcagggaacattagaaaaagcttagaaaaactacaggcacccagcagactgacactcggttctctttggcactaagactttgaaagccatttgcatttccccttcctaattcacccctctgttcaaggatactgaagaaacaacttatgttctgtatgagttcaaatttccggaaaaaatctggtcttttcaaccacctaaacaaaccatgactcaggggctctccagatcatgaccaccaccaccaccctgcaaatgctctggatggagtattcctctccagccacacattcttcccttggttttccttaaagctattacgagaccaggctgggtctcttgcatgcctcaggaagtccccctctccatggcctgtaccctgtcctgcgtgccccagatcactatcaacatcattctgtctaatctcgtttctgttactctggccctgtccgtccaaattcacatgcaatttgaacaaaaaaatcatctgcagcgcaacccgcaggagggttgccagatccaaggggaggaccaaggcaaaggtgttgtccctcttctccagtccctcctcacagaagccgtttgtctattcttgagtatttcatgagtgttcaaaacagacaaaaggaattgtacagagtggaatttgccaaaacccatgtcctaaatatctggaattctgtacatatttttggaatagaaactgaaagggaaatattcaactcagcatggatgatgggagagacactccttgccgacctcagggaacacactaagcctcacgcgtgtgtgtcaggggaagcagcaagagttgcccttctgagggtttcctgggacatcttgctctaatttgatgaaataacaagccacatatactcaatatattttcttaaaacctgtgtctgaatttttggttgaccgaggtcacaacagtgttttgccttcagttaccttgactggaatatttttcctagtgccaaagttatatatatatatgtaatatatattatattttatatatatatgtaatatatattatattttatatatatatatatttttttttttttgagacggagtctcgctctgtcgcccaggctggagtacagtggtaccatcttggctcactgcaagctccgcctcccaggttcatgccattctcctgcctcagcctcccgagtagctgggactacaggcacccaccaccacgcctggctaattttttgtatttttagtagagatgaggtttcactgtgttagccaggatggtctcgatctcctgacctcgtgatctgcctgcctcggcctcccaaagtgctgggattacaggcgtgagccaccgtgcccggcccaaagttatattttatcctgatgacaaatttgaatggtaaatgtgttctggggaaagaccaccaaagactatatcatatttccttcctgaggtgttttatctctgaagtggaagactgcatttctagatgtagttataactagtagctttaaaattcttgtttggagctctagattgggccctgttcttttatggtgatgtctgcctacactggctcaggtgataactccactactcactgttcggttttagatgtgaatgaatgcctggatccaaccacgtgcatcagtgggaactgtgtcaacactccaggcagctatatctgtgactgcccacctgattttgaactgaacccaactcgagttggctgtgttggtaagaccttaaaaacttttcagagaagcaagcatactgtgtattattttgaaaacagcaccaaacattccattctcaaagtttgcaaaatgaatgatacagaaatttaaacatttcctaactctactttagattcagatatcttttccatagggaaaattctcggtagtgtataatgttcatgggcactttttagtttctcagtaaaagtaaattacggtttttgaacagttcctgaagtgggtttgaattttcaaccccagtagaaagattctgcctgatgcttttgtgtttgtatatggtaaatagatacccgctctggaaattgctatttggatattcgacctcgaggagacaatggagatacagcctgcagcaatgaaattggagttggtgtttccaaagcttcctgctgctgttctctgggtaaagcctggggtactccttgtgagatgtgtcctgctgtgaacacatgtaagtggacatcctcctatttattattatttcaactccagccagttctcctttctagatcagaagacaaaccttttctactcttagatcagagaagaaagatcagtcctctcagccctgtagaggggaccttattcccaattcgagagtcagaaaatattcctggttggctcacactaaaagatcaggtagggcaggtaacatctcacttctgtgtaagtgaaaagcagatagcattactttaaagattttccagactagggtactttcaccatgttgcttacgttccagggacacattgattatctctcctcttctcatctattgactagtttggaaggctgtacgccagactcagtgtcccggggtttgaagagaagcaattagttaagcaactataaaatggaagattattccattgttatggggtggcttgaaagaaggctttagcatatgattgtaaggacatacaaactatgtctcctaaaaatataaaagggttttcgtttttccaagtgagtcctgtattatgattcagaattagatgtagcttctttggcaaaattcagtggctactgcttatagcgtatgttgggataggtatggattctttttttgctgaagggtcatttattcaattcttctaaaaatatttgttgagtacctagaatgtgtactctggatgtgcaaagatgaattagactagatcctgcccttcaggagaatacagcatagtaggcaaattatgacctaaacataagcgctataattcaaaataggcctcagaaagagaagaaagagcaggcacagtgctgtgttggtacaaagagcacacctggtgcacattaggactccactagttgtcacccatgtaaccttgggcaagttccttagcattcataaaatacctcataggattaaatgaaatcactcatgcagagcacccagcacaggggtgagtgctcagctggctcctccttctctcttctcttcagaaagggaggtcagttctgcttgggagagggtggggacttagtgtgttttttaattgagccttcaagaaggttgtgacatgaaagaagaaattcaaaaagtatggatgattgcagaaagaggagaacaagtaaaagaggaggacttttcatttcattggtgtcgaagggggcaaactaagacacttaatttggggagtcagctttgtagattaatgacagtagcaaaacaatagatatccacaccacaccagatctggaccagagttagaactggaatatatacatataggcatgtgtacatataatttcagggagccaggacagggattagcagatctggacagaccatgacattatgaaagaactgatcttatagctcctcactgggatgatgcagcaggttacagacattcttattcacatgtcctgtacatatcaccgtcctggtgcataccactgaaataaatgtttctgggtaaaatacttggatgaaagaattaatgggggaaacccaaggacactatagaaagttgtttttggaaaccaagagaatcaatattgccacccatagaaacagaggtgcaagaaatgtctctagtcattaaggagagaattgggatgggaatcaacagagaacagcttttcctaaggctctatttggaaagggttttggaaagaagccaattaagattattaagggaagctgtagttcccagaaagtaggctgaacagaacataaaaatgaagatgaagtttttcagaaaataaaaagggaaagaaaatctgtaaaaagaaataagggatgaaggtaaggtataaaacagtccacacacatgtaagaccagggagtggttagagttcaaggactgaggacagtggccttgcactggggacacataataaaaaccactggaaaatgggaagtgtacacaaaggtgttaacttacttcagacgggcagagtaacaactaaagattcctgaaaatgaacattttcagttggatatgtgagtatttctcttgaggatactatttctaaaaactttagattcaaaacaactcaatttgaatttttgtttcaatagccgagtacaaaattctttgtcctggaggggaaggtttccgaccaaatcctatcaccgttatattggaaggtaattgtgtttcctttgtcttaaagcacacacaacttgaatttccttgggtttatttacaatgctaaaggaatgcctttgttttgattttgatagatattgatgagtgccaggagctaccagggctgtgccaaggaggaaaatgtatcaacacctttgggagtttccagtgccgctgtccaaccggctactacctgaatgaagatacacgagtgtgtgatggtaaatggtcctggtaggatgataaggtcttgcagatatcaagaactgacctgcaaaaccagaatatggttactaggaaaatagaatttagcagtgtagcacaatgttctaaacacgaacatagccaggtagatatgtctcacatgtggcaatttggactaatgttactcaagtgatgtcatttctggtaagtcctaaatctccctcttttcctgagaaaaacagaatcttattctgctggaccatagcctcatttatgcttacaaaatatttttccatgctcttcagaaaagccattttttacatgaatggcacaggtccaatttcagtgttccttctctatttggaggagttctgggccctcttcttttaatccttcaccacttaccattggtgctcatgtattcaaataagcttctcctagaaggcggccctttggctttatgctatgagtggtggcccttgttcatcctgtgttactggaaaggtggagaatattaaccacttacaggtttcagagcacttcagccatgagccatggttttcatctacatggaggaatcacacaattgtttaggaaagagacctccttgtgctctgcataagaaatattcccctggctctttaatggcttattaggtcacccagacaatggcaaccttattgagtattagttgaacatcacagtgtatatggcacagctctaagacccatggagttaacaaagattagaatcaactccttcatttggaagtggggagaggatgtgaaatatgctccatgctgccttaccaatgcagattcatgaagccagctgttaatggcttcgggatactatataccctatcatagattttgtgagcataagaagcgtacttgtcttcctaagggatatttgatattttaatttctccacatttctatctctgcctacctttgaggatattataggttaatttattaggagactcattattatatttgataatgcctcatgtcagaaggcaagagttccttttcttttttgtttttgttttttgtttgtttgtttcgagacagagtcttgctctgttgcccaggctggagtgcaatggcatgatcttggctcactgcaacctctgcatgtagagttcaagcaattctcctgcctcagcctcccgagtagagtagctgggactacaggtgtgcaccaccacgcctggctaatttttgtatttttagtagagatggggtttcaccatgttggccaggctagtctggaactcctgacctcaagtgatccacccaccttggcctcccaaaatgctgggattacaggcatgagccgccatgcccagccaagagttccttttctaaaaccctctttcctcaaaaggcacacatttacacagagagaggacacggatgaatgaaatacctattttcgttatcttatttgaaaataccctatagattttctcctctaatgtcaacattcattaagtatcaggccattccaaaatgtgaagttttcatattcacataccactttctctttggattatagatgtgaatgaatgtgagactcctggaatctgtggtccagggacatgttacaacaccgttggcaactacacctgtatctgtcctccagactacatgcaagtgaatgggggaaataattgcatgggtaagtccaagcttttctcagtaatgcatgtttggttctcatctacaaagaggaagagagctcacaagttcatcaccttagggtgatgttactcatcagactgagtgctggcatcccttcactgtcttgttaggagactcttcccctataaatcataacttggcattttttcaccaccacgggtgggtggttgggagttttctctaaaatgtatgttggaaaatcccaaacaacagttaatagtacttcttttgtttgacttttgggtgtatctttgtacaattatatttacagtgctgacctacagtattaaaacatcacgagtcggaaacgagaaacttattgccaaatggcagtagggaattgttactaggagactgggcagagagtcatttaaagtttattaatgctacagctatataatgacttagttctgtggcatgaaatatcagggaatgtatttctcaaagtcctttatcttgtagcagcataggtagctagaaagttgtgtaagagcaagttttttgtgtccttatcaaagtcaagctacaatacaattcaaatgaaacttgcttgttgagtatccacttagaaatttgttgtgatttcccacatggcatcaccaaccctccaatccttttttttacctcccttctagatatgagaagaagtttgtgctacagaaactactatgctgacaaccagacctgtgatggagaattgttattcaacatgaccaagaagatgtgctgctgttcctacaacattggccgggcgtggaacaagccctgtgaacagtgtcccatcccaagtacaggtgagttttagtttctccattatcaaaaatataggttgaaaaattacccatgaattgttggggaaatcagtcttagcgaaggaagcaaagtgtgcattgtttatctttacagggaaaaaaacggctcatgatttaaattcacagttggtgctggtcattccagccgaacactgagtcacagaatatgttttctaatgtataccctaatacgtaaccagacttgtagactcagcatatcacaaaaatataaactataaacaatgttctcattgttactgaattcttcatgtatctaaaagactgtaaacattagacaaatcaatgtgacagtaagggaaacataattccttgtctttttacttatttaaagctaaacttgttccaaaaatagttaaaggcagcctacaaagatgtaaatgttaaacaagaaataagcataaggcaaatggcaaacaagaataagaaagagccaggagcaggactaatacacaaaattcaagccgggaattctacacacttgcctgaaataagcaataattttagccccaaactttctagcagctcctatgaaaagggagatgtgatcaagtacaaaattctcaatgagcataaagaaaactcaaaatgaaaggaaagtgcaacttttcttgatattgagatcgagataaatttcttcttatattctcatggagaaagaaactaaataatgttatttgtcttaaaaaaaaaaggctaaattgcatcctttgaataaataaagacattagtgtactgttcttatatcatatggtatatgctgtgcattatgtatatgatgatgacatcatttgccaagattatgatttgggttagttgaaattatcatgcaaggaattgattagggtattctataaagggaatcctacaccattttccacagtgatatataaaatattaaatctgttgtttggtactacctgacattgcatgcaacagaaaattgttttttagtaaaatgtattattccatccattgtttactccagaaataatataataaccaccacttagaattctgatttacctccaccctgcaaaatgtttctagaccagggcttggcaaaatacaccccatgggccaaatctgtcccaccatctacttttgaatggcctgcaagctaagaaggatttctacattttaaatggttggaaaaaatcaggagaatcgtatttcataatatgaaagttacatgaacttcagattttgtttcccataaataaaacttttttagagctcactaatttatttccatattgtctactactgctttcatggcaacattaaatagttttgactgactgtacagcctgcaaagcctaagatatttactctctgtccctttattaaaaagtttgctgacccttgatcttgaataatggtctttacaactttaggtggtacttacctgttggtaaaaaatctgaagcttatgcacacctggtgtgcatttatatgtaaaagtctatgtatatatatctatgtatgtgtatatgtatttgttttcaattatattgaaaaatacatttattatttttctgagctgttctaatataaagtgtacacaaaattaatttttttaaagattagatttttccaaagatagatagaagtcctcgcattttcttttttatcctaatggattattgcatattcctctggagaccactttggaaacccttaatgtagactaacatttacttttagaaatgattgcctgagttttgaatatctacatactcttgtgtaaaatgcaagatttcttcttgatgttggatattcaccaaattcagtcatggcttttcattagctgtgaaatctgcacatattttaagagtccctgtaatttctttaggtgaccaatgtcagctggcgttacagtgttggaagtgaacactcatagattaaggagacaaaacacaaggagaataacatgctgtattttgattaaaatacttccagaaatcttttactgattttcactgagcgtgaccaataaggcaatggccatctgaagcttagattgataccataccttaccagttacagtcatgatctggaatcacaaaatctcacagttagaagggactgctgatagaatttagttcatcctttattatctgttaaatttgactaattcaagtgagagaaagacagagagagacagaaaaggagagagggagagggagagaatatgacagagctgtaccaaatgaaatccagctccaaaaactgaaaaactggtgaaggttggttgattgacccaaattagtcattaatagatctgatgtcaagaatgtggctagatttgctatggtctcctataatctaccgagaaaatggcttttatacgtgttcctcaaaccctagatctctaaatgcagagtagagagaggcactcttaccagtccctgagttcagagctgaataacatccatattgaaatccaaactcctacaggtaaactcatgtgaatgagtggcatgtgatctggggatctctacttctccttcattatcacgtcaacattaggtcatttttttcttcaatatttgtcttacaggcaagattatatctgtaggaattttcaggtttactttttattttaaattcttcaaactacagacaaatacctttcaagaatgcttacaaaataatttttttcagtccaattattgttctttgctgacccctatcctcccatcccacctttgtttaatcattgcagatgagtttgctacactctgtggaagtcaaaggccaggctttgtcatcgacatttataccggtttacccgttggtgagtcatgacggcattgtcagaactttctggttttttgcctttgtgttagcattattttttcagttcccatttttttcttaaaggaaaaaaaatattaaacaatgcctttcactttattgaaacactgattcttagtttgaaacaaactgtgcaaacaccctgtgcagctccacctaattggcaacaacatttgttgttcatgattaaggggattggaaagcttttcccaaaattacaatcaagcatagttacaccaaccttaggcatcaacatggggagagattctgggagtggggccagttgacatttgatttaactgtaattctcaatccttccttctgactaagaccaggttaagtgacttcacaccaatccttacgtgtagattgtttacataaagtcctttcgtggatcaattttatcttacatggaatctcctcaggtcatctgctttgggaatttcagatgtgaaataaaaatcttttcggtctgaggccctgcctggtaaatgaagcagagaacacaacattgggagagatgcttgtgcaagaatcagaagtattacacagcactcagccagtgcaggcaatgcccttgtggtttaaaaccaaataacataaaagtagatggaaagctattgcattctctgagtttttccctggtgtgatttatatgcatccttagatgccctcttaagtctgcacagttgtgtctagtagcaaacatcaccacttgctttattccaccttattcataataagtaaactaaaatccacatcagcctttccagtgaccttgtttaagaaaacaagagtctggtccagcaatcagcctggctcccttagtgccaaatccatatggctccacagtctcgtccacgtccaaagaaacttcatggtttggaaagaaaaactgctaaatgacattggcatggaacacctggccctagctgctttgtttttccccttcccaaaacagatcttttaacctccctagaatctgtgatcacaagataagtggtctgtaatggtagtggttctccacggaccaaccaggcatgtaccccagcaaggctgccctccaagtttggcagtaagcaaagactagaaagaacattagcgttgtccactaggagagctggaaaggcttcagacttcatctagtccaaatgccttgcttcatatttgaggagacagaggcccagagaggggaagggactcacccaaggccacccagctaattaataacagagctgggaccagaacacagtcctgactcatggcttagtttgcttctagctcttgaaaactggacatctgttatttagctatatgcttattgttaccaaattccagcatgacaaaatatttagatgactgaaaaactttgttttatttaagctttatactctccttttggaagatcttatgattgttggcatgtggagtccattcatatagggttaaaactatagcatgtttatcaatcttgtcttaaaatataaacttcactaagttgaagttcaaataaaatcctgacaggaaaagaaaatataatttttaatatatccttttgctattttatacctaacaatggctggaaattagactcagcccgttattgttaaacttgataataatatatcacttatatttaaaacgaatgtgaatatgatgtttcgtgttctaacccacactgaatgaatggcatctgaatttgttttttgtttacttatgatacacagttgtgatgtaactttatatggcattttcatgacatgaatgacaaaggtgtgaaagatctaaagacataattgcgtgtattcaaaatagcaatgaaccctttgagattctaagctgtttcttttcattaaataggtcaattttgccttcacacaaaatcaagcccttttttaaaaagggtctaaaataaatctatgacatcaaatttctcctttaaaacagattggttatagagtgtggttcttctaaaattgcagcagctcttgtaggctccacttcagtccgtgatcatcttctcacaagtatgcaagcaaagtatgtaccttgcaaaggctcctgactataataagtaaacaacgtatctcaacaacagtcatagaaactagtgaattggaagactttggattgtagaccaaggctttgcatacctcccagctgaggtgtttcatcaaacccagccaaggggctgatggaagggccctccaggataacaaaagtgttgatgacagttctgtgaagattgtattagggtgatgcaggaaatcaccataatacgatcttcccttatatgataagggaggcaggatggcctgttaactgagtcccagtgtcaaatcctgactctgcctttcattggctgcttggtcttgggcaggttatatcctgtggcttggcctcacttgcttcatctcttagttagaatagtcatagtaccgagaccatctcatggggtggctgtgataattcagccaataaatacaggttgaatgcttgagaaatgtaccagtcatgcagcaaatgagatactgtcactattaatactattaccattattactactattactactcttatcctagagggcacttcagtggtcaggagttcagagtgggtaagacagagatgggaccactccaggctggggacatggccaagctggtgaggtgtccaaagtctctatccatagctggccagccctgccttagcagcctggatcctggctgtgttctcactcttggtcctgttttagtgctcaccaacacactgccagacacttgctcttaactgaacaaatttgaattgagcacttactacctgtcatgtagagtgctaaggaaccataacacagtgttggagagccaagcccaactcccagtcttaggaagcacacattctactgcgacagttcttccttggtgctgacctcgtttttattgtcagccccagcccagctgacatccccacacctgacttacctcctttctaaagccacatgaagtaggaagggggagttaaactggaatttgaaagatcagagttccatatgaccatgtgctcctctgtggttctttaccagctcacctctgcctttttccctaaatataggcacacttgggtggagaggctgtttacccttgaccatccctctattctactcatctggtgcatccacagtgcccagaggatacaaagatatctcctacctgtacaaaattgacattctgaagcaaaacccagaacatatatttaaatccagttagactcatgtctggaaagtggtttagttatctcaatttgctattcgttgatgtccctattgccatcaccaccaccccaacacatgcacgcacacacacacacacacacacacacacacgcacgcactttccatcttgtcttaccctgcacagggatcatgtgctgtcctgtcactcatgaatgactactctgtctctagatattgatgagtgccgggagatcccaggggtctgtgaaaatggagtgtgtatcaacatggttggcagcttccgatgtgaatgtccagtgggattcttctataatgacaagttgttggtttgtgaaggtaagtggcatcatgactttatcatatccagaaaagagctaactgatgagctacttgatacacacttggcgaatttcacaacattgaaatttcagaaatgcattaagctctagaaatagtaaagggcatggtgtggaacaacatgaaatttcatgcaaaaaaaaaaaattcactaacttcagtggaaaaaccaggaggcacattcccagcccctttcccccaacacacagtgtgttaatattagacttcccagctgatatgaaaaagctttgagttcctgggtgtgtcacatagattgctttcgtttcacattgctggaaaatcagtatgagtggacagtcatcctagttgactctcaaaatcatttctcttccagacagagactttgctactcccaagtgaaaacaaggttaatgcagatattccaaatgcatgagagaattccaaatggcaagaacagcaaatttgattttatatgaagaatgttggcatgcacatgtacttttttcattttcaaattacctcctgttgccatgtatatgtactgtgattcggagcattccttatagcacttcatattttttcctgcatctgggaaagatagttctcttacattttagtaaaagggacattactggttattaaatataccatgtgcccaggatagttggaataattttctatttaatacttacacttcaggcctctagcagaatttttattcatgttagaaagggttattaccccttagagcacgtattatagcacatatgtcaacattttaatgttaaaaaaaaaacttttttgtctatactgaagacaacttatataccacaagtaaagttatagtcctaaccacatacttgttaagttcctgtcaccaggctttcagttactgtgtccaagtgggcacatgtcccttactctgcctgctgtgtgagttagtgggaatggggtaatagcccttccgagccttcctaagaagatagccagttcagaccttggcccaagtccctgggctctgggaagccatcaaggatcaggtacctggagaggaagcatggatgtgggagagggaacccacggcagatgatcttacagtgctagagttggctgcctccctcacagccgcacttttccccctctcaaacatgctcagcatgcctgccacctgcctgtggcattttcctccccacccttcccctcagagatggctttgatgatgactgtacccaggtaccttttaaccacttatatttgctgaagctgcaggccttggccagaacccatagacaagaccacccatgaccaccaagtcaacttagaccttgctagatccatgagattaaacacatgcaactgtaccaatgcaaggcattttgctgtcagggtagcattctgtggatattgagataactaagtgctccaacttctgatttccatttcacagaatatccgtcttcagggtgaatgtttaatccagggtcagctgcttcctagcatactcttagctcttagaataggaaaatgaaggttgagtgcatacatgcctcagcaatgctgaaattggaatggattgtagaggtgatttagggagcttccacgcctctgctcttgccaagtagccacattatcagatgccacatcatagaagtgcttctctgtgacactactcagtttctccagtggcgcaatctgccccctgtgtttctatacatcctgaatacaaagcagggcagacctggtgagtgaggtggtgctgggtcccttgtaacccaaggcagacacactcctgctcctgtgtctgttgcccagagaggcacaatccacctgccttagacaggaacccccactgactgactgacagtcctgagggttttccaccacagaatcacgcccaagaggcatcggctgatgtatttgccacccccttgtaggaacttctttggtcgagccaacttctgtgtaaaagcccagaactggtactaagggccaaccttcacctgtgttataggccatcccctttattggacttagtctgtaaattagattgttccactggagcagggaagagggaaacatgtattttgccccatgatatagcatggacatgtagtaacttttgtgatgccatgaatttgaactatattagtatctgttttttgttgttgttgtttgttgttgttgttttgttttgtagacagacaaccccctaagcaaagtcaaaactctggaacacacaatatccattatccaaaatcttttctgttttaatgagagttggtttgttttcagtagttttatgataactcccatgttaggttttcttgatttgattgccttgtggtagtaatttgagcaggtgtctttacagccctgtacctcaaagcactctctacagaccaggagcacctgcatcagctgggaacttattagaaattcagactctcaggccattttccagacatgccaagtcagaatctgcattttagcaagatcccaagtgattcatgtggactttaagatttgagacattctgctcttgcagcctttcagacaatagcaaccttattgaatcataaaatccagatctttgagtaaatacaaggcttcctaggatattaatctatacccatgtcaagtgctggccctagcagccaagtttcatgacttttttttagatgtgagcatcattagagtccatatgtggtcataaatcaagccttgcatttataaatattactaagtgggaaagtttagataatggactttcggtcttcctttctttctttcttttttttttaatagactttattttctagtgcagttttaggtccacagcgatattgagaagaaggcacaaagatttatcatatattccctacccctacacatgcacagcctcccccatcatcagcatcctccatcagagtggtgcatttgttacaattgaatctccgttgacatcattatcactcagagtccactctgatgatttacattagagctcgctcttggtgttgtacattctatgggtttggaaaaatttataatgacatgtatccaccattccataactattcatagaataatctcattgccctaaaaattctctgtgctttgcctgtgtatcccctaatctcccctaacccctggcaaccactgattttttactgtctccagagttttgccttttccagaatgttatatggttggaatcatacattatgtcgcctttccagattggcttctgattcgcttagtaatatacatttaattttcttttttcttctttttctttttcctttttttttcctttttttttgtgtgtgttttttttttgtttgttttattttttgtttgtttgtttgtttgttttggacttggagttttgcacttgttgcccaggctggaatgcaatggcatgatcttggctcgctgctacctccatctcccaggctcaaacggttctcctgccccagcttcccaagtagctgggattgcaggtgcccgccaccatgcccagctaactttgtatttttagtagagacggggtttcaccatgttggtcaggctggtctcaaactcctgacctcaggtgatccgcccgccttagcttcccaaagtgctaggattacaggtgtgagcaaccgcacctggccatatttaattttcttccatgtcttttcatggcttgatagctcatttctttttagtgctaagtaacattccattgtctgaatgtaccacagtttatttgttaattcacctatcgaaggacatcttggttgcttccaaattctggcaataaataaagctgctgtacacatctatgttgtcttttcaatagaacagatcaaaataaaatataaatttgttttcatgtgagaggctttgttgactggacaccagattctgttctccttcaaattcagttctcttctgctcgtagatattgacgagtgtcagaacggcccagtgtgccagcgcaacgccgaatgcatcaacactgcaggcagctaccgctgtgactgtaagcccggctaccgcttcacctccacaggacagtgcaatggtatgtagtgccccacaggctggacatgcctacccaagagtttgtcttcatgaagcttcagatatctggatttattttcagatagttaagctgaagaatatatgagttaagatttagattgatgaactctaatattaaactaaattggaaaaagggatattgtcaaaatatctaaacacttagctttttaatcctctttctggatgagatattttcaaaacaagaagtaaatcattcgcatacatagatttcgtatttgcctgtctgctgccctgcctgcaaacactcacccccacacattacacacacacacaattatgcatacacacattcccctaagcaacatttaggaccaaatgatttttttccttccacagaatccctctcagaaaggtgaggttttcaccatcttggctgcataccccaaatctagacagtgaagctctcctgagctgggtcagattaatctgcagaaacagaacaaacaaagccatcgcttttcttcccagtcatcttacagggaaagggtcactcactgaaggcagcaaacatcaacagcctttattagctatttattcccatgacccctagagattagatttttttggtgttcacttttgtcagggatgtgatagaaataggaagcacgttggcatgttatcaacttcagtgtacggtgaagttattcagtatctgatggtatcttgtagccagtggtgtgaaaatttaaaagactgctgtttcagcccagaaacaaaataatatctcagaatgattttcttgtaagtttttaagtaattctgaatctgtatatttagcaaaaatcactgtatatttagcaaagcaaatcattgtatattagtcaggaagaatgtgttattttgctcacggttcatttcacggggggtttcctggatattttatgcatttgtgaatgaaacaacacaggggaacgtggtcagattttccttggatttccttgcctaccagtgattaagtggtaggaagtgcactgttctctttagggtattttgcattgttttatgagaccttggtgggaagagggtgtaattgccaaacaaaaaaatcgcattgagaatcaagacttgttttgttgagtttaaaggaaaatgtgtaagtatttagcattttgtcaacagagctgttgctatccatgtattaaaaatacaggacaggaaaagcagggacgtctctgatatgaaccacaataccctagagaaacttggcattgataccacttccctgcattttgctcataatttatatttctttagaactggatgaaataattccagtcaaaataaagaattgctgataatatagaatgagtcatttcacaccatttcacactcaggtaagaagtgggacagagctatttatagatcaagataagacattcagccatagcctgctggagcttaagtcatttactgttttcttgtaggagactatcatacataaaatgcagccagccataagtgttgtgagtgagcatcatttgcagccaaaagcttgatttcctttattcattgaaatcctcagaagaaagggaattaacttgagttttgcaaccattcagcctgttgggttgaagacctcattctagaaatgtctttatttatgtcttacttttaaaatatctttaaatgctattctatacttggcattttttttttcaggcatgctgcaaagtactcctttgtgcatctgtttaaaatgaaaataactaaaactttctctccatcatgagatccttatttgaattcataagcacattatttcaaatcccaaatcacacctggccatagcacccacattattgctgagagagctgagagaataattagatatctgagctcaggatgctagtctgacagcagaagctggatagttagaacaaatgcaacccccttctgaaatgtcttgccccacaaaagacaaggaacagtttcttcccagctacttccttgtggtttcctctctttctctgttgactatttgggtttctttccacagtagcctgttcagacctcctatcccaacctcaaatatgatcatctaagagttcaaattctggtgcttgtggaaacctagatttctgctctagttttaccagtagaactccaaagtactccccatgtttcatttttcatttatttaaaccatcatgaaatagggcagtagatgaaaggaaattcctaattggggatccctttctaataagatccttaaggctctccatttccttgtggaactcagatatgagacagacctcgtcccctgcatacctccaggtccagtcctacctgaaggtgccaaagttttgggccaactatggtaggacctgagacacccttcctcaagatcggaaatcagtctcctctgcctatactgggaagcagttggctcactttaaattcattttctcaaaagggaataatcataatttgttaaatagcatttctgcataggctagtagtagttcctaagctgctctatttcaatttcccctcataatgatatactccacttcacttggaacttctaaatggtatgatgattcatctactaaataggagataaccataacagtggcatcccggacacatgaaatggaggagatgtccatgattctggcacagggagggttgctgtgtgcagcaaaaagtgtccattcatgattactgtgttctgagtagacattgcaggcaaacggcaagtctggattatttaactaagagcgaaatgccatctgccctacagcatctgcagcaaagatgacactccatttgctttcttctgtgacagtaggaaaatcagaatggcacagtgctcttcaaagtacatttactctaaacatagagctttaaaaaattagagacgtaagttggcatataattatgtcatatgtgaattcatgcattaaattctgcccctcagataatcagatttcaggaaagcaacaaagattcagttgatgataaatataatttagaacttaaagactggcagaagcaagatgagagggcttccttttgaatggatgagagtaaaaagaaagagacagtgttcaggttgtcacatgctaaaaggagccctgtgtagacgtgaatacttggtgaagatggaacaaaaagttacaggcataagacaaaacaaagagatgcaacttgaacaagcagccatgtaggttgtccatcaagaaaaacttaatcttagtcataggatttgactttgatataaatttacaaaggaagccatgaactatccatgacttaaggcaccaaatcttaactagacaaaatacttcaattaattccacagtctgtggtgctgcgtaggccgataatcaaacagaaaatcctcccggcttgaatccccccattttacttctaagttttctcatctttcagaatattttttgattacttacccttattttttattgtgtcaagtattgttaacatactctgactatgcctggtaaatgagagtaagttttaatccattttgatgcaaaaataaatatatctgtttcactaacttagtttagagctaggattactcctgagaatgatagctagaagtaagttattcaattatattttgtcttctaagttctcacttaagatgcttcttatttacagatcgtaatgaatgtcaagaaatccccaatatatgcagtcatgggcagtgcattgacacagttggaagcttttattgcctttgccacactggttttaaaacaaatgatgaccaaaccatgtgcttgggtaagtatgcaattattattatttttttcatatgctgttgaaagcttcatttgattctaaatatggataaaatttaatactaagtcttttagtagtatttttgctatatacaaaataaaaacacagacagatatgcagcagtgatatcctatttaatctttggcaatctgaacatgataaacctcttcctttgttattcatttggctgtcagtttagaaaaaattgactaaggggtaaattgaaaaagatattaatacaaaaatattaatgttaataggctattattcatatgtaatattgatgtggattttcttttgagtttttgagtgtgagatgaccatttttttggaagggtttatagtgtgtaccagattctcaaaggcaaatttataaatcctacaaaggcaaagaaaagttaatcatttttctagaggaaaaagagctcaggattttaaatctctttcctgatttctctattatcaggatgctgatttagaataaacttcagtgtgtaatgaatcattttcttcttttccttcctttatttttctactttaaagcaataccattaagtctttttgggacattaagaacataaatcagattcacagctgaaagaacaattaatatagtaatgtttaagtccttgactttggctatgactgggttcatccatttgggaacatttctcataaagttgtatcttctccagagtaatgacaagagcactgacagccctactcatcactgggcagctaacctgtgtaaaagctatgatgatcctgcccaactttctttctacatctctcatctgaattttctggagccccctaacatagaaccttcccaaccaaagaacttcaccagtttggctaaaaatgaatcaaggcaaaaattcttgattactagcaatgactcatctgggtgtagtcttcaaccacagacacacattagagtccctttgggttagcaatagcttcctgattcaggaatcacagatcatttatcttcatgtccaaaatgtgaaaagaaagggaatcctagctctaatcattacattttgctattctccgttgttaccttccactctctctctctctcatttcatccttgtccctcttcatggtgcctcattctttcaaaccagcagtaacaactttctttcattaaattttttattacttcctccttaatataatgtgcatctactctttataagaaatatgctagctgctgtgatgagatgcaaagacatataagatgtcagagtagctttacaaaatcatcagagaaaagtacggaccaatcaaaaggcgaataagaatgcaagcatgtatgaaaagaacaaattaagtgccatctctttggggtagtttagaaaagtgagagaagtcatcattggtggaagttgttctatgtttttatgggtgtagggaaaaaggaaaagttgtctgaaatgacaggtgagctagaaagctgagttattttgttgctgattgtggggtaatgccaggtgagtcactgctttttggtaaactggagtgagaatcttgaaggttgaagtttgccaaaggtggcaacacctcaagacccagatgcacacagagttttttccattttcaagtgaaaatatttgagaaaagtggcaagggtggagaattctagaagtaaatagaataaaataattcttgttcaggtctcatgtccttagcttgcctcctttcactggccagccaaggaaaccatttattcccaagatttagagctttgccgctgcctggtatcttgcagggatgactgctgctggagctgataccaacatcaagaagttctcagcctatggatgaggcctggtgaaccctaaaatgctctttagccactgtaaccgtgtaaccactttttctacttataattatgtttctttatggcctttcttcctactagacataaatgaatgtgaaagagatgcctgtgggaatggaacttgccggaacacaattggttccttcaactgccgctgcaatcatggtttcatcctttctcacaacaatgactgtataggtgcgtgtgcaaaattgtgcatcagcaaaggaagtcagttttatatgtgttctttgtaattagcatcatctctagtgttccagctgtcttttaaaaatgtatgctatcttatgcataacaattggttatgggacttgtcaaatacaatgtgctcaacatgaaatatattacagaagtctccccttatccgtgagggatacattctgagacccccagcagatgcctgaaaccacagatagtactgaaccctctatataccatgttttttcctacacatacatacctaaagtttaatttataaattaggcatggtaatagattaacatcaataactaataagaaaatagaacaattataacagtatactgtaataaaagttatatgactgtactttcttgtgcactgtctctctctctctcaaaatattttattgtactatactcacctatttttgggtagcagctgaccttggataactgaacccccagaaagcaaaaccatagataagagggaaccactgtaactatatccattacttttattaaaatgcttattagcagctataatttttatgtctactttgctgtaaattaaataaatttcaaaataaatggaattagattaagccaaaaaatttttaaatatacaaaagtgattctttgtatagaaattatatgattcaggactatgaaccttctggtctagatgtttcatgtagcctctcttaaataaatcattgaatctacagaatctccttctaaaacatactaggcaagagtaataagccaaattctttaaattttattgtgctataggctaatttaaatctaattgcaagaatacaaaggaatgcccttagctgaattgtgtattaggattttattttttaaatcaaaaaatttttaaatctaaaatttaaaaataaaatctaaaggaaaatcaaggaaaaactgataggaaatttgaatgtaaattgtcagtctctaatataataatgtaatcttattgttaaatgtgtataggtgcttaaagccagttctgttgttgcaaactagatcttcattggcatttcttgtttggctaagccagcaaaggccactaaaattcagaaaaagtattttttcttttagaagttttgattattgctgggattatgacatctttggaatatattaaaggattgttggggatttttctgcagatgttgatgaatgtgcaagtggaaatgggaatctttgcagaaatggccaatgcattaatacagtggggtctttccagtgccagtgcaatgaaggctatgaggtggctccagatgggaggacctgtgtgggtaagtacaggacttagaaagacctggaaagaatgcttccagagaccactcaaggaatcatgcagtctctgttctaatgcttctttctggaaacctggaggaaaagtcagagtagaattatattaatcctccctataaaggcttgtttttatttaagtatatatacacatatatatatgtatatatatatacatatatatatgtgtgtatatatatatgtatatatatatgtgtgtgtgtatatatatatatgtgtatatatatatataatcactttttcccttattttaaaaattaagctattgtactcaccaagaatactcaaactattaaacagtgaaattgctaaattgctctgtaagcaattgtgatttcccttcttaaatatttttctttaaaatacttttgtagtaagctctcatatcttttgagtatccttaaaatctatatactcactgacttttcacatgctacaattttctggaaacatttaatttgatgcaggtaaaataaaatatggttgttatgctatacatttttgaaagctgataaagcttatttttattattgcttatttttctccatggtggaattttatgaactttaatttgctttatgtatttctttgattcattctagtttttttgaattttaattgtttgatggaagtcatgccagtgggaacctcttccttatttttcccttttctttgcagatatcaatgaatgtcttctagaacccagaaaatgtgcaccaggtacctgtcaaaacttggatgggtcctacagatgcatttgcccacctggatacagtcttcaaaatgagaagtgtgaaggtaggaaagctatcagttgtagcaaatgaggagtgtcgggtgtccactggacttagcagaatgagaatttttgtaatgacgtcttcattttggaatactttatcagaaacaaatgcaagggcataggtatgacatggtctcatccttctggcaagacaagaagcactaattatcatgctaatctctaatgaagttattttgttctgtgcatatgactgatcatatgatcctgactcttttccactgtgctttcacacatttgttaggaatgctgtgtcctactcccagtatttccgaactacattttttaagtggcgattctttgcagctaaaaatagctcctgattccatttaaaaactttaaatgaccacattcaaggttggatgaatgtggttatatcgtttgtctattttgtttttacctatagagcagtggaaatgtcttatttcaaataaattctcagcaaattttacagtattacattcctttttgtttgtttgtttttaatggagacagggtcttactctgtcaccaggttgaagtacagtggcacgagtatagctcactgtaagcttgaactcctgggctcaagtgatcatcctgtctcagcctctggagtagctgggactacaggcatgtgccaccatgcctggctgattttttaattctttgtagagatggggcctccctatgttgccaggctggcctcaaactcctggcctcaaatgatcctccttcctcagcctcccaagggccttcctttaacctcaacaaatatgtcatatcattaagtgaaggacattaattgctagaatttcataaataagtagggttgaaaggattttcaagaagtcacctagttcacacccctgactttaaacaggtctgcatctaatccacaatgagaattttctctacttttaatatcgtcaattagaaattttattatatatccaatttaagtaacaatcaagtggtgatatttaaaatggaaacaccttattgaaattgtctagatgcaaattttttaagcatgttattttacttttattaaaaattggctttattatcaatacataagttcgctaaattgaacagaatatatatagaaagaaaaataactgcacagtcaatgaatgtgcccattctacaatatttggccctatcctaataagttggcatgtacaggctaatttctaccataatataaatagtcatagtaataattaaaaacaactgaaaacatttgagcattttcacaaaagttaacttttatattaagaaaaggttggatataggggtggaaggagtgtcagaatggagtaattcaatcggcaatagaagatcagattcattaataaaccacagggaacataacacaggtataaatgcaacccaataacatggcatgatggagaagctgattttgcgttgcacagaaagagaatcacttggcattgcacatttctagaatatttattgtgtggtatttacaatattaagtcaagataataaggttaatttctcaacttttccttagttgggcctcttgagaataaagttgtataatgcaagtacattttggtgtgagtagaaacctttgcacaaatataaaaataaagagcccaggatacaaggatattttgtgttttgttgaaaaaataaaaaagtattctcataaaagtagcatggctcagaattaagacttaccactttgttcactaaaaattcctgctgaaagtcaggaggaaagataagtgagtttgttggaatagagtgggcatatttttccataggtaatcgtatgttttattgaccaacccaagccaattttgaaagtagaaaagggcactattaacaataaagtcaggccaactggcatgagctggggctcccccaggcaaactaggacatatggttactcaagccattcaaacttcttattggctactcttaactaccactgtacaggagctaagatgtataatatactaaagaaaacatgccacaattctaagtgtacagtttcctattgtctatatgatgaaagaaaaagcctgtacaagaaaggtatttttgtgtcttcagaaagattaacccacaaatcaggagcgtcatcttctatgatatcgttagtttgcacttcataggattatacttattttcatgagtcttagtgttcttgtaaaattcacagttttagggctatagcatagggtattgggaaaagttctgtgggtggttggaggggagtaaatttggatcaaaggcctagatctcacattgagtgagtcactagcaatgtgcttaaagtctcagcatttctgcttcctgaacaatggtgcagtgtgactctagaatttcatgcttctttcctggcctagggtactatgaaattactctgacttttctagttagccaagcaactcagtctgggtaagagacgtttgtcactgcaccccttagaaggcagttgcacattccatttttatatcaataactgtcaaaactaattcttttgaagtcatgacaacctagaagtccagtccacagtgttatggtacagaaaaatacctttattattgtaagagtttggaaactcagttgccctttgtgtgtccacattgtgtgtttggtacctgatgatgtctccatcgtgttttgactttgtttgactcatgtgattcttttagatattgatgagtgtgtcgaagagccagaaatttgtgccctgggcacatgcagtaacactgaaggcagcttcaaatgtctgtgtccagaagggttttccttgtcctccagtggaagaaggtgccaaggtaagtgtctttgaaggctttgggctttcaatgctgcatgtttatttgtggtggtcttatttttcaaacatggcaaagctctgtttctttgtgaacaggaagatggagagttttcattcacccagaggtctaatgataaccatatgtcagaaggttcattttcacttttaaggttaaaaactcatccatcaagttatggttgcttatacaattgtactgacacataaacctctctcccactaagaacacaaatgctgataggcccatcagtggggaaacaccttgagccaccgaaacagcaaagcctgggggaagttgagctacatatcccctacctctgaagagataagctgaaaaatgtgggtccaaagttagacttgagactgaaaaactgcacattaacccatttgcccccacaatatggtaaccatcccttatatcacaaattctccaagaaaacaaaaataaatttaaactgatcaggattcttgctgggccattgttcatttttaggaataatacttgtcaactatttgagtaaagattttcaagggtttgccaatgactttcaaattttaaacaaaaatcaaaaggatcctgaactttggcataacacagtatgtacttaagtcccagaaaactgtttagacttttctaaacaatacagttgtgtatggatatctacatacacaaactagtttcatgaattccggggaagggagatgaaacaaacacatgtatttcttttttttccacttgtagcttttgttgtttggttgttactgttgttttgatgttgagttgggttttttttttttttcatggttttttggttttgcttccgtattaccaaatatggaagaggcactggatatcatttaaggttcaaaaaattgagtttggggtcccagccctgccatatttagtctagagcaagtcatttaatcttttggaagctcaatttcctcattttaaacaacaataatatctgcccaaccagccttactgtgacaaagctttgttagtttctgagtcctttgtagactcttgttgttattctaatgatctgattaactttttacttttcaactagttatttgggaagtaagaaggagagggttgagagttctccggttgatttcagcttgttggtagttgtcagtggtctgtgtggatttcagggtggtgcttaattcgaacagatattctgcatggtacagaccagtcagataaattctaactcctactcccttgtttttgtgtgcctttggcttggcctgaatttggaaagaaagcagtgagaaaccaggtgtgaatctgccgatgtggcaggccagaggaaactcctaggctattaattcaatttgcactggcccatcacagagcaagctaacgctgcaggaagaatcagcccagctgtgagcagccctgccacatgctcagctccaggaggcagagccagaactgaggaatgcaagcagggaaagtgacttttgtagttctgatgaaatttcgaggtcattaagggctctttgcagatggactggtaaacaggcatcccagtgagtcctgaagtatgtgggcaagcacagctctcttccccaatgcaagacacccttgattaataagccaattctagagaatcaccacaagctaaagtaagtctcctacagagcacagattttgctggagccaggaaattgagagctgggtttttcttgtaagatgacaaattaggagtcagacttctattgctcatgaaatgagaaaattccacagaaccgtggataatgttttttaaaaagcgaatgccatgggactcaggtggacagagcctggcacaaaagaccacaggtgtaaatgagccactcccacttgcaaagttcaacgaagagaatttgccacttagactgactcaagacttcgtgcatttgagtctctgtctaatgccaagatttttttttttcggggtggagtggtgtgggggagatagagctggggtctgggacgaagtcagctattaaaggaaaagagaatgagaattttaatacaccaatattacaacatacatatttaaagaaacactacaaactggaagacaaagcagagttaagttttcatatatttgttgagacatttttgtgagtagtcactgaattatatctaaaggtagttggaggcataaataacaaaaacaagactgataaatacaaaacattatatgtgacaaagaacttgaagaataaaagagatcaaaagtgttctccaagaaacaagaatttgttcagtcttgaagtttctcagcaaagcaaacatttgggtggcagagatgccgcaggattgacttttattgctcttgaccttcagaaggataattcattgaaaggtgcttgccaggtccttgccacaacagatggggaagtggaatagaaattagagagatgatttatctggatgagttggtagccatgaaaggttgagcaggtttactggggaggctacctgaatttgatttacataacttggtaaatataatagatagatagatagaaactttaattcatgaaaacctttcctttgttatctctggcaactctgttattcctacattgtcttctttgtcatgaaataaaagctggtgagactgtcttaacagaagtgcttaggtggttatgatagtatggttcctgggattgaaaaacagtgatggaagtgaatgaaaaaggcagaggtggtcagatataaagaaagaagaatagtacaatatgggtatgaaagcatttcttttaaacctgcagattgtggcctctgtgtaatgagaggagttttggaaggctttaagaagtcaagttcgagggaaaacacagtccatacctctggttgagctcactttttggagtcaatgtgttgtatgagaaatggaaaagcccgtttccaaaattatgtcaagcaatgttggagaattttataggaagtagatcccatcttctttgttggagtcatcaaagcaataatcaatattgaaatatattctttcaaagaaagactattctgttcccacccacccacagccctgccctcctcttccttccctctctgtgttgagctaaacaagcttcttttaaaaatttaacattgacacagctctgcatatgtgtgtgtgtgtaaaatctacaaaaagccccacttgcattttgtagccagcatctccgggagtatctgcttcagtgaccaacccttgtgttgtatttttgcccatctacaaagttgccacttctgtatttgttctgtgcctgtgatctgggattttattttagttccagagtttaggggacacagaataaaccacaaagtgtgatatcacagtaaatattagaactaagaggattctcttactctagtgtgctcattaaacatgatattgcaagcagagctatcaatgaaggaatcttgtgaatgattccttctgtggactttccaatcctgaagtcactgacagatgtcagttttgaaaactgtcagttttggattttattggattcacatcgggttactttgaaatagtgactaaaatgagaagtaataaatttaagttcatagagttgttcatcagatctcactatacaaaagatacccatgactttaacaatctcagctcagttaccattagaatcacgtaaggagtattgctgtggtcctgagaggagaacatatataacatagtgggttgttctttatttgctatggtgcaatacggactcagtaggaaagcaactgaagggtgtcataaatttatgctgcagatttgcgaatgagctactgttatgcgaagtttgaaggaggaaagtgttcatcacccaaatccagaaatcactccaagcaggaatgctgctgtgccttgaagggagaaggctggggagacccctgcgagctctgccccacggaacctgatggtatgtctgtcatctgcatttctctctgggccatgcagggtgcagactggccatgatgtaagtaagactgtaggccttaaagacagtaacacaatttaatttaattgtaagtctaattagaatgttcattaaaaattattttatctcaggagcttggtagttattttctttttaattatgtcatgaatcacagatgcccaaggagtagacacaacatcttagggagtctcgttaaataacttcctctggtttctgggcttgttttttccatcatttatcaatatgcacagcatgtagcaattttctacctcaaaatacttgtggagaagcttgtaatgaattgctattgttctatctattaatgagtgtctccaccacagaggccttccgccagatatgtccttatggaagtgggatcatcgtgggacctgatgattcagcagttggtcagttgcctgtgctggattctcagcatttctcagtattctcaatctgcttcttctctagttattcttatttttctccatctatcttggaaaattaagtgctacttttttgtcccttcatttagatagcaattatattattgcattattagataatcttttgattaaacactgaaatgatcataatttatcttcacgtttaaaaaataccttgttattcactattttttttctcttgcttaagatatggacgaatgcaaagaacccgatgtctgtaaacatggacagtgcatcaatacagatggttcctatcgctgcgagtgtccctttggttatattctagcagggaatgaatgtgtaggtgagtaataagttttcttccataggaactttacaaattaaaaattaagctatacagtattcactgtatagccatgaatataggtaccaagatggcactgaaataagttttatccatccactcatacatcattcatttagaatactagtgagtcaccatcaggtcccaggcactgtgctaggctctggagctgcagcactgaaccacaaagacaagttccttcctttcatggaccttacagcctaatggtgaaggcagacactggacatatcagaagagatactagaaaggacaacatcataatgaaagtctttgtgaaattttttaaaaattgttaatggtcataatcttattcccttatcaaataaaaattttatctggattcttttacatttagtaagatgaaaggctatataaccagtacacaatcttttttttgtaaccctgtttttaaaatgtcaaataatggctcctctggctggcctttgacccttaatcaacactaactctaacttaaatccaaggatcatatttagttatctaagaattccagagtgattcaatataacataattaatactagcataaatgctgagagtttgtctgtgtgaattagaaagtactttttccatacaagaaatcaggttatgaagatttcagctccagctatggctgtgggagtttaagcagtttttttagcttttctaggccttagaatataatattatgcaagtaaaataacatttctaattacctttgcagctctaaagatcaatggtatcgggatttttattaacttgaaacagaaataatattcttgacagtaattgaatattatagtagaacaaaagcaaatatttcaatgttttctcctcagaatcttcagttagtgctaatatgtgcatatgaaatgagcctcttcgcctaggagctccccaccatagcctcttgcctttacttttgacttaagaacctcagcacaagaaacaactgttgacaagagccattactcttctgtgccttagatagctaaaatatcaatgttatttctcaaaattatttctttcctaaggggagatattctccccaagggatgtgtcagaataagaatggtgagtattctaggtggatgggttagaaggcatatatacacacacacacacacacacacacacacacacacacacatatacacatatatatacacacatatatatacacacatatatatacacatatatatacacacatatatatacacacacacatgcacacacacacacacacacacacattttaggtctctggtcaaagatttgttctctccgcctgtgttttagagcggtcataacctaaacatatttttttctagcctttcctcttcctaatgtaaaccatctggtttcaacagaatcaacacaatctacttgaatcttgattttatttgatgtattaattttacttaacctctggtcttttattttacgtaagtttagtcttttattttatatctggcaaaaatccatcatgtttaaggcttcttggggagtgatgtaatgtaaggccaaactgtggatgtatttctgctttaaacaagcagaaacttttgacgagtgataggggcctttttttttttaacccttagagcatctactccaagtagaagatttagtttataatgtgggaggctggagaaactcatggagaagagcactgtaagggctatatgtccaggcactgtcattctcactgtcattgccactgccactgagcaagtcgaatttcacggctataaacctgagataataagacatgcacactccctttttgcaagaacagaatgagaattaaacattacagatcaggctgggcttggtggctcacacctttaatctcagcactttgggatgccgaggtgggcagattgcttgaggtcaagagttcaagaccagcctggccaacatggcgaaaccctgtctctactaaaaatacaaaaattacctgagcgtggtgatgtgcacccataattccagctactcaggaggctgaggcatgagattcacttgaacctgagaggcagagtttgcatgagctgaaatcgcgccacagcactgcagtctggatgtcaaagtgagactctgtctcaaaacaacaacaacaacaaaattacagtttaaaatcctctgatagaataaaaggtattatctcaattcatcatgttttggacacattcctggtttcttgcagatactgatgaatgttctgttggcaatccttgtggaaatggaacctgcaagaatgtgattggaggttttgaatgcacctgcgaggagggatttgagcccggtccaatgatgacatgtgaaggtacatctcttaaacagagaacagttgattacgtgtactgatcctgggaacaattggttgattacaagtcttaatattaaatacaactcagggtgtatataataaagatcatctaggcctgatgggccatttgatcattcttcttttgtggcctcttctctgtagggaaagagagatatccaagaatgatacagttgtgtgttcatggcacatctacactgtatatcacagagagttctcattggtgtttccctaccacttatatttagatgcttccgtgttgtttaataccttctttcttactctcactttctccttctttctgtctctcatactccctttctttttcttttctctttttctcttcttttctatttctaggagcactgcacactaagatacccaccatcatcctgtagccatttggaggcaatcacagcaaaagcggttgcctgtaatatataagcatctgaaaagtgtccatccgtaagcctggtggaatgtatggaaagaaggaaagggagggagtgtctagagcagtggctctcaaagggtggttcccaggagcagctgtatcagcatcacctgggaacttattagaaatgcacattgtgaggcctcatccaagacctcctaaatcagaaactccgagagtggggtggagcccagcagccctctaggtgatctgatacactctcaagtagggattcactggcctaaggaaagaatgaaggagaggtgaaggcagagaataaagttggtagcaaagagagctcttcatcagatatgatctatcaaatgcccattgtcagagttgtggtaaatctttaaaggttgtgactaagtcatgatctgggctctcactcgtgttcttagtcagcactggccttggggagcaacatgatagttgagatggtctattttaatcctgcttttccaaaacacattctgatggttccaaactctgcagtctgcagaaatgactttttttccattaacagtaaactcattcccatctatttaaggtttgaacatgggcatctgtgtaaactgagtgtctctgtcagtataaaatgatctggaacactatttgcttgggcagaagaattgctgttatttcacaggagcctctttgtttgggggaaagagaggtggttaacaatattggaggagttggtttctgttctgaccacaattgttttggcggaatggggcaaaactgattcccacgccatgtaactgttgggagtgacaaatggtcaacctgagccttctaagccaaaatttcagaagagcccctcaaatgttgggtggcctgtaatttcccatccacctaaataatcattaataattataccaggacaacaaacataaactgggactgtgctgggagaaccgggatggagagtcactctgtttataccaaatataaaataatcaacccattttataatttccgggaaatgggagaccacttgatccatccatgtttatgacaatgaagcattgcaacttttggtaaagttttagagttttagttcaattggtaggttcccttttgttgctgtccatgatcccttatttacttactctcctctgctgcagatataaatgaatgtgcccagaatcctctgctctgtgccttccgatgtgtgaacacttatgggtcatatgaatgcaaatgtcccgtgggatatgtgctcagagaagaccgtaggatgtgcaaaggtgagtcatcgtgttcaaggtcatctaagccaggaagctttatctgtgaggggagatgtccctcaaagcttcccttagtaggagaaggctgggaattggaatataaatagtccgtggacaatacgggggttgtcactgccacgtttccccctaaattgtagctggaagcatcatcaagccaagttgaggactgcactgcacatcctttattaggtctcactgtgcatcgcatgctcacaacacgccagtatttctacaagatatgggaatagaaagaaaaagacatttccccacgttcaaaaaacccaatatgaagagattgagacagatataaatacgttctcataatacagtgtgataaatgctatggtgattatatatacaaaatgctctgagaacaccaaaggatattctatttcaagaatggggtaacacgtggaatctactttagctaaaccatctccattaaaaatacctcctgaacacctgcaatttcctaagcactgaactaggctctatttcacaaactgcagtaatcatagagtttgctcttgaagagctctgatttgctcctgtcaatatcttaaatgaacagacacctgttctctcaagatggcgtaaatataattttgcttaagggtggggaaatttcctaaatgaaaggtcctaatcatatgcagaataaatttcaaatttctcagctcagagcatgtaaacgggaaagatagaaaaataaagaagtacaataggacagaaagtaaagactgaggaaggcccaaccaagtccagaaaaggaaatgaaggagggaagaaccagtagagaataagatatttgagatatataatataaaatagtcatttactattatatcctgtttactaatattatcatataaaaataatgtcatattggccaggcacggtggcttatgcctgtaatcccagcactttgggaggccgaggtgggtggataaccagaggtcaggagtttgagaccagcctgaccaacatagtgaaaccctgtctctactaaaaatacaaaaaattagctggcgtgatggcgcattcttgtaatctcacctacttgggaggctgaggcagaagaattgcttgaaccccggaggtggaggttgcagtgagctgagatcatgccactgcactccagactggatgacggagtgagactccatctcaaaaaaataataatatcatattataatatattgtgttattattataattattgcataatgtaagctttggtttgttactcttacaatccattatgattgtagtactattataattattgccttatcatatattgtgattataatgctgttataattattgttatattaagatatatccattatattataattacatgaggcccttttagttcaattagtcaacaagaattagaaatcatgcttcaacaaaggagtataaaacataaagggacagccaggcacgatggctcatgcctgtaatcccagcactttgggaggctgaggtgggtggatcacttgaggccaggagtttgagaccagactggacaacatggtgaaaccccatctctactaaaaatacaaaaaaaattagccaggcgtggtggtgcatgcctgtaatcccagatacttgggagactgaggtatgagaatcacttgaacccgggaggcagaggttgaagtgagctgagatcgggccactgcactccagcctgggcaacagagagagactctttcaaaaacataaataaataaaaataaaaataaataaaaaataagggaaggagaagagagaaaaggcatgatcagaatcatgcttcttgaagaggtcatcagttgattagggagcaatttcttcaagttcaaaggtggttagaagattcctttccattctttagagatcatactcaacagagcagaaggaaatacagccagtagtgaaataacagatgaaaattggttacttactaacattttatgtttaaaagtcaggtaattaaggcagatatatgcattttctttgacaaatttgtgattgtacattttttacagatgaggatgagtgtgaagagggaaaacatgactgtactgaaaaacaaatggaatgcaagaacctcattggcacatatatgtgcatctgtggacccgggtatcagcggagacctgatggagaaggctgtgtaggtaagaggatccctgtggaaggagctttgagtgcatcagaagtgacagtggacagaaggaacctgggctctgagttcttgggatactgttcttggcgagacccattttgttctcttaaccgcatgtcaggactctccatggtggttcccttgcctcgtgatcatttgtgaattccaagagcactgtcattgtccctctgatctggcctttgtctgctttcttgacccatttgctgccaggatttgaacagcatgccttttctctattctcctcctttactttccatactcttttgttgatttgggggtcaattctccccatcacattggaatgcttccctattgacttagctttgctacaaatgccaggtacctctgaatcaggaatatctcaaaaccattgggatctacctccagaaaatctggtcttgtctagagtagcatccaggcactgatatttttttaaagctcctcagctgattctaatagggatccaacattgaggacttcagccttagaccaggagttggcaaactgcctacaggctaattccagcctgccagcccactgtgtgtttttataaataaggttttattaaacataggtataaccattcatttgcatattgtccatggctactttcatgccacaatggcagagctaagtggttgcaactgagaccatatgacccacaaagcctaaaatatttcctatttgaccctaacaaaaagtttcctgacctctgcttagataataattacaggagaaaattattaaaaccttctcacacgcattctctttctttttaataataaatggtattataaagatatattttatgttgtcattcaagaagattaagaatcccattgcccttttactctgtacaatacagattgaagcaggaattaaagaacagattctaaaagcacagaatcagaaaatatgtagattaattgtcacacactggatcctcctggatcagtaattctcaacctctgctgcactttggaatcatttggggagctcaagtccaacctcagatattctgattgaattgttctgggggtggctggggcattgcattggggttttgaacctgttttaacactgttctggattcaccttccaactttctctctttcctagtgagagctccatctgagggaccctgaactattctcaaaggaagggaagcacctcagcaaattatttttgatctttctaaataatcatcagataattctaagaatctgtagatattttaatgtttttttaaacctgggaaactgagttgtagtttatgatttcttaataatattgttgaaatattacaataaatgcaacctatattggagatataatctaggttaatctgaagattaatctagacaaactcccccagatcaatattgaccattacagatattattctaacatgtattaaaatatttctttcatatgctgatattcacatttttccctccttcacttgaaataacactttgagagtcctttttatgtcctaatatgaaaagatttaaattttactaagtgaaaaatgtaagtgtgcataaaatgctaccatctatgtttaagtatataaaatgctatcagttaggcttttaaaagatctgaagtgcacacacacatacacatattatgtatgtatttgcttttatatgcataatccagctctggaaggatacattagaaatcggccccagaattggttgcttttcaggaggggagtttggtgtctgggaaataggaaatgaagggggtacttttgctgaatctccttttgtacctttttaattttgaaccatgtgaagagataagctatttacaaactatataggaaagaagaaaatctattcttctataaaagattcagatggctctttctgttttcagtctttcaatgaaaccaaacagttaagaatgaattgaagtctcttttataccttttaaattttgagccatgtgaacagattagtgattcaaaagctaagttaagaaggaaagatgtgagagagggaaggaaggtgagagggagggaagggaggaaggaaaggagaaaggaacaaagggagggaaggagggagggaggaaggaaggaacgaaggaaggagctccatcctctataaaatggtcagatgactcttcttgtttttggtccttcaataaaatcaaacagatgagaatgaatgtcagacgaagccagggatctgtgagaatgggcgctgcctcaacacccgtgggagctacacctgtgagtgtaatgatgggtttaccgccagccccaaccaggacgagtgccttggtgagtacagttggcaccgcactttcctaacctcagcctccacactgggatgctggaaacccagacttcttatttaaaatacaagaaaatgtcaaaatctgaggaaggataaaaaatgttcatattttggagatgccgtaatgactgtgattgtccattgggctcagcaccaccctgcagctaaattcttcctttgctaattggatcctgaatcacttgtttggaatttcttggctgcctttgaagcccttggtgatcaggatccacttccgtatgtttctctgcccctctgtctgtaagcatggctattcccctgtatttctgggagcagagagagttataagcttgtctaggccaatgtctttctgcctacttactgaatgtcttatttgtttccctcagacgtcatcctttctcttttactgctgtctccagctttcccctcttgcttcttctcacccagggtaaagtgttacatccttttttggtttttatatctgaccaaatttttaatattttgtttgctcttaaaatttcctgacatcccctttgccatataatgtcccttccagacaatcgggaagggtactgcttcacagaggtgctacaaaacatgtgtcagatcggctccagcaacaggaaccccgtcaccaaatcggaatgctgctgtgacggagggagaggctggggtccccactgtgagatctgccctttccaggggactgtggctttcaagaaactctgtccccatggccgaggattcatgaccaatggagcaggtacttcatttatagtccaaaaatacttgcagggaatctatttatttgttttttgtgtgaaacacagatgaaaatatggagtttgcaatatgtgcctaggttgaattgcacagctgaggccaacaaaaattcttcattatggagttttagacatttgaggtcatgctgccaaagtggccttggtccacttgattaagctgtgtgtgcttaggaccctccctctgcattccagcgagtcttcaactttttaaaccgtttactataagtcaattggctactcagaatataatttttaaattttttagataaactttgaaataaatgattattaaatgtgcaaaccagtccaccaagatgtggaactcctaaaactggccaaactgtattgcataaaagaagtataaatcatgctgatatcctggcaattagacacaattgcatctggaaaagcacaagctccttaactagagcaggatgaggaagtgtcagactgtctaaggcaactctagagatatctaggcctgtcaccaatatgattcctgtgtttatcaactgtaactacaattggtttttagttcataaaaggactgagaaaaggtgagagcttttttgagcttcttgggagggaattagaagtgaaaggggaagaaggaggttaagaaggatttgtgtttgtattggaaagatgtggctgaaggcagaataatggaactggatgtgatttaaaaaaaaagaaaaaacagacctagaaaggtaagatggagtgaccaaaagcaatttatgattctttggaggatgtagcaataagatagccgaaaaaactcacttctggagaccaataagagtgtgctaaattgcacttcagagtagacttgtaaaggtcagatacacccagctgttggtataaaatggttatttggcagtcaagggctgagaacccatgtagaaagtgcttgtatcggcacttcgccaagcagtaaggaggtaaaatgggtcaagatgtggaagacagtggttttaatgctcaacagtgcatattgacccagtctttctctctgtggtacagccatgagtgagggtctcccttccttagcaggctgcaaaaacccagcactgtcatccacctcagagccctggttagtttcccccctcaccagaggacagaagttcatctcatttccccaatattatgtaatttgaactttttcaggattaaccacaaagacaacaaaaataatgtaaaaacaaaaaacaaaaaaccttacttattttgagcatgcaatactagggggtggaaatggggtttcctcatcaaaaggatctgcttctgtgattcatttattagatgtcagcaggaggcaagcttaatggcatgagatgacacaaaaagccaaatatgtctagatggggtggctgttctatggatccagaagagaaaaatatacatttagaagaccagttgtttttaaagtttttctgtggctgaattattttatcaattgtagtctaatgaagttatttgtttaccttttgatatagctactgttacatattaaatttatgctgtcatcttactggtttaatttcttaggcccaaaatatagtaacacaatttattagtatttacactgaagtgaccccctacatattaatgttgtcaattttatgatatatttcttaatttatatttgttaaattacagatatcgatgaatgcaaggttattcacgatgtttgccgaaatggggaatgtgtcaatgacagaggatcatatcattgcatttgtaaaactgggtacactccagatataactgggacttcctgtgtaggtaagtgtctatttctgatggcttatcctcaagtggaaattttagattatggaaaaaaaaaaacccaaagctaaaaatctaaaaagtctgtgcagtttcataggaaagcacaggacaatcatcaaagtctacacagagtttcctttttctttccccgaaactaaaattcttcgttagaccctgtggaaattgagcgtgtacacatcatttttagatgcacagtcacgctgtatttctttgatcatagatctgaacgagtgcaaccaggctcccaaaccctgcaattttatctgcaaaaacacagaagggagttaccagtgttcatgcccgaaaggctacattctgcaagaggatggaaggagctgcaaaggtaaagtagaattgaccattgcccctcacctagctcctgacacatggctgcattcctttgcctgtaagaactccacaggcaagccgaaagacctgctctacaggcaggaggtgcttccctggggttaatgcctccatgggacctacctcctgtgctggagggaaggaggctaaagccagggagattgtggaggaagcagctgtccttgctgcatgccccctgggcatccatggtggccatccatgactgtctcagagatagcagggccagcttcaatggctctggtggggcagattcttaattggtgacctcctctctgctttctgttttttgtatttattctttatagctatatagttcaggtttccaggaaggtcctgcctcggaataatcagtgccatgatcgtagaggacattgtgcctaatgaattagatgctgtgtccagatttttgttctgcagaaaaagtctatttctgccctgtaggagcttccctgagacataaatatcacacagaattaagaaccagaaaagctctgggcagaaatcccttctcaaccagaagttatcctttgcaaaatttttttggtttaattttactcctgtaaacatcttcctccacaataagaacattatatttagtgaatagcactagtgagtcatacttaacaataatttgggaaatcagagatttggagaagaaaagatagaccaagtggtagagcaagagatatcatgtcatgccatgaaactttgaaggaaatttatagaaacatacagaagtaaggaaggtaaaggatagagtggagtctttttcctattttttctcataaagcttaagttcttccacttacttggtatatataactaaatatcaaatgaatgatgcagctgtgtgtaccactgaactgagaagaggctagaagggtggagggtgggaccagcacatccccacggaggatccagattggaggagaggagaggagagaagtggagagcagagagaagttgggctcttgacctctttcctgtgtctgctgaaagggagagttaagagacatgtaatagtggatgacatcatgggcaagtgcctgaggccttcctgtgcagcacaaagcctgtataatcctgtagtttggggagaggaagttgagagacctacttacacattctaaacatcttaaatgaagtcgctcatagctttgttcttctcaaatgtggaacttattttacatctggggtcactgtgagttctaggcaatgtgaagctataactcagagccataaatttattcatataaatgaagaaccaaattcaaggggaaaatatctctcattgtatatattatctgtaacaagcaaaacaaatttatagcattttttctaacctctgggggcagaaaattctcaaaagtttccagcaattaaaagatgaaaaatgaaaatgcatcaataaagttctctttatggctttaggagtgcaaagagcaactgtaatttttacatgtccactcacaacttgtcccttttcctgttttttcccataaggttcaaattcttccacttacttggtatatataactaaatatcaaatgaatagtgcagatagttgcaccacagtcactgagaaggaggaagccagaagggtggccgtgggagcagcacatccccagtgagagatgggtagaatgcagattagaggggagaagaggaggaagggcatcttggaggcaagagcagcaagtgctgctgttcttcatgtgttgtactcatgaaatggtgttaggagaaatcactgagtcatcttcctcacctgttgcaggtgagcttcagcaaatgtgtcatgatgctccagccaagctccttgggccatagacaggggaaaccagtccacagactctgagaaagctgaacagagagtgcatatcagtcaagatctcagcagtggaaagagcacaggacaggcagcattataagagaagccggaactaggacaggtctcgggagggtctctcagtgtaggtccactccagatgttactctagccaggaactggccctgtggagtggaagcagtcactggcaaagctggcactgatctgcagctccaaagcagttgtgcagatggtgagggcatagtggttgaatttgtgataaaataaagtcactaatgttttttcctgaatatgcgacaattttaaaattatcattaaagtttagctagaagctagaacacaacatttcatctcttggtattttgaaataacattggagttgagaatgcaacttagaagttgaggcgttgagaaaagaggcctggtcaaagcagagggttttattgagatgtgggaaacaatgttggataaacactgcaggcagttgtcagttttggatttttgttttttttgttttttgttttttgtttttgtttttgtttttgttttgagacgaagtttcactctgttgcccaggctggagtgcagtggtgcgatctcagctcactgcaacctctgcctcccaggtagctgggattacatgcacacaccaccacacccagctaatttttgtatattcactagagacaggttttgccatgttgcccaggctggtctcaaactcgtgagctcaaagtgatcagcctgccttggcctcccaaagtgctgggaatacaggcatgagccaccacgcttggcctggaggcagttttattaaaagtgcctttagctattaaaatgaatttttcctttgctttgtttccttcctgattgctcaattttggtttatcctaagaagaatcacgactaaagaaatcagattttgtttttgatgacttcatttgagtagattaaaaacagcaaacagaagagaactaagccagcaaattcatttccagcttcaacatttctctttatgttttaacttaaatagatcttttcaaagctctggaaaatttgcagaatcattcatctttcgcttcatttaaaaatttgtttaaaatgtcatgatttatttgaaattcctttgttgaggaattcctgcatttctccaattagaattgtgttttcttggatcccctaaagatctctttatatttttttgaggggaggagggtctaaattgacaccttgttttatctttcagatctttaccccctgtgtctctccttgccttttgctgtggcttctttctagtcagggtcatttgagacctccaaatcaaacgtggagctgcttcatagggtcagcttccctgatcctgttttgttggcttgactcaaatgcctctcttgcattttcttgtagatcttgatgagtgtgcaaccaagcaacacaactgccagttcctatgtgttaacaccattggcggcttcacatgcaaatgtcctcccggatttacccaacaccatacgtcctgcattggtgagtaggagaggaaaaaatcctacatggattgtagcgattcttttaagggattattttctatttcctctgctgttgggataagaaaataaaagctcaaagaaatatatgagtgcatgtatgtgtgagcacacctgtacatgtatgtgaagcgttgttggccttatttggccttttccgagttatccttctaattttcttttaaatgatacaaagagagctttggggaattttaacccctctttgcccccactgcttctcatagataacaatgaatgcacctctgacatcaatctgtgcgggtctaagggcatttgccagaacactcctggaagcttcacctgtgaatgccagcggggattctcacttgatcagaccggctccagctgtgaaggtgggtggagacttcagctgcgatccagctggtgaatccttgtggaggtggcctgtgtggctattggcaccttcatcatcagcctctatgagatagcagatctgagcccaggggggcactcagctaaaatagtgtgcacaggtcctgtatcttagagagtcgtgttttgtttcatgcttgattgtgtctaacacacatgcctttcctaagtatatcaagactttttctgctaagtttttaatttaacctaatagggaataactcagtcaagaaaaatatacttgattttgattcattaattttctggtcactgggtccagagccataaagggatttcccccatgtggactaaacatatgaggaatagctcttctgatgacatttaattagaagtttaaatgatatttttagaagttgactgtggctttgacacgttttggtttctaattgtggcaccaaaaataaaaaaaaaaaagagcaaacacaaataacttataacttacagagctgtcccagagagtgctttgggctttgcactaatttcctgacaatttttatttgtagactttgccagggctctctgaatgattttctccttggacttagcagcagttccagaagagagattcttgaagtttttggtggtagaataatgtgtaggatgtgtaggggccagatttcttattagaatccatctggcttcagagagagatgttgagttggcatcatggtggctctgcttctttttcagacgtggacgagtgtgagggtaaccaccgctgccagcatggctgccagaacatcattgggggctacaggtgcagctgcccccagggctacctccagcactaccagtggaaccagtgtgttggcaagtaacttttcctcactctcaagatgcatggctatcaggtcctatgaagcaaaacactgcttgctttctgaagctgtaaatgtgttattgaagcaacaaatactcatttaaaattgccctaacctggttgaaacccgaggtaagtaacagtctttgcaaaacagcaaactaagaaaaaaaattataattgagggtgctttgagagcatctgaaatgaaatgcccccagaatttcttgaagcgcaatatcctccaccctcccgctgcactgctagtcatcagcccacacttgagttatgttcatatcaggggtcaaaaaatcttacttatgactgaaaaatatcagccagccaaaggctattttgagtggcttttggcctgaagatgccaaagtagttctgttcagctctacacattttgagacagagcgcaagcaggaaacacagcaaggttgtgtttttttgtgtgttttgttttgttttgttttgtttttcaagattgctaaattcttttgataattaagggagatctactgactctctcattaaattgaaatgatgtcatctttgattctacaatgtcatgggaaaataactcttaatgcacatcagagaatcaaaacattgtgagtttggagggataccagaagccacttagctcaggcactttgttttacagataaggacctagaagtccagaaagggacggtaatatttccttgcccagttcttttgtgacatgcttggaactagaacccacaactcttaactttctgatgtagagctgcctttcaagtgtcacattcacttgtttatgttcattcagcaagcgtctgtgaagtgccactgcaagcttggtgctttggtaacctgttctagttgccacattattctgtacagagccctccttagcaaaaactcaaagaattactgcttcccgggtgcaggctctgcattgcaggggttcactttcatgcagatgaagacatatttggtgtgttttcatttatcaaaatcatctctgtcatctagtttgattctacacaagacagttttgcagtggcatgtagggttgactgaagtgacccctgtgctataggagtttcgactgcgtgagtctctggctagctatctggttttaataaaaatgtctttgttcattagcagctcagggaggtctttgattttaatcaccagtttctgacattgttcacagaacttccagagtgaactttgttgattcaacacccagtttatgagcctgtctgttctcattatttaggtcattttaataacactggagctaagtgaaaaaaacataagagaggaaaggtatgtcgctcctgtaccttatcctcctcctcctaccatcagtctgaggatggtagaggcgaccaggccatgcactagtgtcctggagattctgctctggtctcgtgaagatcatctcctggctggacactctaaaaaaacaagttgatttagaagtcagaagaagtttggggttcttaatgtctccaaatgccaaattgctctcatcaatcttgagaattagagttatctagaatgagcattgccgtgggctaaaatagcttccccagaaccacaagaaacagagcagatctcttagaccagccctccctggatcctcactcccaggtggctggaagttcactctttggggtaagagggccactaatttcattgctttctagaagtaaatttcaaaaaattcagcttgcagatagatagagttgacccattttcccctagagaaaatgagtaaaagaaagcccatcctgcatttgtgaagtttcctatcggtactcccttaaggccacagctaacatgaacagtgcaagctggatgctgaaacctttgattttagaggacagagtggtgggtttcaatccacttttaaggagtagttttcagactttaatgctattttggtaaaattcgaattgtctctttttataaaacaaacaaaaccctcaccaatctaagtaccaactggaagaataaaacaaatattttggagtgtaaaaaaattccttgtggagtcatttgctccagagtgcagaggatgaaaaaggtcaggaaaagtgcaaaacatgttaaccaaatcgtggtgtttgtatattgataaaaagggcgagtgcacaaacatgctgttttcaaactgtaaacactgaatatttgccaatttcttattttaatctgtgctctactccatcctacctctccaacctagataagcaagtttaatttaaactttattaaattctcagggaagggagaaaatgtaaaataaaatttaaaagaatgtgaaaggagagggggagaactcttgatagttgtagtaacacagatagatgctcaaagttaaaaagaaccttagagatctagccttctctctttcctaatatataaatccttctctaacttccttgcttatcccagtttggcttaaataccaccttgaagggtgcccactttctcccaagatagcccaatctatgtatagacagcttttaatacttagaaatgtctttttttgctataaaaaaaatcatttctcctccctctaatttctcaccattggtcctacttctgctctttggaggaaaaaacacagaataaatctaagctatagaatgacaagtcttccccctcatatacccacgccttgcaggttttattagtcagggtcccagcaagaagcagatggctgaggccaaccaaaagtgagggacaggggagcagagcttgctcatgctccatagatcagccacctggggccaagagcaagtggagaggatggaggatggacgtggaggagcaagaagacatcagcccaggggtgttctctccaatgaagtaaatatgcttcgttcttcattctttgtttgacatggagcttggtgccagtggtttctgttgctctctattgcacacttcgtcctcaatttaaaataaggagaaagaacacagataacgtgttgagcacagaaagagaaagggaagaatgagaaagataaaattattatttatattttaagagccctggagcctaagtgaccttgggtgaagacttgaaggtctttggatacaaaagattttcagacaggcagttaagatcaaagacctgtagctgaagggaaggagggaaagagagaaggaaggaggggaggagagaaggaaggaaggaaggaaaggaaggaaggaaggaaggaaaggagggaggggaggggaggggggaaggaaggaaggaagaaagggaaggagagaaggaaagaaggtaggagggaaggagacatggaaggagggaaggcaggcaggcaggcaggtaggaaatgtgaatatatactaagtatatacaagtgagcatccttccccaccacttttatccacctgttttctaatttaaaaaaaaagaaaaaatagatttgttgagaaacattatttttctttataaatgaatgtgccttagcaaagaaggtaaactaattacaggagaaaggaagcaccagcttaaatgtggagcgtctcttgagaggcactgtggtataaaggaaagcgcatggatggcctttgcagtccaacagacctggctgtgaatttctgccctgctgctgctggctgtgagatcttggaagagctttctgagcctcactttcttcagctgtaaaacagagaatataatacctctttctcaggattgttaggaaagctaaggaaatggtcaatacctgtatcctatctatcataaaataggtatctaataaacattcattcccttccccttcctctcttccataggaagtggttattcgctaagtgaagagaaggccaatctatctacattcaaatgaacgtatgcctgaaaatggactatggcagttaagaaatgtcttaccagcaactttccaacctgccctgcaaaggcagatctacaaaaatatattagagacttccaaaaattataaatcagaaataatgagaaactcatggttttcccccttctagctgatttttttaaagtaagatttctttttcctgcttcttagcatcagacttggcaggtccctgtgggtagccagccctgcagcttctgtctcacttgtgggttttccccaattactgcttgtgaagtctgcaccaaatctcttccagccacacttagttttagacagggctcagacactctgggcaggaggctggtttgaataaggagggggccgattcggtgatgggagcagacataccagaaggcattattcatctcccagaacaggtacctgggggcttttgcagaattttgaaaaggaagtccaagtggggcagacacgtggggcagacacttggggcaggatatcagcctttgccagatcagcatatcctgaaataggctgacagggaaagcagcctgcgggaaaatggttggtctctgcttttgagagatttgtctcctcgctgggcacttgtgaagcaagtacgcagagaactgcaagattcctttcctccccccttgaaccctaaatcttagctacggaccagccccatgttggttcatgaccggatgtttacatggagcagaagataccagtgttgacttctgatgagaactggagtctgctggtcctcagaatgccatcctctaatgccctctgcctggtgcatttgacttcatcttccatgtttcatcttccatgtttactcacaacatagcaagaagccacatccatgcccgcatctttctctgctgttgctctccccacccagccacctctgcctgtcttaccttcctgagagcctagctgagggccagctggccggcagcaagtggccagatccaatgtcctcaatagaaatctctggctgctgccacacatgccgcttcttattttgcctgcagatgaaaacgaatgcctcagcgctcacatctgcggaggagcctcctgtcacaacaccctggggagctacaagtgcatgtgtcccgccggcttccagtatgaacagttcagtggaggatgccaagacatcaatgaatgtggctctgcgcaggccccctgcagctatggctgttccaataccgagggcggttacctgtgtggctgtccacctggttacttccgcataggccaagggtaagcagtgctcttcctggtcatggttggagattctttcattcgtaatataattaagtatactgaactcaaaattacctgtcctagcagaggagaaccatgctttttgtaatcctaaaattaattccagttagcttggcaaaagttttaggttattttatttggaaggaagcatctggatttctggaaacgtcaaacaaagtaatgaaactacattgtaaatatctcgctatatgacttctctatcttattctcttgatcttcacatcttgttgggaagtgattcatctctctgtaaatacacctctctgccaacccatgacagaactgggctcaccctgcacacgactgatccactcttctcctggggcagggaggattctatctggacttaaaatgcctttgtatctagctcctgttagaataagtcaaagacatccctttgggttgaaaattatttagggttttaaattatattttacatttcagacttgaatttacattaaattttaccaaaggtgcattgaaacacttactgtattttcctggttaaaaaaagaaaaacaaaaaaaacacttcaccaaattataggtgtgtctgtgtgagagttggggcagggaaggccttttttttttttttttagacggagtcttgctctgtcgcccaggctggagtgcagtggtgcaatctcagctcactgcaagctctgcctcccgggttcacgcgattctcctgcctcagcctctggagtagctgggactacaggtgcccgccaccacgcccggctaattttttgtatttttaatagaaacggggtttcaccgtgttagccaggatggtctcgatctccggacctcgtgatctgcccgtcttgacctcccaaagtgctgagattacaggcgagagccactgtacccggccgggaaggcctatttttattttacccagtgatttaaaagtttagtgttaagttttcaaagtttggatcttttttcctgctgaattaatctggactcgggtgtccacctagttttagctatcctgagaggaagtgcacattttaactttttaattaggaacacatagacattaaatatatatatacattatgtactcctccacatgcgtgtacacacacacccccacacacatccacacttataccaaattattaatgtagcagtctttgatttcttgacatacaaacatcaagtgattcattttggatctgggtaggtagaagaatgtttcgtgggaagcacacagaatgccagcaatcagacacaaattcccagatgtttgtgtctggctctcagtagactcattctttatagtttaatgccagaaccatttcttcccagcaaaaattgtgacactctaaactggcttttggccagtgggattttgtagtcacacttcttataagtggtgctcccgggatatgaaaatactggaaaggagttctgagaaaggaaccaaagcctgcaaatttgcagtttacctcctaataatttaatcattgtgtgaatgtatacgcatgcgcacacacccacaggatgagcatttatcacttcatccattgtattgtttctacatatttcatgttgcaagataaagaggaaaggaaatgtattggactctggcaagattgggggaaacagtaggaacctataaactgctttgaaatacaacagatattctgttcattggcaacatattttgaatcctaagggtatataggaaaattagttctaaagagcagatcagctattacagaaaaacagataaataatttttggtctatattatgacccattgttagaaatctacccatttaaaacagttttggcctctccgaatcactagaatggactctgcccccaaataaagattcttttaaggaccattcaaatgtttcaacacatttggaaagaggagcttgataaatacacattccaagtggcctctgaaatagtaagcagaataacaaaacaaggtacttgtgaaacattcgagcctccctccgtaacttggctttgataactgaaaggcaaagaaaaacagctgaacgagttctctcttgggcatgggtttgtttatccatcttcacatgagtcggagccagtggccctagtggttttgaatgacttgaaacagtttcccacagttgggcaaactctgatacatgcattttatatacggcatatcttcatagtttattattaaattaaccttcattatcaaccggagctttcttcttatcctcagtagcataagcaaaagtgaaacgtcaaggaataggagcaattgctccaaagcttgagtgaggaaaagtaatgatggaagtgggagaatgcaagaaactcaacagtgatgtctcacaccttgctcactcccatggagcctgtttcataaaaagaagccatttttatttagcctcccaagttacatggcctccctcatctactattctcttgtttccactctgtgtctcctccccagtataagtactgcaaaatgctttccatgttaggtttgggaatgaagagataaataaatatccaagacagggtcttgataggcagtagaaggaaatcaatacattcagggaactgggaattagaggccaaacagaggacctcaatgtagttctcagaactagctgatcctccagtggacaagcaagggctgtatctcacaactgcaaggaacaggcttcaccagaactcttgtaccacctaccttgtcttcccattctaatgaaaaacatctatgctccccttctgctgcaggcactgtgtttctggaatgggcatgggccgaggaaacccagagccacctgtcagtggtgaaatggatgacaattcactctccccagaggcttgttacgagtgtaagatcaatggctaccccaaacggggcaggaaacggagaagcacaaacgaaactgatgcctccaatatcgaggtgggtcagaagttagtttctcctgatgtctcctgtggtggaaagcccttccagattcctgtggtttcctccaaggatgctccaaagtgtgaaaaagctccccagggagaaactccagacattccctgagctctaggctgtattttacaagaggctgtggggctttctggagtttcttgctgcttttcgggagtggccatttgaaggttttcacatacttgctcatttcctctgtctcgccaaaaaaaagtcaaatacccacccaaagtctgctgaaaggataaggtctgagatccaggacagcaagtgggcagaatagcgaagtgacatagtgctccctacataggaatgccaagttctgaaagctagaggctcctctactgaaaagagccatgtggagtgtgagggaacttggattgtagacaaaaataacgtggagctgaagcagcctggtttcctttgcctacggctgctgcagcctttcagtcaactcagaagtgcacagatattcacccagacctctggctctgggcccatagaatccagcacatgtggtcccagagaggcaagtaagaagccaggtgaaaagcattgaatattagcagatcatcacagtcaggaagtaggctcataggtgtgtccttaggagaagatggttttacgtcaatgaatcaaattgaaatagtctggttcttcgtattggtgctgcaacccatctgctgtcatttaagaaatgagataagtctttggaaagaacataatctattaaaacagtggttctcaaactttagcatgcatctgaatcacctactaggtcttgttaaaattgattgttgggagacatcccagggtttctgattcagtagttctggggtgatgccgagaatttgcatttctaacagattcccaggtgatgctgatgcagcttgttcagggactacattttgagacctccagatacaaatgatttcaacctgcctttcttcctgacatcagttaatattttcaaatattacaaatatgtgccaatttaatacacttgtggtctaaacaaaatgctttcaatattgtgtatgcagcataaggcagaaaattgtattagtgtgaaatttgagtcattttttctttaatatgagagctaagtggcatatgtacattgtatttaacatattgccatgtgtctttccaggatcagtctgagacagaagccaatgtgagtcttgcaagttgggatgttgagaagacagccatctttgctttcaatatttcccacgtcagtaacaaggttcgaatcctagaactccttccagctcttacaactctgacgaatcacaacagatacttgatcgaatctggaaatgaagatggcttctttaaaatcaaccaaaaggaagggatcagctacctccacttcacaaagaagaagccagtggctggaacctattcattacaaatcagtagtactccactttataaaaagaaagaacttaaccaactagaagacaaatatgacaaagactacctcagtggtgaactgggtgataatctgaagatgaaaatccaggttttgcttcattaattcaccatccagagaccaaataattaaaagaaaaacaaatatagataggtagaactatattttcccccaatcagaatcatcatatcataggtacaatctttcaccaagtaaatttgtataaataagcactattctttgtattaccaaagcaaggtacaggtgactaccctagttcaaaacaaccactttctcaggcttctcatgtgtgtagctaagctaccttgtcatatgtgttgattcttgaaaactgggacgtgtatttccattgggggttggccatttatgctgacatgccatccttccagcaaacgtacgggaatgtgctttcaattgatggactactctattttttgcaaatttgtaaactttgcttctccaaatacaagtactaggttgtccatttatggtacctatttggtgctagtaaattttcaaactagatttataaatgcactgtaatatgtacacaacttagaaaccaaattacaagtattcagttccaatacttcattaatttcaatcaaccaaagttagttcagtagcttatctcagttatgagtataatacattacatgtaaattaagtgtgtgtatactgtaatcgtgctattttttatcattgaaacatttataaactagaataataatgcccttaatgtgagggtttgtaatggtgcttattaagaccaaagacttgttaaatgtatacaccaagtggtaatgaaatttcggtgactggcccacacgtgcatagaggtctgggaggaccaggaaacagcctcagtggccagaggatcaccagtgcatccttcatcacagcatgtgcaatatgccaagattaccctcggtcattcctgtcaacaaggggtcaatgtcataaatgtcacaataaaacaatctcttcttttttttagtttaccccttggctttgtgttcttgcatggatttggggttggaggggccattccggaggctaaataaagtctcctggatttaaatta

SEQ ID NO: 36248 - DNA, 234913 bp, Homo sapiens; identical to SEQ ID NO: 36247

SEQ ID NO: 36249 - DNA, 41598 bp, Homo sapiens
ggtcggatgccggaccgggggcaccgctgaggcggtgggtccccgacctgcgagacaggtttggaagcccccgctgcgcccagtccgtgcggaccgcgaggccgcgggcgggtggaggcgcgtctccggcacggtgagtggacccgcccagggccgccgtgggtttctttgttcgtggtggggactgtgggctttgaggaggttggtaccatgcgagtgcctcggtgctgcctgctcctcatccgctggagcgaccagggtgctgccctcagccccagccccggggggagctggcgcccgcgatggacagatagatgctcgtggggtggaaggaggttgcgactaggttaagggcagtctccgcctcggtgccccccgcccccgctcgtgttgtcacggggacttgctggcgtggtgcttctcgaattgacagccccggggctctgcagagttgtggggccccggcatcagtgggtggacgggtgttgtccctacgggcgcggggcgggcgggctggactggacttctctccccggaccgtagccgggtgtgccgcgccaccccagggctcctgggacgggggtatccgcctctcgggtaagtccggaatcggcgctgcagcagcggacgggaaaagctgggggcgggactctccgagaggggcttctgcagctgggcgccccgggcgggcggggctcgggagtctcctccctccgcttctttgttcagtcgcgagactctccctcccctcccccctattgtgcaacaccccatccccgggacccgctgcagtcgctcgccacactgcagtcccctgggcagaaggccctccctggcgcgacttcaggtggggcagaccgaggggacgccggcgcccgcggacagtttcctgtttgtgaaacgccaagaggccagggctggccggtcttacccagcgctggccggcggacctgaccacggctcctccccctgccacacctccctggccgtggtggggattgccctggggctctggcggacgtgactggtcccttcacccgctccttgtcggggtgtgctggggcgacccttgctggaggtactggcctcagccctttctcccgcttccccacccctcttacccccagattacattctctgtgtggtgtctttactgcagatgaaggatttgggggcagagcacttggcaggtcatgaaggggtccaacttctcgggttgttgaacgtctacctggaacaagaagagagattccaacctcgagaaaaagggctgagtttgattgaggctaccccggaggtaagttggcagaaaagataacttgctcaagcagctgatggggcttggaggaggtaacccccccgcccccgttgaatcatgactaaagcctgcaaaatttcttaaaagttgttctttctggagtaccaagataaaccttattacaggttaatgcttttgtttcttagcaagaatgagagtgatactttagagaagtggggttttttgttgttgtttttaatgtggcaccctcctcgctgccccccatactccagcctgcagcttcaggatgggagaccccgggtgaattgagtagttcatttgtgcaaacaccctctgcctgtgaaatacatatttatagtagaatcttaaatgactttagaaaagcaaacaaaagaaccctttctctccattccaagggaattgaattatatttgctataactctctgaaatcttgcaacagttcaccttatattgaattgctgaagctcttttatgatgcgtatttttaagaagcagtgatttacgtcttacagatgataaagtgtatagctttagttaagcgataccactctttccacctatattcttgaagattgagggaaaaaaattaaccttattcttgggaaaaaattaaccttattctttggacctgtatgtgtttttcatctggttctaagaaaattgtaaaccttggttcttggtttttattgcagaatgataacactttgtgtccaggattgagaaatgccaaagttgaagatttaaggagtttagccaacttttttggatcttgcactgaaacttttgtcctggctgtcaatattttggacaggttcttggctcttatgaaggtatttcatcatttttataaatatgtcttcctttttctatgcccagtgcctagcacacagggttcaagaaatatttatcgaatgggtataataacgtccactgtacataaaaatttataatcagaattgtgatcgttagtgccagaataagactacaagattaattgtattgttgtatcttaggtttttctgttgtgtcttaggttttacctcttaagtactttctcttgaatatgtgacaaaagagagactactattttttaggtatttgccatatatttatagtcctcaatataagatttcatctgccatcatgcttctcttgaagccagatttttaaaatactgaagcatgacaaatgaagtataacagtttattaaatatgaccggctgccttccctagaagtctcttcaaagcagggagccatggttttattaacagtcaccagcaatggctagaaaaatgtggggaatcttctgccagtaggattgctgtcagctgctgggtcagttctcagggcactgaaaagaaaagggccgccatctgtccatggcagcttttacatatgtcccactctgcacaactcgtgatatttctcttgggcaaaattacattgaaatatggaatgactcttaaagatttttatgtaaaaagataagtataaaatattttaatatcccagtacatttttttttggtgttaaaaagcttaatttattttgggagagattatattatgaatttcataagtctgaaatacaaattatactttagtgctaggaatctagcttttgaacctgcatggaaatttttgtacctgcatttgaatttacataatttaaaggttcaaaaaacttttttttttttttttaaatagagatggaggcttgctgtgttggccagaatagtcttgctatgttggccagagtgttctcaaactcctggcctcaagcagtcctcccacctcagcctcccaaagtcctgggattacaggcatgagccactgttccctgctgcctttttttttggggggggggggaggtcgagaacgtctaaaatgtgaaaatgtgtataattgtgggtaaagagccagtacatataagagaaacaacttgattgtgttctgtcttaagaataggagcatcattacaatattctaagtatctgctaagtcaaagtgacagttgttaaaagaagcctcttgtttttttctcaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggtcagtgggattaaagatacattttgtactttgaacattgctatagctaacagtaaataattggaatggcaatgaaatttatatttttaccttcttcaaactttcaactttgactttattggtaaatctttttttttttttttttttggagaaggaatttcgctcttgttgcccaggctggagtgcaatggcgtgatctcggctcactgcaacctccacttcccgggttcaagcgattctcctgcgtcagcctcccaagtagctgggattacaggcgtgcgccaccacacctggctaattttatatttttagtagagacagggtttttccatgttggtcaggctggtctcgaactcctgaccttaggtgatccacctgcttctgccttccaaagtggtgggattacaggcgtgagacaccgcgtctggccctggcaaatatttaaaatcatttaaaatcatttaaatctttggaagtttaataaatctttgttctttgcattgtataggaaagaaatactgagccttgataaactagaagctcagctgaaagcttgcaactgccgactcatcttttcaaaagcaaaagtaagtcgattccttgcttatgtatatatctcacagtttgtattttgaatttttaaaaaatatttttcttttttttcttttttcttacagccatctgtattagccttgtgccttctcaatttggaagtggaaactttgaaatctgttgaattactggaaattctcttgctagttaaaaaacattccaaggtaattacagtcattattctttaaggcaaatttttttcctgatgtttatttttttctgtggtgacttaaacattaagtaatactttatgggactcttaacttttacacttgttttttttcttatatctctagtgttaaagttctcaaaatgcagctttgacccagacagtattaatccggaagggaacctggtcacttagctcagcttctttctgcatataggtgccccttctgtagtaatcatgccatatgatagtacagctgttacattgccacatatgcattgttctgaaatgcatactaggtagtagactcagaacaaacactaatgggataggatgggatcccatcacacctgtaggactgaactgtcatcccattagcagcagcatcaattaacaccagcaatgttgatgttttaaacccgaatgtcttttcaaatcctttaggccagctaagtaaaagtaagtcttaccatcacaaagagatataaaacaaaagcacaatactttttcttaaactctcagtctagttggggaaatgaggaacttaacatgaagtggtgtgttctgtcatttgttattgtgtcttggtgccaggtaatagtgaatatagagagtactttgggattttttttttttttttttttttttttgagacagtcttgctctgttgcccaagctagagtgcagtggcatgatcttggctcaccgcaacctcagcctctcgggttcaagtgattctcctgcgtcaacctcccgagtagctggggctacaggtgctcaccaccatgccaggctaatttttatatttttggtagagatggggtttcgccatgttggccaggccggtcttgaactcctgacttcaagtgatcccacctgccttggcctcccaaagtgctgggattacaggcgtgagccactgtgcccggcttactttgggttttttttaagcaaagaaatagggcagactaggagaaacactatgactgggagcctgtttggagcaaaagaatctttgacagtgaaagtttcagcgaaggcttaacggccaagaaattggtggactagacagatataaaagtcattttagggtagacttacaggtacaatgtctaggtggtagtcacaagcaggagtaaggctgtccaactcaaacagtggttttggaagccaagcatggaaatgaggcaaggagtcttgaatgaccaagatttgtacctaatggtggatataatattagcataattggcaggaaatttgggagaagttaatttgtgatgagagcaatatgattttagatgcttgtgtacacaggtgggtgtctagtaggtgtttggcgttttggaataagaagataaactatagttagagattgaggtttggaatttctcatgaagaagcagtagttgaaacggtaagaagctgtggaatcctttttgtaggggtcagttgaagctctggggttttcagcgttggcctttccccccaacattaggagccaagtgaagaaaggtacatccccacaagtagaagcactgtcagactggaaggaggtttttaaggaggtggtcaggagtattgaatttttataagagatccaatataatgaaaattgaaggtcattgggtgtgtcagaggtaatgtcagtagagcagtgagaaggaagtggtagaaaccagattacaagtgggttaggatgtagctacattaggtgaaaatgggaagccaagaaaatagatcttctgttttctggtgaaaatatgtgcatgtgaagcattttgtttgtaacagataactttttgctttagttatgattttattagtttttatctgaactttttattgatagtgatagctggaaccatcttcagtgaaaattgattcgttgaaataaactgaaggcattccgaaggaggagggaaaaaaatacgtaaaaagaaaaacaaaaaagaaataaactggagcactgcccagtggtggcggaactatgtcctttttgggaaattcctgttctctcatatcactaacttctttagttttgtatctggtgttataagtgtgtattaccagcaatccaaacaatgccttgttgcaggaacccaaattggtttctgtaacaaaaggaatgttaaattcctttgcattgagactaaggactatacttgatagctgatttattaacagacccagagtgtttttaggtcagtgttttcttagaataggcaaagctttctgtgtattgaatcctatgtagttttatacttacggtgctcttctcctaaaccagtggttcccaaattttgaaagtttggctgcacattacaatcacctagggaacttagaaaactcttgatgcccatgttgcactcattgtcaattaaatcagaataccaggggtggaagcgggtagtgggagccaggcatctatatatatatatttttcatagctcacctagtgattccaaggtgcagcaagatttgggagacattgccgtaacctcttaaaatatttttttttcagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaaggtaggcaggttccttgactaattaaacttccctagactaaatattactgagtttattatactcagaactggaatagtgtaagacatcagagaaagcaagcacctacactaagagctaagaattaaagcccccactcttcaggtaagcaaattaaccagaagtagtattttaatatgtaatgatttataaggtcctctccaatttttttagtttttttcttttttatatttttttgagtagagatagggtctcgcgatgttgcccagggctggtcttacatactcccaggctcaagtgatcctcctgcctcagcctccgaagtgctgagattacaggtgtgagccactgcactcggcctcttttccctttttaaagtggttgttttccatctttctcctatttcccttgctcttgaaatacagctaaaaaaccccaaaaaaacaaaactgaaaaagaattctgggctttgtaatgttagtatgaattcctaatattgtgctgtggtgaagagattgaggggtaggtgcctggaaaataaagggaatcaccaccactgatggggaagacttctatatatgttctcagaggtttgtcaattggtgttgtcttattcagaatttgattactttgtttgtaaagtgaataactttgctaaatttgtttgttttatgccgtagagataaagggccagaagtttcattttcatagcttgttagtttactttgatatttgacagtgtaagtggtataataaatcactgatgcaagaaatacatctaaatagaccatatgctaggaggtatgttgtttttagtcttcattactggatttaaaatacttagaattctacaattctaatacttgctgatagttattaattggtacaagaataatagtttggcaaatagtaacttgtttaaacttaagaaaacctatattttctttctttctttctttttttttttgcatgtgccaccatgcccagctaatttttgtattaatattttttgtagagatgggattttgccatgttgcccaggctagtcttgaactcctgggattaagcgatctgcacacttcggcctcccaaagtgctaggatgacagggatgagccactgcacccagtccaaaaaatctatattttccaatgagattactatagacttcatttaggaagtccttataaattttgtctctgtaaagcataaattttgaatataaaaatcctcactagagatatagcagctttattttggctataaaacatttaagtgtgttttaagtaatggtatcctctttttttgtctctttttctctttagtgaggactcttgtgaagatatgagttgtggagaggagagtctcagcagctctcctcccagtgatcaagagtgcaccttctttttcaacttcaaagtggcacaaacactgtgctttccatcttagaaatctgattgttctgtcagaatttatatttacaggtttcaaagcaataaatgggggaataggtagtttcctggtttagcccccatctagtcaggaattaatatactggaatacctaccttctatttgttattcagatcagatctggcctattttcatatttatcctaagccatcaaatggggtagtgcctcttaaaccattaacagtactttagacattggcactttatttttctcgtagatctttagctactttggggaggagggaaggtgctgataccttcaatttgttacttttcaagatttttaaaaataactagtgtagcttatcttaaacattttataaaaccttcagatgtctttaagcagattggaagtatgcaagtgcttccttagcagggacagtggataatccttaatggtttatcatagatttcaccctccccccttctcagaagagtgagtatgctcttaaatgtcaaacacatttttgttgttttgttttttaaatgatcagtgtctatttgatgtgatgcagatcttataaatttgggaattataatattgacatttctgtgatttttatatatgtaatgtcttaattgagatttctgttaaggcagaaataattaggctagggctcttagttttcattcctattgcccaagtattgtcaaactatggtattattttaatgttactttaaaaatccataatctgctagttttgcatgtacttatatgaaaacagtgcagtaagttgaaaactcagtatctatggaattgataaatgttgatctggtgtagtatattttatcgcattttcttatattaaaaaatgtctgcatgattacattttatttcctttgtaatttacatttcagaatagtgtattgctatatgggtgccaagattgaatatgaagaacccgagtgtttgtagtattatagttttaagcaaatctgtgtggtgatacagccataagaatggggcttatataaactctgtacatgtaagattttgtacagagaatttttaactttataaattgtatatgaacatgtaaatcttttaaaatgtacataaaatactgtatttttttaccttgtgtgtgatagtctagtcattgcatgtaaatataatttattatgtattctgtagtataaatcatacattgatgacttacatttttactggtaagtcaacatccgttggatgttttctgaagtggctctttttgaagtgataatagattgtaattcaaaataaaattattaatgaattctccttgtttgggatcacatcttaatttttaatctgttaaaagttcttgatgtattttaatgagaagactttaggtgaggctacagtgattccagagtgagccttctaactggctagcagaagttctctaggtttggcatctgtgccttggagatactgaaagagaatctgtcatttgacaattgacctctttgtgggatggactcattaagtatgctctcagagactggtatattaccagaatgcctattaattttcagtgagaggcaacaggtattaagtagaacagaatgctcaggttggcagattagaacgatctttcaggagacaaagcaagttttaatcagttgtttggttaataagtatggggtgttcgctgtgatagggccccgccagcttctggctcttgtggacctcaaaagtatcaggtggttttgcaagtggtggtcctttcccctgccccaccccaataggttccccatctgtctagtttgatttttgtagacctttgttttctctagttagaaaatcaggtacactgaatatggttttcatgtaacacctcttctctggagataggggtatgttttcctacccttctagtggagaatcctacttgaggatgacctttcctctcttactaaataatattagtaaatagtgggcaatatattctgctttcagattttgatttgttgagatgtaaaagttgtttggggcttaccaaatctcaagactctctttagctcctgcaggattgtattgcttttcttactggatatttttcctgggtaagcatctttgtggcttcatctcttccccctgtggttttcagtgtatttagtcgagacctctctgctgagcttgcaacctgtttattcacatggcctgccatgccacttggaggtttctgattactcccaaacctgctggttctttatgtctttctcagcgaataattccatctattcatgttggaaacttaggtgatatgctcatctccttttgcctgtttatggaggtcaccagcctctatcatttgtatgatttcgtttacactgtttatatctctctgtcccccctttttctgccattggcatggtttagacctgtactctttatcagcagaggtactgtaatatatttgtgatccctcagcttccaggcttactcctggtctctgccttcctatctacatatccttttaaaataaaattttaactatctcctgaaaaattgttgagtaggtcacgcacaatcaggagaaaaatctattcatgacatacaagtctctgtctaatctgaacactgcacctgtctctggcctttttttcttgtcatttcctagaccttaaaaaatgtgtattgagaaagaactctgttagctatacagaagatgaactgggcaatatagagtagcagcatggagaccagtctgactgaactaaggcagtggaagtgtggatgaggaagagaggtgaaaattgagaagcgctatcctttctctttgggcattattaggaggctcacagacaagtccaggagcctggttataccctcctgtgccattcaaccaggtggctttcccatgactgtgatgaataaaattgagaagcccctgcccttttcagagcagagggtgaggagaaagctaccattttgtcctcatccttacccccgttgacttggcgagagatttgacctttcaggttttgatcctgtcattttctaggatgtggtgcacgcactttgctgttgcgcatggtgaagtattgtgcctaggtcctgggtcttcatctgtttggctctgctactgtttcctcctcccaggaagtgtggttagacaaataatgtgttttaattacctgtcacactcaggattaatacatactcaggttaactgtagagaggcattggcttcagaacactcctcgtgacaattttaaccattttctttgtctagagtctgcctttttcttttttacaatttcttttatttcaacactaggtttcaatatggtgttcctgctacctcccacctccctcctccctcatcacacatgcaaattgtcagcttattgagacaacccacttagattcatatatggacaaggacaaggtattttgcatttgttactggaattcagttttcctaactatttactaccagaaatggtcaataacttactttgtgtttagcaaatcaaattgtgtgatagatagtttcccagtatgatggccagtcagtctttccatccctgtgcctacatgctgctcttcccgtccacaagtggagtctgtttctcttgagttttggctggccttatgaatggctttgcttactgaagtgcagcagaagaaatttagtatatgtccaagcctaggctttaagagactggcagctttccttttatcctttttggaagctagccaccatgctgcaaagaagctcagctggattactgaaagatgagaggccatgtggagagagactcttgaggatgagagattatcttggatgttccagccttaagctcccagctgaatgtgggtgtatcctcagctacaccacagaaaacagaggaactactcagtcgatcccaatcaacccacagactcactagaaataacaaattattgttttaagccacgaggttttgggggagggttgttaaacagtaatagataagtgagacagattgcttgttatttatggtcaaatggtgattatctctggtgagattacaggtgatgttttttttaagttatgcctatctgtagtttcctttttttcctaaaattgatttgaattattagtgtattaacagaataaagaatgaactttaaaacacacacgctggttatatgcttcctctaattaaaattcatggctctcaccacaccttagcatcaagttccaacttcgtactgcggcttagaagacccagcttgatttgttcccggctcccttttcagccttgtttcatggcatccacatccacgtatttcccaggcccactacatctgagatgagtcagagacccctcttaggggcctgttccctactcccaaacatggaaattaaaaaaaaaatcgtgagttcttccaagagaaattccaggcatctggctagccctgagaagtaagagagaaatgtgataagcaacaaatagcggctcaaaacaatagccaagtaagttagaatcatgggatgtttggttcccctatagaaactacagataacatcttaatatatatccctgagttgttttccagaaacctgaacccctagcaaatggatgcgctagcacatagacctcagataagagggagctgaggactgaactctgaccaccgttctttgttctaaatttcttcctgagaggcctggaggaggtcatgcccatgagccagagattacatttttttctgtagatttcaaatgttgagacaaaacgtcatctccttaaccaatcgcacactagaaagtctttgaatccacccccacttcgagatgccttgcctttttaggtcaaaccaatgtatagtctctatgtattgatttctgacttcgcctgtaacctctgcctttctgcctttaaaaactcttacctgtaaaccatctgggaaattgggatttaagtcttagatgcctgatccttctttggtgccccgcaaataaatgttttcctttctcctgctgcaaacctcagtgtggctatctgatcttgctgggccgggtgggtggaccccagttctgtttgataacaccccactcaccatgcttttgctcacttcagtgccttgatgcacaccatttcctctggctagaacaccttggcaccctcatctggcaaacctacttactaccttaggactcccttcattgacttactcattcacccatcagatatttgaatgctttgtgtgtcaggcacacttgtgttgctatggaatgccaaacacaacaaaccctatccctgccctcgaggaacttacagtctagtagcagaacccaaaaattcatggcaaataataaaatgttcaggctggatgcgatggctcacgcctataatcctagcaccttgggaagccaaagtgggtggatcacctgaggtcaggaatttgagaccagactggccaacatggtgaaaacccatctctactaaaaataaaaaaattagctgggcatggtggcggatgcctgaggctgagacaagagaatcgcttgaacccaggaggcagaggttgtagtgagctaagatcacaccactgcactcagcctgggtgaccgagtgagactccatctcaaccacaacaccaccaaataaataaataaatcatgttaaaaggctgtgacaattttttcttccaagaaatctttctggaactccctgactttcctctctttgtcagtgttacatgtttccataaaaccctacattttttcttatcctagaaattaatatcttgcttgtgtgtcccacttatctgctaaccttacctgtttgctctggaacagcagggccttttgtctctttcgttctttgttgactgccaagcacccagcacattatctggcccatactcctcatgctgctgttgctattactggcaacaagtaactttgctggccacttaatatgtttcaggcaccttacatgaatgattttatcctcaccacactgctattagacaggtactactattagtccaattttacatacgaagaaactaaggattagagaagataagtaccttgacacaggtctagtaagtagcagggccataattcaaacaaaatttctctgccaaacactatcctgttaaccacaacgctaagctattacccaaaagttgatgatattaccaaatagttgttgattgaattaaataataaaaattcttataaagaaaattctactcataataccagtaaaataaatcacagaattcttttgttcaatgtttaagtgctctcacccatagaaaggaaaggtggctaagatttagagttaaaatattttttctcagaagccaaaataggacacaaatgtaaaaatccaagacagtatagtggcagagaatataggtattcctcaagggctggagattttaatttgcccgggacctcttggtactcaagcctgtgggtcttcccagcccctgtatgtctagttctttttacactttgatgacagtttgtgcttgatcattctgggttccaatactcacagtgttggaattcagtgttagtgtgggtggaacttgcaaccccagacaaccgttttgttaaaggcttgcttgccctttgctattttactattattcaacgtagcaatcatctcacacttactcatttactgctctgaggtttgtccaataaatatttcacatgtctgtggtttatccccttgcctaaactctaagcttctcgtgagaagagaccatacagtctccttcctttatatcctatgggtgcctagcataataatcctgggtaaaaatgtgtgtcaatatttttctacgtggatcacacctgacaatgtttttttccattcttggttgcagtgagttatagtttgtaaaggtaaacacacgtgaggacaaattcatgctctccagagttaggatttcagatcattaacagggcttctgggaggccattgcccattgctacaatcacctgtacctatttgagagtaagatgtagtgatgggcataggctctgcaccagaaggccagtccttgagtcctggtttggccactcattgtttgacctggcgaggtgttaactaaagtgtttgtgcctcagtttcttcatttgcataaaggaactaataacagctacttgtgagggacatagtagtgtgctgcggatgccccagcctctgggagtgcccttggcaggcagccttctgtggacagcccctctggggactgccttagtggcagagtactgcctcatccaaggagggctcacatctaatgactgagttggaggaggtataaagtcctggtcactttggtgcccacacaggacaacccaggtgaatctgtccaatctcgcttctttcttttctttccttttttttttttttgagacagggtctagctctcacctggtgacagaatgtagtggtgcgatcaccactcactgtatcctcgacctcccaagctcaaatgatcctcccacctcagcctcatgagtagctgggaccataggcatgtgccactatgcctgctaattaaaaaaaaatttttttgtagggatgaggtctctatgttgcctagggtggtcttgaactcctgtgctcaggtgatcgtctggcttcaaccgcccaacgtgctgggattacaggcatgagccaccacacctagcccaaccttctttcccctctctgttttgggtgttgatcccaagggtattccctaataaacacagtgtaccctaaactttgtttcagagtctgcttcctgggcaacaccacctgctccactgcctcgtggggttactgtgtatttaaatatgatgatatatgataaagcatttggaacagtggctgatatgcgctcaataaatactggctgtaacaattatcatcccgtttttgtctctcttcctgctaagactcaattatttattcaactattactgaactagtatgatgcagagttatgtcctaggcactgagaatgccaaaaggaattaaagcacagtttttaccttcaagaagctcataatctaatgagagaggcagacatatcaattactatgtaatgtaagaaatgcgggaataggaatttgtctatagtgctgtgttagtgttctggccttgcctctgcttgtattcctaaccttctggatgaagctaaaaggccatgtagtgtgattccagtcattgaagggaggccctgagggcccaacctctccccagttcccctcacatccttgttacccttcagctcattctgccattcccccttttagaatgccttttctttagctaaacaccttgaatctggttaaaatgcaaatatttctaacagggcttacattttaatgggattcagaaactggtttgagcatatgttagctgtgaatgtagtttttggcaagccacatgctcaggtaccccatgaagcagatactgagatgaaggggtttcttgggaggatgcttgtaaaagggaaaaagggaggcaagaggattggacaaggagaggctgcaattgtattgcagatctgacaaagatgcagctaacctagtactttggcgcagaatttgcccattagaagagtcccaggctgggcagaaatgggctgaccttgtacttcctcgcagctggggaggctgtaagctgaaaactacccaggaagagcttggcttctgctcaaacgctgaggtggggtttgatgatgctgcagctggtgactgggagctgctgccctcctggtggtggaatggcaagatcttcctggaagggagatctgtgtgtcacacctcccagctgccacatcatgtaaattctctgagaactagttttcttgttttttttgttttgttttgttttcatttttgttttttttttttgagatggagtcttgctctgttgcccaggttggagtgcaatggcacaatctcggctcactgcaacctctgcctcctgggttcaagcgattctcctgcctcagcctcctgaatagctgggactacaggcgcccaccaccatgcctggctaatttttgtatttttagtagagacggggtttcaccatgttggccaggctggtctcgaactcctgacctcaggtgatccatccgcctcggcctcccaaagtgctggcattacaggcatgagccactgcgcccgaccgagaactagttttttaagctgaaaaaagggtactcagaatgccaaaaaccttcagcacaaacgcttctttcaaacttctgcacgaacagacttgaccaaactttaacacggcttctagcagactaaggttgtgtccctggggcaacctagccttcttttaagttcctgtctggaaaagctcagggctgtgaaaagaatttgctgtttgttccagccaacacctgaagatagacccctgacctccttacttagagcatttaccaaacagggcttacaattgtgaattctttctctgtctctttgagatgtatgtgtatctcctgcaagtcaggagtgtctctctcaagaatctgaaagccattcctttgaaatgtaattatcaggaaggatagggccctggctcctaactggtgttaattgccagctagcacgtgcagctggcctaattatggtgatgcccaccaaccgtttgtaaggcttcaccagagtcccacaggctcctcctccctcctcccgcatcttcccctttaaaacgcccagtcacctcagcacaaatcagaattgagctctgctccttctcttactctcagtagttactgaataaaatctgttttcaccacgttaacggacggttgtttatctttgacaataaatactaagatctatcttcccaacctcacagggctgtgaagacggaataagttaatggggaaaataaagttgtgaagctctttgcaaatataagttgttgtcagtgtgaaggctttgcatatattgttcttagagaaggttttaaaaaactacatcaaagtatttttctgttactatatctcctttgtaaaaatgtaagcaatatagagaaagtggataatgcctctaatactgttcctcagagatgctactgtcaacagaatgacatttatcatttcattctttttatgcaagtataaacatgtaaactttaaaaaaatgtataagcacgatcctactctatgtatgcttctataacccactttcctcatttaacaatatatcaggggcatacatcagtgtcagtagatataaacctacttccttatttttaaagattgaagagggttttgttggatgcttacgtgataatttatttaactgatctctttctgatggatggctgtattattgacaattgttcagtattttaaatcaaagcagcagtaaacattcttgcacatacatttctgcctacctgggtaataatttctttaggatgcatttctagaagtgaaaatcttgggtccaagagaatgtacatttaaaatgtatactgtgttgacctgcatccctgaaaggggatatagatttatattcccatcagtaatgcctttcagtgacagtttccttacttccttgacaggtaattttgatggggaagggggaggagggtcagaaaggcaaatggggtcaattcgattcctaaagaattcagaggaaggtgtcactaaaaaggatgggaggaaaaagcacagaccccaaaagctgggctcagaaagtaggcagtgcctgactaccttttggtcccaggttccagctcgcccaccactgagaaacacacatcctaagccaccagaacatggggactcctttccataggatgtgggaggcaagcaactgcaacggctccccttgggcctgggcaggcaaaagcctttctgtacagcactggagaaagctctgcctgcagctatacctgcctggcctcggctcttgcctcatcttgcacattaaggaggagcaaggttgatgtgtcccacgaaggaatgatcaaagtctagtaaagctgccaactctaagaagtggtgctgcgcctgaacttggggcctggcttggggagcagacattcatctttggttgctccagggaaacatttcatgttattttcgggtggggcattggagagggggaaaaggtgaaggtggcagactcatattttacccgcctccatgtctgtgttgtaccagctgccgtagttcttctctttccatttttttcttattaattttcttaaattgaaaagattggagcgcattaactttcatggggaaaaaaactttaaaatactgtttgaattctcatcttttatgtatccattctaataccgcaaatgtcttcatgatatatgttacctgccagctgttgtcgcagggggttgtgtttttcacatagtttccaagggctaatccttttttcctttgcatcttacactaagcagctttagagcacaatggtgcagctgcttcacagctgttgtctggacttagggcaagagccctgtttggggttgaatgatttgactcctttatgcagtttccaggaccctgagttctgagaacacacacagggctgctcaagcaagaatgaaatgagcctacaagagacgcttctcctttgtctgaggcacacagagagaactgcatttgctcacccagggccagccccagcaggctctcaacactgcttttcttccctttcttgatgctgttagaaaaacatgaaaaagatggcacagagagaagcagacctagttatccaattcttaaaatctttaaaagccatactcctggtttgttgaagccaacgagattgtctgctcttagagggcaagtaacctactatattcaagacctgcaattatgctcaatagatatgcatcattttatcaacttgaagaaattagagagggacctaaaatgctaaagagggaggctggctggacatgaggcagagctcatggtaaccacacctttgtggggtcaccagaattcaaggtgagaacctcagctctgccagcccagagctagaatctatcacacggagtggaacagcctcttactgaaagagaatgaggataccaagtaattaatttatactgagcattttccttccttggatctagaatattaatgcctgccatcaaaaacatgttctttctgttggcagaatacatgggaaattgaacggtaatcagaaggtccatgcttgggcagcatggccacagaacagtaggtttgattttgagcattacttgtccccaaacagctttcccagttaaggtcatgaggtgttgttgtttttgttgcttgttttttactctctcagtcattcatttccattgcttctacagagagttaatatcatcctttacattttggtttgattatattacatgagactagaattcctgtataaaaactgtatatcttttcttgatcctgagagctctgatgcaatcattccaaaaacgactctgctatcctagaagtactttagtattaagcatttagtattgggaattgggtagtattattttcccagtagactttatagtatatttgtagaattataattttaaatatagttcagaatttccataaacattaagcattttttaaaagcactgaatgtagaagatacaaagatagacatgcatactagttttcttcttttagttttgctactagtaactagtagcaaagagaaaaaacataggctctgcatacagggagcaacacaggactgacaggaatgtaaaaaatcctgtggaaggagaaggaagagggaaagaaaggaagctgcaggtgacatgagatgaaagaaagagaacacagtggggattaaaacatggagggaggattagctgtgggagccagtgagtccaggcgagttctgtgtaggacagctgttggaaagagcctgggcaggaggagggctttcgggttttagtcccagatttgtccacagctgtctgacctaggcaagtaacttaactgatctggagttaattttgttgttttttctttctttctttctttctttttttttatggagtctagctctgttgcccaggctggagtgcagtggcccgatctcagctcattccaacctccacctaccaggttcaagcgattctcatgcctcagcctccggagtagctgggattacaggtgtgcaccaccaagcctggctaatgtttgtatttttagtagagacggggtttcgccgtgttggtcaggctggtctcgaattcaggtgatttgcccgcctcggccttccaaagtgctgggattacaggctgagccactatgcccggcccccattctgttctttatgaaatgaggagtttgggctaggtgacctaggtgactttctgaggtccactatagctttgccgaagcacccaagactcttgtcttttgggaaagaccagactagactgaattcccagactagagggctgtcattatttctaggtataatgttttagattacaatccagactgtgatccagtcaagtctgtcttgagctgtgttaatttttactttagaaggacagaactgataatgattatataaataattacggtggcaaaatggaatgatgggcattaattaatgggaataagaacattcagcacaaatatattctgaaaccaagacaaggatgaagactgtaaggcaaatgtacctgggaatgtgctgcaagtatagcaggtgtagaaagaaccaccatttgggcagctccatcatttttcaagctctggtgagagaggccatcttaggcaggcagctatcagtagtggagatctgagggtggcaccagacagtgacaagcagcataaattggcagacaataagccacacccatatttaatatccagtgcatgcctgtagagagtctatgctgttctgacaatctctgcagtttcatctcttggaggatggaaagcttaaaatatttaggttagagaaagggtctgatgagtgaagaactcctcttttggcttgaatctatctcttctgcctttttttcttttttttttttttatattgagtttcactcttgctacccaggctgttgtgcaatggcatgatcttggctcactgcaatctccgcctcccaggttcaagcagttctcctgcctcagcctccagagtagctgggatttagcagagatagggtttcaccatgttggtctggctggtctcgaactcctgacctcaggtgatcccctcacctcggcctcccaaagtgctgggattataagtgtgagccaccacacctggcgtcttctgccttttttttttttttttgaggtggagtctcgctctgtagctcagactgcagtgcagtagcacgatcttgactcactgcaacctctgcctcccaggtcccagttcaagcaattctcctgcctcagcctcctgagtagctgggattacaggcatgctccatgatgcccagctaatttttttttttttgtatttttattagagactgggtttcaccatgttggccaggctggtcttgaactcctgacctcatgatcctcccacctcggcctcccaaagtgctaggattacaggtgtgagccactgcacccagccctcttctgccttttaataatagttttacttaacttaaaaccagctgtgagcttcttcttcattgttgctatggccagctcctagaaaagagctcatcacagagtagatgctcaataaatgaaggtggaattaacaaacacatgaagctactgaagggttccccgcaggaaattatgctctagaatggatgctattttaaaggacagtatagaatggaaaggggtgtcagtgatgcttctttagaactctgagaattggaattataaagtcaatacacaatggaacaaagcagatatttggagaattctccttaaagcaaaacaaaacaagcaaacaaccgaccaaaaaagggaacagaatgtcttctgggccccaaggtgggaaaaacagggcttggttctagtgtactctgtggaatcaacatggctaagaaagcgcaggccaacagaatgagaatgatttgaccaggaacagaaaaacgagtcagagaatccaagaccgactttgccagtgtgcacaagtgtgaggctgggggcctggatgtcctttctgaaataagagagaagagagaccaaattaggaacacccttatggtgagaccggactacttagagtaccctagcttgttctgatcctatatttctgttttgttttgtttttattttttgagacagggtcttgctctgttgcccaggctggagtgcagtggcacaatcacagttcacagcagctctgacctcctgggctaaagtgaccctcctgcctcagcctcccaagtgctgggactacaggcatggagcaccactatgactggctaatttttcttttttagcaattttttgcagggataggatctcattattttgcccaggatggtctcacactctggcttcaagtgatcctctcacctctgcctcctaaatgccagtttgcgctgggattacaagcataagcttgtaatcaaacaatactcatgctatatagagtcagaaggcctgcacctgactttctgatcctatattctcctagcacgggtaatgtctgatttctttgttacaggtaactaacatgttgatgttgccctttgctgtcagttcagctcctctaggaagcagatgctaagatggaattaggagtacaataaatttattgggggctaatggccatgacagaagggagaggaaacaggactgggcaatgaaagtcttcacacctccatgcagattagacacctgtgaaaggaaagaaagagaggcagaattgggcaaggggagcttcagaccatggtgtggatctgcataaatctctgcctatgcaatagggagttctggaacaaagagtccccattagaagagtcccatgctgggcagacagggccacacccgagcactcccagcttgtacggtattggctgggggctacccaggaagagatgggcctcagctcaaacacatggcatatgttgaagatgctgcagctagaggcaacagtgagttctctcttaaagggagatcttcgcagcacacctccacagctgccatgcgatccaaatctcttattccatgctggctttcactatagaatagtggccagagagtttgatacctgctttcccagcctccctgacaattggaatgactatgtgacacagttctggctagtggggcttctgagaagctaactggataaaaagacaaagccttatgcgaagaaagcacgcacacacatacgtgcaccggctatttgttttctaattttgaatgccgtcttgatacctggaggggcagccatcttgcaaccaagaggccataagcaaatgtgctgaaggatatagttccttgatgacattaatgagactgctctcttcctggtaaataaacaatatgttattaacaaatgttcttatggtttaatctattgttttggtttttgttacttgcagctaactgataatacatttattgcctggttgaagtaacttaaagtatatatgtacttaaagaatatatgtaattcacccacaagcaagttcccatataataggtctcattataaatgagtaagttggcattctactttacatgtgaatttcttaatactttggttagagtgagccagtccttgtgaaatcaatattcacagagtattctgagaaaagagttttgagacctgaaaagccagagaaagacgaagcctgaaaagggtgacaaggtgcactcactcagcgtccttcccgagattgtgcgttccaatcttagcaagagggtttgcatttattcaagccccaggacaaactatggctgtacatcctagttggcaataatttttaaatatcaaaagcctgaaacttgtcacctttaaaaaaaaaatttctgcagtgaaataatgaagcagcgcctgtactttttaggagaatcagccctgtatgattaattataggccacaggacagcaatggaatatatagactatgaggaccagtgggcattgtctagaaagaagcaatttgtttatagaagaccgataaacactgtgccgactttcttccattgacatactagcaaccataaggaaattcactcgttgtcatgttggaagacagagtcatgaaaaaggatacagaataggtcagttttaaacatagttgaagaaagtatggtgtgaggacaatagtgacagagtggggaataccgagttgctgggctgtagtagtgggaattctgggcacttgtccctttagtgtgaggaccctagacactgggaaatctgaggagcactatttagatgcaaaaatggaccattttgatgttctcatctgtatcagtgttgtcaaggaaacagatgacttgctcaaattaggataattcaaagagtgtttaataaaaggacaattttcaaaggtaaaagagaggtgtagggaaacctcaaggatagtgaagtcaggtcttgaaacagagaagctgtaatcaaattaggcccaaagtgataaaaggaggatagatggctgctggaacccaaaaggaagagttgcgtagaaaagatgacttgagaagatctgtgaccttggttgagaggacacagcttacctgagagccaggggcctaaatatactgacctcatactcctccctccctccaatctctgccagggctccccattggcccaactagaagccagggagcacaagagcctactggtgtagttcatgaactcagtttcctgggtggaaagcacaatggagaagagcagagagtgggtctgaaggacaaagagaagacactgtgtcccttcccttgtttgtcctctttcagagatggttctggacaactctaggactaaaaccagaaagagagagaaggaaactaagtctggaacatctgcagatgatgtaatttgttcctaagaatttgagagattctgaaaacataaataaatcataacttcaggctttcaagtaagacttggatacagcgagctctcccgggaggtgttgaggagggtgtttggaaacgtacctttggctggtattgaaggaagaagagttctcatttcaaccagttaactagttatttcatccaagaaatagcataatggaaaatatagggaaatgagtatttaagtgttggaggaaaaaaaaaaaagaaaaggaaagcagaccaagcaggaagaagcagaggaggtggagtgggcacttattaagggaagcaaagctttccagaaacctcagtttatgattcactacccagaactgggtcatatggtagttgggcaccccgagctgagagcgagtctggagaagcagacatttctacctgggcacagtgatgccctgaaccaaatcaggtttctggtagaagacagaaacaggcgtagatattgggcaggcaattagcagtgcttcctgtcttacagaaaactaagactcatatatgtgaaggaattgatccaagaattcacagttagtaagtgatggagctaatattcacacttggcttctttggactccaaatgcttttgtgtactgggttataaagttataatggaaggctggtgctggcttcttgccttaacatgtagcactaaaagactggtagtttatcctgtaggaaaggatggctttggacatatggagaagaaaaaacagaatatttctaggagatgaatttatttcacctgcagtgaggaacacaggatattggttccagttttgtcactgacttataacttaggtaagtcacttattttctctgtgacattttgttactgtctataaaatggaataatattaccttctaaaaactcacagataatgtgaaatataataacaatattaagaaatgctttgatatccatggataaaatgttttaaggaaaagtcaaagatgtcaaaccagcattttgggccacagtgctcatcaagaacattccagataaaggcagaacaccactcctgttggatgtaacagtgagactaaatactgccaaagtctaagtgcctggagaaattcctgttaggaacatgaactacagagaacaacaatgcttcctcttcttttcctttattacaataagatttcctctatttctaagctcctggacctgaagcagacctgcagagaggatcaagtgcagagacaagctgctgctgagatcatcataggggacctcttctaacatatgagttcctgaggaagtgctgtgaccttccaatgctgccactggtagtctcatttcaaagagtaaaatgtgaaaatccaatggcagcagctattgtgatatgccagacagcaggaattgggactaaaaatcaagggatacttgtgataatagatccatagtactttggagctggaagaaacccagcttcaaaaaacagcttgatttgcagctcttcattcaaaaaggtataaaccctctctttttaaatgcttaaatggaataaatgtattcaggacagctgctgagattatctagaaatacagattgcttaaatttgaattctgaattcaaacttactaactatgcaactttaggaatgttgcttcatcttttcggatgtttcctcatctgtaaaatgggatggtaatagaatctttcttgagtttctttaattaggcaagataacctgtgtaaagcccttggcacacagtatgtactccctaaattctagcccttatattagtatgtatctataaactattagaattatagagctatagtttctatattcagaaaggcttaaatatttgtacatgcctacctcactgcttctgtgttagagatacaattgaaggagggaggttgacagtgaaaatgctcagaagttagagtcagacagacctgattttggatcttgctgtctctcctggcattgtgccctttggttggctactttacttctccaaaccccagttccttctctgtttatctaagcaatgtgtctttcttcttgatgccttcagcagccctgtaccattccaatattgatacaaactcaattccttcattaacttccataagaaatctattcacactgagcatattatcactttttttttcatccttactgtgagttcatatgatcatagggagatatctcatcacacagagtgcccacattttcacttgaaaaatctctactagattgatctcttctaactcttgcctcctggccctcagccactgtcttcctcctactcttaaacttaccccaagaatgcatccaatcccattttccttccctattcttcctttattattctgagaaatgtgcttctaccataagaaacctggatgccagcttattgctctttttttttttttttttttttttttgagaccgagtctcgctctgttgccaggctggagtgtagtggagcgatctcggctcactgcaacttctgcctcccaggttcaagcaattttcctgcctcagcctcccgagtagctgggactacaggcgcatgccaccatgcccagctaattttcgtatttttagtagagatggggtttcaccatgttggccaggatggtctccatctcttgacctcatgatctgcctgcctcggcctcccaaagtgttgggattacaggcgtgagccaccatgcctggcctcttttttttttttttttaaaatcacaactgggtaatcaaagtatttcttctgtctctgatcagatgctaagaagacaatttttttctctgatcatgttcttaaactccttaatctttagaatgcaattcttcttttcttggagagaaactgtgttggatattttccatttgctcctccagatatgaccccctcctcccaccccacactcatcctcaccctgctgtgcacctagggaagatgacccacgctgactgcatcactggctccttgccttttggcttctggatggtttggccagtgagtgtcaggagcagaagactggaggatgggagagtgagttcaggatatttatcccctcagatttatccccatcttcccaggtcactgcaggttggacacatcctctactgaaggccatatcgcctgtcagtgggtccttccctgaaattaccctttctggttctaagagctactctttctccttgtaccttcaggcctagaggtggtcacagctcctgctgtagctggccccagggatgctacattacttcttatatattttccttacttgtctacaccttcataaatagtccctttattaaactctcaattacaccatttaagtgtaccatctatttctagttacagcaacctacccatttatttaactcttcattccttcaaaaaccatgattgagttaccatttctagccaggaactattgtggggactggggatacaaaggcaaataatacattctgttttccatgagctcactgctggcaaaggacacagacaaatgaacagatggtgacaatggagctgtaataagagcagtgttagcatttttgctttgaaaggacatgagggaggtccttagttctctttaaggactagctgtggtctgaatgtttgtgccccgacccacttcccaaattcacatgttgaaatcgtcacccccaagatgatgttattaggaggtgtgtctttggggggtgatgaggttactgggggaagccctcatgaatgggattaatagccttgtaaaaaagaacccagagacctcccctgctccttttaccatgtgagtacacagcaggaaggtgccatctatgaaccaggaagtgggccctcaccagatactgaattgtcacattgatcttggacttctcagcttccagaactgtgagaaagaaatttattgtttataagctatcctatctatgttattttgttataccagccagaatggactaagacagggatctagcagagaaatgctttctgaagaagaaaaaattggctgggtgcagtggttcacacctgtaatttcagcattttgggaggctgaggtgggaagatcgcttgtggccaggagtttcaaaccaccctgggcaacatggagagaccccatctgtacaaaaaaaattttttttttaaaattagccaggtgtggtggtgcatgcctgtggtcctagctactctagaggctaagtcagaaggatcacttgagcccaggaggtgaagactgcagtgagctgtgattgtgccactgcactcccatctggcctgtggagtaagaccctgtgtcagaaaaaaaaaaaaaaaaagaaaaccttgcttttgctttcactgttggaagtcaaagtggaataagataagtgggaattagccaggatggggaagatgaaagagagatgagagtgtactagaagtgggaatagttttggaaaaatgctaggaggaggatcaactaagggggtcagagcagagatggaatttgaagactggtagaagactggctcaggcagtaaacggctttttttctctactctttttgcaggaattttgtctttatcctgaacgtgatgggaagccagggaaggcttttgtgttttagaaacgtctctctggatgcagtgtatagaaggacctagagagtgggccctgaaggtagtgaaaacagttgggagggcagagcaaggcggtaggcgagaaatgagggctgaaactagggttgttgcagagtggatgctgacgagggagaactcaggagaaggtctacgtgggtagcctttttaccacagtacttgcagctgctctctcattttaaactggggatgtataaatatagccgtggcagggaattggaaagttttagctctgtatacattctaaattaggcttgtacattttggagttcaatatcttattaatgttgtaaaagatagaataaatactattatatatctgtctacgcagtagcaccagctccatccaaataatgagttagacagtaacaaatctcagattccaaagggcagagcaccaacacagagggttcttcctgctgtgctggcgtggacagtggccacctttcaccacctgttcccctggatgcttttgttcttctatgctggcagaactaggatccaggcaggcttcacaatgcagccagagttgctgatagttttggcgaataacctactgaaattaatccagctcagaatatgagttcaggaaactggaagtagaattgttctttacacaaacctcatttcccctccctgtttcctcctccacagactcaggttgtggttggggggaatcaagagacagaaaagaaaagggatgggtggattaggattcggaagcagtttgtcttggcttggaagtaatagaattgaaataaagctattgaaaagaaaattggggtgctttcaccacacctcttctctctgtgccgccatccctaaggatagctcgtgtggcaggaagagcattttatctttcttctcttgtgggtttcaggggtctttcacgggaaaaaagggataatagggccacagggagtggttactggctctaccatctcaatacatccctctaaactcactttcagacaatcctagctgtagtacttagtgctcaagagcagggccttggaatccaaacaacctgggtttaaatcctcactctgactattcctcttggcagctgtgtaacttggggaaagttgcttcatcccttcaaacctgacttttctcattcataacataggaatattaatagctatctcatagaggcaaatgggggattaaataagccaaagtatgtagagtacctggctcagagtaagcagagggtggtagctttttttttcttctttttttttgagacagagtgtcactgcatcgcccaggctggagtgtagtggcacagtctcagctcactgtaacctccgcctcccaggttcaagtgattctcgtgcctcagcctcctgagtagctgggattacaggcacgtgctatcgtgcctggctaatttttgtatttttagtagagatggggtttcaccacgttggccaggctgatctccaaccccttacctcaagtgatctgcccacctgggcctcccaaagtgctgggattacaggcatgagccactgtgcccagccaaagggtggtaacttttaatttttgggctgtaaattagagatggaatggccaaattaggagtccaagctgggcctccacttttgtgcttgtcagctacataggctagggggcagtgggagcctcaagatcacatcctcaggcatggtccagggccccatcctctggccttgaagagtgatgactaactgtggaatgttgcctggcttctctacagtgaggattgttatgtgtctaattttgaactggactatcaggtagttgagctttctatccaggaagtcaactgagaaaacactggcataaacatgcggggagtgggtttctcttatttgttaagctttatttttagtgttattgtatgacttgtagatgaagattctcactgacttttgggcctgcagaagcaggtgctaccattgcaggccttggacatgaacatggtattgttccaaattcatttctgcattatttatacatttgcaacttcaaagtggggctgaccatttcccttttataagggtgcctcttttcttgggctttccaggatgccatgtctcctttcttcttccttcctttacaggcagtgctgtgtagtgtgctgactacaggtaaggattctggagccagactgcttgggtttgaatccacgtccactactgtggctgtgctaccttaggccaatttttcatccttgtgtggttcagattcctcatgtgggacatgaagaccaataatagaattgttgtgagagttaaatgagtcaatatgtattgcacgtggaacagatctggttaatagtgctatatgtgcttgtgccatgaactagttctagatgctttacaaacataatatcaaccaactctcacaacagttttataaggaagcactatttgtatccctatttcacagcctgagaaaacagaagcttagagaggttagctagtgtgaggtcacagagctagtaggtagtagagttgggaattaaacccaggtttttctgtctacctgtaaagtctgtgttcttgaccactatttacccagtcttccatagtaggtgttttaaatttttgagaaagttttttgtctttttttttttttttattttaatggagtctcgctcgctctgttgcccaggctggagtgcaatggcatgatctcagttcactgcttgaacctcctgggttcaagcaattctcctgcctcagcctcccaagtagctgggactacaggcgcctgccaccatgaccggctaattttttttgtatttttagtagagacggggtttcaccatgttgcctatggctggtctccaactcctggcctcaagtgatccactccccttggcctcccaaggtgttggcattacaggcgtgagccaccgcacccggccgaaaggtttttttaaacagttcttctccagcatgtttggcaattttgttgattctatctggctaccctaaaggaagagtatctatctcctttctcctgactacaagtatgtgaacactcaagatgaaagaaggggactagcatcagtaaattcccggaaagcactggtgacagtcgcaggaataaactaggtcaatttgtgtctcattgtccattgacctattgccttagacttggttagatctcagtgtgattccagctggcctctcagcttctcttcttttcatcctcacatctatcctccaatgggattcatgtagctaaacttgcagcttttcaaaaacttttgctctaaatacctctaataatggataagtgcctctggaaactctggggaaggtagagtttaaagcagtctgtgataagcataagatttctttgaaggctcatgttttcttaagatttcatgcaaattttacaatgtatttcctttttttaaattttaaatcaatgttttatctaggaatgattttagatttacataaaaattgagggatagtaaagtgaataacatattctcttcacctagtttcccctaatgttaacatctaatgtaaccacagtacatttgtcaaaacgaaaagattaacattcgtatattgctaagaactccaaacttatttggatttcaccagtttttttttttcactaatatagatttttttgttgttgttgttccagaatcccatccagggtatgacattgaacttactcatcacgtctctatagtgtcttctggtatgtaatactttctcagtctttctttatttccataaccttgattaactgttttgaagattactggtcagcattttgtagaatggctgtcagtttgactttgatgtttttcttatgattatgttaggggtatggggtttgaagaagcataccatgggagcgaagtgctcttctcatcatatcagggggtacataatagcaacatggtttatctttgatcatattaatctggatcacttggttaagatagtgcctgcgaggtttctttttttgagatggagtcttgctctatcgcccaggctggactgcagtggcgcgatcgtggctaactgcaagctccgcctcccgggttcacgcctttctcttgcctcagcctcccgagtagctgggactacaggggcccgccaccatgcccggctaattttttgtatttttagtagagacggggtttcaccgtgttgaccaggatgatctcaatctcctgacctcgtgatccgcccacgtaggcctcctaaagtgctgggattacaggcgtgagccaccgcgcccggctgaggtttctgtactatacagttattacttttcccttcgtctactctgttctttggaagggattctctaaaacttgctcagactcaaggaacgggtgtggtgattaaactccacctcctggagtggggagttacatatattatttgaactttttctgcaagaaagatttatctcttttcccattcatttatttatattggtttggattactattgtcttaatataaaataaatctttttatccccaaatgtacaagtggaatgactttccagaaacatgtgagtcctgaggatactcatactttctagcccgccgtttgcgaagcacagacaaaacccaaagcctcactgggttacttccttgcttccattgagtcatcctcctcaataatacttgtgaatgaacgaataaatgcataacacgcacaggtgagcgatgagaaataccagcgttgtctgacggtaaggatatttgtgttcaacaccagtgtctgaccaaatagctactcatatttcttctgaaattctttagggcacactaaacatcttccatgttgtctaagtgctggaagggaaattgattcagccactttttgaaggtgactctaaattattctctcaaaatactcaacagcctttacaatgtagttaaaaaaaaaaagcgggtggaggggagaaatgcctgtctaaagtaggaagccccaagagaaagccctggggcgtccagaggcttggtttcacctggcagccgtctgggaccaattgcggagttgaagtagctcctacgctttctcattggtcctcacccagggggaaggcgtggcttcaagtgtaaaaggcgaggaagcctggcggggctgtgggttgttccgctggtggatggtttggggttggtcgggcggggtttcttccaaagctttgtaggcctgcgaggtactaagaagttctctggtggctggaggggtgggtggaaaggaccaagctcttggtaattctcaagggggaactttggttagcttgctttagaagtgaaagatgaacgaagaaaaaagcgagggcacttaagcggactaaggaactcgaaagaaggggaactaggcgttgtgtgtgggcagaaaatacctcctaggaggtcacagcaactccctgaagtcgtttttagcaggcttgcctcttccagttactgtgctttcttagagtttgttcttttagaagcttaagatacaatcttgaattgaggtttcttctctcatgctcaagccttacttgctgagaaggctcctgtctcttgacttctgtttaatctctaccatagactttagcaaagccactcttatagctaacttactgaagttacgtaaactccaagagaaatacacgggtttagaggttctacgtttaaagcaagcgcagcaatctttagaacttccttttagctatttggaatcccaaagtctctattaaacacctgtctggagtaatggtggaaagtgactaaaaagctagcttctcatctcttcagagactaaaaattagatccacttcgatgaaaaccataagaaaatgtagatcaactttgaattagtttttttttgagggtaggaaacgtccctttgtgacctattagtaaaaaaaactaaaatgaacttcaagcatgtggcttttaagactccttactaggaagttaggatcttaatcatattcagcagaaagcagctgtctgcctcgaagacacgcaacctgtgggctgcaactgaccttccacctggttgtggaggtgggagactcgttgactggcaagcctcaggtaatgtcagactgacacacctgaaagcacttctgatagcagttagaaacttagtagttgaaacaggaaatttcatctagttgaacagatcgttagcattgagaatggacacttcctttaggcttactaggaaaggcaaaccatctgtcatggaaaagataaagtggcatcttagtgacagactcaaaagtacacagcatgatggatatgttcattatcttgactgacaatttcacaggtgcgatggtagcaagttacatagcttaaatatcgtaattcttgcgtgccagctacagaaaagtgctttttaaaaccatgtccagtcatgtaggtccacctgccttaacctgaacaagggtgaataaatacatgggtagggacatgaagcactctcccctcatccccatcagcatggagttactttcttcacactgtccttacaaagcagggttcaaggagaagagcagagttctttccttcatgtagataatctgatcaagggatgtgtctcccaggctgacaatccacttgacaaagagtcacttgacaggtctgggatctcgaagcccaaggctttccaacactgttagttaagtgctgtaattagagctggggtgctggggcagggaaggctcctgcaggatggtcaaggatgggaataggtggccttgtttttccacagttgcttaacattaaaaactagtcttctgattagtcatcctgtagcattctcacctgtacttgtgtccttttactgatagcaaaactttctctgcttttatagactccagaagctaatacagcagtgacttagtcctgccaaataagaatttggtcaaatttaagtgcatggtacggatgccttatctccctaatccttttcccgtttttgtaaacttcaaccactataaaagccgagggaaacaaaaactaactttacataaacaactttacttcaaaactaatactctgggctgggtgaggtggctcacgcttgtaatcccagcactttgggaggctgaggcgggtggattgcctgaggtcaggagttcaagaccagcctggccaacatggcgaaaaccctatctctactaaaaatacaaaaattagctgggcgtggtggcaggtgcctgtaatcccagttactctggaggctgaggcaggagaatcatctcttgaacctgggagacagaggttgcaatgggccgagattgcaccattgcactccagcctgggtgacaagagcaaaactccgtctcaaagaaaaaaaccaaaaatccaaactaatactgatagatcactgggtcttcaggacttttcacctaggctaacagtaaagacactggaaagttcatctttcccacctcaggcagagcaaaatatctactaccgacccaattaactatagtttcaactgcaggtgagtcctatggaactgatgtctatatgtaggtgttattgcataggcttctggggcatgccacatagttctagaaaaactcacatggcttaggagacaagtttaaagttatggctggagagcaaggtagaaggggctgaaacatctcaaatatcaacttccttttagaacaagatgtggagtagtgcaggatttgtcaatggcactcccgccattcctaaggctgcttatgtacttctgagctttggcctgatgcgtgtttgtctgtcttgcaactggcctcactccaatctgaactcctgatgtctcttaaagcttgcctgagaacccagctttttagtagctcaaatccttactatcccttaggatagcattactttgaaaatcctcagttgtgccaagaccatttcggattcaacctatttttggggttcctgcttagtgtctagtgtctacctagagctgcttgatgccagaggctagtggcttctttaccaggaaactgatggtagccatgtcacttcttggcatcaaacctgtctaaaacagtccctagctgaagacgactttcttcctaattgtcagccattcagatgagagaagttacaggtggtcgaaggtgagaactaagtgatagaaactggaaccaggtgtactgaaactcttgactctaggagaaactaatttcttgagggatttgttaaaggtaacttatcaagacccacttcctcccaatctacacagattacatgtttaatttgggccagtaacttttaagtctttagaatcttgacataatctagcaaagtaagactgctctaggtgtggcaggaagcatgtaagcagaaccccttgctggcctgctgccgcaaggagcccagagaatccccgaggcattggaacagtctgaggggtctaaacatacttttgcttattgaggtgcttgcccactagagttctccgaatcagtccctgatgagggaggtgcctcaagcttgcagctgtggtcacaggattaacttctcaattctcaggctacccatagggagatgccatatcttggtttaatcctgtttctgtggcagatttcagcttactgctcacactctgggtctcacggctcctatgacatcagtttcagtactgtaggtctgatcttcagttgggggtggtgctggagaaagtgctctcactagggagctgggccctcactgtttctgaatcctctgatccataaagcaattgtagtgtgcctacaaacgggccctctgacatctgactttcaaatggttgggatctttttcctcagggaatagattctttaaaaaagcccctgagtgagagcagagcggtggctggaggttattcgggctaaatggtttctccggctgccacccaaactgaaatgctttacctagcaatggtcatgaggcaggtgactggagcaagtaactgctggtagcaaacgagcctgttgaagcatttgtgcaggactggtctgactggcctggagagattagttaacacccttgcacactgagcacactccagaggggagtccctgccctccaggaacttacaacgtagcttgaaggaacatgaagacccagctgtagcttgttacttaatggcaatagaaaatgggtgagggagtgctggctgggaattggaactgactttcaagtctgggttttttcctgtgaagtaattctcaatggagtagacttcagctctggcctaaacgctacattacagtgcctttgtgtatctaaattctggtgtctaatctggaataacctttcccaactatgtgacagaagtttgggcgctctaggaagcataaagtgagggggatggaacttgtcttcagtaggtaagccctgtagatgacaatgtggtcttacttccttaatgtggtggcctggtagaagcatggctaagttgagatggggaagaagcctaggaaagcccaggatgacttctggtctattttactgctgaaacagtctggagaacttgtagagatgcaaaaattcgtcatgatcaacaggacagtcaaagggacctaatgtgccatgtgtctttgggactggggttaggaactcccagatagaaggggatgtgatataaacagaacagtcttgtgattttgtctagttctgaaatcacctctttttaaagagctctcaactcctatctgcaaatgtgtttggaacgcttccagatcaagttctctgtgcatcctctttagagggaatttataggagcctctagaacagtgctgagacacacgagccaaaagtataagccatatatagtcagtcccattaaagaaaaacgaatatctttaacccaagagatgcttattttgacatgtaacccagcttattcttggtactgagcctggtatgcattttaaacttagtgtatcaattgagatgggtcctatcaagtgctcaatgaatagtggttatattggagagcacagctctggataaaacataactttaagtttttgtttttgtttaattcatttgttaccgctttagggaaatgctgatctaaaatgacggtagaatgtagtgtctgtattgctgtctgagtgcaaatccttggaaacttccaggaactagtaggctagaaccacttgtattacttggactttgtcagaatgactgcctttgtgtaaaacaccattctgtcagcaatatgaccattttccatacccctagcaatcactttgattattgtgggtaagctttgtcctggcatcttctatgccatctatatctaaagcacccattccaaagctcattttagtaacttatttgtcctgagcacgggaaatgggaagaatacaagtagctctcattcaatatcttccagttttcagtttgggttactggtattctttagatcctggaca

SEQ ID NO: 36250 - DNA, 41598 bp, Homo sapiens; identical to SEQ ID NO: 36249

SEQ ID NO: 36251 - DNA, 6495 bp, Homo sapiens
gccgggcaccggggcggcgggttggtctacgctgtgcgcggcggacgtcggaggcagcggggagcggagcggggccgccggggcctctccagggccgcagcggcagcagttgggccccccgccccggccggcggaccgaagaacgcaggaagggggccggggggacccgcccccggccggccgcagccatggtgagcacgggcgatgaggcccatgaaggtggtcgggggtgtccctgagggaggaggtggagtctcaggggcctccgacgggcggccttgaggggtttgagggccagcctgggggtccctgacccgggatgggcccgagggccttcccgcaggcggagcaggagctcgggcggcccgcagtctccctggcggcgagggctccgggcgctttgcggcccgcccatgggtgttaccaggagcaaggacgccccgccgccatctccagacctgagccggggtttcaaggatgctctaaccaaaaattagtggagaagggggagagagtagatctctggcctacgtggaaccactggggaccaagcagggttaggagcgggctttggggggggggttctggggtgggtggagttatctgcaagcccccccgtgaacccgcccccatttctgttggaaactctgcctgggctgatggcctgaagcatcctgggtgagggtctgggagttcaagggtgattgacagcctggggccactgagtcaagacttgggcagtctcagcatctttaggccctgcgggaagcccagctcttaacactcgctcaccctgctctcccatccgtgcccagaactccaacgtggagaacctacccccgcacatcatccgcctggtgtacaaggaggtgacgacactgaccgcagacccacccgatggcatcaaggtctttcccaacgaggaggacctcaccgacctccaggtcaccatcgagggccctggtgagtttggaaggaaaaagagaaggggctgctgcttagatcctccatcaccctgctctagatcaccctagcgggaagtacccattacaggctggcctcgtgtcaggtgttgggatgcattggtggacagggcaggacgccacaaatgacaattatgtactcttttcccacaagggttgagaaatatctggtcattgagttagtatatcatgggacggtactctagatttgaagcaaggctttcagacatggcttccctggacctgagggtgggtaggaattaagtaggaatgggaagagagctccaggtggtgggaatggtgtcagcaagggcctgggagggtgggccaggtgatctcaaactccatcctgctgtgagtgtcagggatgaggaaacaagccagatgcagatcgtggggagacgggtcatgaatgatttgcgggtcacatgatttgcggagtgatttagaatactgtttcatgcaggctacatttctgttatcaccagaattcctacaaagtcaggatttgagcagagcctgtgaaggaatggtctagtccacggtggtgatggtggtaggtggtcaggaaagacctggcagcggtgacagttgaggtccttcatgccttgctgcagagggcgcgggatcatgacaataggaaggctccagaaaggcccttgggcaggtggagctgggcgcttggtaaaaacacatgaagaaagttgatgatgaagctgccaagctcttttagggcttctaggcctcttcaaggagtttgtagaggaagctggtggaaggtttaaagcaggggtgtgacaaatccctccaaagttcctattgactgtagtgaggagagccggcctggcagggggaagaacccagaggccagccaggaagctagccttggagatgggatgagattcaggggaggacctagcaggccggtgctcaggctgctgatgggctaggggagggacagtattttgacccaagcaagtgggtgagtgggagaggcgttcactgggttgggaggctgtggaattaacagacagttggatccttgatctgaaaggcatataaatgggcatcttataggaaagtgcgtacttgggtccctgccacctgggaagggcctgtgactggagtggtcagttgggctgagacgggggatccaggagggtgcagacgagcttgatagtgacacaggtgggggctgcaagatgggcatcatctctgaggttttgggggaggtcctgtggccccctaggaacccagccattcttgctcttttttttttctctctctaaacggagtcttgctctgtcgcctaggctggagtgcaatagcacaatctctgctcactgcaacctctgcctcctgggttcaagcagttctcctgcctcagcctcccaagtagctgggattacagacgtgcaccaccatgcccagctaattttttgtatttttagtagagatggggtttcaccatgttggccaggctggtctcgaactcctgaccttgtgatccgcccgcctcagcctcccaaagtgctgggattacaggtgtgaggcaccgcgcttggctttttttttttttttttggaaacagagtttcgctcttgttgcccaggctggagtgcagtggcgcgatctccgcacactgcaacctccccatcccgggttcaagggattcttctgcctcagccttccgagtagctgggattacaggcatgcaccaccacgcctggctaatattgtatttttagtagagacggggtttctccatgttggtctggctggtcttgaactcctgacctcaggtgatccacccgccttagcctcccaaagtgctgggattacaggcgtgagccaccacacctggcctcttgctcttaagaattctacagcctgactgggcatggtggttcacgcctgtaatcccagcactttgggaggctgaggtgaacaaattgcttgagcctaggagtgcaagaccagcttgggcaacatagtgagaccctatctcttaaaataaaaaagtagccagacctggtggcatgcccgtaatcccagctacttggcaggctgagatgggatcacctgagcccaggaattgcaggcggcagtgaactgagattgtgccactgcactccagcctgggtgacacaagagaccttatttcaaaaaaagaaaaaaagaatcctccagtctgttggcagagttggcggggcacccacctgcatcacaatcagaccgtggagactggactttggggtgttgaggtgccttgggactcctgagtgccctgaccctgtacccctccctccactccagaggggaccccatatgctggaggtctgttccgcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctggtgagttctgggctggggctgggcctcctgcctcctgcctctggaggtctgctggtgtctgagccatagcgctttgtttagtttttctgaatcaactctgaagtggttgaaggtttccacataaaaatccatgttgctagctttcctggaaagacaaacagtgccagacccaggacacccaagtactgttgagaagtgcccaggagcaccttactatgcaacgagtggtgagtttgtattgtaggatggtttttctcttctcccttttttttaaaaaacaaggatagggtaggccaggtgtggtggatcacttgagctcaggagttcgagaccagcctggccaacatggtgaaaccctgtctctactaaaaatgcaaaaattagccgggcatggtggcacatgcctgtaatcccagctacttgggaggctgaggcaggagaatcgcttgagcctgggaggcagaggttgcagtgagccgagatcgcgccactgcactccagcctgggtgacagagtgagactctatctcaaaaaaaaaaaaaaaataagataaaaaataaaacaggaatggggtctcatttgttgcccaggctggtgtcaaactcctgaactcaagtgatcctcccacctcggcctcccaaagtgctgggcttataggagccagccactgcgcctaccctgtaggacagttttctgacaggtggaggtcaagggtctagttagaagctctttctttcttttctttcttctttctttcctttttctttcttccctttctttcctttctttctttttgttttaaagatactggctctttgttgcccaggctggagtgcagtggcgcagtcatagctcactgtagccttgaactcctgggctcaggtgatcttcctgcctcagcttcctgaatggctggtattacacgcatgcaccaccatacccagctagtttttatatttttatggtttgcagagatggggtctcattagaggcttttttgctaaagctgagcttacatgccgtaaaactcagttccaaagtatacagttcagtggttttttaatagcgatagggttcataaaccagtgtttctcagccagaggtgattttgccccccaaggggtattatgcattgtcaggagaccagaaagggttgtcacaactcgggggtgccactagcatctagtgggtggaggccaagggtgctgcccaaatcctgcagcgtacgagatggctccatgacacagaatgacctggctgcggtgttgctgaggtggaggcgtcctggtctaggctggtgctccaggctgcttacagcctgctgcctcccaacccttcccgcaagctgaaaaaaaaaaaagttaaccaaatttctaatgagtccctggggcacatggcagagagggtggggaattggggtttcctgccatggggagggagaggattgagctccaaggtaaacagaccccaaacccttccctcccacatgtaccgcctcccttcccctggggtgtcattggaggctgctggggacattggcaccgagctccaggcctacttgctgctaggtcagcatctgggcctgtcaggggctcagccagcaagaagagcagccagacctgcagtttgggtgcagtgatgagaattagggtgggaacctgtgtcctggtcaccatcagtgatatctgctgagcatctgctgagccaggtactgtgtatgtgtcatagtggccccagggagcaaactgctgtggccagtttgcccagacccacttcagaggatccagctggggctgctggaggcctggctgcaggtcacacctctgcactccaatttacccctcaggacgggctgtgaagggggttgagaggaatctctggaccaccctcgaagtgcacctcagccagcagtcctggtgtcttgccctcttgtgtgtggtccaacccagctagagtcttaggctgtgaacttcggatgtctgataaaagacagaggtcaggatttatgctgtatctggaaagatggggagctttagagtccaacacgcaggtgtgatttcctcaaatcctgaggccctggggaagtctcttctctctgtccaggctgcaggcctcactcgttgaaccagagggcctctaaggtcatgctgaactgcatggaggcaaattcaaaaccataataggactcaagtctggggctcaggcaagtaatggactcctgagagggggccttggcgtttcccccgttacccagcaagttccacggaggaccagggacattttaaaccattgggcctatggcatcgtgtccttttgggaacatctgctgtgaggcaggtcacatgaaggtggcctctgagggagacaggagcaaagatgagggaggatgcagcataggtggggcctggatctgcagctgagttgggagcagaaggaacagccagtgcggaggccaccctcttgtggaggcctgggggtccctgtaggttgcccgacccactgtgaccctgagcctcttcccacagaccatcaagtgcctgctgatccaccctaaccccgagtctgcactcaacgaggaggcgggccgcctgctcttggagaactacgaggagtatgcggctcgggcccgtctgctcacagagatccacgggggcgccggcgggcccagcggcagggccgaagccggtcgggccctggccagtggcactgaagcttcctccaccgaccctggggccccagggggcccgggaggggctgagggtcccatggccaagaagcatgctggcgagcgcgataagaagctggcggccaagaaaaagacggacaagaagcgggcgctgcggcggctgtagtgggctctcttcctccttccaccgtgaccccaacctctcctgtcccctccctccaactctgtctctaagttatttaaattatggctggggtcggggagggtacagggggcactgggacctggatttgtttttctaaataaagttggaaaagca

SEQ ID NO: 36252 - DNA, 102765 bp, Homo sapiens
gatttttcctagcgagctggaggaaaggcaggtacccggagtggagttatattacctgtttctttgttctgatgggaccccagagaggacatcacgctttgtaactggttcttcaaggggagaagcaaatgtgtccctgaaaacttcagctgccgcgtttggcaccaggtttgattgacaaggactggcggagggaaagcgcggaggctgggctgggggccgcaggccgaggcagagacaaagaggtttcgcctgtccccgagagtggaagggcccctgggggtaactagcctttgagctcaaaggggcatttcgtgaggtcgccttttggttcggagagcgcgcggcgatcgggtggagggggcctggcgggaagaaagctggggcggggaaggggcgcgggccgaggtgggagcggagctgcagtcacgtggccgcccgccgccgcggagttggggctgttcttccgggttggaggcgcagcgccgcggggcccaagcccgggtctgccagcgcgacgtcctctcgcggccctcagggcacagcccaaggctgtcagcctcccggcccaggtgagcgcgacggcactggcgggtgcgggcagccggggcgcgcgcctagggcgcagctgggaaaggggctcgggcctttcctgaagaccacggccctcgccgggagagagacctgtcaaagagcaaagcggggcggggtcggcggtgtcccgggcgcagggtgcattggggtgtccgcaggccgcaggcttaggtggggaagaagcaccgtgcctcttggtgtccctttctcgtctcctgctggggcgatgtcgaagggagtgggctggtggatttgggaactgggtccccgaagagggcagggaatgaggcggcagctgtgcaggtgcagatatttgcagctttgggggacagcgagagtcgtacggggtcatttcggccctcaagatcgggggtggtggagagggaggtcatagaggactttcgatgggcggttcatccagagaggtggcagctggatgcccttgaggtatgcttgacccttgagggagttcggagagggtgtccggctggggacataggagattgcgagcacaaattgtgagtgtgagttggggcggtctggcggtggtgggtacaagtttctggggcctaggctggtgaggaggaagagacagcggagagggcgacctgggcagagctagttcaaactcaacagccggaatgactatttgcagccgtggccaatcggcttcctagggaggttataaatagcggtctcgtgcagatgccagcgggtggcagttagttgccgagcaagggacggcaccggtggcagtagccgtgacaccagtggctttgggtgaggtcacggcgcctgccagccgaagctggctcagtagggtattgtgtccttgctggtatgtctcgcttttaaaagcgtgacttgtttatggttgccggtgtcctttattcaccctgtggcgccggccagtccttaggtggtctgtttgtcaggagtcttgtaggacagacttattcggagaagcgcgtggggcttaggtgcctacctactcttcttatttaaagtgtgccccttttcttcattgcaccccttttatttgtaaaccttgactttttattaacagacagtttaggattgccttctttccagcaggtgcgcttaggctgcttaccttggtgatagaatcagttttccacaaggctacacaaacatttccttttcaaaggaaattttccgaaaatccttggaaaatgtgctcaataggtacttaggcttaaggtcacctagccctattcattcagtcaaaaatactgacttcctctgtgttgtgcaaagcactgggggagagtaataccaaagtgaatataacagctgataaggatattctcagtcctggcaacaaccctgagaggtaggtgctgttattttattttttcaagtctcgctctgttgtccaagctggagtacagtggcacaatcacggcttactgcagcctggaactcctgggctcaagtgattctcccacctcagactcccaagtagctgggacttcaggcttgcaccaccatgccctgctaattaattttttttttttagcaatgggggtctcactgtgttggccaggctagtcttgaattcttggcctcaagcagtcctccccactagcctcccaaagagatggcattataggcgtgagccaccaccctgggtgggtgctattattccccattttaaagatgaggaaattaagtacagggaagttaagtgacttcccaaggtcacacagccaataagttgcagagtggggcttccaatccgcagatccagagctgactctcttaaatatctgtggtatcctccctctttaggttgggtgctttccctcaaggattttaatatctaataggggaaataacccatataagttacattaaacatacatatgaaagcaatgcttaaaaagttgtgcttttgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaagttgtgcttttttcccctaattttgagttataaagtttttttcttattgcttcaaagccacaggaacacatggataaatgagagctttacagtgaagatggaggaaaatgtgatgattaggatggagtattatcttttgtataaacctgtacaggtcaatgataagatagtttaaatattctctatctttcagggccatttgtatttggtttagacttagtgatatgtattgcttttgccaagaaatgacctcctgatctctgccctgtatgttcacagttgaatcaagtgaaatttttcacagaaatgggcctatgaaggctttggccctactgatgtctgatgcccctgccaaggatctgctgaacatcaaattaccattttccaagtagaaggaacaaattttccagatttcaggccatgaaataggacttcagttttatagcattacaaagtctcatctaatcataaaatttctagagactaaaatggcctttgaaacctgtgctttttttatagttgagctaactgaggcagggggaggttcaggtcgaacagtaagtgagtggcagatttggacaatacaggactctattaaagctcagttcactcttttgctgatgaggtctgggaactctttgtcagccccataaaaatggtggttgttggggagttgggatgatccaagaagagaaacttgggtaagtggggaggttgggataggagtaggtcactcagtaatggtggggaaaaaaaatctcactcaagacaagaataatcttttacacatctttgcaactcccttagttcttggcatagattcggtaggggttttgaatgtgtagctgaatttcgaactaattttctctttattctcagccatgataactctagatgtgacccatgaatgaatgagtagggtatttatgagacttgagaatactttaggactgaaatgaaatgacatgatatgtggaaacactttgaacatgtaaagctgtctgtccaaatgcaaataattattcatacatatttttaattgcatgccaaaacacatcttgcattctttcttccttagctatttttcatttgattctcttcatctcaaacggctttcccttccttttctgagctctaaaagaggacacaatctcattctttgatccttcaaaggactctgagcttgtgttactctgttactctactttgtagtgttattatttgttgacttcttatctccaggaaaattccagtttgattctacaagtgcttcttaatggcaaaactctgcccttggtatatatttgttgaattaaggggcatcttatgaataaatatgctccctggattaaaaatttccattaccaatgctgctttctggtattttaaagatgtttcttcaaggagttgtggcagcaggttttttttgttttttgtttttttgttttttttttgagacagagtcttgctctctcgcccaggctggcaggctggcaggctggagtgtagtggcatgatctcggctcactgcaacctttgcctcccaagttcaagcgattctggtgcctcagcttcatgagtagctgggactacaggtgcgcaccatcactcctgtcaggactctgagcccaagctaagccatcataacccctgtgatctgcacgtatacatccagatggcctgaagcaactgaagaaccacaaaagaagtgaaaatggccagttcctgccttaactgatgacattccaccattgtgatttgtttgtgcccaaccctaactgatcaattgaccttgtgacattccttctcctggacaatgagtctcaggagctccccactgagcaccttgtgacccccaccactgtctgcaagagaaaacctcccttaactgtaattttccaccacctacccaaatcctataaaactgccccacccctatctgtctttgctgactctcttttcggactcagcccacttgcacccaagtgaaaataaacagccttgttgctcacacaaagcctgtttggtggtctcttcacacggacgtgcataacaacgcccggctaattttttgtatttttagtagagacgaggttttgccatgttgcccaggctggtcttgaactgctgaactcaggcaacgcctcccaaagtgctaggattacaggcatgagccaccaagcctggccagtggcagcagttctgaaattaaaaatgagctaagtctttctccctctggagtctggaagaacatttacggagcctgctaggatcagatgctcagtcccgtgagggtccacatgatacagcagaacttacaggcagagttagcagtgttagctgagtttggctgataaaattctaagtccttggctgctttctattctttttttttttgagacggtgtctcactctgtcacccaggctggagtgcagtggtgcaatcttggctcactgcatcctccacctcccaggttcaaccaattctcctgcttcagcctcctgagtagccaggattacaggtgccagctaccagggccggctaatttttatatttttagtagaaacggggtttcaccatgttggtcaggctggtctcgaactcctgacctcgtgatctgctcaccttggcctcccaaagtgctgggattacaggcataagccactgcgcctggcttctttccattcttgaaagaaagaagagaaaggtatggaggatcattgggaattatggggacagtgggagtgcctttcatgcatccctggggatctactgaggaatgtggtggaggtagttcctgaaaccttagtaacagcaaaacccagtgacacttcacgcagcctggtgagaactcgcaaaaagtggccatttgtgagaaccactgacaaaacagttcatagttatggccacatcagcaagcacaagcctatttgataaagatactatggaatttttctttctttcttctttcttagagtcatgtgtcatgcatgtttaattttcttgagaggtgcacttggcaaacatgaatcttttgttcactcagtcagcctcagttcagaggtctcagtggataagcatcctgctgcactgaacaggatgtcagagtatttggtatgacctggtggctaaatgtaagtcaccattatactgtacagtattttaggtaatttaagggaaattcaaaggtaactgaattacatgcactttttgctggacatgctgacttagaagataactttcatgtaagatacaacttgattctgtagcaatatgtgtgtgtattaaagctttctagctacattaaggatcaaataggttatatgacctaggcttggaattgaatagtgagtttagaactccaattttagtgggaaaatggattccaagttttaaatgtctgaactggaaaacgaattttgagcatcttctataagtaaggaacttggcaaataaattctttatagatgtctacatgtaactgttatatttcaagctctttagattagtatttttaaaatgtttttcatgtttaaaagacaaatagtttttttcttggcatatatacatcctattttcttttttcttagtgatttgccttcaaggaaactggggagtcagaaaattgggaactcatatcaacatggcaaacctattgaaaacagtggtgactggctgctcgtgtcctctacttagcaatttggggtcctgtaagggtctacgtgtgaagaaggattttttacgaacattttatactcaccaagaactgtggtgtaaagcgcctgtaaaaccaggtaaagtctcacttcagtgattgtaaatgaaaccttcaagtcataggaactaatagatctgatgattgataaaaggaaaagccatgtagttttatggcctggtgcttgtgagtgatcattttaaacaaacaacaagtaagtgctatcttgtattttccatgtactatagacgttcctgatttccagcgctaacagagaagacaaggtaatagaaaaaacaaacaaacaaaaaagataaaccagttgagttgtccctggagcctattgctcataataaccatttctcctagaagcccttcctaattccttgttagtatttgagaattgtaccatatacagctcatctatgctcaggaattaggaattaagtatattaattggtctacattaatgctttccaatttagttagtagcaatttgattgcagttgctcaggtcagaaaccctggagtcattctacatcctcctagtaggtataggtcagctccatctcatatctacaaactgtcctcttcttgccattgctacttttatcatcttggtccaagccatcgtcatctgtcacctgtactgatgcaccagtcttctaaatgtctctgtgctttttacctctgccccctacagtctgttctgcacaggacagtgagaataatctttttaaaatgtacagtcatgtcactcctcaattcaaaatttgccacttgcttcctagctcttacagaggaagatctgaagtcttccagtggcctacaaggccttccctgatagaatgtctccttgcttctgttctggggtacaggccagaaggaggagaggctaaaaaggggcccttctaaaccaagtcaactgtctgtcttttttttttttttttttttttaagcagcagcaagatttattgcaaagagcgaaagaacaaagcttccacagaatggaaggggacccgagcaggttgtcccccaagtcaactctctttcatcagtcttgcccaaagatcatcccagtacttctgtcacttcacctcactgtccagaactcagacatgtagctgtaagggagacttggacattttgctgtaagggagacttggacattttgtcttttattctagatggcaatgtacccagctaaaaatggcattttcttattaaggtgaaggaacaggatggatattttggggggcaacctttgtcacctagaataatgccctcttttgttttttaagtttgtaggactgtttgtggattcattaaggacctctaaactgctaggtgttttgagatcttatgtctgccttgaatagattttatagcctcttttcttgttctcagatgacaagtcacaattggcagggtatctgtccctacaagcctccaactttatcttcagatgctttcttttaaattgctctggaaagccagattatcctggtgataaaattgtgtataaaataaaggtaaataactgttgaagacatgaaaactgtccttgtgagtaaatccatggacatcaagatctctatattgattatgtataagacatttttgtttaatttctggttcttcactatttcctaattatttttatctctgaaagataagaagtctattttttccttaatataaccataagttcattaccatattgaaaagtgtagtaagtaattccagctacagtcagtattcatattttttcaattgctttcttgcttctttccttccttctttccttcctccctccctccctccctgcctccctccctccctccctctttttctttacagttggcttgttcaaagagtgatccaaacagggtccacacattgtatttgctatgtctcttttgtctctttttatctataagttcccctctctttattccttttaatatactgaagaatttcattgttgctctgtagaattaacaacattctaggtttggctgattgaatcctcttggtattgtttagccagtttctctgtcccttgtatgtgcttaaattatctcttatttggtcagtggaagccctttcaaattggcttctaaatccttttgacatggcttcagtcatctttggtagcttccttgcttttgccatgtagagcctgacaatttgaggttgtcagctaagtgaacttgagatgagtgtatgtgattgagctttgtatgtcaatccaaatatttgccagctttctattattttcctccttctccttccagtaaggagtaagattcagcattatttgcctttcgtgtactgtaaattattactatataggtagtgtggaatctaagacagtgttcaaattcaggtctaggttgacttaatttctctaaggtcttacttaataagttactttgtagggataatttcattcattttgaaattatacatattcagatcttaggttgcaagaatgggtttcctaagctttaataaaccttatatagaaacagatactcttcattaaaaaatgtttatgctgcatattaagtaaaacatcaggagaaactgatgtcctgtagctaaagatggtctgaaccatatctaaatataagattgtactatataggcttttttgggttgcaaggaacagaatcacatcagattatattttgtgatgagggtttgctatgtggattcttggcaagtgtgagagcccagaaaccccccatctactccttggataagtggaatgttatttgtagaattcatggctgtgacccatcttctctctttaaatatctactactgatgtttctatcactgttactgctgacctccctttgattacctcatagctgtgcttacaaataatatttgcactgatctactctccttgtccctctctgtgggtctcccatttaaactccttgagagagaacccagtgggttgagtagtcactggccaacatagagcgtccttggacagagttcctgtctaagtcatcttataaggtgcagctgctagttttccttgtctgccctgtagatgattgtccttgacacagttgctgatcccttgtctaagtggctgagtgtgtagagtcttaagatacaacacttagaaatttatgaggcattgtgtgtggccaaattgcctggaagggaactttgagtgtggcaggccatcaaagtgtctaggatacagttgttcttcaaaatagctaattacttccaattttgttaaaagtaagggcaaggagaccataaccttgcccttagtttgaagaatggagtcagcatgtggagggatctctaaacccatttttttttctcctacaaatcaactaagcttgttatattccttgaagaaagccaattgattaaataaaatatttagaagtttcagaagagtaggcataaaagtttcttataatctaccacaaaagtcaaagaattataagtatgaatcaggaacatcattctgaacagcagcttgcatgtgtggtatattttgaagaaaagattgctcctttcaattttctgaaatctgtttttaaacattttttgtttgtttttttaccaaatatatattttttttgcctttgcttgtttctaggaattccatataagcaactgactgttggagtccccaaagagatattccaaaatgagaagcgagtggcattgtctcctgctggtgttcagaacttggtcaagcagggttttaatgttgtcgtggaatcgggtgcgggcgaagcttccaagttctcagatgatcactatagagtggcaggtgcccaaatccaaggggcaaaggaagtgctggcttctgatttggtggtcaaagtaattattcctttttcctctcccatttacagcatgctgactttttgaaatcttttcatagaaaaattaaattactttatctggagttacaccttttcctattttcaaacagtgtatttttctcaaagaaatgactgcatgtcgtcatattcttcatgctccagtaaaacttttatcagacaatatgatctatgtttaaccatgaggagagaaaaagtgatcttcatttttacatttgctatatggacattttcttttaattggctaggaaaaatttgttctacatggtccatatatatccagagtacccacacgtgaacatttactgctagaatggaaagaaggtatggaacttagtctgggactaaatgttcagtgatcttctgacacctgaaggcgcaatgacttacactgacatacgtgctatttctagagagggcatgactattttggagaaagcagctttgggctgagtggcgagtagctttacctactctaaaataagttcttaaggtaatatataacagaaatctatatactaaatgacttgagaattaaaatattaaataaaaaatcctttagagaaagggggagagactgtatcaagggtctagcacagatgataactagagttgagcattaaattaaatgctaagcctcctgcaaccaaagcaaacagggaagtaactcattttttcaggagatacagcttttttctacattaatttctatgaggtatcaatcacatagtttttttatttccttacataaagcccactgaataacttgacaggatcctaacacttgacaggtggtttttgctaaagttacaaaaccaatttttgctattgaaagttaatagtaaaatttgtggcatgggggttaactgtaactcagctaaagctttttaaaggtttaagtttacaaatacttggtgatatagctagatatatagtaaaattacttagagaaaaaagaagagtataattcattctcatatatattctagggatcatcttttgagatgtcttgaaaaagccctataagggtgtgcttacattttggaagtgctatgtgttccttttagggattcacaatgtatataagcagttaatggtgtgctcagaaatcctataacatagaatattgtatgactttatacagtactagcattaacaaacttcttgatcttgggggcctctcatttgagccaagtctgttaatatcctgaggagcgcattcagggaaacattctattggcttgacttactcagatgacagcggtctcagctgagcatttgataggggccagtagaatcaattcagagttgttttctaacttttactaaatctatgttatagattttcttggaggaaaagtagaccttgtcagagagccttaattaaagtccagaacctagaaacatatgcatcaccagatcaacaactgaaatgggaatagcagacaaaggtgtctcataggtaaattgaggtgaaatgctgtgagataaacttattgacccaatgtttgtgtttgtatttaaaacataagtcccagaggctgtgttttctgtgtttacttgcctaaaagcactattgctaactaggaactaatgaaatgggatattttatttgaaggttgattttaaacttggatataaaacattttaaaatacatttaaaatacagttttaaaaatttggctttaaaaaatggatggccgggcgcagtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaacaaaaaaaaataaataaaataaaaaataaaataaaaaatggatattggaaactttcaagcatatggagtgtatattcattgacttagttgatacttcttaatgtaacagaatatattgtagcttttggcttaaacccaattcagcaaggttactagtgtgaattgtgttcatctaataaatagtcatctggaattttaaagtgacataaatctatacttagttttagtttatgatgttcttaatgtctcatcactccaattattcatgcttgccaaaattagcaaggactgaatcttgcttgaaggattgaacacacaacaaaacttcctgtctgtttattctaatatctgttaattttaccagggtaataagttttggggactgcaggtttgctgtagagcttccatatattttttcacctctctgcagttaattgtcaaaccagtctcagtattttgtatttcccaggtgtgtgtgccctttactcagagcagtccacaggtcattaggcaggggatagatggtatacctctgtgtgtgccttatattgcttaagaatttagtcagaaattattgatggaagatttatttctggagtattatttcagtcatggcatattatctaagttttcctgtttgcttaaaaatatgattaaagtatttatatttataatctgtgacttgattttttccccaggtgcgagcccctatggttaatccaacattaggtgttcatgaagctgaccttttaaagacatcaggaacgctgattagttttatttacccagcccaaaatccagagttgctaaataaactttcccaaagaaaaactacagttctggcaatggaccaggttccaagagtcacaattgctcagggatatgatgcgctaagctccatggccaacattgcggggtaggttcttttccatttcaattgaacaaaagcgcaatagtgctacagaaaccttcacactgtagctcttctgtcttacagtgattttatttgtaattattgttggagattacagccttttgagagtgcatttaaattatttttgactcattttattgttttacagtaattagataggaaatgaactctatttatattcctttttaatcttaatgagtagaagagtagtaatgtttccattcaccaaagcaaatagctgtcagattatttgtatgaggaacacactgtatttcataaatgtgtgtgtacatgtatatgtaaggttgaagttactgtttttataggtcaaaaatggtagaatagtgacaatttcatgtggttaaattaatatgcatatattagtggatttgctgtcttaattaggttttgcttaggtaaatttataaaatatttaaagaataggaaaaaggtctggactagaggaagtttcatctgatgtcaaaacccatattgataactgagggctatgtcttcgacctttaaggtcaagatggtaataagcttcatttgcccaatagcactaatacattctatgttgattgcctggagtactatgttgagaaggattctaaggcccattctgcttggaggaatgtggctatgattgagtaatcatgcctgccatgggtgagggacaggaatagctacatgaaagcagtgtactgctgactttgccttaaagggtgggaacaatctggaaatgggataaggcttatgaatcaacttctctaagaaactaattaaattagattttaatcatgaaaactattagtagttgagaatttgctaatattaatgaggcacaaagaaaataacctttttaaaaaaacagtgcataaaaagacactaacatgactaacatgaataaagccttctatagcctgacacctaagcagaaagttttcttaggttttatattttagcataggaaatatgtcatagattctactttgtgttttagctgcacacttttaaatttatttagcctgtaagggagttatattatgcaatgtgtgacttaaaattttatctagaaaatgtataatgtaaagttttaagggtgctgttgattctgaaatacacatatgtgaaagaatatcaaaaccagtcgctctagatcaagtggttttagctgttgaatcttttgagcaaatgaaatattatgagacaatataaataaatccagtaagagctgagtagctttgggtacactgagtatggcaggattgtgcagaaacattcctactctccatctcatccactatggccccagatttgtctgaagtttaaaccttcagggacccagggatcacaatttgaggaatcactcttctatgtcctgagctgatatatgcagagagcatagtgtgaaaggaatcatctagtatacatatccatacaatgtatgataaatcattatccgtctcattcatacacacagccatattacagtgaagatgtgctacttccacttcattactgttcattctgaacttttttgctgtcatgaagaaaatgtccaatttattacttttttcactatcaatgtttcctcgtacatttcctgtgtaatctccttttattatttatttttcagaatagcaactgaatcttttagagcattaattccacaattaatttcttacagtggcctttgaatctttgtcatatttgcccattaaaaattgctgtcatttgaattcaggagagcaacagatactgtaatctctaaagtattgttttttgctccagtgtgattaacttaataatggtgactttatatgtttttgcatcaattattgtatcaagtattattatgtaaaaatatgatcagggagaagattttcttgtcacctagcaggggagttttaatagttgctttataatattgagccagtgtatatattaccaagtaagaatgcaaaagtgccttttacatataaattgctatgaaaatgaaattagtgtagcatgttaaaaatatcctgttaaagaaaagatgatgcatattatttgatttattaaatagtttgtttctttggctaaaacacttaatattcactgagcattttctatgtgacaggctttatgcgaagtgtttcacctgcgttatctcatttagtcctcacgaccctaaaagatagatgctttttgtccttactttatagatgaggaaaccaaggtttagaaaattttaaaaatttgcccaaggtcacaaaggtaatcagtcagagaactaggacatgaactaaggtcagtatatcggaaaatcccatactttgaaccattagagatcaagggaagtgtttcttctgttctccgaggttgaaatcttattttgtacaagcctatggctgacctaattttttttattttaaggattttccccccattacctaagcactacccagtcatcaaacaatatttggactatatagtaaagtaagtgtgaaggatgtatagtcctagtacccaaagaaaaccattgttagtattttcctatctttctttcattacattttctattatgttctacagtacttgttatgaagagggtgggtgcataatggataagagagtgcctctgtaggcagactgcctgtgttagacttctggctctaccatttactagctgagtgaccttaggcaagtctctcagtctgtatctcagttttctcacctatgggatgaagacagtaattgtacctttccataggcttgttgtgcaaattaaaggagcaagtgtatatacaacacttagaactgtttttgacacatagtacatactacataaatattagctattattctttgacaaaacttcattgatgacttatgatgatatgtgagtctgagatctctccttttatggaattatttatttatttatttatttatttttaaagttataaggctgttgtcctagcagcaaatcattttggacgtttttttactggtcagatcacagctgctggaaaagttcctccagctaaggtaggtacaacttttaatgtttctttataatatgcattgattaaaggaaagggtatgtatagtcttaaaatacagttatttaaaaatttttatatgttaacctcactgatgactttttggtgtgtataaatatttcacgaaacctcaaagcttaacgtttaagattgctagaaaaaaatgaactttgactttctgaaagttctagtcttttctgttttttgactttactaatttgaatttttaaaagaattttggataacttgttctctgtagcctatatattattaatttttaaaaaaaactttcaagataccattcagcagattctgggtttctcaatttttgcaacattttggcacatatacaaggtatttttggtttcttcacttcttgtcaatttttggatcaagaagacaggaaatgggaggtggtgtaatcagagtatttggcagagagaaatggtgccagtttctttaatccacactgaaagcagagaggagcagttaacgatgagaggtgacgatggcttgctgaaagaataggaggtcatattgtgatccttcaatcctatgtacactcagtaacaatggaaaccctgaggctaggtgtcttagtccattttgtgttactaaaagagaatacctgagactgggtaatttattttaaaaaagaggtttatttggctcataattctggtagctggaattcaagatttggcagctgcatctggtgagggcctaaaggctgcttcaactcatggtggacagtgtaaagggagcaggcgtgtgcaaaaaagatcacatggtgagagaggaatcaagagagagaaactgagggagccaggctcttctattaacccccagagtgagaactcagccccccactcccagggagggcattaatctgttcatgggagatccactcccatgacccaaacacctcccactaggccccacctcccaatattgccacatttgggatcaaatgtcaacatgagttttcgtgggaacaaagcacatccaaaccacagcactaggtacaggaaacctgactttaaatgtgatcatttacctacctgtaggttacaggttaactggtgcttcctgctctttttttttgagacggagtctcactctgtcacccagactggagtgcagtggcatgatctcggctcactgcaagctccacctcccgggttcatgccattctcctgcctcagcctcctgagtagctgggactatgggcgccggccaccatgcccggttaatttttttgtatttttagtagagacggggtttcaccatgttggcgaggatggtctcgaactcttgaccttgtgatccgcccgccttggcctcccgaagtgctgggattacaggcttgagccaccatgcccggctgcttcctgctcttaagtactttgttatataaagcccagagttctcacacaaaataaatctcctggaaaaaaattaaaacaaaagcaaatagtagctttgagaaattatattgttttgaaaaacaggccaggtgaaaaaaatggcaggctgtttaagtgtaggccagaatacttagcaagaaagtgtgagcaaacaacacagacgtgagatgtaaaatgattaaattttgacttctttctcaggatcatacaaaaatgtctggcatgcatagtggccagaagttcgatgctgttcttaaattgactgaatgctttgatgcacaagtctactactaattttggttataatctttctagatatatgtggaagttgagagaaaagctgtgaataaaagatattaaaaagtgaaacaaaagaggcttaaagaaaagagaatcagcctttaaaaggtggaaaagtgactatctttattgaaaatttaaattgcagcttaagggactttggttacatgacagaaatagttttctgaaattgaaggcactggtatagctcattaaggtggattgcataatactgtcttttatttggatttcctttaaacatggagggttcttacctgtctagaacaagtttgttcaagccgcagcctgtgggccacaagtggcccaggacggttttgaatgcggcccaacacaaatttgttaactttcttaaaacattatgtgatttttgttgccattttatttttttggctcatcagcaattgttggtgttagctagtgtattttatatgtggaccaagacaattcttgttccagtgttgctcagggaagccaaaagattggcccctggcctagattgaatgaaaatcaatcagttgaaggcttatgatatgcgaggcattgttctaggagctggggatatggcatgaacaagacaaaattcctgctgcataaaacttacactccagtgggggtcatagtgaggagacaaaagatcaaataaatacctgagataattttattattattattatttttgacttggttttttttttggaggcagggtctcactctgcctggagttttcactccaggctgatctggaactcctgagctcaaacaatcttcctgtcttggcctcccaaaattttgggattacaggcatgagccactgcacctggccatgagataatttcacacaggaaaaaaaatgaaccggatgatgtgacagtaatgggcacaggccactttagtagagtgatggggaagcttcctctgacctttgaggtgagatttgaagcatggaagaaggaaacaggagtttaaggattccaagcatttaggattccagtatttaggttctggaaaaataaagaataccattggtcttggagtgtggtgaacaagatgaagagtgatctgagatcatgttggaaaggaaggtctaggctggatcatgtgggtcctctcttctaggtcatgttatagactttggattctcctgcaggtgagggaaatgtttggtttaggatttaaaaaaatcatgtggctgttctgtgggggaatggatagtagggtgaaggcaagatctgtcagcaattggttgcacctgggacgatggcggcaccagaaatgtagagaaaggtgaaggattttatctggattagggatgatctttgggagttaaaaccagtactacttgttgatgaactggaaatggaaatatgtgcaaagggaggagttgatgaattccccattttggcttaaacaattgtgcatagttactgcctttactcagatggggaaggccagaggaggggaaggttatatgagtgaacacgagcattgttcctaaagttatttcctttctcctgccctttcccatactatttctttttttaaaaaagtttttatttcttattttttaatagagacaggatctcactatgttgcttaggctggtcttgagctccaaagctcaagcgatcctcctgtcttggcctcccaaagcgctgggatcacaggcctgagccacctgcctggccccgtactatttcttgagcatatgcctacggtgtaacagttagcagtaagtgcttcggttagattccattgtttaatataacaacagtctgagaaggcactttgattgctgtattgcagatgataagcagcttgccgaagatcacccagaactagttagtaacagagtcaggattttgacctaagctctctgactcttactcactgtgtctttttctttactccatgctttagagagaaaaagtaaatttcgatagtaagatctgctgcttttgtgcgattctgcttttttaaattatggtttttttttttttttgttatgtcttgattcaggataacttggccaagtcctgtgacttttacttatttttatttactttttctttctttctttttttctttctttaagtggtgatggagcttctgtgtggaagagtttggtgctttgaagcctagagcctgcttattccctctggtcactctttgccccatttcctatagacttacccctgtccccaaacacagcaccaaacaccccattatcaagatcaattcacatgacctctgagacactgcccagagctcactggagcacagtctgactagcctagtctttgtaaaggcagaaggacatgtgggcatgatgggtgggtggcaatttgtaagcttcactgattctgtgggtggcattttttttctacaggaacaaagtgttgctttcaattgactgtttatgggatatataacaggactttactctggaaggcccgttccagactggagacaatgttcttactttgtttcttagaaggcgggggtagggggagacttgtttctgaggaattttttggttctcttgttgctgatccttccatgattagggacattagttacattgcttcagacttacggagagttgctcaaaatggttcagaattgtggttgctcatcagctgttcctttcagaagcattttggctgaaaatagaggttggggtagatgtttcaccaatgttgtacccatctttgaaatgtgttttgatgtttgatgaacaaagaaaaaccttataatttgatagggtaaaggtagttagaatgccacactgggacttttagtagaaggaacttttagacagtggaaaagaatctgttaatcttcaacatacgtaatgctgatcatgcttaggtagttttacacggatattctgattattaggctatttttagtgaattgttgttggcctttgctagcagttgtttctttgataaaatttcaagatcagtggtggttcagttaaagaatagtctatgtactccatacagttactaagggctgatcatcattatcaccatctgcaccgccatttattgatgctaaacttatactaggcaccaataattgttagctgatgatttttcattattagttgataatgagccttaacacataactgggtctgtcttctagattctgatagttggtggtggtgttgctgggcttgcttctgcaggcgcagcaaagtcgatgggtgcaattgttcgaggatttgacacaaggtgagtgctttactagtgactgatgttaaggtaaaaacattttgtttcaggggcatattatgattgccttaaaacttgtaaattgaagtagcacattgcaactggtctataagctctttccatttaaaaatgtttccactttttaaaagttaatgcaaagtgaaaatgtattacttaaactaacaactcacagctctgttttcttgggtggattgacagtgggaccagaattctttctatcctgagtttctaacatgttgctttacctatttctgttcagaatgcttttaggcactagttagggcataaacaaagatgtttgtgaatctgaagaaagagtaaaatagcaggctgagttgggggcatgccctaccgtgaatgaatagaagcaaataaagctgactggcacttcacctgactagcaacgcatgaattatttatgctgcattatttatgctttctgtgttttatgttaagatagagctgcatatatttttctgataatttttgagcccctgggtgaaagtacttggttatgtatactgtgtatttctttaatgcagacatatacacattttcctagattgtctttaaagagaagtttgattaaaattcttcttcatttcagaagacactagacactggattttattaaatgtcagtcgagtacagttaatatgtgttttaataatttttgaggttgaaaaatgtagtcatttattatcagctgagggtactggaggaataatactactgttaatcttgaacatagaatgatcaaaaaagaaaaaagcaaccattcaaagttggaagaatgtgacttttcagagtaaagaatgttccatagaatatggttaatagtctttatctagagttaaagtgatatactgataaaaagctgtcctgctgaaatgagaaaataaggcatttccaaagtaaccaggacacaaaccaaggatagctagagttaagcatgccattgatcctgtcattttatttttactgtttgttgatgtgaagttttctcaagacctccaagcccatagaaagccggtcgtttaagttttcattgtagtggacagtagtattaaaatggaaatgtatgtatttgacttaaaggtgatttgaaacttggtggtgggtgaactactgagaatttagtatattgatgtcattttttagattgtgtacagaatcaacagctagaatatggctgttgcttatattagaaaaatacaaaaactcaatttttctttataatttattaagtttgttatacgggtatctcaagtgtacaatgaagaaagatgtggctgaagtgatttaatacttttctaagaattatagctcattagttactctagtcactattttgagatgggtttggtttcatattataaatatgaaatccaaatgtattggaaaacatacttgattttaaattcttgttggaagattgagtggtatgtattttcagttaaatatcctaaaaacttacagacagctcattgcccaatggtatttaaatggtctgatttttgaattctttcaaacaataactaggagatacccctcttagcaatagtgattatcttgcctaatgcttgtatcacaaagtttaaatatataaaatccttgctttctttcctatcataaaatagtacatgattattcttccaattcggaaaaatgtgaaaaagcacaagaacagaaaataaaataccttaaagtctcactgcctagagattttttttatgtgtttcctcatctacacattaattaaaaatgtaattttactgttccatttatcttttttcaattaacagtagatcatgaagatctttccttacctataaatatttttagtggctgcagaagattccattgtatagagaagtacagcaatttatttaactaggcctcattttttgctatatttaaacaatactctgtaggtcaatatacatatacatgtacatacagtaagccctctatccatgttctattatctgtgggttcaaccagatcaaaaatattcagaaaaaatgattgtgtttgtactgagctagtaccaatttcatttttcttgtcattattctctaaacaatatggtataacaactatttacataacatttacatttattaggcattataaataatctagagatgatttaaactatttgggaagatgtatgtaggctacgtgcaaatactacactgtcttttataaggggcttgatcatccgtggattttgatatctcagggggatcatggaaccaattccccatggatactgagggatgactttatatctgagaacatacatttatggagatatctcattatttccttagataaattctaaggaaatattggaatcaaaagatatacacattttaaatgctaatatgttataatgtttttaaattatgagattattttatgggcaaagatataactacaaagatttagaaatagcttatatttctaatgatgcatattcattattgaaaaatagagagaaacataaggatgaaagtgaaaataccttttattattctatcagccagatataattgctagtgatattttggtgtaatttcttatagaaattatatatatataactttagaacaaaatttggattattttatatacatatatgtatgtgtatatatatgtatatgtgtatatataatatatatgtctgtgtatacacacatatacacacatatatgtatgtgtgtatatatataacatataaatacaaatataacattttgaattcatctaattcttattaatattggtagacaattctgaagctttttaaagaactatatccctatggctgccacaaatggaacaccaactcagattggcttaaaccattagaaaatgtattatttcttctaactgagaatccaggggaatgacttccttttcacattagagtgagatgctcctccgtgctatcaaggaccagtttctgtcactcctctctgctgtccttggctttgtcttcctcctaaggctgattccacttgtggttgcaactttacctccagggggcaatctgggctaccagattccttgctcaagccagcagagggagaacctcttgctcaaccatggactgtatgtcctaccctttatgcatactcttgaacatgatggttgctagggatttattggctcagatcacggtttcccaaacttccctgatgacaaggatgaactgcagctcttgctaaaaataatatagtgtctggcctgcttgctggagattataattcactgggtctgggaaggggcctgggaatttgaatttttaacaagtaccctgagtgattattgtcattaggggggtttgagatttaccatagtggaatggatattgatgagttacatgcacgtccaccacagaactgaggtgtttgttggctgtggttttccaaccaggagacagtacttgggtagcatttatttatttatttaaaactgaatttatttttatataatttaaatgtgttggcttttcatattttaccctttactactatttataggttactttttgcaaacacaatttaataaggactggttggggggtaaaaatcactttattagaataattttacatataaagagttatttttgtgggaaaggtctctagtaagaacaaattcagaatatttacaagtgaaaaacctcatcctgagtgatttgaatgatatcaaatcctgatgtatatgaggtatcacatcatcatccacatcggggtcataaggaacataattgattactggagttggcaattgtgaaatcgcttttgcaacttaactaagtagaagttggaattctcagtagttttttttctttcagaaaagaatattctcataaatatgttacttgcctttagaaaaaaattggaacaattaagtacgaaatcaaagggactgttgacttttgaatatatagtttgttgttcttaaaaaggtatatgtaaatgatgatcttgacttctttattagggcctgaaataactactctttccactttaacaatcaccctagagctgcagctttggaacagttcaagtctcttggtgctgagcccttggaggtggacttgaaggaatctggtgagggacaaggaggatatgcaaaagagatgtccaaagagttcattgaagctgaaatgaaactctttgctcaacaatgcaaggaggtagacatccttatcagcacagcacttattccaggtatgccattaagtaaacggttattttaaaagcacttttactctttttttttaaaaaaaagcgagagtgaatgattgcttaacatttgaatttctttaaggaaggatctagtactttctattataaaagtactagaaaacgagaaaatatatgacaaaattcatagtcattaataatttccttcaagtattttttctgtgaaaaaattttttttttgagatgaagtcttgctcttgttgcccaggctggagtgcggtggcatggtctcagctcactgcaacctccgtctcctgggttcaggcgattcttctgcctcagcctcccaagtaactgggattacaggtgtccaccaccacgtctggttaatctttatgtttttagtagagtcggggttttgccatgttggccaggctggtctcaaactcctgacctcaggtgatccgcccgccttggtctcccaaagtgctgggattacaggcgtgagttaccacgcctagcccttttgtgaatttttatataaattcatagattatactgtgtgtacaatgtttttttttttttccgaagaataaaacgccatttatttagaaaagattattattactattattttctctgcaacttaaacaacttcaatagcttttggggagcaggtggtgtttggttgcatagaaaagttctttagtggtgatttctgagattttggtgcacctgtcacctgagcagtatacactgtacacaatgtttagtcttttatccctcaccccccctcccactcttaacccctgagtccccaaagcccattatatcatagcttagcttccacttttaacaatgtttagtttttaattcctgagttacttcacttagaataatggtctctaactccatccaagtttctgtgaatgccattattttgttcctttttgtggctgagtggtattccatggtgtgtgtatatatgtatatgtatgtttatctactcgttggttgatgcgcatttaggctggtttcatatttttgcaactgtgaattgtgctgctataaacatgtgtatgcaatgtcttttctatataatgacttcttttcctctgggtagataccaagtagtgagactgctgaatcaaatggtagttctactttagttctttaaggaatctccatgctgctttccatagtggttgtactagtttacattcccactagcagtgtaaaagtgttcccttttcactacatccatgccaacatcagttattttttgatttttaaattatggccattcttgcaggagtaaggtggtatctcattgtagttttgatttgcatttccatgatcattagtgatgttgagcattttttcatatgttcgttggccatttgtatatcttcttttgataattgtctattcatgtcctttgtccactttttgatgggattatttatttttttcttgctgatttgtttgagttccttgtagattctggatattagtcatttgtcagatgcatagtttgtgaaaattttctcccatcctgggttgtctgtttactctgattatttcttttactgtgcaaaagctttttagtttaactaagtgccatctatttgtcttggtttttgttacatttgctttctggttcttggtcatgaactctttgcccaagccagtgtctagaagagtttttctgatgttatgttctagaatttttatcgtttcaggtcttagatttaagtgtttgatccatttttgagttaatttttgtataaggtgaggggtgaggatccagcttcattcttctgcatgtggcttgccaattatcccagcaccattgcttgatgtatgtacaatattatattcataagcaggttcctctgctcaaacccttgataaattgattgttaatttatttacattttctttgttaagatactaccttctccttgtaggaaattcaaactgtggtgataaataagaaaaaaaatacagatcatttgaagttctaccagagagatgactgttattaatattttgatcatatttttctatatatgtgagagagaggggactttgtatgtatatgtatttatggaattttcagtgtatatttttacttatgggaatgaccctttgtcagttttaaattatttcctttgacatgttttcagccaaattgtgagctttttgatggtaggaattactttctagtccctttacaaatctccttctaaagagtattttgtactcagtgcatgactgatgtcaaaccaataagtgtttattaatcagtaagcagtagcttgatctaacaagatttgggagtgaagaaactgtccaccttttatagtctcacctcttctcttcacctatcctttccttttgttattgaataatgaataccatactgactctaattttttcctttctgaaagaaagtgggtcatataatgagagcttaaagggttcttggttgcttatgttagatcctagtgaaggagcctcactttctctgaggtgctgtggagaattagaatttgctttgtcatgaggctatgaaagaggagaaactctcctccagtagcttcccccacaacaaaaaacctggctaatataaacccaaggacaaagaattgattggcatcagatctgtgagcttgttggggaaaacaagccttccaaatgtgtttttctttctgtcctctgttaacccaggtgataggtgagctcgtctctccagataaccgcatccccccagagcggctagatgaagcagacaggtaggagtctgatatgggggtttcggcagggctcaggcaatgggagcatctgtaagtgtaggaatgaggcctgtggttggtttctggaggtgcatgcagatcagacaaaccccggacccaggatagtgtttgtgaaatctgtcagtgaagacataactcaggcacaagcagtgtcaggagagcacttcaggattcatcctttccttgtgtggcagtggctcctggctcagctgtttcacaggtggttctgaggaaggaatggggtgacatatgctgcagccaccatctgacctctgagaggcagctgcgcattagcggggaagttatgagaggattagatgtaacaagtggccagtagagggtgctaaaacatttactcatggagtaagccatgtggataggaagctagttttatttagtcaactcatactctaaagagctagggataatttgaatagagtatatagatttattattgattacagagctagatgtcagtgatagtactcaagatttattttataaacacatactgactttcagggccttcccctctccccataatattttattttttataagtagtttatagttagcatactttagtaaaaggtcagactgtatgacagtcttgaagactagttgaagaagttttattaatctgttccactaagcctttcttgttttctgaagccacgatctgaagattaatgtgaacattaaatttacagaaagtccttgatcagtacctcagcccagagctcaccctcaaaaggctggctgaaaaaggccttcagtttcttttgggaaaaaaaaaaaaaaaaaaagggaagaaagaaaaaagtgaattagaatattatatggaagaaggtgatttttctaaagatctttcctatctctggggcactgaaaacggaaagcatgagcatttaacaaaaatgactgaaagagtacatgaaggtacaaatgccctttggaaaacaatatccttggcattatacctttactggtttatgtcctgagcctttgcctgggtcccctgatgatgtatctgactcttgaatgaccctcagagcagaaattgttctgaagttttccttgagtggattcaaaggggattaagtcaaatgtcagaaattctctaagctaagatttatagactgagatccctggaaggctggactgaaggcctggtgtggataagaatgttgagaggcagacacaggtaagtaactagtttcagggagcaactttacggagttagtaaatttttattgtcctaggtatacgtcacttggtggtcttgaaaaaacaatgaacttgtacttacgtagattgtatgtggaatgagatagttctgtagctagctagttgttatgctgcctgatatcttaaaccgtcatctcacccccctattgggttgagtgatgggttaaaggtgagaatttcacttaatgcaggtaacttgaggatggggccaagctgacagccccgctttgtggtgctgtgcacacaaagaaaagctctctactttcctgtccagctcgttgacctttggggctaccattaaaaagtaaggcagccctgctgtctggtaatgttcaggctgtgctcataatcttttctgctaagccttttgagacacaggattttttagcatccctagtgatctgaaacccttttagagaaacttttcatagacatagaatagttaatcaggaagggactgaatcaggttgaaaatctgataagtacgttggggaggggagtatggtgtggggtgagaaggaatcatggtgattttgcactgactgtgtcttgggcaaatttcacctaagttccaatgagaatgaagagaactatggagcacatgctaagtcctataccttcccagctctcccgtttcccacctcaggtctagtccttactaatttaggggaaccatagctattctaaggcctgggtttttgtttagcaatgatgacagtagcttgggcgacttgggttcccagcatcattagatgaaacaagccatctaaactgaacagagttggatcatagtctcccactccccaattacctgtggtataaagtttgcattccttggaggtatttcttggctttcattatctggtcctgatttagcttttgggtctggtgttaaactaatatcttattctctgggcctgatttcagccatgttgactgctattatctcctcaaatgggccaagatacttttttgcctttgcacatattgctccttctctttggaatactatccttgcccttccctgctttttgaaatcctactcaactcaattactacatcctccatagtttctattgcctcctgctcagcagtagtgttcttttttcttttttctgcactcaaagaactttgcttgttcttcctattacagcagtgcttagtcccatcattcctcagttatcttgtctcccagtgagtgcagcaggagtctttgatttatgccagcgcttggcatagtggtttgtacacaatggtggcttagcaaatgttgctgaactaataattctggataccttccttaggtcttggttggtacagttcctttcatttttttcagtgctgtccccaaattcttatagaacactctgttggttcacttttggataggaacattgcagaggctaatttaagcttgggaacttaactttcttaaattattcaaaactggaacacatgcccagtctgcagtttgaggtggctggctagctagacctctcaggagatagaattaggaagtagtggaagggctgtttgggaattagaaagtgtcctgtcagagaggaaggaacatattcattgcttgattgtaaattaaaataccttatgccatatgtacttgtgtctctttttaggcacaatccagattagggtggccatactttttgtttttatctatacttgttaggatctgtaaaatacacccctcaaaggatgtggacttctgtggtaattttccatgtctctggagaattgggtgggaggtgttttcctccaatatgcaagttccttacatatatgaacctgagatgttgctttgttctccatctgtcttgttaaatttatctttcatatggagtggaaatatagcgcaaaagaatgactttccatagtaattgttgaaacctgtgctttcgggcaagagagtgattgatacaagaataactatactctctagttgtgtaattccacaaagaaatattgtttttgatgactaaagtttttcccaaaagtaaggatttattattcattttcttattctgtatgcattatgatcataaaggacaaaactatatgctatagatcagttattcccaattcttttatattactttttttgttatctgattcatgttcggtaattccttcccttcaatgtattttatgattatatagacttttgtaatattgttatataaagtttcatttgttttgaggatattgaagacattttgaagaacagagagaaacttaagtgttgcaacatcaagggttggtaaccacaggctgtctacacacctcttcgtagctttcaatgcagatagagcaacttgtcctcaagtggaagatgccaaaactgtgaagttttccattgctatttatcagtcttgttcttagggtgtatttgagcacactttgtgagtgactgggccagatttaacaaatgttctgttaggaaaatttatggcatcgttatactttggtttggtttgttatttctccaaaagcatgttgcaatattggtatgcattatgcttccttcctggctttccctgggttgtaaaggattgggagactgaggctgtctttggcaaagcagcacaaatagcgttactgctaatgtactagtacttccctaccatatgcattgctgtatctccttccttccattttccttatagtttcttgtgcttcagtattagttagggtggtctagccctaaatctatgagttttgctataacagattaatccaacaatgcataatggctctgatgttacagaaattaacatcttgcttagtaatagataggttcacatattgatgggcagctctttttcatatggtcatttgggattcgggttaggacagtgttgccatcatcattatgaggctatgaaggttgctctgggactgtctctatttaagccagctatagggaaagtgggatggaggagtgtgcatggaaggccaggaagtggtacacatcattcttgctttgcattcttttgctaagacttagtcatgtggccaaacttaactgtgaaggaagctgggaattgtctagctctgtgcccaggaataagagaacattgtattagtgtgctagggctgccataacaaaataccacagacctagtggcttaaccaacagaaatttattttcccagagttctggaggatagatgtataaggtcaatgtgtctgtggggttagtttcctctgagcctctctccttggcttgtggttggctgccctcttgctgtgtcctcacatggtctttcctctgtgtgtgtgcattccttgtttctctttttatgcttcaatttcctctccttttaaggacaccagtcagattgtcctagggcccaccctaatagactcattttaacgtaatcacctctttaaaggccctgtctctaaatacagccatattctgaggtattgggggttagggcgtcaacataggaattttgcagtggccacaattcagcccataacaaatgtagatttttgtgcacagctaacagcctctttcctcttctctactttgtaattttatgtgttaatgtttaatctgttcattggaaaacagaggaagggtcatagatttagagccagatagagtagattaaaattctggttccactacttaacagctgatttgtctctctgaatatcagattccttatctctgaaatgtggataaaaatttctaccttgcaaagttgttttgaggaatgaagaaaaagcccagtgtagggctgggcatagagaacattattgtaattctttcttccattggcgatgcctcgtcttctggatggtacccaggacacaaatcttactgacttttgcaataaaagtccagacattctcaaggattatgtggaccattgaagatggtgcctcatgaatccacccatgaagttacataaccagtatttattggatggcaatgtggcatgggtttccctggggagaaacatgacttaattgtttttgatatgaatttgctgaagatatccattttattaaggctgttttcccagttaacctcattctgacctaagttgaaagacgtgagaaagaaaataagcagtactgtttctattttttaaaacacttttaaattcttttgtagtaacaaaataataacatcagaatgcgtaatacaattttattgcttcaatttttaaaggattttggtagctaatgtacatctatacatatgttggagagaattcaaagaatgctatagtttctatgagaatgtatatttccttatttgtgctaccatttaagtttggagaattcctgtaacctgtgaaaccatggtaaaatcttgactaattttgctttttatttatacagaattttgcagctatgagaggtaaattattaagttaatcctttcaaaatttttataaacatgttctttaattatgaggtaaaagcttgtgtttaggtttcttctttaaatagatctttaggaatttttctaattttctaaaatatgctgttgactaatcatatttcagaagtattacatttagaaatatctcaaggggtccagtttgtaaaagccaactatttgccagcctgactttctgtctggttccttatacaaataattatgcagacaaagttttcctgtggttccagggataaagctcacatataaagtactctgcttgactgtttaagcttgggccagaatctctttaggctcatgaacacagctttcatatctgtgataaacagagtagaggggttgctgtatgtactatggagccagctaaatcagagactcattagataatggatcagtggattagatgttcagcactttcttgccatattctatattttacataatctatcatttcttattctcacatgcatacatatatgtataaaaacccttttgttatcattggtaacattttaaaagcttaagactcagtactttaaccccatcagtgattttgaaatgctaaaagagattttggtatggatccattaggatgcctttagctgccagaaacagaaattctaatacaacctgccttaaggtaggtgatttcttgggttctgttaacagaacgtagtccagttatagctgtggataggtgtgggctgggacactctgactgtgctccttcatgctttcctctctgagttggcttcatcctcagtgctgtgcagaaggcagcaacaatttcaggctccagtgtgtacaacacaatatctagaggaggtagtccagtgctgatggcaccctcttgaagagcaaaaagaaggaaacttctttttcagaaatccttagcacattttccctcatttatattaaccttgattgatttatgaccatttctgaaccaatccttgtaggtagggcaatgagatgcacctcggcttacacctggatttctgaaccagtcactaataaggtgataagattacccttaggccttccaggcctgcctctggagtggtgatatgatttggttgtgcccccacccaaatctcatcttgaattgttgttcccataatccccacgtatcacgggaaggaccaggtggagagaattgaaccaagggggcagtttcccccatcctgttctcgtgatagcgagctagttctcatgagatctgatggttttataaggagcttcccccttcactgggcactcatttctttctgcttctgccatgtgaagaacatgtttgcttccctttctgccatgattgtaagtttcctcaagtctccccagccttgcagaactgtgagtcaattaaacccctttcatttataaatcacccagtctcggccagcaatttatagcagcgtgagatcagactaatacaagtggtttctgaagtcatgtctcctgaagcttgtggactgggtggaaaaatgaaaatcagcatagtgataaaaggaggaaatggatactgagtagatactaacaatactcagtgcaacattatgttgttataatgaaggttcttactgtgtaaatgataaagttcagcctatctttctttacctgctctattttacatttagtcaatatagagactacattacattaaaaactgtccttgtctgcctagtacttgttcatgagaaatctattttggtttggattaatagattctataattcatattatttatttgctactgtggagctaaatatctcatgtttttgttaaagcagaaagttttgtttttttttttttttagaccctctaatttgatgccttacaggtcaggaagttaggaatttccccatctgattacatgctgttgagtaattccagtaaatgatgctgaatgctccttggaatcattataaaattttgtggtaaacccatttcatcttcatgtcttgttattttaaatatttttagtggtttcttcttaattaattaattaattttttctttttggtatgattagagtgtgagggcttggttcttttcccattaagatagaatctgggaatttattgatttcagatgatcatgttaggcctgattcattcaaaaagatacaatatattacagaattttctggtaaatctttagtctttggtatttaatttaagctgtgtgactctttttgaatttagtgctgtaaagaagccaatgatatattcttttgctacatagcaatgagttgttaaagccatttttagaaattagtaattttttctccagtcacagatgagaaaaaacaaaaaagcagaacttagtttttctagcagctccttattttaatactttcaaaattgcatcttagtattcatttattgagaaaatacatggttgagaaaagatactgtgaattcagtaacatttaaaaatgaatttacgtgaatcacagccatatgtgcatatatcaataaatagaacacatgcatgaggcagtttttcagtctacagtcaattcatggtgcacatggagattcaaggatgccttacactaacctgtggtacacttattcactccaaataactgccaaccaattgggaaactataattcaaatttttacatgagtgctttaaatatccaactcttctagtaataaaattgttgaccaacctttgaatgcagccacttttagttgtaaaatattagactctagagcctaagtaaaatttttcttcctccatccaccctgcatatgggaggcactaaataagtattaattatgtcaatgaatgaatgaatatttgaatgatgactgtgagagcttgatgtcctacagttttcttggcaaaagtgtggaaataagtccctctgagagggaactgagtaacccttccaggggaacttaatgtccatgaaccagaagggagcaagaaatatttcataaagttggatatcatgccaaatccttcacccacagttggtattgtgtcagaaaatatttcttaaaattttctctccttgttaattttattctgtcacagtgactgattttttttttaagcgggctggtttaggaaatataatgatctttttgtgtatctcatcttttgcagataaatgataaaattaatagaaaagttaaagcccaattgggctttaaaaatgcctctcatctgccttcttttattaattttcctgtttcttttgcaattatgtctaaaaatacctgatgtgctcattattattttcttttttatcagcctttgtcagaaagatgtgcttattttctcttttatatctaggtctttcaccaagctgtctctggggtgtagagggcatctctttatatttgaagaatttgtaaacattggatatattcatttccatgttatacatgtacaaaatccggacacatcttcctgtttgtattccatgtttagttatgcccatgtctccctttattgtgttttggtacactccttgaaagactgccctaaccgcatagcttcatttgttgtagaagggagggcaggtgactttgagccaggcttttcaattggtaagtaagtaggttggggtttttctaaattcttctagttctcctagtaccaacttttaaactgccacttcttgacttaaaggagaaactggttgtgattatccaggagtactttattttatctttaaaataaaaatgatatgtggtttttttggagatgctgtaaagtacaaagtagaaaataaagatcacctgtgatctctccacatcatactaagagtgaactttttttttatttgtttttactgtttttattgaattttccatttgtatttgtttttcacttatctataggattatagtgttttgtttttattgaaatttctgtgagcttttcatcaatttttgtctgagaattgtaatatatacatttttcatatatatcatatatacacatatataatatatacattttcatatacatcatatatatctatattttcatatctattgatgttttcttttgtaattttcttcattgctttaaatttaggaagtgcttttttatccacagactggagagatattccccaaggcttccttttttgtcttttctttcattttatggattgattctcttcttttacaattaattcttatctttctagagtttaacttatggtattaggtttgggtagatattttttacccagatacctaactaatcatcatattacttttgttcttcattgtgtaatgctgcatttattatgcattatactttattatattaggctaccagggtaaggtagtattctgaaattgtcttctcagtctttctctctctggacttattcttttggggttttgcttatctggagcttttatttactattctgcttcttttttggctttatttttttcccttctgttttcaatttttatttctgcactttccagaattttcaaaaaattaatccacatgtgagtgcttgaaggcagctgcactgttacattcatgactgtattccctgtagcccttattaaaaacgtttaattttaaaattaaaacattttggagataaggaaaagcacagagaagaaaatagtctcaccactcaaatataccctgattttgttaaattttatatgatatagaatttactacaaactgtatcatatatgtattgtattatgtaatattaatctatgtatatataaatgagaaacattcatgtatataaatatatatctaaactgacatactattttgttatgtgctttttacttataataattccatgtctttaaattttcttgtgtgacttaagtaaaattttaaacttgttatagtgatacccttcagtctgtacaccaaataagttaacctatgtgaaagaatatgctattgttttaaaagtgattgaatttctgagcaataatagggacaaaacacccaacttatctctgttaagatgcaaacatgtccatgtgtttttcaaagttgtgttagccactgtacagttgttctgtggaggttgaatgagtgaaatcagaggagataaatgggttgtatattttgatgtttctagggagcctaaaaatggttttggacacttgatgtcttgcaaagtggtagcatacagtccagggactgatccttagctatggatgtctcaggagaaagaaggagtctcacatatctagggcaggagaaattagttagatgccaaatcaaatatgtgcaatcattggccaaagttgggtacaaataaggtgggaggaaaagctgtgctaaacaacagctgataaatagagaagaggctctggccctagagggtggggatggtgatgacagtaaatacctggaaagtacaggtagccctttaaatgcgcccctctatgttgaggcggccatatgatccatagctttaagtcactggagagccgagcagcatgacctttattttgggaatagtcctcagatggatgtggtttgcttcctcaaattctcatggttgagtaaagtttagttaagtattcaaggtgcctttgttagattacagtacggagggtagaggaaaggaatacttttggagaattttgagaagtggtgaaactaccagcacttcagggtattgtctctgggcaaaatgtctcttgattcttgctctttcttggaaactcaaaagaaagaacaagagatcttataacaaatcatgtggcagcgagcccagtgtggctgaaatagaagaaggtccaatggtgcagttttgagagggcatgttagaaaaagcacttcacccagggtgagaggcatttagtcccaggagccttaggatttggactttatctcaaaactatacagtttgtagcaaaaagaaggaagtactacataaacacttcacttgtatcttcacaaccttttatttccacatgtactacaaatgttatttttcctttttgaatcaaattctgtaaacacagaattgaaagctttcagaagaactaaagataatcaggctactaatgctctgctttctttttataaaaaatatgtatattttaaagagatggagtttcactctgttgtcccggctggagtgcagtggtgcaaaaatagctcactgcatcctcgagttcctgggctcaagtgatcctcctttctcagactcctgggtggttaggactataggcatgtgccaccacgtccagctaagtttttttatttttgtagagatggggtcttgctatgtgctggtttggaactcctgggctcaagtgatcctccccacctcagcctcccaaattgttgggcttacaggcttgagccactgcacccagccatgctctacttccatactactaacattacaagtttatttccgttatcttttgatttaggtatttccattgttttatgaaatgtgaacacgatagtatgctgacagtataagcccctgttgaacatattgatgtatattagctcgaaaagtcctaaggtctgggttttcatcttctatgtaagaattagtgaacttcttaaaaagacattgtgaatttaaaatgtgaactattaaatgaggagaatgcacaccatgagaacaaggactttttttgtttatttaccactgtattcccagcaccaggcatagatagggcttgactcactgtagacaccaatacatagttgttgagtgggaataaaagtgtatgagggaactcctaaaccttttggagttgtaggattccactgttttgatttattggcattttcctgtctctcctcaaagttttctgtgttaaattaaggtaggttaatatgatgtgttagaaaatctggtgacatatgttaagataattggcaatgttctgttttgtaattcataaattagtattaactgtactcttgacattggtgacctttacgaattgttcaatttgggtgcatatagtttccatagtggtttattattaggcattttttaaaaaacagtcaaactgtttatctgttcatgaatgctgtggtgtataaaccgggtagggagagcagtgctgagattctcatgctgagcagatggcagggcctgcttgccagccacatggcttcctcctgcacactgcctttgctgctcacactcatcatatatttttctgaatgcccagtctcacccatgctatggtctttaggggtctcttggaaagagttaaaatttcagatgttaaattcctgaatgcccagagactactgtaataattagactttaaggtgttagaaaatgataatacaaattgtgctgctttctttgattttattaggtaaaaaagctccagttttatttaataaagaaatgattgagtcaatgaaggaaggttcagttgttgtggatttagctgctgaggctggtggaaactttgaaaccactaagccaggagaactctacattcataaggtatagcaagatgcgttttctatctgtgatcacttctcatgtcttgagttatgggggggtgtttatttctttaaatatttagagacattaaggcttgaaattttaaaattaaaaataggcatatttaaagctcctgttgaaatatgtatttgtttatgggtatgtatgtatattcataaagatatataattacaaaacttagcattgaatatgaatgataattgttctagaatgaatgtgaacatagggtgatagacctttttgactataattttgttcatttagggaattactcacataggctacacagacctgcccagccgaatggccactcaggccagcaccctatattccaacaacatcaccaaactcctgaaggccatcagcccggacaaagataatttttattttgatgtgaaagatgactttgactttggtacgatgggtcatgtcattagaggaactgtagtgatgaaagtaagtaaagagatctattccttcctttgcttttaatgtaaatttgttttagaatttctgtttatggaagaattctattttggaattgagacatattttaataaggtattggtatgccagctttatgctgataaaaattatttgtaaatgcagaatgatttaaagaaaaatatttcaaagacttaaaagtacatgacttaaccaaaaatatacactccttttgaaaaacggagatgaacaaacaaattgaataaagtaaaaattaaacattccccccacttatctgctttcaagggtttaatttgcactcttgcttatatggtcctgtacacatacaaattacatatatatgattgtatatgtaacatggatattagtatttgtatatgtatgtgacatatttatgtaaaatgatgttacaaattatatgaatttatatatttacataaaattatatttaaaagaacagggttttaaaaaatagtatattccttaagcaattttgaaatgctggattgactttttaatacgtactattttttaatgtctattaggatggtaaagtgattttcccagctcccacaccgaaaaatattcctcaaggtgccccagtaaaacagaagacagtggctgagctggaagctgaaaaagcagctaccattacacccttcaggaagacaatgtcaacggcttctgcatatacagcaggtgaggataccatttaccagggtttagtcttgattgtttgattttgcaagttatatatatatatatctatagatatatgtgtagctatatatacgtatatatagatatatatacacatatatatctacacatctatctatctatctctctctctctctctctctctctctctctatatatatatatatatatatatatatttttttttttttttttttttttgagacggagtctcgctctgtcgcccaggctggagtgcagtggcgcgatcttggcttactgcaagctccccctcccgggttgatgccattctcctgcctcagcctcccaagtagctgggactataggcacccaccaccacccctgggtaatttttgtatttttagtagagacggggtttcactgtgttaaccaggatggtctcgatctcctgacctcgtgatctgcccgcctcagcctcccaaagtgctgagattacaggcgtgagccactgcacccggcctgcaagtaatatattaattgtcaaaattagtaaatgaaatgctgttgtcttttttggattccattagtaatcgggcctgacagacttggtttttcagcaacatgttacttgtcccacctctacggaattggagattacatttattgactcagtaaatagaggcactgtgctaaatactggaatgaaagcatgtgaaataatatgcagacaataaacatttttcctgttatagaaagcattttaaatgcagtcatttatatatatactaaaaatatacatatatgtatttttgagacagaatctttttttgttgctcaggtaggagtgcagtggtgtgattacggctcaccatagcctcaacttcctggggttgaggaaggaagcttctcacttcagcctcctgagtagctgggactacaggcgcatgccaccacgcccagctaatttttgtatttttttttttttttgtagagacggggcttcaccgtgttgcccaggctggtcttgaactcctgagctcaagtgatcctcctgccttggcctcccacagtgctgagattacttttatctacatcaaatgtattgagaagtgatgtatgccatattgtgctggtgttaaatgcgtataaatataattacgtttttttctgttttttatttttatttttgtgaaatatcagttgtgattatctgcacacatgggtaggacaagggaagcaaagtttgccttaaagaataaatactacaatataggctatagcccctgaacatttgactaacattttaagttactcaacttgtaaacaaattcaacattttcatttagatctctttctttgtaatttaacataaattctttttttaaaattcatctttacaaaaacactaaataatttattgtaaagtgatgattaatattcattctggctatgcattgttggaggctgaaatacggatatttgattttaaattggtttctgtctcaaagaatgaattaaaaatgtttagatctattcagagccaaaacaaaaacaaaacaaaagcaaactataaagaattaaggaccagcaccaggcgcatagaattcttgtagagtcatcattctccaaattcccatgtgagtccagatgttttaaagctaaacatgtaactctccttgaataaagagtaagtctcagcaaaatgactgaaaaagcctctagtggtgaacactgtgagtagataaagcagtgtccctacttgcacttatttgttaaaaaaacaaaagaaatgaggttattgtgttgtacatggaacatattatgagtaggattgtaaatttccatttctctttcagattcataaggaaatgtagcaaggcacatataatgatttatttttctcagtttctcttatatttcttgaatcagggcatattgcttcttaatatatatgacagtggcatattccagtgaatgaaaggatgaacttatatgtgtttttctttatcttgaactccctctttcatattaaaaataagtatttttcttttatatgtatcaggaatgtatttgaacagcattcttcaaagaatgtgatttgctttctcttcttttgtcagcctttctcttcctctgttatacagatatagaaatatagtctgacatacgttactaaatatattatagaaaatacattagtttattgaatagttgataagaaaaccttcaggtgtatgatgtaatttttatcatagatgcctaacacaaaagactgtggattgtgataaggtagtgcttcttgactaatgtggtcatgataatagctagcatttagtgactcctaggcattgtgctaaatacttcacatgtcttagctcatttattttttacaagaattcagcagtgggtatattattattttctcttccagatgaagacagagagggttgataattttacctatgaagacactgaagcacagagaggttaagtaacttgcctgagatgacacagctagggagcagcagaaccaggattcaaaccagactgacttaagaaaacatattcttattcacaaccctatgcaacttctctaatttttaactggaagacaaaatagtgttgtatctaactctctcaccagatggttaatgggctatgcactggaactttggatacatgatatgtgggtaggaaaataaattaaaactacagtcatattgaatgatttaatgtaaaattaatgtcaatccctagatattccagtggtgccacttccaaagtaatagtttacatcaaggaaaaaggtaccttattcaggaaagttaacttctagttccctggtcacccactgtcattttctttttactgaccactaggtaacactttcttctgttgcagaacaactgtccacatgtttgctatcaaggaaggcgataattaaagatgtatgttcagagctgtttgtattctgcacattcttaatttaatttgtattttttttccttttgtttgtaaaatcctgtttgctgacttggtgttgaggctggagctgactgccctggccaacagtccagtccagattcaggagcaattgcaaaatttgtgtcccgggtgggtggaagccatatgttttggggaggtgctggagtgaatgaaattcttcctactcttttaaaacccctattcctcagccaaatctgagagtgacataaaattgccttcataaaagtcttgtcttataaaggttgtgtcttgcccaagtagaaaatgctttggtagatcctctgtaggcctgtaatcgggaataaaaatgcttatataaacacatgtggcattgttaataaaagttaaaacagggaagaggacaaactacacagaggaaaatgtgcaaattgttattagtgtgactcataaatattactagatctttatagcttattttgggggggtggtcagaaagttgggttttgtccacagtattcctccatccccccacttctcaactgtcaaatgtctaaaaaatctgctcattactggcaagggagtggaatttaaaagcattggctattccacatatttatgtatgtgcttttaatcttactgagataactggatgtcagctcaaacacactctttactctctttctctaggtctcacagggatactgggtttgggcattgcggctcccaatctagccttttctcagatggtgaccacttttggcttggctggcattgtggggtatcataccgtctggggagtgacccctgctctccactcaccactgatgtctgtgacaaatgcaatctcaggtttgttcctctcttgtttttcctcatctcaggttttcatagggttactcagctctaggaggactatcaatgccgtttataaagtgtgttttcaagttgttttgcttggcatctgagtcatctgctttggtgatctaagggctcccagactctgagagggtatgggatatgggcctgcagagtaagaggccgtgggagtgtgtcagctctttgggctgctcccatttcaagcagtgcagagccactgttatttcttccaagtttgatcctttttttttttttttaaagaaaaggattccactgataaaatttgaaaaccagtgttccacagaatcatagctgcaacatcctatagggctctccttggattcaactcagcattcagcctagcaaggctacaataggccccatgtggcatcaggttcaccatgaagctatgggacaggaaaacacagctttccagtgaggtggcatcaggcatttctctttggtgccggtcttttcagcagttcatgcagcagtccatgtggttgcccaggatctattctctttgtcccctagcaatgggtcagatatgagagaatgagtcctacattggacaagcataggagctgtcctggcttgaaagcctcagggccaatagtcatcttttataacattgccataggcacagcttcgaggatctctgcagggaacatgtctagctccaagaggtgctgtagtcaggaaaacccaaagctaggcatccccagcaggcatttacagttcatgaatactttcttccagtttacatgcaaattatctaccagggtcactttttaaccataagcaatgttgtctataacactggtggatttatatctgtattagaggaacatcgctagaaagttaaaagaaagtccaattccaatgcagaaggagaaaaagttttgttaacccttttcccacagtagtaatttcagtgagaatgatgtgaagatgtgttgtcaacagtctgcataagcaaaattgtttatttcattttaatgagggtgtaagaaagctgccttgttttttaatattgagaactttaccctctatgaatctatgtatgtgaggtacttcagctatgatatttgatttggtggtgtcactatcactattaaccatgttaatgctttctttctagggctgactgcagttggtgggttggcactgatgggaggacatttgtatccttccacaacttctcagggccttgctgctcttgctgcattcatatcctctgtcaacattgcaggtatgatgtcagtgaaaggtctcagtactattttcaatggagacatacaaagcaaatataaatccatataaaatagacataattgtgccttcaaaaaatgtttcactctgaccgtaaatgctctttttgcaggaaaattagttattttgcccatctgtaatttttagaaactcttgataaaagaacaacccccagatccccaaaacaaacaaacaaaatgatgtcttgctacaagttaactggaaagttattgaatgcatagttttgaagttgggttagagctatcaccgtaacatctataaattagtataattttagataaaattttagtcttttgccttatcccagccagggtttgttactggaaactgaaagcctagcacatcactcatgtgtgagactcatttgatgctattttgtagctaacaattctttaatgtgtccaagaaacctggtgcctgttgatatggtatttttttcttttataatttattatagggttttacaaatgtaacaacctactaggaaaagataccaatctttgatctttcacattctcaagctttttgaatggcttttttttccttttagtcatgcagaaatagttttgcattctgatagcaagttttcttcctgaatatatttagtgttttttcccccacctctctaatggaactggcttgagtaatagaatgactttaaattttggctgggcacggtggctcacacctgtgatcccagcactttgggaggtcaaggcgggtagatcacctgaggtcaggagttcgagaccagcctggccaacacgatgaaacccccctctctactaaaaatacaaaaattagcccagcatagtggcgcgagcctataatcccagccactcggggggctgaggcaggagaatagcttgaacctgggaggcggagattgcagtgagccaagatcgtgtcactgcaccctagcctggtcaacagagtgagactccatctcaaaaaaaaaaatttgaggttgcaaaatgttactttaaattatatttgttcctaggtgataaagatgtgcttaaaacagaaaaattgtagcactttaaaaaatcatgttgctcagtgagctcaaagaggtactatgttttttatttcctttggtttgctaaggtggctttctggtgactcagagaatgctggacatgttcaagcgtcccactgaccccccagaatacaactacctgtacctgctccctgccggcacctttgttggtggatatttagctgccctctacagtggttataacattgaacaggtaagatgctctttgtaagtttttatatttaccacaatattttcttctctattagatttaacattgttagttatcctaattcaaagtatcgagcaaatacaactctgtcaagcaaatacaacaataaccctagaaacatcttggtcaaactgagcattctcttcccctaaggatcaggaccctggattctagagacagatttttctggtaactgagtttaaatatgggtttatgtctttgttttgatacatttttccacatgtaagaggagttaaggttatcagtatcttcattatgtatctagctagattgcggtggatttataatgaaacaatacaaaatttgaaaaattattattaagtactattagttcttttcctattcttcctctacaaatccagcacatcatctcttgctactaagagatgttatatattcataaaaaaatccataaagaaaaggatagtttaaacttaatgttgtatagaaaaacagaaataatccagctggactttgaaagttccaacttgtaatataacagaccttcagctttgttctgaactctgtattttctatttcttttcaatggctgtcttttagtttcttctatgtttccaacctgcagtatttattgaatgaacaattttttttttttttttgagaagagttggagcagtgagtcagaaagaccttagtctgaattccagatttccaatttattgatcatttgccttggagaaaatatgcaacttctttaagctttgattctgtcttttgcaaaatgaggataatgatttttccctcttgtggatctcatgacactgtgacaacacaaataaaacatgtggcaaagcccctggcacttacctcaggggttggctcttttacagcatttggtcaggtttagtatttttagatccagtaatgactccatttaaatttaggtacttttatgtgtatttgtgcatgatagcaaatccagaaaaaatcaatttatataaatggtataagtgcaaatacaatataagtatttaatatgttaatattcctaattggcaggaaaatatattgaaatctctaagctaatagaccaaaggttttaataatctctctctcacttttcctttgaaaagatcatgtacctaggctcgggtttgtgctgtgtcggtgccttggctggcctctccacccagggaacagcacgtcttggcaatgcactgggcatgattggggttgctggaggactggcagccaccctcggagtcctaaaaccgggcccagaattactagctcagatgtctggagcgatggctttgggtggtaccattggtaagcacttgtgggcttctgccttcatgtgaactccagtttctcaatatatatttctaaggtccatattgatgaaataattaaattttgttcatggaagttgcttcagttaatattattttggtgaaaattcattccagttggtgtaattctcattcaaatacattttagaacactgaataaatgcatcaactgagtcaaaatatcctatactcaattcttatcttcctttactgactgtgtcccgttagctgataatggaatgggggattggaatccttatgtatgtactatacataagctaacttttgttctgctgggtataaataacagccaaagattctgcttcatagacctgttaaaaatgaaaaaaaaaaaaaaaaacatgtgccagcagaaaaactactgttttaattttattcagttgtttgctggattgttaaattttcaggaatttttaggctgggcatggtggctcagactgtaatcccagcactttgggaggctgatgtgggtggatcacttgaggccaggagtttgaaactggcctggccaacatggtgaaaccccgtcgctattaaatatacaaaaattagttgggcatggtggcgtacaactgtaatcccagcttcttgggtggctgaagcatgataatcgcttgaacctgggatgtggaggttgcagtgagctgtgatcatgctgctgcactccagcctgggtgacaaagcgagactctgtctcaaaaaaaaaaaaaaaattttttttccaggaatttttaaagttgattgttaaacacagccattattaaatactaaattacataaacttaaatgaatcagaaacaaagttaataatattaaaaactcgtaactttctaattaatttactaggttttattgtctatgctcttgaggttacttatgtctattgtatgtgtatagaagaaatactatgtatcagtgggctgtggtacatctctttccaattctacattcaatgacatcacattggtagattgaaatttgacttggtagcagtattgcagtgtggaaataagcaaacgctacaaatctgggcttgatttattgttttgtttattgtccagacgtgagaaagtgatggagaaaatgttaatgatgcagcttaaacttgagatgttttgactgtagctgtgacattgtgaatagcacaaataattgagcaaataatcttccagtatttgaaaactattatcagattcagcaataaagtcattcatatggttgataaatgagtgaagttctcgcatacattctgttgttttactttcgtcttacttattaaagcaaataaaaatatcaaacaatgttcctgttggaagtatgcttgttcatcagttgcaaacactaggttggctacagatgtaagagtttagcaaagatccataaaaacattctttgaaagtcaatttgtctacatggaattttcagtaaagagcactatttcttattatttgaaaattgtgtgctagccacctttatatcagttaaagctcatgtatttgtatgtgcatgtatttttttcccctggaactggttattaaatgtttcccagtggaacactggctttaggcctccttttatacttcctcaggaaagctttgactcttttcttgataatctctggggaaagggacttgaaggaaaatgtttgctctgtaggttcatggcaggaaaacctttagacatgatcttagcaaatattctgagccccactccttctgtatcacctacctatagccatgcagttccttcagaggctcctaatttgggtatttactgcccagatttttgcatttctttaccttgggactttgctcccacctacccacctgaaaaccaaggtcttcttcatgttccaggtgtttcttatgtgctcaggagaaagcactggctatagagaagagggcctgggttgcaatggggagaatataagggaatttgattagagatttaggtagtctgaagaagtgttggctaggggaaggttgggagtttgtgacgggaagaggcacgcattgatgctgggtgttcattggagttgggtcgtgcttaggtgtgtggagaaaaactgctgttttgaaagggtatacaagttgagcatctttaatccgaaaatccaaaatgctccaaaatccaaaactttttgagtgctgacatgacatcacaagtggtgaattccacacataaatacttaacacaaactttgtttcaagcacaaaataatttaaaatgttgtttaaaattactttcaggctatatatatatgaaacataaatgaattttgtgtttagacctgggtcccattcccaagatatcttattatgtatatgaaaatattccaaaattaaaaaaaattaaaatctgaaacacttctggtcccaagcatatcagataagggatactcaacctgtatacaactagtgcccttaccttctgtacagcccctgtagagaatatttagcccgtactaggaactagataatatttatttgtgacaatggtggaaatccttaagggtgatctttgttgtggttacttctcaaaagtttgtcaagttttaatttatttttgacctttcataacaggattgacaattgccaaacgcatccagatttctgatttacctcaattagttgctgcttttcacagtttagtgggtttggcagctgtacttacttgcatagctgagtacattatagaatatccacattttgctacggatgcagcagcaaatctcaccaagattgtggcctacctcggcacttacattggtggcgtcacctttagtgggtctctcattgcctatggaaaattgcagggtaagtgattcagcataacatagaggtaaatatctactgtttagggcatttagggatccattttaatttcagaaaatacattaacagggctgggcgcaatggctcatgcctgcaatccagcactttgggaggctgaggtgggaggctctcaagcccaggagttcaagaccagcctgggcaacatagcgagaccctatctctactttttataaaaaataaaatattactactaataaaaaagattaaaaaaaatgccttaacagtaaaactgttaggtgaagagtattcgtatagcactcagaaattgtaagagtttttttcccctcatccttcccctttattgatacttagtaagtctcataaagctttgaagctgtttcatttgcagacagctaatggaggaaattagtgaacagaaatttgcatggagggactagttgacttttgataatatatgtgaactaaacagcatcctcataatccttggttagagatgactgtgtagaattcacagaaatgaactttatgtattttcttacaacacattctgaattgtaactactatgtgcttggctctaggtctcctgaaatctgcccctctcctactgcctggaaggcacttactcaatgcaggcttactggctgctagtgtgggcgggataatcccattcatggtggacccaagctttactactggcatcacctgtctgggttcagtgtctgctctctctgctgtcatggtaagaagtcagagattgaaaagtacatatttggtgaagaactgggaatattttgttagattaaagtgtaatcatatttttatctcttcaagaaccttgatggaataaaaatgttttaaaattacgtcacatgtgcatctttttagaatctggaaaacatagaagagtgtaggaagaacattattctttcttgcaacttaattgttcattttaaagttgtcacatgagacacctttattgctctggagtcttttcaccggatcaatgtgttggtgaacaggagcttaaaaaggccaagggtttcaatgtattaggtgcctactatatgacaagccctacaaaatagtgcttcggggtttatacaatacaagtaagatagtctctgcccaccagttgctcttacatcattggaagatatgacacgaaatcaaataagtataaaatgaaatgcagttaaaaaaccctgtatgctcagtgagagtattcagtgaaggcttttatgataggtttggctttcttctttctctgcaatttttatatttagtgtattgaaacacacagtagtttttagttgtctatgtgacagtctggcatcttatatcaatgtatgatgctgttttatgcagcgctatttactgttattcactgttactcatgttctttcagtgtgtaatccgtagacaaggtttatatttaagttaaaaaaattatctacagtaactaacacaaagttagacacatagcaattgcttatgaaatacttactggctccttgattgagaaacacctaatttatagtgtaaaaatgatacttatttttgtgtgatcatggcagttaggtcatgattttaacacagaaattttagaacactgaaaagtaaattaaaatctcatctttatattcacactcatggtctaattttattctggcttattgcactggtttttgttttaaacaaaagaaaaataattttgatatttttaatctaataaagcagaataggttgatgaagtctcaaaataaaagatatacaaatgtgattgggtgaggtggctcatgactgtaatcccagcactttgggaggccgaggtgggtggatcacctgaggtcaggagtttgtgactagcctggccagcatggtgaaaccccgtctctactaaaaatacaaaaataagccgggtgtggtagtctgcgcctgtattcccagctgctcgggagactgaggcaggagaatcgcttgaacctgggaggcggaggttgcagtgagccgagatcatgctattgcactccagcctgggtgacaaagcaagactctgtctcaaaaaaaaagaaagaaaaaaagatatacaaatctaaaactttaagaattgttgtttttgggaagcagtgactatgatatttaaaggatttattggttctatgagaatgtctgactaagacaaagtattttttgaatttattttattgcttttggcttaaatgagtaatacatgaatatgctctcattgtaacaaacaaaaaaaggtaaaaacatgtgaaataaaaagcaaaaagctttttcctttcatgtgtttagtaatttcgagttgtatcacggacattgttaatgatacattatagacattttggatgttatgttatattccttcaaagggtattgattattattatttatttatgtgtttttgtagccagctaacttggctaaactcaaattccaaattttgactcccttatggtgggtggtggggggcagctgaaatctattgttattttatccttaacaggattgcttggagtctgtctcacatatgtgtagttcaagagtcatccagagatttgagtagaatttataaacagaaactgggactccttccctctagcctgcttctttgtgggattccccttattactttccagctgccttagtcatctcaaatgctatcttcaggatcttcaagtcagtaagactgtgggcttatattttataatttccttaactggtaccaacaggggattgccctcagtctaaagccataaaaactgggaaattcacttagtgtcattgtatttttccaaatgtagacgcttctccagtttctgcctgcttttcatcactgaaaagtgtttttttaaaatgtagggatttttttttaggggggtgggtggctcagtgtttatagttgttatacctgtggaagtgttggtcagatgggagacacttattaccggaagtggaacttatatgtaaatatattaatgggaaaactagaataattaaggagcaaaatgttaaatgtcagaggttttatttttatgttattaattttgagttctgatttgattgttgttctagggtgtgactttgacagctgctattgggggtgctgacatgcccgtcgttatcactgtgctgaacagctactcaggctgggccctgtgtgcagagggcttcctgctcaacaacaatctgctgaccatcgtgggtgcactcataggctcgtctggtgctatcctgtcatacatcatgtgtgtggtaagaaacaacacatacatgaaacaaaaggaaatggcttcctgaaaacatggatgtgcatgtcatttcttttattacccataaaaatgaatattgtaggctgggcatggtagctcacacctgtaatcccagcactttaggaggccaaggcaggtggatcacgagctcaggagttcaagaccagcctgcccaagatagtaaaaccctgtctctactaaaaatacaaaaattagccaggcgtggtggtgggtgcctgtaatcccagctacttggtaggctgaggcagagaattgcttgaacccaggaggcagaggttgcagtgactgagatcatgccactgtactccagcctgggtgacatagcgagactccatctcaaaagaaaaaaaaaagagtatggtagctttgaattctcttcagcagacatagcagagtatttcatttgcataaatttccaagactgcctttaaggtacccaactgtaaataattaggaaaattaaatagaaagatgaaaatcttctagtgcctctctccatctggagataaacaggtaagattttggtttatttccttatgtatggcatatctgtgtatttacttgtctgatcgtgttgtatattgtcctacatttaaaaaaacttatatactatattgttgactttttgtcattaaaaattcttttaaaatattattttaagagactttatcgtgatccatcatatggatatacaaaatttatttaatttgcccttaatgctatacatatgaagttgtttgattttgatttctctttgtacatatctttgacatttcagatttttgtcttaagatagattcctagaatttataggctcattatacttatagccatgtttctggaaaggttgttctaatttacactcctgttggtcatctgtgagagtttctaccttagaagttttgtggtcagcatgatggttttttaaaagaacagaaaaaagtaacaacactaatacttcctagcttttctgtttgtttcaagttctcttcttgatggcaagaagatgttctgcaaatattataattaaaggtttgagtagaactttttttttcaaattatggatgttattttctaaataataatgaaactaaatgaaagcagaacgtgattttacactgataaataatttagacaagaaagggatctgtattagtccattctcacactgctgtaaagaactacctcagactgggtaatttatgaagtaaagaggtttaattgactcacagctccacaggcttaacaggaagcatgactgtgaggccacaggaagcttacaatcatggcagaaggtgaatgggaagcaagcacatcttaccatagcggagaaggggagagagtgaagggggatgtgccacacacttttaaagcaccagatctcgtgagaactcactagcataagaacagcaaggcggaagtcagcccccataatccatcaccttccaccaggtccccccgtggcatgtggggattacaattcgacatgagatttgggtagggactcagagccaaaccatatcagatacttactctaccttcattcttttattataatattttaaaaaactcgcttattttacaactcaggatttttcttatgatttaactgaaaatctcattgtaatttggaaggctgaagtatcttttcatagtaaaaaatatttttgtttcttaggctatattgcaaaacaaaggatttgatagcccaaattcaaaacaagctaaggggttttaaaattaaatagcctaaattacctggggaatttggaaaggtgaaggtttatgtatcctatttgaaaagtgtcaggctttgtgacagaaagaagaaacatttgtgaagaagaaatgtttatgaaattgtactagaaatacagttttctgtaaaagtaaacttttaacccttagtttgattttgcttcagttgatgaatttgaatgaccagcagggggcagcagattttcattattacttaaacttgcggtttgtcagaaagtggcttttatttatttatttatttatttatttatttttattatactttaagttttagggtacatgtgcacattgtgcaggttagttacatatgtatacatgtgctatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaacattcggtgtttggttttttgttcttgtgatagtttactgagaatgatgatttccaatttcatccatgtccctacgaaggacatgaactcatcattttttatggctgcatagtattccatggtgtatatgtgccacattttcttaatccagtctatcattggtggacatttgggttggttccaagtctttgctattgtgaatagtgccgcaataaacatatgtgtgcatgtgtctttatagcagcatgatttataatcctgtgggtatataccccagtaatgggatggctgggtcaaatggtatttctagttctagatccctgaggaatcagaaagtggcttttaaagttaaatgggaggatttgaaggatttgaatgttaacaaagcctatggcatgctgatatggggagaggagggaagaagacttgtttctagttcttgaaatgtcagcatgggtaatttctcattttatccttttttaaaaatggttttctttaggtttttaaatttataaagagtattccccacatttctgtctgtgtctctcttattactctctttttccttcttcacttagtgtcttttattattattagttatagcaaccatagtaagtcttacagtaactcttctgtaacactagaataaggtagtaagaggtacttgttgaaagtactctcttctacgtgttctgcaattatatcatctttctcttatttttcttactcttttatttttttgatatgttttctctaggtcttctatttcttttctttccatttcactgccacaggcatgccacttaccatcagcattccatagatattttgtactcctattctgtatatagaactaccaaattattccgatagctgcctgagaccataaatatcatattgggtcagattaataattcggattcaagaacagtttaagttttaattaaaaaaaaaattctggccaggcgccgtggctcatgcctgtaattctagcactttgggaggctaaggcaggtggatcaattgagtccaggagttcaagaccaacctgggcaacatgataaaaccctgtctctacaaaaaatataaaagttagctgggcatggtggcacatgcctatagtcccagctacttggggggctgaggcaggaggatgacctgaacctggggaggttgaggctgcaatgagctgtgattgtaccactggactgcagcctaggagacagagtgagaccctgtctcaaaaaaaaaaaaaaaaattccaattagttaaagatgtttaatgtaggaaatttggaagaatcagaaaaggataaataaaaaaataaaatcacctaaacttccattaccacttaactattaacattctagtcttttttatatgaatgtttaaatacattctatttaatatattatgtaattgtctaaccttaattttaattaaggtttaattaatgtttaattttctaataatttttagctcctagtattatagcaaacagatattaccatagtctatttattcaaattcatattagttgtttttaactttctttttttcttggttgcagttttccttcttctacatccttgattatttccttaggtccagtttttataagtgcaattacatggtcaaagggagtaagaactttttgttggcttttgatattactaaattgatcttcacaaaggattcaccagtcaaagctcttacttgtgatgtgcaatgtgtttgtcttactgtatgatctctactcctaggcattgttacaaaacaagtcagaaaccaacaaatacaagcctgtcatatttttcgattttgaagatggaaattatcttttcttctacaattttctgatttctcactttttacattaaccttcgttgataaaccttctttatgcttctttattataggaaattataggagatttattcagtttcttcatggctgtgcttagcggctctaggtagatcggtataatcataaaaatgaaatagctacttaaaattggccattagtgcaacgtagcaggcattatgctgggtgctttacaaaatatagctcatttaatccccgcacaaattctggaggtaggaaatattattctcattttactgagaaagtattgtaaggcaccatttattattcacctttgtgtttgtggagtttggccaagtacctggcacattcacacaaattggtttgttaaatgaacattagagaaatattttatttgttaacttatttcatgttttagaatcttctccagatagactatgatagcagatatagcagagttaatatggtaccagtatgttgaccttcactcttatttattgaaggaaacacacaagtccaaactagaacagggtgattttattatgtgtgagggaatggaatgcaccccaagtggctaaccagcaatccctaaaattgaatttttgttctgttgggtgtcctctgagctcagtgctatggttacacaatacccaagattataaaaactgaaaaatgttgtcagtgtccaaacaaccaattcaaatgaatgatatccaaatatcatatagacattaacctctttatgattttacagtttctttgtttgtgatagtatccagattgcctcagaaatagaggtcttacaaaaattgaacagcattttcagatcgaattttctgatttttgcactttgctgcttggttccaaataaaaatagaacagaatgaagtggatcaaaagccaaatcaaaaatattttttcctttgtgattaattaattagtatctacaaagcattgaaatgagagatgctagtaaatggtatatatgttattattgctttggctttgtcagttttatgacctttctttggctttcagatttatttcttacagtgtattcagaattatgtgaattaggattctctttaatgtagaatgcaattttaattattggcttaatagcttaaaatgaacagtcttaaacagtcttgcaaattctttgtcttggaagctgggaactgttcaatctctggaacagtggtcataggatagtctcattaatcatttaagccggcaaaaaaagaaaaaagaaaaaaagagaaagaaccaaaacaaaaccataaatgctaaacatttgttgagaatgtgatgttgcaatggtaaatttagagataaaaataatttcgtttttaagagaccacatggaattgttatagcttaatggtgatgtaattgtggatacatgtttaacaagttgactatgatggttaaactactgtgtggttccttttttttctccctaagatgccatcagaagtgggtacccattaattaaatgtcctcagagattctttccttcttcttcattcagttttataggaggaaataatggttccttttaagccgagttagaataaaatggtttatttatccctctcctctgtccctctacatctgtacagcggtacatctactgctgtgatcttctgcaggactgtgtaataagggtgatgaaacctctttgttcactggatttttttttctggtattttatttatttatttattattattattattattattttttagtatttattgatcattcttgggtgtttctcggagagggggatttggcagggtcataggacaatagtggagggaaggtcagcagataaacatgtgaacaaaggtctctggttttcctaggcagagggccctgccgccttccacagtgtttgtgtccctgggtacttgagattagggagtggtgatgactcttaacgagcatgctgccttcaagcatctgtttaacaaagcacatcttgcaccgcccttaatccatttaacccttagtggacacagcacatgtttcagaaagcaccgggttgggggcaaggtcatagatttacagcatcccaaggcagaagaatttttcttagtacagaacaaaatggagtctcctatgtctacttcttcctatatagacacagtaacaatctgatctctcttttccccacatttcccccttttctattcgacaaaaccgccatcgtcatcatggcccgttctcaaggagctgttgggtacacctcccagacggggtggtggccgggcagaggggctcacttcccagacggggcagccaggcagaggcgcaccccacctcctggacggggtggctggccgggcaggggctgccccccatctcctggacggggcggctgccgggcggagatgctcctcacttcccggacggggtggcggcggggcaaagacgctcctcagttcccagacggggtcgcgccccggcagaggcgctcttcacatctcagacggggcagcggggcagaggcgctccccacatcccagacgatgggcggccgggcagagacgctcctcacttcctagaccggatgacggccgggaagaggcgctcctcacttcccggactgggcggccgggcagaggggctcctcacatcccagacgatgggcggccaggcagagacactcctcacttcctagacggggtggtggcagggcagaggctgcaatctcggcactttgggaggccaaggcaggcggctgggagggggaggttgtagccagccgagagcatgccactgcactccagcctgggcaacattgagcactgagtgagcgagactccgtctgcaaccccggcaccttgggaggccgaggctgtcagatcacttgcggtcaggagctggagaccagcccggccaacacggcgaaaccccgtctccaccaaaaaatacgaaaaccagtcaggcgtggcagcgcgcgcctgcaatcccaggcactcagcagcctgaggcaggagaatcaggcagggaggttgcagtgagccgagatggcgacagtacagtccagcctcagctcggcatcagggggagaccgagcagagagggagggggagggggagggagagaaggagagggagagggagatctatttttttttttcctgcctcaggtttatttgtacaaatagcacaggaggaccccagccccatgcagatggtagcccagggacgggggtggggggtcgcaccagtccttctgtcctcacgttggcagagatatctactctgaaggctttgtaggggcctcggtacctttgggagcctgagctggaactgaagctggagctgcagcctgggccttggtttgatccttggccttggcctttggccagcacagcctgggccccttggcaatacaggcacaaacacgcttcccaagcttggggtgggcaatgtaggcaagtggatcgagcttgcggctgacaccctttgggatcttgggcttaacctccttgggctttacgagggccttgatagcctgggcacgtgcactcatggccttggcattgttggcctgcatcttctttaggcccttcttgttgtgcttcttggcaaagtgcatgttcctcaggaacttggggtccacccccttaagagattcgtatctttgtgatcggggtttcttgataccatttctgtgccattttcgggactggttgtgtgtagtgtggttcttggacttggccatgtctgcaccttaagctgccggtcccgaagtgcctagaaccctattttttattattatactttaagttctagggtacatgtgcacaacgtgcaggtttgttacatatgtatacatgcgccatgttggtgtgctgcacccattaactatttacattaggtatatctcctaatgctatccctccccactccccccaccccacgacaggccctggtgtgtgatgtttcccttcctgtgtccatgtgttctcattgttcaattcccacctatgagtgagaacatgcagtgtttggttttttgttcttgcgatagtttgctgagaatgatggtttccagctttatccatgtccctacaaaggacatgaactcatccttttttatggctgcatagtattccatggtgtatatgtgccacattttcttaatccagtctatcattggtggacatttgggttggttccaagtctttgctattgtgaatagtgccgcaataaacatacgtgtgcatgtgtctttatagcagcatgatttataatcccgtgggtatataccccagtaatgggatggctgggtcaaatggtatttctagttctagatccttgaggaatcgccacactgtcttcctcaatggttgaactagtttacagtcccaccaacagtgcaaaagtgttcctatttctccacatcctcaccagcacctgttgtttcctgactttttactgatcgccattctaactggtgtgagatggtatctcattgtggtttcgatttacatttctctgatggccagtgatgatgaacattttttcatgtgtcttttggctgcataaatgtcttcttttgagaagtgtctgttcatatcctttgcccacttgttgatgggattgtttgtttttttcttgtaaatttgtttggtttagttctttgtagattctggatattagccctttgtcagatgagtagattgcaaaaattttctcccattctgtaggttgcctattcactctgatggtggtttttttttttttttgctgtgcagtagctctttagtttaattagatcccatttgtcaattttggcttttgttgccattgcttttggagttttatacatgaagtccttgccatgcctatgtcctgaatggtattgcctaggttttcttctggggtttttatgattttaggtctaacatttaagtctttaatccatcttgagttaatttttgtataaggtgtaaggaagggatccaatttcagctttcttcatatgtctagccagttttcccagcaccatttattaaatagggaatcctttccccatttcttgtttttgtcagatttgtcaaagatcagatggttgtagatgtgtggtattatttctgagggctctgttctgttccattggtctatatctctgttttggtaccagtaccatgctgttttggttactgtagccttgtaggatagtttgaagtcaggtagcatgatgcctccagctttgttcttttggcttaggattgacctggcaatgtgagctcttttttggttccatatgaactttaaagtagttttttccaattctgtgaagaaagtcattggtaacttgatggggatggcattgaatctataaattaccttgggcagaatgaccattttcacgatattgattcttcctatccatgagcatggaatgttcttccatttgtttgtgtcctcttttatttcgttgagcactggtttgtagttctccttgaagaggtccttcacatcccttgtaaggtggattcctaggtattttattctctttgaagcaattgtgaatgggagttcagtcatgatttggctctctgtttgtctgttattggtgtataagactgcttgtgatttttgcacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttctttctcctgcctgattgccctggccagaacttccaacactatgttgaataggagtggtgagagagggcatccctgtcttgtgccagttttcaaagggaatgcttccagtttttgcccattcagtataatattggctgtgggtttgtcatagatagctctgattatttggagatacgtcccatcaatacctaatttattgagagtttttagcatgaagagttgttgaattttgtcaaaggccttttctgcatctattgagataatcatgtggtttttgtcattggttctgtttatatgctagattacgtttattgatttgtgtatgttgaaccagccttgcatcccagggatgaagcccacttgatcatggtggataagctttttgatgtactgctggatttggtttgtgagtgttttattgaggatttttgcatcgatgttcatcgaggatattggtctaaaattctctttttttgttgtgtctctgtcaggctttggtatcaggatgatgctggcctcataaaatgagttagggaggattccctctttttctattgattggaatagtttcagaaggaatggtaccagctccttcttgtacctctggtagaattcagctgtgaatccatctggtcctggactttttttggttggtaggctattaattattgcctcaatttcagagcctgttattggtctattcagggattcagcttcttcctggtttagtcttgggagggtgtatgtgtccaggaatttatccatttcttctagattttctggcttatttgcatagaggtgtttatagtattctctgatggtagtttgtatttctgtgggattggtggtgatattctccttatcattttttattgcgtctatttgattcttgtctcttttcttatttattagtcttgctagtggtctatcaattttgttgatgttttcaaaaaaccagctcctggattcattgattttttgaatggttttttgtttgactatctcctccagttctgctctgatcttagttatttctagactcctgtaggcttttgaatgtgtttgctcttgcttctctagttcttttaattgtgatgttagggtgtcaattttagatcttttctgctttctcttgtgggcatttagtgctataaatttccctctacgcactgctttgaatgtgtcccagagattctggtatgttgtgtctttgttctcattggtttcaaagaacatctttatttctgccttcatttcattatgtacccagtagtcattcaggagcaggttgctcagtttccatgtagttgagtggttttcagtgagtttcttaatcctgagttctagtgtgattgcactgtggtctgagagagagtttgttataatttctgttcttttacatttgctgaggagtgctttacttgcacgtatgtggtcaattttggaataagtgcagtgtggtgctgagaagaatgtgtattctgttgatttggggtggagacattctgtagatgtctattaggtcctgttggtgcagagtcgcgttaaactcctggatatccttgttaactttctgtctcattgagctgtctaatgttgacagtggggtgttaaagtcttccgttattattgtatgggagtctaagtctctttgtaggtctctaaggacttgctttatgaatccgggtgcccctgtattgggtgcatatatatttaggatagttagctcttcttgttgaattgatccctttaccattatgtaatggccttctttgtctcttttgatatttgttggtttaaagtctgttttatcagcgactaggattgtaacccctgcttttttttgctttccatttgcttggtaggtcttcctccatccctttattttgagcctatgcgtgtctctgcatgtgagatgagtcttgtgaatacagcacactgatgggtcttgactctttatccaatttgccagtctgtgtcttttaattggagcatttagcccatttacatttaaggttaatattgttatgtgtgaatttgatcctgttattatgatgttagctggttattttgctcgttagttgatgcagtttcttcctagcctcgatggtctttacaatttggcatgtttttgcagtagctggtactggttgttcctttccatgtgtagtgcttccttcaggagctcttgtaaggcaggcctggcggtgacaaaatctctcagcatttgcttttctgtaaaggattttatttctccttgacttatgaagcttagtttggctggatatgaaattctgggttgaaaattcttttctttaagaatgttgaatattggcccccactctcttctggcttgtagagtttctgctgagagatcagctgttagtctgatgggcttccctttgtgggtaacccgacctttctttctggctgcccttaacattttttccttcatttcaactttggtgaatgtgacaattatgtgtcttggagttgctcttcttgaggagtatctctgtggtattctctgtatttcctgaatttgaatgttggcctgccttgctaggttggggaagttctcccggataatatcctgcagagtgttttccaacttggttccattctcctcatcactttcaggtacaccaatgagacgtagatttggtcttttcacatagtcccatatttcttggaggctttcttcatttctttttactattttttctctaaacttctcttctcgcttcatttcattcattcgatcttcaatcactgataccctttcttccagttgatcgaattggctactgaaacttgtgcattcatcacgtagtttttgtgccatggttttcagctccatcaggtcatttaagtacttctctacactgtttattctagttagccattcgtcttaatattttttcaaggtttttagctttttgtgatgggttcaaacttcctcctttagcttggagaagttggatcgtctgaagccttcttctctcaacttgtcaaagtcattctccatccagctttgttccattgctggcgaggagctgcgttcctttggaggggggagaggcgctctgatttttagaattttcagcttttctgctctgtattttccccatctttgtggttttatctacctttggtctttgatgatggtgacgtacagatgaggttttggtgtggatgtcctttctgtttgttagttttccttctaacagtcaggaccctcagctgcaggtctgttggagtttgctggaggtccactccagaccgtgtttgcctgggtatcagcagtggaggctgcagaaccgcgaatattgctgaaaagcaatgttgctgcctgatcgttcctctggaagcttcgtctcagaggggtacccagccatgtgaggtgtcagtctgcccctactggagggtgcctcccagttaggctactcaggggtcagggacccacttgaggaggcagtctgtccgttttcagatctcaaactccatgctgggagaaccactactctcttcaaagctgtcagacagggacatgtaagtctgcagaggtttctgctgccttttgttcggctatgccctgcccccagaggtggagtctacagaggtaggcaggcttccttgagctgcggtgggctccacccagttcgagcttcccagctgctttatttacctactcaaggctcagcaatggtgggcgtccctcccccagccttgctgccaccttgcagttcgatctcaggctgctgtgctagcaatgagcgaggctctgtgggcatgggaccctctgagccaggcatgggctataatctggtgtgccatttgctaagaccattggaaaagcgcagtagtattagggtgggagtgacctgattttccgggtgccctccatcaccgcttcccttggctaggaaagggtattccctgaccccttgtgcttcccaggtgaggcaatgcctcgccctgctttggctcacgcttggtggactgcacccactgtcttgcccacactgtccgacaagccccagcgtgatgaacccggtacctcagttggaaatgcagaaatcacccgtcttctgcgtctctcatgctggtagctgtagactggagctcttcctattcggccatcttggaacccaatcctcactggactctttttttaaaaaagttatctatgacagaaatatcttaatgtctgaaatagtcctttaaatcaattttaagggcaaaaatttggtagaacatatattttgataacaatttcagaactgtataattcaaaactagaaaggattaatctagatcaatgagttgaatgtttgggacgtctcagatgtggctatttgtgtttccattaaacgttggttttaaatatgggaggaatgtgttaggaatttaaaacaccatgtcagctagggattgtgaacttaattaaaagcatttctttagctgggcactgtggctcattcatgtaatcccagcactttgggaggccgaggcaggcagatcacttgtggtcaggagtttgagactagcctggccaacatggtgaaaccacatttctaccaaatatataaaaagttagccaggtgtggtggcatgcacctgtaatccccactactctggaggctgaggcaggaaaatctcttgaacccaggaggcggaggttgcagtgagctgagatcattccactgcactccagcctgggtgacagagcaagactccatctcaaaaaaaaaaaaaaaagacatcactttaattctttcaccctcttatcctttaataatacacgtaaagacatttcaggttttattttgtatgtaacaatcttagacaaatttgtcagactttgggctctgtaaaatgtcaatgttgtgtctgataaacgagtttagattgaaagaacaattacaattctggcaacattttgattcatcatctttgaaatttacgttatttaggctttattaaagtatggcttcttgcttatcttctgtgtaccttttcctccctgcctttgtctgggccctactcagcataatggaaatgtctccaccaagctggtagcaggctgagccatcattgtgtggggtggccatagttgtctcgatgtggtacttatcattgaagatcttggtgcttttttacctttttaatactaaagtgttgtatttttaaaaaaagcaatagattgacacttatatagcctttaagttgtataacgaagcaataatatatttattacagcacttaaaatagagttcagtaagtttttggaaatttgttctgaagtgataaagtcagttatgattatgtagaatgacagtttcaatcacatgcagtgatttgaattcttaaaatgcatttgattactcagaacaactagttttttttcccctttcttttactaccccacctccagaggtctacaaatgaactgttttcaaaaccagaccagttactgtaacatatttcagcagtggcattcctatggtacattcttgagtgattataaatgagcatgagaagttcatttattttatttttcttttgagattatttttctagttaaaagagtgagtataaattttaaagagtatataaccttattcttctacctatttggaagtgaaatattttagagtcctaatgatgaacccagttacttctattaaaacttaggtatggggctttgtggagctataattgatttggaaaataagacagtatcaacccccatatttctattttcttgatgacagagggcagcaaaattctagatgaaatggatctttactgttttgattcttaccagttgcttcttcacagctggtatctgtgaagatggaatctgtagcagaattcagctgagagataaaattgttcaatcagcattcagacagtaataaatagatgtgattttttcattagtttattaattttattgataattttttcttggtttctattttttttactgaaaatatatcagtgtgcaattgatttgatagggaaaaagataatgtggttctcagatatcttctgtcatttcaatttttgaagtgattttcagaaaccagctgaaatttatctgattaaagtgttttaaatgatcaaataaaccttttaaaatgattccaaatatcatatacacaacatttgtactattctcacaaagttatgtgtgttaaactctcacagctgataatttggctttctaggcaatgaatcgctccctggctaatgtgattcttggaggctatggcaccacttcaacagctggtggaaaacccatggaaatttctggcacacatacggaaatcaaccttgacaatgcaattgacatgattcgagaagctaatagcattattattacaccaggtaaagaaaaaaagcaaaagcaaataacctataatagctgttataattgatgacattaaaatttcttataataggaaagtagaattgaaacttctttagttttgaaaatataatggaaacaatagcaaatctatgattactaagtgaaaaatactgagaattctcagtttaaattaatattttggagatcacatggaaattctataaattcttacagtgggttctagccatgtctttctgtgattatgtgtacatgtttacatcattttcgagtcttttttcttctcattggtaatttttgggcccgttgtcaagattaaattagatatagtatatgaaagtctttagctcactcattagagttgcttaataaatgttgttttttcaaaaatgattatttaaaaaatgatcaagaatcatgtggttttcaacaaaatgaggcaatgtggcctagtagaaagagcttggtatggagtcacgatacctcacttttgttcttaattttgcctctaacaatctatgtgacattgcccaagtcatttaatctctccaggcctcaattttccagttttctgagttttagctcagttcttcttcactgttatcacaggatgctgtggtattatgagtcatacattggtttcagattaagattttaactctatcatgttatcaaatgagttttctgtaaataaaatctactgatttgacatgtgagtagtttactagttagttatgtactgaagtaaaaataggagacattagctgaattgagtgttaaagtgtaagccttctcaacttgggacaatatcactttttaggggcatttgaaataggtggatttgggtttttggttgtccaaagatgggaatgctactgtcaattagtggatggaagcagataaatgaaatgtactgtaacgtgtgggacactgctgcataatgaatcatcacacccaaagtagcattggtcttacctattgagcaatgctgttctggagtgtaaaggtgtaaagatgtagaggacacaatctatttcctctaggcactttccatctagtgattaagtcagataggtagatcagtaatgcaaggtgggttatgataagggctaaactgaactatgtagacagtttttcaatcacaagaaacctatgaaggtttgtagggaggcgacgatttgtttttaggacttagagaatagatggtgttgggatgggagaagccaacgggaatagcttgagcagagacttggcatttgaaaaaatggggatagaaaagtggggacagatgtgagattcattgtgcaggtagaatggacagaaaggagggtgaagatgactgaagttcttggttatacctgtaataacatcagaaatatggaaacagtttttagagtgtggggtggggggaaattttgagttctttttttgagacattaaatttgaggtgaagatgggacaagagccatgttatactggcgctcaaatgacaggtcaagcctgcagacagattgggaatcatcagatggttgttgaagccatgagaggagctgagattttcaaggagaatgtgaggggcaaagttaaagccctttggaaacttatataagcggagaaaagaaggagaaaaactattcaaggaactagagaaagaataataacaaagttaggctgggacaggggaccgcagtgtcgtcaaagccaagtatgaagagagtttaaaaacatgagagagagagagagagagagagagagacagagacagagaaagagacaagagagggaacacccaagggtgtgtgcagtgtcgggggtggggttgcacagcagcatgagacactacagaagattgaggagcaatcattacattttcaatttcaaatttagggcaatatttttaaaagcccagcttataaatttgctttcatttctagtcctgttaaatgattgcctctgttggcataaacatgtgttttcatcaagagagaagttgtacttcatgtaatttcaaaataaaaaacacattcttctgtgttcttaatgttccttgcaggctatggtctctgtgcagccaaagctcaataccccattgctgatttggtaaagatgctcactgagcaaggcaaaaaagtcaggtaagcgtttgcagtggagaggcttgcactatgtgtaaagatgtgtgtgtggagaaaaggaaatacagtggacccttgaacaatgtaggggttagggcactgacccgcccatacaattaaaaatccatatataacttttgactctccaaaaacttacctactaatggcctactgctgatcagaatgcttactgataacataaacaaaatatgtatcaattaacaaattttgtatattatatgtattaaatagtagagaaaggaaaatgttactaagaaaatcataaggaagagaaagtatatttactattccttaagtggaagtggatcatcataaaggttttcatccttgtctttacgttgagtgagatgagaagaaggaggaagaggagttgttggtcttgctctcatgagtggcagcggtagaagaaaatctgtggataagtggaccctctcagctcaaacccatgttgttcaagggtcagctgtatatggcttctgaaaaagatgactgtttcttaaagtggtgttttacatgtgtaatcctaggtaaagaagttaagttgttaatgaacaagccatattctggtcttagtcttactatttagattttgctgttcctggattagcgtcaactcaaatattatcgactcattttagaaaaggaaaatgtgttattccaaattcttggagatttattaatggggaaatcggatgtcttgtttctctgtggtttgatttgaggaaagaggtcaagcgaagcattttaactacatcaagttgtatctttttggtttccggtcacactgaataaaaacaaaaggtcttaaaagagaggccttgaagagcaagaccaagtaataaacctgtgccctggttactgttttgctgagttagctgagttagccagtcagagtacttgtgctggactggatgcagaatcttaatctctggctggaatgtcccagctactagtagtggtgaaagaaacttagatgatgaaatcagggggctaccttaattgtattagtgtcggcagttaattgtattagtgtcagctgcactttatttcttccttcctttgtttcctacacttcctttcttgtctcactccttctccactccttcctccaatctatagtctgtgtttgtcaaatatatagaatcaaaatactattttgtggtgggaccagcatttctgtgacaagattttcatgtttattgagagtcttagatgaattgaaggtagaagatgagaaaagtcattgactttatttttaaatttttgtataagaagtctactttttagttacttattccaatttttacataggatattaagctgtgctttttaaagccatcattttgctgctgagaacatttgtaggcctgcaagtgaaaatgatatgttaaacaacgttttatgattttcctaaaaagaaactgttttctctatttagtccagatgtgaaaaagtgtaatgtattcgtaatgccctctttcaccacataaatatttaggagatgggtggcaatcataatagagaaagaaaaatgcctttcatgtcttaattatccttagggaagggaaggattaatttggcatacctctcttgttacctgttgatcagcctaggttaaccagacatcttggaaaatcagtccagtgttaaataggtggatgtggagtgaagaacatcgtgactgtagtgtagcttgaaggaaggcagcatcttaagggaaatgtcaaaggaaataagagagatgggaaaaatgatctgaaaggaaaaaggataagacaaatgaattttttgtttctgatctgattaaaattagaattttatctatgaggacatgatataaactactgttgtaggatgatttctgtgacagtgcttgggaagagtaattatttgatgaaaggtttaagagaaatatttaattatacatatatgaatagtttttcagttctacattttttattgaagtaattgtgtgaataggaccaaagccttttcatgagagagcttttcattgcttcacataattattaacatagttcaaataattttataaatttattaataatttattatgtaggatcagaataagattattaattcagtctagtttctctatttgtaagttatttatagtcatctttctttcatattaaaggtaaaatatattaatatattgtagtttttttttactatagtatgttgaattttcaacatgaactttgtaacaaattatgtaaatcttccatttgaattaaatggaagaggactattcttgctaaaattatgacagcagatcatcatatttttctgtgtgaattttttttattgaaagagatttgtagaaactttgtgattttgctttgtgcgtgtgttagcttttcacaggagaaatgcaaattttctttacgaagttaggaatatgtatatacatagatgctagcttttttccttttttttttaaagggcaaacgtctgtttgaacaagagatggctgcagcagttacctcatattttaatgaaataaatctgtatttacagtttgcagtaatttagtcctttcatcactctgtggagctcccacggtgttcattgagtacagctgctgggcctctggagttagcaggtctttgtgcctcaggaccccagcatgcctagcatccagatgtggtgacatattcacacacatcccctgtggaaatgtgccagtgtggacatatgattgtcatcaattagttatacccaagtggtgccaagaaaaatcgcatctgtcatacagtctgtctggcttcatggcccatgattgatttagagacactcctgttttcctttactttgcccatagtcataatatgctcacgagctaagattatataatgaagcacatgacatttcatgacaagaactcattttagaatgtcatgaaagttcactggcttagacttttgttagtggccaagatatcatttgcttcccagtagcccagaatgcctgtatagcttacctaacttctgcttgatgtctaaaaggattttatgacaacaatcttacgacgtaagagccacagatattttgtctttttccttcccaatttttggactgattatatgataggcttttcattataaggcagagataatgttcccattgagtaattagggaggggtagaatatgcctgtaatcccagcactttgggaggctgaggcaggcagaccaagaggtcaggagatcaagaccatcctagctaacatggtgaaaccccgtctctactaaaaatacaaaagattagccaggcatggtggcgggcacctgtagtcccagctactcgggagggtgaggcaggagaatggcgtgaacccaggaggtggagctcgcagtgagccaagatcgtgccattgcactccagcctgggtgacagagcgaggctccttctcaaaaaaaaaaaaaaaaaaaaagaaaggggtagaatttttttattataattactgcttgattttctttctataaatcattgcttgaattatcacagaagtcatttgaatttattgaacaactttcaacttattttttttaattattattttgtttttgagatggagtttcactcttgtcacccaggctggagggcagtggcatgatttcagctcactgcaacctctgcctcccgggttcaaagcaattctcctgcctcagcctgccaagtagctgggactacaggcgcataccaccacacctggctaatttttgtatttttggtagagacggggtttcgccacgttggccaggctggtcttgaactcctcacctcaagtaaactgcttgcctcagcctcccaaagtgctgggattacaggcgtgagccaccgcacccggcctcaacttctttgattgactagctgatgttatgtattgctttcatgttaatgttctgctatatccttctactaataacttactgagaaatttattgctaggtactgagcatacaaggatgcgtaagtccagtcctcaaaagtttatagttatgaagaaatctctattaacagatcaatcaatgaatgaattccatttaatgtgatagtatgctaagacaagtagagtagtagtaagaatgcaaggagtagttagctgtccaggagatattttaaactttttacaacctgaaatatcttgcatgtttttaaaaataaatattttcatttattttttatgtactgtctaaacacatctagctgcctgtggtatttgcagtctaataatgttttacagtcttgtgtaatatggctataagtttaaatacatattatttttacttagaaattgattctttgaagacacttgaaaatataaaatattttgtccatctaactgtctaactggattcttttttttttttttttttttttgttggaatcttgctctgtcacctagcttggagttcagtggtgtgatctcggctcactgcaacctccgcctcctaggtttaagcgattctcccacctcagcctcccaagtagctgggattacaggcatgcgccaccacgcctgactaatttttgtatttttagtggaaatgggatttcatcatgttggccaggctggtctcaaactcctgacctcaggtgatctgcccaccttggcttcccagagtgctgggattacaggcgtgagccaccacactcaggcaggattttcctgtttttcatggataagtatgattcagataaacaaagtccagccttcttggatttgttatgtttttgggtggaggaagagtcaaggcttgcaaattggtaaagcaataaagtcatgtatttctgacgagaatagaaactaggccagttaaaattatcttgtatagtatttgagtaacgaaatagacattatttagcagtttcatgtcagctttgtaatacttttataaaataaagataccactattcatatccataaccattcattgaacaaataattataatatatactactctttcctaagctactgttgtaggtccaggggatacctcagtgaagacaacagctgaaaattcctggtcttatggaatttacattagttaattaattgattaattaataggcttcaagataatctgacttggagattataagcccatttgtctcccaatttcaatgctacttgaaacaccagagaacagctgtaacataggttattgtatcagagtttcaaagttatagctgccactatttggccttgaattagccagcgcttttggttttctcaaagaatgtggtgtgtttctttgcactttgcattggggctgccttctcgaaaaacatggtggcaggatagtgggtatgggttattcgtgtaactggtcaaatgagtgaaactttgatggaagagaggaaaaccaaagaaagtatgtgcattcactcacatctatgttcaacctattgtgtggagttgctagtaatctcccagatcaaaggtgtctgttatgctcctagaaagtggccaccttcatcccagattggctttatcttgtccacagcatattggtatggtggaaagaacagaagactgcattaaagcctgtgctttaggtgctttgtaaagcctcttttggtcataccactctaggatgcattccttataaactcttgtcacaggcattcctgtgatctgaggaaaaaactttcactgttgatgaaatcattgtcactgaccatcagggtgatttttggcttctggttttagtattagttacaggaaactctttgagctgagtttttacaatgaagttcatgtgaacaaataaataaggatcttgcttataaataattttcattttattgagctcattagccattgcattccagcagccatttaatagcatcataaaaattattcagacagaaagatgaaattatgtataattttaactaaatctctataatatgccagaatgtaatattcaagagttagttgcaaattgaattttttttttctggtatcattcttcataatcttgttgcctattttaaaatcaaaacagtgtcagtagtcatacagtttctattctgggcctggtagttggatttggttaagcgatgggaaagccagatttgggcacaatctataattactctcctcaggatggaaaaggtagttttgggacatggttttatagaggactgcgttgatgtttgcaccagaccatctgagctgatccttcttaggtgacagctcatctctttgggtggcctcagtgtcacaggccacatgtacagatggaaaatgtgactgtagcctgtcaaatatttcctgattcacattcataagacaaggtctattattctgcattagaaaaattgttcccctgagatattttcgtaagctttctttcataattttttttttttttttctgaagaagggaaggccatggatgaacaacagaattcagaaacagagtagcagttcagcccttatttgccttcaaaaaaagaaaagtacaaagtgttctctaattctggcttttagaaagttctaggaagttaaatgaacacttttttttcactatgaattatatgagtgaattcatcagaacggctgcttctaagaaggattttggtggttttagaaaggtaggtgtttattcctttgcctgggaagcctcaccagagatgttgactctacaacccatctcattcgttagtttttgtggacagcagttgcctcatcgggaatttttttttttcacttccttaccatgtttcccttcggatggatagactagcccgacccagttggtccaggccttttcactaccaaggataatttatctaacaggaacaattaccctgctgacaccatgatttggaaatttttattcagaactgattcactaaaatgattgcttaaaaaaaaaaccttttccttgtagttttaataagtatgatttataactgtcaccagaagttctgatcagcatgtgataaaccaaagaaacttgccttttcagggagtctatcatatttttcacaggtgaaatgcataattaaatgtaaaaaaatactgaatatagtaatgaatcatttgattacctccagagaccctcctcagaatgtaacactgccacatacaaacaaaattccaaaggtccttgagctatagcccatactacggactttttattgtatccacagtggaatttccagcctgtttttgggacaaaacagtgtgcaaacatttttggtataatttctaaatgaagagttcctaccttaagaagcagttggattggaagatctttaagttctatttaaaccattaaggttttatagatttataaatatttatagttttaaaacaggagaagttagtagatgtttaacaaatgagccttctttttattttctgtttatgtattttgcctaatttgtcaacctcctagaaggttatcattaacatatttagaaaaattgtgggatgatagtattgggaaggcagaattccaaaatgctatcagtgtacattgccctatatccagcttgattttaaaatgtaaaacagagtaaaataagggaaagtaactgaacatttggagtatggacataaattttgcatggtgactcacaaaacatgtaagcaaatagttgaaggttgtaaagagcttattttttttaaaaaaatctgttgatccttgtcactatttataatagcaagaagctgaaaaatggaaaaagcactctaaatagtttagaaaggggcccaattgtacttacagtttctttgtgtaactgttgaattgggatgcttgatttaattaaacattcttaatagtttattgctgaactaggtctggatatttccataatacaagaagcaaaacatagtttatttgaacagttgtggtaggacccatgtggtgaatgttttatattcttcaatagcctcacatgcccaagaaaactgctgctgtgtactctggtaggacatattgtctccatggtctgtgatcatggaaacttctgttgttgtgtcccctttaaaacatgtggtatctgaaatctaatgtgaagttgtgaaaaactctaaagaatgaggttcatgtcaccatatattataaaagaggcttttaaaaaatagtactttttgaattgcttcttcttcatattttaccaagtatactcagtattcgtgaatagttcttgtatacacttatattagtttttattcttccttggttaatttaaaaggttctgaagatcaggttgtttcatttgagtagattattctactttttttgaactgtgcctgggtctattcttaattgatgactgaagcctgagcttttttattatctaatgttccatgaaaggctctattgttttcatatttgagagaggaaaataacaaatactgttgaattttttttttttttgcttcaagatattgaagagattatcctaatttgatgacatttgttgtatctgtcaaccaaggaaacaacatttttgcctaatcatatctgttaaatggttaaaaatggccttttgaaatttgactgtatcaaaataaatgtgtatttgaatgttagttttgttcaagtttccagggagcccaacgtttataattattggcctcaatctagattgactatacagttttttagtatttttgatgtagctgcaaatacaaataatttctggcttttattggactttattgatttttactggcattacaagataaaaattagaaaagcaacccagtaagtgttgacattaaatcaacatttgttttaatgtgaaaatgtatgcttctttgtattaagtgattattaaaaatatgcatttatttgaaaaacagatgaacatttatattattatacaaaaatgtatttgaacaggataattgctgtgtacatttattgaacaattgtgtctgccaggtgttggcctaaagcactttgtatgaaaagctttttatacaaactacatcacttaaatccctcagtagtcctctgaggagattttattatcaatcccatggtacacatgaaagaatggaggtacacagaagtaaattgttcaaatgctttgaacctggcagtggcaatctagaactcttaactgctaccctatactgcttttctaaatcctttctctaaaaagagacatagatagtgtataaatcagtatactttattgggcacactgtgttgtttaaaaccccttctctccttctctctcttgaatggagtccttgcaatagagtggcaggaactggtaaataagacatggtttgttcctattctcaaggaactcttaggagagcacagtcatgtcaaccagttatgttattgtatagtaagaagtagatgcataaaggaagaattctgaaagcctgcaagatctttctatgacctcattttagttattttcctctgtagaatcttgtcatggtcagggatagctcattcttttttaagcatatacataataaaagataatgttcatagttgaaagagaagaactaaaaggttggtaggctttgcatgttgaaattctggatattcttcatgtgatgatggaatatcgatgagctttggccatcagttccgggaaattgctcattatggccaaccagtgtctgatataattaattttaatacatactttggggattagcctgttacattgtgccagaattttttataaactcacattgactcatcagtgtgcatatatatctctacacatttgactgtattctgttattcttctcaaaacattggcattctcttgtaataatcttgcacgtgtttttctctgactttagagtcataaagtttagtgtaataaattactgtgcaagtagatataaaatgataggtcctttgggatattaggcataacatgatggttatgttggtaattatttaccctttacaactagctcaacaaaaacattgtctttatgcagtctgcagctaatcaaggcatcaaaatgagaacaaatatattcagaggtccttaatttctaatttggtccaagatacctcagttaaagcctcaagatggtagccagatggattaatttaaagatgacaaaaacagtattaaaaacaaataaaattaaacaaaataagctagaatcaaggaaggatataaaattgaaatccaaaagtaatcacaacgtatatattgggttatttagctaaaatagaagtcctagttcactgaatttcaggactggagagctttgtggtaggcagaatagtggccttccaaagtgtctatatctgaatccccagaacctaatgactattttaccttacatggcaaaagggactttgtagatttgatgaaggtgaggattttgagatggggagattttcttggatcattgggtggctcagtgtaatcactagggtcattataagagggaggcaggaggatcagagttagagaaggacatgtgacagtggaagcagaagttggggtgatgtagcccccccaccaaggaaagagggaagactgcagaagctggaaaaggcatggaatggagtttgccctagaatctccagaaggaatttttaaaattttttttcaatttcaataggtttttggggaataggtgtttggttgcatggaaaaattctttagtggtgatttctgagattttggtgcacccatcacccaaggagtgtacactgtacccaatgtgtactcttttatcccttgccacccccaccctttcctctgagtccctaaagttcaatgtattgttcttatgcctttgtgccctgatagcttagctcccacttatgagtgagaacatataattttccatttggttttccattcctgagttacttcacttagaataatagtctccagttccattcaggttgctgtgaatgccattgtttcattcctttttatggctgagataccacattttctttatccacttattgattgatgggcatttgggctggttccatatttttgcaatcgcaaattgtgctgctataaacgtgtgtgcaaatatcttttttgtataatgaattcttttcctctgggtagatacctagcagtgggattgctgaatcaaatggtagatctactttcagttctttaaagaatcttcacactgtttaccatagtgtattgtactagtttacattcccaccagctgtgtaaaaatgtttccttttcactacatccccaccaacctttattattttttgattatgttcattcttgcaggattgaggtggtattgcattgaggtttggttttcatttccttgataattagtgatattgagcatttttccatatcctagtcggacatttgtatatcttctttgagagttgtctattcatgtccttaggccacttttagatgggatcgtttgttttattcttgctgatttgcttgagttctttgtagattctggacattagtcttttgtcagatgtatagattttgaagattttctcccactctgtgggttgtctgtgaatgaactctgttgattattattatttttgctgtgcagaagctttttagcttaattaagtcccatctgtttatctttgtttttgttgcatttgcctttgggtttttggtcatgaaatcctcacctaagccaatgtctagaagggtttttctcatattatcttatagaatctttatggtttcaggtcttagatttaagtctttgatccatctcgagttgatttttgtataaggtgagagatgaggattcagtttcattatttcgcgtgtggcttacaattatcccagcaccatttgttgaacagggtgtcctttccagacaaaatctctgaattgccagaaaaagaattcagaaggccgattattaagctaatcaaggaggcaccagagaaaggcgaagtccaagtcaaagaaatcaaaaacatgatgcaggatatgaaaggaaacatcttttgtgaaatagaaagtataaataaaaagcaatcacaacctctggaaattaaggacacagatagagaaatgtaaaatgctttgagtgtttcagcaatagaatcgaacaaacagaagaaagaacttcagagatcaaagataagccttttgaattaacccaatccgtcaaagacaaagaaaaaagcattaaaaaaaaatgaacaaagcctccaagaagtttggaactatattaaacatctaaaactaagaataattggtgttcctgaggaagaagagaaatctagaaatttggaaaacatgtttgagggaataatcgaggaaaacccccctggccttgctagagatcgacacatccaaataacacctagtaaaactcaaagaacacctggagaattcatcacaaaacaatccagaaggaattaagccttctcgatatcttgatttttttttttttagtccagggaaactgattttggacttctgaccttcagcccttaagtgataacaaatttgtgttgtttgaaggcactgaatttgtggtagtttgttacagcagcaatatgaaactaatacagattttaaatgtcatgtagaacaacgattcttagtcttaagttctcatcagtcaggttttgggaagagcagtgggcctggtgggcctgggggaattaggagatgcttattggtgatctggattgagaaattaggaaacatttttggtgtccaatattacttttaatacctcaaaagagcacacatgattaatttgagaggcagttagtactgtaggattgagctagggcaacatcatgtagttattctggaaatcctgggctccctctaagctgcttcttgctcttactagtggttaagaccattggttgaaatccctcccccaccttccataaataaaaggctgtcccagcttccataatggtcttgatcatgcccactgccaaccgtcctttgagttatatgtaaaatactcttggattcattttggattgaactgggggttatgcatgagggcagattaatgagcctctctccctctgacccacaaaaaagaagactgaaatttcctagataaggcatttgttttaaattgttaacaaaaagcttttttttagtaaaaaagattttaaattctttcttttgcatttgaatattttcttctcttctgtgcaaataagaaatatttggtcattttctgtggtttatttgaaaatcacagttttgcctttttttctggccaactgatccagaatttttttgagagagtgtgtgtgtgtgtgtgtgtgtgtgtgtgtgtgtgtgtgtgtgttttgagatggagtctcgctctgtcacccaggctggagtgcagtggcgcaatcttggctcactgcaacctccgcctcctgggttcaagcgattctcccaactctgcctcccgagttagctgggactataggcatgtgccatcatgcccagctaatttttgtattttttaaaatagagaaaagatttcaccatgttggccaggctggtcttgaactcctgacctcaggtgatccgcccatctcggcctcttaaagtgctcggattacaggtgtgagccaccatgcccggccagagtgtgttattttttaagttgttagctattttgtctttctcttgaaccttatccaagtgccctctgatcttttaaatctgtagttctatgagctaaatctagttatttagtttcatcattgggtttagtcagtgatagaagagtacctttggtaactgggggaaaaagtctctgagttaatttgaaatgttgatttgaaattgataacagttgaaatacaacttggcattaactttgaaagaaaatcagctgattaataatgcaatgtgatactttagatatattactaagcatctctgttaaagtgaaatgactttttcaatctaaaactttttattttaagatacattcttttggaaatgattttcttccattattattcaaaaataatcacacgctagggctctagaatttaattataggatctctgcctttgttggagcacaatctctgtgcctttctttggttcataaaatagaacattgagttaaaatattgtcagtacctgtgtctaccaaacagtgcattaaaatacatattaataaactatagtttcaatgtaagttcttcttggcagagatttggatgttaaacttggtaaaatctattttgttaggtatttacaaggaattattatctggggagaaaacaaaaatatggactctgtccacataattaaatgcccattcagcaaagtgtacaggtggttaatatttctagcaactactgtctgattatagatcagttttcattgacgtagttatcaaataaagcattaaaagttttaattttttttttctttctcagttgaggttagagtaagggaacaggggcaaactgctttgagctctctttaagaccatgcaaatatcttgctcttcatcaaacttaactccctagactgaacatgtgctgatttttttttctttttcttttgagatggagttttgctttctcgcccaggctggagtgcagtggcgcgatcccagctcactgccacctccgcctcccgggttcaagcaattatcttgtctcagcttcccaagtagctggggttacaggcacccaccaccatgcccagctaatttttgtatttttagtagagacagggtttcaccatgttggccaggctggtctcgaactcctgacctcaggtgatccatccgccttggcctcccaaagtgctagaattacaggcgtgagccactgagcctggccatgctgatgatttttacggtaccaatctttattatgatgattgcaaaatggtgatgtaaaaaccccatcacatttatcagttcatggtctaccactgtaagggagagtgcttctttctttctttgtttatttcttactgacttatgaatctgttatcagtattgattcctggtttcccactttctgcagtgggttataatctcttactatcctttccattttgatgttcaaataactttcttatttttaaacactttgtgtcatatgtgcctttaaagccatgtgtttgtgtcaatctcatgtgcattttgctttgtttgcatccttctttctcacatactcaaagattacacaaattcagccctttcctctttttaaaaaaatttgaattgttattatacttaagtaagctttatttattttttttttctggatctgttatctttttcctagttcttcttttattgtccctgaacctgagggattattcagctatctccaccgtagaagacaaggttaaaagtctggaacttgatgaaaacagtgatggttatttgtaaactcaggcaccttggaaacttccattcatcatgtcttttctcaaattcctggtgatcagtagtcttgggagtatattttggttatttcaatataatgcattttctttctaaatctatttttaattttcatgcttaaacctgcatatgaaaagatatttatgtttagagctgaggtttagaaaaatacctcttatttaatgagcatgcactttgattgctggagaaatttttttccaaatattttcttattgctgctgtaaaatattacatttttaaagtagagatctcagcagaagaatccttgtaacattttggaaatgctttctctggagcagtttgaaaacagctgtagtagtactgaatatagcttgtattactacatgaaaagtatgcacataaattgtcagtattttgcctcattcatttgttgtcaagagtgactgaaactctgatttggcacagatggtgacattaggatagcaatgtttggttaaaaaaataaacaatcttgtttctagagaattaaaaaaaaattaacttaagtgttgaactagctgtaatattgccaaaagtgatagaataattcatggttgaagaacctaaaacctgcattaagatggtgaggttggatgaccacctaaaactaatgaatggctttaattttattctcacttaaataaaactgtcaacaacccactgaaggaagggatgctggattccttttaaaataatcttagagtattaatagttcattctctgcagtttgtttctacttgctatcagtgctaataaaaaatacctatttagtctttgtgtcccattcctgacataaagcttataaaacccatggaatttcgtaatgtggaattttgtaatgttcctgatttggctagagttggctattgtttgtgtataggaatgctagtgatttttacacattgattttgtatcctaaaactttgctgaagttgtttatcagctgaaggagctttggggccaagactgtggggtttgctagatataaaatcatgtcatctccagacagggatggtttgacttcctcttttcctatttggatgctctttatttctttctcttgcctgattgctctggcaaagactctcagattgtgttgactaggagtggtgagaagagggcatccttgtcttaggctggttttcaaggagaatgcttcctgcttctgcacattcagtataatgttggccatgggtttgtcatagatggctcttactattttgaggtatgttcctttaatacctagtttagtgagagtttttaacatgaagggatattgaattttattgaaagcattttctgcatctattgagataatcatgtggtttctgtctttagttctgtttatgtgatgaatcacgtttattgatttgcatatgttgaaccaaccttgcatccctgggatgaagcctacttgattgtggtgtattagctttttgatgtgctgctggatttggtttgcaggtattttgttgaggatttttgcatcaatgttcatcaaggatattggcctaaagtttgtgtgtgtgtgtgtgtgtgtgtgtgtgtgtgtgtgtgtgtgtctgacagattttggtatcagaatgatgctggccttacagaatgagttagggaggagtctatcctccttggttttttcgaatcatttctgtaggaatggtaccagctcttctttgtacatctggtagatttgagctgtcaattcatcaggtcctgggctttattttggttggtagactatttattactgattcaatttctttattgacctgttcagggaatcaatttcttcctggttcagtcttgggacggtgtatgtgtccaggaatgtgttcaattcttttaggttttctagtttgtgtgtatagaggtatttgataaaaaagaatatctgtcatttgatgtatttttcctccaattacaagacccctaatggtagcttagagtcttcattattagctttaaagatgtcgaaaacaatttctcacttgtctgggcaaaataaatcaccatctatagctcttttcaggtcttccttttaggaaggggtcaagtcctatgctctttaacctcttccctgatgcgcctatatgaagagtggggaggcctggcttgccaacagttcttgtgaaaaataacaaggcatcttaaatgaccataatttttgtgtgaggcagcagtgtgttgtggtggccataaatgctgatacagacttaggctttatcaatgaaagatgtgaggatatggttttcttactgtgccttatgcatctagatcatgtctagcacactgtattcactttgagggactgaggcttaagctgggcattgacagtataggatacagatgactaggacagcagtaggtcaggatgtctgtcattcattaaatggttgaaaggactgaggatgttttgcttaggaggcatccaaggtgtattagtccattttcatgctgctgataaagacttacgtgagattgggcaattcacaaaagaaggaggtttaatggacttgcagctccacatgggtgggaaggcctcacaatcaatggcagaaggcgagaaggatcaagtcacatcttacatggatgggagcaagccaaaaaagagagcttgtgcagggaaactccttcttataaaaccaccagttctcatgagacttatgagaacagcacagaaaagacctgcccccatgattcagttacctcccactgggtctctcccacaacacacgggaattcaagatgacattttggtagagacacagccaaactgtatcatcccacctctggcccctcccaaatctcatatcctcacatttcaaaaccaatcatgccttcccaaccatcccccaaattattaactcatttcagcattaactcaaaagtccacagtccaaagtctcatatgagacaaggcaagtcccttctgcctatgagcctgtaaaatcaaaagcaagttagttacttcctagatacaattgggtaaatacacccatttcaaatgggagaaattggccaaaacaaagggactaaaggccccttgcaagtttgaaatccagcagggcaatcaaatcttaaagctcaaaaatgatctcttttgactccatgcctcacatccaggtcatgctgatacaagaggtgggttcccatggtcttgggtagctctgcccctgtggctttacagggtacagcctccctcctggctgctttcatggaatggcattgagtttctgcagatttttccaggtgcacagtgcaagctgtcagtggatctaccattctggggtctggaggatggtggccctcttctcacagctccactaggtggtgcctgagtagggattttatgtaggtgatccgaccccacatttcccttctgcactgcagtagcagaggttctctgtgagggccccacccccgtggcagacttctgcctgggcatccaggtgtttctatgcatcttctgaaatctaggcagaggttcccaaacctcagttcttgacttctttgcacatgcaggctccacatcatgtggaagctaccaaggcttggggcttccaccttctgaagtaacagcccaagctataccttggccccttttagtcatggctggatggctgagacacagggcaccaagtccctacactgcacacagcagagggactctgggcctggcccatgaaaccattttttcctcctaaacttctgggcctataatgggagggcctgttgcaaaggtcgctgacatgccctggagagattttctccatggtcttggggattaacattaggctcctcattacttatgtaagtttctgtagctggcttgaatttctcctcagaaaatgggattttcttttctatcacattgtcaggctgcaaaatttccaaacttttatgctctgttttctttctaaaactgaatgcctttaacagcacccacgtcagctcttgaatggtttgctgctcagaaatttcttctgtgagatattctaaatcatctcactcaagttcaaagttctgcacacctctagggtggggtaaaatgccgtcattctctttgctaagacataacaagagtcacctttgccccagttcccaacaagttcctcatctccatctgagaccacctcagcctggatttcattgtccataacgttatcagcattttgatcaaagctgttcaacaagtctctagggagttccaaactttcccacgttttcctgtcttcttctgagccctctaaactgttccagcctctgcctgttacccagttccaaagttgtttccacatttttgagtatcttttcagcagcaccttacacccagtaccaatttactatattagtccattttcatgctgctgataaagacatacctgagactgggcaatttataaaagaaggaggtttaatggacttacagttccacaaggctgggaaggtctcacattcatggcagaaggcaaggaggagcaagtcacatcttatgtggatggtgatggtggaaggcaaggaggagcaagtcacatcttatgtggatggtggcaggcaaaaaaaggagagcttgtgcagggaaactccttcttataaaatcatcaggtcttgtgaaacttattcactatcacgagaccagcatgggaaaagagctgcccccatgattcagtaatcttccaccaggtcccttccacaacatgtgggaatcaagatgagatttgagcggggacacagccaaaccatatcactaggatagctgacaggaatctgcaaatgaaagaggttgtagattcattatggttccagatggcacaactatagaccttggaaaaaaatgaggtggagtttctctttggatatatacacacacacacacacacatatacatacatatacacacatataacttatttatctggcttaatatggatgaatatattatataatatataatcttgtattaagactgaatatattaatatatgaaaatatatatatattgcaaatcctcaaataacgtcattttgttcagtatcattttgttaccactttgatgagaaaaaaaatcaattcccagctggggccattgtctctgtggggtctgcacattcttaccatgcctgtgtgggttttctctggattctctgctttcctctcatatctcaaagatgttcatgttaggtgaattgatgtgtctacgtggttccagtctgagtgagtgtgggtgtctgggagtgtgccctgcaatgagatagtgtcctgtccagatctggttcctgccttgggcaaataattatcttatttgattttattaatctttcctaactgtatgtatagctcacatttatttcaatgtttaatattagaagtattttggtctttatttagaagtttggtgatatttctgtggccagaaatatgccataggaacttaactcttgtttatatcaattagcctagagtaaaattggtttcattatatcttgtttcacttaaagttgcactttctaaaaagttgcactttctaagaacttatggatgataagtgaggacttactgtatatgaatgaatatattactatatgaatatatatgcatacatacacatatatacacatacttgcacacacatgcacacacacacatatatatgtagactatatatatatatacactacatatatatatatatatatgtagtctagtaatggattagaccttagaagggtcattgaaggtatttaggctgaggttggatggatctcttccaagagatagtataaactgcatttatttttggattcattcattcattcattcacttcttatggagccctttctatgtgccacacactgttcttagtactgtggagacagataaatactgggcaagaggttggattaaaaaactttaaagacctcattatatctgtggtcaaaagaagttgcttgatgctttggggtcctttaccttaagtgtagagctctgcttgtgtattacccactctgtgttttagatgctcctgtgtgttcccatcacatgtcttctgtgatgtggagtagtattttatatcattctctgagtggctgtaggctttaacatcatgtgtatgacaacattttatctccctaccttttttttttttttttttgagacaaagtcttgctctgtcacccaggctggagtgcagtggcacaatcttagctcactgcaatctcctcctcctgggtacaagtgagtctcctgcctcagcctcctgagtagctgggattacaggtgcccaccatcatgcccggctaatttttgtatttttagtagagatagggtttcgctatgttggctaggctggtcttgaactcctgacctcaagtgatctgcccgtcttggccttccaaagtgcggggattacaggcattagccaccatgcccagccatctccctacctttgaacaaagtggttaaagttgaatgtgaagtcagcttttgatagaataatgttgatttttcgtgggaaacatttaattccaggctaggtaaataggtttttaaagattcaatatttaccagaaagtatgagagaacacagtgatttttaaatgtaaggtgatattatttattaacattattggaagttcactgcactgaaaacaaagttaagcttttatttttctgagggaagttatagtttctgcacactaaaatactgaaacttcagcttcaatatttgtaaattgactatatatctggactactgctgtttcattctgtagagatcagatagtaccagaaaaaagcagaggtgccaagaacaaagtgtgcagatttggaggtgatattggggtctctgtacattatgtcctgtcaagtaaggccagctcttcatttgtttcatgtctaggtttggaattcacccagttgcaggccgaatgcctggtcagcttaatgtgctgctggctgaggctggtgtgccatatgacattgtgttggaaatggatgagatcaaccatgattttccaggtaagtggtgggggcaattgtgaagtttaaatattcttactatgaataaagcagtgcaggtgtgggatatgaattgtagattcagtgaagactgactagtcagatgaaaaagaacttgtacatggtagataataagttgaaattaaataagtgaaatatagtattgaataaggtacaaaagattcgtaaacagcacaggtaaatttttctcctccgtgaagaactgaaggatggtgaaaaccttggtgtgtagtatagaaatgttgaagactggggatctgggcagacctggcttttgaatccagatcctgattctcagtagcttgttacccaacctcaggctcttcatttatgagtgcttctgttgataatttagtgtctgattcttgccagtctctgagattttactggttttcaattgtactaacgtatgactggtgaagtaattttctctttcttttctttttaaaaagtactagaatttccctagataaggtgctgtacgttatagctgtcatagggtagatgttgaatggtaatgacatttggcccaagcctatgcttgttaaaattaaaccacttccctctggcaaatatccactgtaaacttaaaaaaggctgtttattagaaaaagtattgaaattgtgtgtatgtctagattcacatagcatttttttggcaacagtctaaggtagtttatattgcagttcttgaagagaaaacttaggccattttaattttatgtcccttttcagattccactgttgttaaattatgtgtgacaccacccagttccaggaattatggacatggctttaatgcagattttgagactctcaaggagttatcttattttatttttatgtatttttttaacttttattgtagattcaggggtacatgtgcggtttgttacctggttatactgtgggatgctgagggttggaggtagtgagcatagtaccccacagtttttcaacccttgcccatatccctcactccccattctggtagtctccaggttctattgttgccgtatttatgttcctgagtacccagtgtttagctcccacatataagtgagaatgtgcagtatttgattttcttttcctgtgttaatttgcttaggataatggcctccagctgtttccatgttgctggaaaggacacgatttccatcctttttatggctgtgtagtattccatggcacatatgtaccatatttttttttatccagtgcaccattgatggacatctaggttgattccatgtctttgctattgtgaatagtgctgtgatgaacatgctagtgaatgtgtctttggtagaaagatttgttttcttttggatatgtacgcagtagtgggattgctgggtcaagtaggagttctaagttctttgaaaaatctccaaattgctttccacactggctgaactaatttacatttctacaaacagcgtgtaaatgttccattttctccacagccttgccagcgtctgttattgttttgactttttactaatagctgttctgactggtgtgagatagtaatttcattgtggttttgctttgcatttctcttatgtttagtgatgtcgaacatttcttcatgtttgttgaccacttgtatgtgttcttttgagaaatgtctgttcatgtcttttgcccagtttttaaatattttttaaaatttttttaaaatttattttattttattttatttgcttgttgagttgtttaagttccttatagattccggatattagaactctgtccaatgcatgcataatttgtgaatattttctctcattctgtagcttgtctgtttactctcttgttagtttcttttgctaagcagaagctctttagtttaattaggtctcacttgtcaattattgcattgttgcatttgcttctgaggacttagtcataaatttttcacaaggctgatgtccagaatggtgtttcctaggttttcttcttggattcttatagtttgaggtttaagtggtcattttaaaggttgaaagtggaatgcaaatttcataaaatcatgtgaccctattgcaagatcattttgagatcataaaagttatagagtcagattaggtagatttattgagaagggagaagcataataatgcaggctgtagtcaagatagtcaagttcaaatgcaagacctactgctttttagctgtgtgaaattggccgagttgcttaacctctctgataaagttctttgtaaagtgcctggcacaagtgcgaatcctatatttttgttattgttattataaagtaaagatcactataatttgtctgaaaatatgtaaaagtgaccatttgagttttatattctttcttttttgttttattatatagatactgatttggtccttgtaattggagctaatgacactgttaattcagcagctcaagaagatcccaactctattattgcaggcatgccagtccttgaggtctggaaatcaaagcaggtaaagtttcagacttgtatttcattctgataatcaaaggtcacttcaaatatacacacagaactttctttgatcatttgataagaaatgatgatgccttctaggaggccaggagtaagagcatgtttagggcccagtttcctatatccagcttctgtctgttctccggccaccagagaacctgagtgaatgccctaatcacaagtagaaccagatgagattatgtgggtggattaacacaatctgtaaccacagctgaaaaaagagctgtgagcttttgtaatgagtctggctaaattccagatcgagtcctgtgaagcagatggcttccctctgggaagtatcaatcgccttcatatgccaagatgagcatatttttttcacttaactttttgaaagggaatttataagttgttatagagtgtctagcagaaaggtgatttggaaatccaaacaataatgtggcataatgaagcaagcttcgctcatgtgtattcctcctgaaaaagctaattgctagattttagataactcaaaggcttgtaaattttcctctgcctcagcagtaggcacattttaccactactgagtcacctctgcatttaaaaaatcataacataatgtacatttccatttaatttcgtttctttttattgtaaatattggagtttaaaacttaatatttgtgatgaatgagtagacataaaatatatttgtttatgtgtgtatgaaaaattgtgtcagtagtcaatatttgagaatttgtagagtgcattactatactaacgctataagaagaagaatacatttgcactgcttctgttttttaatagattacatgtcctagtagaccatagaaagacttttcatttcattaagaaatgacttgatattcagcaggacagcaacatccataacacatgtcattgtaaatgtctataacatatcaatattatagattgacttacctcttccattttgatttataggaacattctgttagttatagctctgctattgtgagaagctggattgctctttgggcttttgttctagaactttctgatatactttaaagtcatagaaaagaataacattgttttcccactcaacctcatctgttttagaatttgtagtggaaacttatgcactaaacttgttttctttagcacattcatagaaagatgcttattttactgactagaaaatggtatacatggtctttatagagaagaagcactaagaagaaaataattgtaatcttatcactcagagataaattattaacatgactttttctctaatggatataagaataagggcacacttaagtattaaagttaatacaatgtaaacatatgttaaaaatatttcttgtgtatttttaaagtccctgcactaaagaattagtagtggtacatgccttgttcaaaggtagtgaagagcaatgtttgtttgcctaacatgtcctaggttggtctgttaaatacactctctcatttaatctctggttctcaggtgattgttatgaagaggtctttgggtgttggctatgctgcagtggacaatccaatcttctacaaacctaacacggccatgcttctaggtgatgccaagaaaacatgtgacgcgctccaggcgaaagttagagaatcctatcagaagtaaatattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggcaagtgatgtggcaattatctctggtgacaaaagagtaaaatcaaatatttctgcctgttacaaatatcaaggaagacctgctactatgaaatagatgacattaatctgtcttcactgtttataatacggatggattttttttcaaatcagtgtgtgttttgaggtcttatgtaattgatgacatttgagagaaatggtggctttttttagctacctctttgttcatttaagcaccagtaaagatcatgtcttttt

SEQ ID NO: 36253 - DNA, 293575 bp, Homo sapiens
gctccctcccctcctagctggcttcggcggggacggcggcggcggcggcgggcggggagggcgtgcgccggccgagaggtgtcggcggcgaggcaaaggaagtttcaagtggaaggtcgtccgtcggccggcgcgtcctcctgctctcctccgcagcatcatggcggagccgagcggctcgcccgtgcacgtccagcttccccagcaggcggccccggtgacagcggcggcggcggcggccccggcggccgcgacagcagcgccggccccggcagctcccgcggccccggccccggccccggccccggcggcacaggctgtcggctggcccatctgcagggacgcgtacgagctgcaggaggttatcggtcagtgcggcgggcgcggcggggccggcacaggccgggcgccgaggccgggcgggagggggcgcgggatgctgggctagcctgcatgcacgccctggaggcagagaggccggcttcggggcctactggcttcaacagttttttttttttttttttttttttttttaatttttaatgtatttgttcgttctatgagcgttggtgctgcaggaggcggcgcggcggatgtgactcgcactgcagacgagccgcatgctgcaaacttttatctcagggatcgccggggcggtggagcggaggaccaggcggcgccgccgcatcttcctccccccgcgtgccgggaccgcagcccgtggccggtggccacgcggacaggcagccgcgggtggggtgtggttgcgggggccccgccctgggtttccagggccccgggggccgcgtcctgggggactctgcgggcgcagccgctcctctgcctcccgtcgtgaccctctcgtcgtgggtaacggggccacgtagaagccgcggaggccccagtgcttttctgaggccggggaggatgctggcctctcttcctgacagccgccactccacgcccgccttgcagcccggctctccgcgccactcggcgcgcccgggtacccgcctccctccgtgccagggtgcgccgcctgccgcccagtccggctccccggggaaagcgggtgccctggcctcctgccctgcaccgggccgatgcttccctctgtttcaggccgagctgcaagagtgaaatccgaggctgccggtgatctgctctctgcctttcgttgccttctggccggctcacaaatatcaccttatcttacatttttaaatacctggcagagtcgcagggctcggcgttacttttccttgggccaagcacttgaagggccaggagatttgttttgtcccttgacttagaaccttccctattggatcatccagtttgagagtcttgtcacttagggaagcctccaggttaagtgggccctcagcgtctaaccttactgacgcagggatgggatgttgcctttccagaatcttggtatataagtacagcgatgaaaaaggagttcagaatatttatcttaagtattttttctaactttcacttcaaaaaattcttcacctccttttaaaaaaattaaaacagatataaaaatttcactaggtgtttaaatgagcctttatcacctgctattggggaataaaacagcatagacggaaatatatatataaatatatacataaaaatatgtgagaaaatgttgggcaggtccgtaacctaggatatatacaagcttcagataacctataataggcatctgtagacaaaattctttgaaaacccagatctttcataatttttgaccaaagactctaaagggatgagtcttcatgtcactgcctgaaatagcttcaggggcttctcaaagcctggaatattccatggaaacctctttaacctggcatataggccctgtaccctcaacctgcctgcctcctcccattgtctactcttcagtgattgcttcctgaatacaccgctgtcttccgcacatctggtcttccattctttgctgccttgcagaggctcttccctcctgtgagtgcccatctttgtgtactaaatctcactccgcttccaaggtgagtgtgaatattccttgaaaagccttctgcttctttcaaggcaaaatgccgtggtttcttctgcccctctttttacagacctcatagcatgtaacctcatagttgttatttgcgcaacaagatctgaaggcctgctgtgtcccaagcattgccccacttgctagcaatatagaaattaacaaaagtgatccctgccctaagttgttaggagacatagggaaaggatcctataggatgtgatgagtaagtactgggagagcccgaaggagggagtgactgccaggaaagagaaggaagcagagtatttcttagtagaggtcgtagttgagctgggttttaagtctgagtttgtaaggtgcttaattatttccactgttgccttcactaaccagctgtgaactctgacaggaagaggtgggccataaaagttgaataatggtatctgccacataattctccatagagtccataggattgggagaagttataatcaatttatatacctacttggtcaattattagggttaaaatacaaacgttgccttttgaaaacagtatttttttgtgaactaataaaatcttagtttaagttgagtgggattaatggcaggacttctttctgtttgcagtcccagcagtgttaattatggttggtcagtttagtggaaaaaaagaaatttacctgaggaatttgagaacaaaaacacctgcttattctaccctgacttttgcgcatttgcattgtgggaagggcttttctacatttaaagtttatctcatattttcccaactaaaagagaaagagttggcctgtgtggaggccctgttattgaaaaatcaaattgctggaataggtttttcgcaagggcttaatgtttataaggaattacaaacctgtttccatttagggtttaatgctagttgagagattaagactgaacttgtggttaagcacttttgcttaaacattacacgcagaagttagcagttcaaacactgaaccagtttcaacatgaatgccagttgacagcctttgcttctacccgccatacggcaggtgtcatatgatatgactccagcagtgtgaaccgtgaccagcagcaggaggctcagatgtgcctgaacagaaaaccaaaggaggcaccgtgttttaactttccagcatggcacgggcacggaggactttttcttcatttccttctgggcagagtttggtcccccaggattaagagagaataagtttactaaaatccaaacaaagcaggttcagttgtttgacttcagttttagaaaaataaacacaggattttgcaaacctaaaaataaagttttctctttattgtattgttgttcttgtgttttaaaacgtcagtggagaaattgtaatgctcttaggagtattctggttcataagtttattcatgacctggaaatgatgtaaaatcgatgggagggagctttatatttacagaggggttaaaaatgttggaaattattaaattccttcttccagacattgatatccttgtcttagtagatttcaaatatttctgtctttttggaggctttccgacctgtttatactcttcagccttgttaatctttgttccttacctctctaaagaaggaatttgggggtgagttgagcccccaaaagtaggtacccctacctttagaagtataaggggcacttaaagctatgccagttgaaaacttagtttatttgttgggggtgttaataatattacctagatttgctaaacagggaatgaaagtgaatcatataagtgtttacttggccatccgtaatggaatggagcagcctcaatgaacttctcattcaaagaattgtagtcattgaagtactaatttctgtatttgaattaggtgattccagcaatgttgttatctttgctgaatttcttctgagaaaccctagactcctgcctcagcaggagtttgtttgattttcttagggtttttgcaggatgcacctttctttatgtagttttatactagatttctcagcattgcttcacttttgtcccgggtggtcatttagaatgacctaaaagtaacaaattgccatcttagtcaacacgaagaatttgagttctagaatcctggacatggtttgacagagggttcctttgaatgctttatttctctcctgtgaggcattgtttatccattcaggtgcgttttactcaggtccaggtaatagcacatatggccaggtctttaaggagcaacagcctcttgtaaaatgagattgtaaatagccctgggcattcccactttgctctgtgctctcagagtttctgtggatttctatggtttgggggttagaattggtttttatagatatcctagaggcagtttgaggacagtggtaccttcgctggcgctagggtaagggagccggagcactgagtgtgttctgatctcccagacctttataccaggctgccttgctgctgcagtgggttctttgatcttgattagtttgtttgttgttgtttttaaaatactaaatgatgtctgaaatgctttgtctcaagacagggctttgattttcatttcatttcactttcttttttaataaatagaaaaatgtatatagaaatgttcttttgtattttgtatttttttttttttgataaagggtctcactctgtcacccaggctagagtgcagtggtgcaatcatacctcactgcagcctcgaactcttgggctcaagtgatcttcccacatcagcctcctgagtagctgggtctataggtgcaaaccatcatgcctgcctaattttttttttctttttttatttttaagaaatgggggtctcactatgttgcccaagctgctcttgaactcctccgctcagcgatgctccggccttggcttcccaatgtgttgggattacaggcgtgagccactgtgcctggcctctttatatatatatatatatatatatatatatatatatatttttttttttttttgtaagagtcttgctctgttgcctgggctagattgcagtggcgccatctcagttcactgcagcctctgcctcctaggtccaagcagttctcctgcctcagcctcccgagtagctagtattacaggcctggctaatttttgtattttttgatagaaacagggtttcaccatgttggccaggctggtcacaaactcctggtctgaagtaacccgcctgcctcagcctcccaagttgctgggattacagcgtgagtcactgtgcccggcctcttttgtattatttttattgtggtaaaatatacacaacaaaaattgtaccattttaaccgttcttaaagtgtgcaattcagtagcattaattatatttacaagataaatactcttttaaatgtgctgtcatggggctggggggagagatctcaagatctctcttgaaactgtggtaaagtgactgcaatcctttatttatgcatttgatttttaactagtgatattatgaattcttccctgacttttatggtttattgtatagtacattttgtgatggtgtttgaaaataagttgcagcagtgccggctctggagtctgacagcctggcctgtttcatgtcctgcaatggcggtcactgacgctgcgaccttgagcaaatgacttagatgtgtctgcactcagtttcctcattggtaacatagggatgataaaaatagggttgtgaggaatgagagaatgtaaagcactgagaatcgtgcctggcacacagcatgctttcaattagtcttagccataacttctatagacttcatttgctaatcagatgcaagttatcaggagagaacacagtcctatctttggcaggattctggagtggcttgaagatttctgtgctatgtttctagcagggaggaagtgggaaagagaggttgttccctattcccactcttgtgctgggctgctggaaggggcttacaaggggagaggcccctggggatctggcttccccttgcacctccactgctgtgggaggaaactgaagagacctgtggagctcctggcaatttggacagctcaggggtttaggtgccaaatggccctctgacaagtgatgagagcatcctgcgggaaggttgctgaagaggagcagcccattatgagagggctccgagaacaacctgctaggactgcacttttcctccacctctgagtttgcccggaggctgccatgctggcaggaaatgctgctgactaaaagaaacgctccctgtgtgtcccagccagtgcgaggacagaggccttcattttcagataaagtcatcaccattgcttccctgtctccttctttccctctttgcttttccctcagtttataaatattctcaagcctgtctcttatgtttaaatgacaaaagagaacaaaacaaaacactctccctacttctttctcctctggctactcggttatctcgtttcttcctttcactgctaaattgttggaaggaacctcccattccctctcagcccactgcagtctggcttctgccctttccctaagaaacccaagttactctctgaaatcactgtgactcttctgtggccagagccagtggacactgcagtccttttctctgctctctgcagggttaggtgccatctttcattctccttttggaaaggcatttgcttgagcttccatgccatgccttccttctggacttcctgtactcccttgcctgccccagatccacatctctgtctgtctgaagcttcaattaccacatcaaatgctgagggtcttcctgactgtataccagtgtttggactacctttttaatgtcttcgtttgaatgtttcacaggaacttcatacagttaaactcattgtctctccaccctggcctcagtcctaatcttgtttcttctatattcatcatctttagagccctcaagggcaaaacctgctggccatcctatactttcctgtctttgtccatctctcacatctgtttggtcaccaagtcctaaatactccacctccttgagatcttctttgatttgactctgactcttcatgtcagccaccactggtttagttcaggcccttatcgattcttatttggattattgtaataatttcctaaccaggttccttttttccattcttgtttctggctgtagtgtgcattgctaccagaaagatactgctataccaaaattcttgatcacgttgctcccaggctgaaatgcctttagtagctctcccgtcaccctcaagacttaatttgaagcacagtgtttaaggtcttttgggaattgtctcttgcctcccttttcagccacatcttgtaatttccagtctcaggacagactctccagccagtgggaaccttttgcagttgctgaaatgcctcttctaggcaagatttccctctgcttggaacaccattccaagacccttcccttccatttttcatctatgtagcaaagagctctgtcttttcttttaaatattgcccttattgaagtataatatgcatgtggaaaagtgtacatataaaaaatgtatatcttggtgcatgttcatgaattgaacacaccatgtaaccagcaccctgactgggcctctcttctcataccctgaacaagtgatttcttgtcacacaaacaatctctgcctctagagcccccctccccccttgcccttcaggctctgttgggtctttcgctccctggcagttgtcacactatctgcaaattgtattttccttgccagcctggctctagactgttaagtcttccttgaggacagggtctctcatctccctaccctgcatgtcataatagatatttaataaatgttttctggatgaagttctgagttttggggataaatactccttcctcaccttgtggaggaggaacattgcctgacgtctaaaaatttgcctcactggatcctgaggatttgatcttgcccgtggttaatgatggggtttatttagttgcgtttgggccaatcagcttaaagggctctgtagaaattagctcattaatcctcacagatcaagagtaagcactttgagtgcgtccacctgcctgtgttgtggaggtaggcaggcagaggcctggctctcctgaggtcttaggactgagaggtggcctttctggctggattaaaggacccagagctccctgccacagttctggcatccgtagacattgtagggtggagtggggaagtcccacactgcccttcaaaagctctagagctttcttttcttttgtatatcagtgatctctctctcttgctgttcatgtatttatatataacactcaccttgaagttctgtggagcctcttcctgtgtaggaatcagggctgctggagacgatcagggatgcaggtgaaacacaggagcagaattgcagaacaagtggctttcaaaggttgttaggatggcaggagttctatttttataacttataagggactgacatgataggatggctgtggtacctgctaagaccatagaaccgggtcattctaatagatgttataattcctttacagtgtactttttgggaaagtttttttttcctatttaaataaaattctccatgtaatcatgtgaagtcatacgttttcctctaggatagttgtgtttagattataccaaaacagctcttagttgaagtgattcaagtgtttcttttttccctatctgccatcaattggccaagtttttgatactagacaagaattcaatatattaattaaaaagtcatttcagacttggcttaactgaaaagcagaagagaaaaatcctttagagaatggattggcatactttatttctagagtcgatttagataaatactttggaatccgatgtgagtaaatgatatgtttcacatttcttctcacttgccaaacagttatttgagaataaactctggcttagctttaagaaacttcttggacattgaggattgagattaattgaccttttaaactgattgtgtattttgatatatgggaaaacattttaagatagaaatggtagagacctctacattcatattatccctgactttattttcaaacttcttccaggtaagtggcatttagtataactctcagaagcctagtattgggggtgctcatgtgattcttcccttaggtaaaaaatatacattttattgacatttatgggtttaggtttctaacttttagttaccactggagctatttgtcagaaaaaactagatggaaagtagaggtggatgactttctgccctgtgaatgatagatcttcattcagggagtattttggagccagtgacctgtgacagttgtgagacttctcataatcattctgtggatggttggggtcttagaagaagtaatgattttgttttgaactggttgcatcagtttgaaccagagtttgtactaagggtattccaactgctttatttcctactctgtttagtctggggattgaaaaaggattacattttgggtaggttggtgcctattgacctatcctgtgtagcttagattttaatttgaatcatctggttctctttctttctctcaggcaatgtcactatctctgtttgtttaattatggggtgactcaagaaagcaaaggaagaggagcagcagacggggtttcctggggaaggaatggcaggtcatggctggtttttataagtgagttcctaagtgagaagtggtacaagaatatagagagaattaggaaatttaattttagaagagaccaaaggaaaaaaaatccatcccagctgctttgtcttgtaactgaaaactctctaatggccaaagttgaagaaacttgcctatggtcccaaagtccttagaatcccaggctccaacccttcatgctaaaaactctcaataaattaggtattgatgggacgtatctcaaaataataagagctatctatgacagacccacagccaatatcatactgaatgggcaaaaactggaagcattccctttgaaaactggcacaagacagggatgcactctctcaccactcctattcaacatagtgttggaagttctggccagggcaatcaggcaggagaaggaaataaagggtattcagttaggaaaagaggaagtcaaattgtccctgtttgcagatgacatgactgtgtatctagaaaaccccattgtctcagcccaaaatctccttaagctgataggcaacttcagcaaagtctcaggatacaaaatcaatgtgcaaaaatcacaagcattcttatacaccaataacagacaaacagagagccaaatcatgagtgaactccatccacaattgcttcaaagagaataaaatacctaggaatccagcttacaagggatgtgaaggacctcttcaaggagaactacaaaccactgctcaatgaataaaagaggatacaaagaaatggaagaacattccatgctcatggataggaagaatcaatatcgtgaaaatggccatactgcccaaagtaatttatagattcaatgccatccccatcaagctaccaatgactttcttcacagaattggaaaaaactactttaaagttcatatggaaccaaaaagcccgcattgccaagtcaatcctaagacaaaagaacaaagctggaggcatcacactacctgacttcaaactatcctacaaggctacagtaaccaaaacagcatggtactggtaccaaaacagagatatagaccaatggaacagaacagagccctcagaaataatgccgcatatctacaaccatctgatctttgacaaacctgacaaaaacaagcaatggggaaatgattccctatttaataaatggtactgggaaaactggctagccatatgtagaaagctgaaactggatcccttccttacgccttatacgattaattcaagatggattaaagacttacatgttagacctaaaaccataaaaaccctagaagaaaacctaggcaataccattcaggacataggcatgggcaaggacttcatgtctaaaacaccaaaagcaatggcaacaaaagccaaaattgacaaatgggatgtaattaaactaaacagcttctgcacagcaaaagaaaccaccatcagagtgaacaggcaacctacagaatgggagaaaatttttgcaatctactcatctgacaaagggctaatatccagaatctacaatgaactccaacaaatttacaagaaaaaaacaaccccatcaaaaagtgggcgaaggatatgaacagacacttctcaaaagaagacatttatgcagccaaaagacacatgaaaaaatgctcatcatcgctggctatcagagaaatgcaaatgaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccattccattactgggtatatacccaaaggattataaatcattctgctataaagacacatgcacacgtatgtttattgtggcactattcacagtagcaaagacttggaaccaacccagatgtccaacaatgatagactggattaagaaaatgtggcacatatacaccatggaatactatgcagtcataaaaaaggatgagttcatgtcctttgtagggacatggatgaagctggaaaccatcattctcagcaaactattgcagggacaaaaaatcaaacaccgcatgttctcactcataggtgggaattgaacaatgagaacacatggacacaggaaggggaacatcacactctggggcctgttgtggggtggggggaggggggagggatagcattaggagaaatacctaatacctaatgttaaatgacgagttactgggcgcagcacaccaacatggcacatgtatacatatgtaacctgcacattgtacacatgtaccctaaaacttaaagtataataataattaaaaaaaaaaaaatcccaggctcgtgattctgccctaattcagtattttcttccacttatatcacattgtttccttgttggtggaaaggcagatgttagaaatattattgactcgggccggccgtggtggctcagggacgcctgtagtcccagcacttcaggaggctgagacaggcagatcccaaggtcaggagttcgagaccagccttgccaatatggtgaaaccccgtctctactaaaaatacagaatgattagctgggcatggtggcacatgcctgtaatcccagctactcgggaggctgaagcagaagaattgcctgaacccgagaagcggtggttgcagtgagccaagatcacgccgctgcactccagcctgggtaacagagtgagactctgtttcaaaaaaaaaaaaaaaattattgactcaataaattttaaggtactactaaaattttttttttttttgttagagatggaatcttactatgttgcccaggctagtctgaaactcctggtctcaagtgattctcctgccttggcctcccaaggtactgggactacaggcatgagccactgcatctggcctatgactcaatagagtaaaaatatgtctgaataaataaatagagtaaaaatatgtaggaatcagtaaaaatcttatgtctttaggggcattaaaatgatttttatttacttatatttatttcttcatcagggcatgtttatgtaacatgtaaccaggttatatgtaaatatacaatgtcttcatttcagccatcaccttttgcctggtctattacagtagattatgtttttaatctttggttataatctgtcagtgaggtggaggtgggtgtgtgttgtaaagtaaggtggaggaacaggaagttgagggttgaagaaaagtacgtgaaatagacatacaccatgactgatcattagttggagagaggtggtcccttatgcggggctgatattttataacaatcagagcagcagcagtgttcccagaagaaaggggctagcaccacactgtccagcttggtagccactaaccatatgtggctatttacatttaaattaattaagtaaagttaaagaaatagggtacagtccttcggttacactggccacatttcaagtgctcaataatgaactgtggctacgactgccttacaggctagtgcagatatagactgtttccctcatcacagaaagttacatggggtggtgctggatggtaatttctcggaaatgttcaaagactggctaaatactgttatgatggctgtaagtagtgtgaggccaccttttaataacatgcaaaggtattgccactgacttagtacaaaaaggagacaggcatcacctgatttttaaaaaatgttttgttttcactctgtacctatttgcaagctagtcaattcatctcttcagaagaagagtattcttgtgtgtggtgaaacagatacccctgtcgacttaggaaaatagttttgaaatataagtttttatcttactgacttacctcattttggaaatgttcttgtgatgactaaacacagattctgtccaaatgaaacccaatattttcagaaatatcataatgtgtcatatcttaaaaaagatcattttagagtcttttggttggatatcgtagtcagaatcacttcagtttgtcttatgttatgaagaagggactgattataaggtttaaaaaatgaaattacaaagaagttctgaaattaaccctaattaggaaaaatagtaccaaaattaatttcagtcacttaaacggtgaatttgaatcatagtccctcttttcctttgagttagaaacattttgggatttgagtgagtcaaggattaatagtttatcctaagttacagatcacaaagcaagtaaaacatcatttaagccagttccttaatagaaattctaactcagcaagcactatttgggtaggatacctgctcttttgggagaaggaattaatgactgaggggtgggaaaaaaatctgtgtagggagattaagtgggtttaattttgggcaactcaggaacagtgtgtactttctcacatttagtgtcccttgagtgaccggagctgtaacagagaatgttttactatgtaatccctttaaaatttttccttgtatatgccctttcaagtttctgaagtctgaaacccagtgcctgaccttaaacacaagttgttgtggaaacatttttaatgtggcacctttcctgaggagtcgggtggctgaaataggactagggaaaagtgtttctgtgtagtttcaaaatgtgatcattaggatgaacgtaagaatagtaatatttttggcataagtcaagatcggggctagagtgtttagtaaagtaaatacccatcagttgtttaaaaagtgacgatctctgatctctagggccaagagatgatgagcctctcagttcatctatagccgtttttgtgattgtcttcataaatgctgcaagactttctgaaggctataatttcatgtcctgttctttttttttttgagacagcatctcactctgtcgcccaggctggagtgcaatggcgcgatctcggctcgctgcaacctccgcctcctgggttcaagtgattctcctgcctcagcctcctgagtagctgggattacaggcacctgccactacgtccagctaattttttgtatttttagtagagacgggatttcaccatgttggccaggctggtctgaaactcctgacctcgtgatttgcctgcctcggcttcccaaagtgctgggattacaggagtgagccactgcgcctggccttcatgtcctgttccttaaagcccattggaaatagataatataggcagctttgtaacatatttttgcttaaacagtctttatggaaaaggaggataattgaagttccagtgactaggacaggtaaaagttacagttggatgctcgttttgttcgtctatcatattaaaaaatgaaattatttttagccatatgtagttgtttaaaattaaatatttccttgtcttttggagctacctggaagaaagggagtgacaaaaataggaaagatgatctttatgaggtatgactgaccttcaattaatcatatcagaatttttatgtacagaaagtgttctttccttcagggggatgtgtgggagggtgtccatttttactttatagctacattttatattaaatgaaaacttagatcttttgccgcaagcaggcttatgttgccatcggaagactatgtgaaaaacgtgacagcaagtgtgtgatttgtgactcctgtgtgcgtccctgcactctggtgatgtgatgagtgtaactgtggatcttaccaggggcactgtgtggtctctggaggtcctggagtctctgatgcctattattgtaaggagtgcaccatccaggagaatagagatggctgccaaagattgtcaatttgaggagctctaagacagatctcttctgtgaatgcaaaaaatatggctacaagaagaggtgattggtgggtggccccttcctccccccacatcaagctgctgcagctgccagaaaagatgcctactattaccagcagagagggagcggagcccagagcatcaccaggagtgcctgctagtatactggcactttgccacccctcctctcccttcacccagacacgtggtagggatggaaaaggattcttcacagagcactctggcacactgtatcagagaaaaattgatagattagttagtggtttttcttgaattcgagaagcaaagatctgttctccatattgatatgttctccctcaaccaagatcttctaaaaagaaataatattttagtcttctgcttgaggagttgactgtgaagctacacccagtgaaaaacatgttcttgcagcagctctggtggcagctgtccttgaggaaccttcggtgtgtggtgggaagctatcagaataagaaatgtagccatttaacacttaaccatttaacatcttttaacacttgtgctggtgtcatgttattttcctcctgagaaattggaaatcctttctgttgttattatgttaacaaaggtggtggttattttctggtaaaaaacaacagcagcaaaaaacttagccatttctgtcagtcctcctatgaagaaatgagactaattttctaaagtgacattaatttgcttttaaaatacttccaaaaatgttttaagcagtggtatttgtattggaataagtatgtaaccttacaaaatgactctttagcatgacagtgctgttagttgtttaccatcagttttgtttactattatttgtagtaaattctggatcactatttcatagaagtgataagactaggacttggttggagattacagtgagctgttggcatagaggtagggattgcaaaagtaaaagctgatggtagctgagaggagtctggtagggtggtgggtgggattctgtagtcaggtctgtgaagccagggagaaaatggacgggctcattccgaagcaaagactactacacagcagcaagagacctcaaacctgagcaggtctgagaaagggggagaataagaacttgggggcatttccaagtttacaatttgcaggacttgacaaggggtcaaggcaagggacttgatagggagagtgtaatttttccaaggatgattcagcagcagcctcttgttgaggtaggtgcctcttttgaagttttgccagcgagggtgcctctgacagactgaaaggctcggttctctcatcatggattctgacattccctgtatcagctatctatagctgtgtaacaaagcatcccaaaacttagtggcttaaggtaaggaccattgtacttgcttataatacaagttagcaatttgggtttggctgggctgggcatttcttcagtttggggtcagacccatggtcagcttggctggggctcttttaagatggtctcgctcgcgtgttgggtggttggtggtggctgttggctggccctcactttccactgatttctcatcctggaagaaacttgcctgtactttgtttcttggctgcagcagtgttctaagatagtgggagtggaagctgcaaagactcttgaggcctagtcttggaaagtcacacaatgccactctgccacattccttgggttaaagcatatcacaaggccagcccaaattcaaagggaaaggagatagatttttctactttttgggaggagtggtaaaatcccatggcagagggatatatatacaaggatggaaggaattcttattgccattttgcaaattccttgccacagcagctcaatttagcacaaggaagatgaatatacaatatttgtcattcatctaacttttgtttttcacacgtattaggggaaactattacccaactacccttgtgtacactctcgttgttatagtgccattgattataggtttcatagactaatttgctgtatgaactaagcatcagagtgatttttgctgtagaagtggcttcaggagtatatcgcttgctaaacaatctaaagatgttgattccaatgtgatatttgaaggggagggagggtgtgtgtgtgtaatgctgatccttttttagccttgaggtgttttattccagactgactttcttaaaactcaacaccacattaaaaacatagattgtttgcatgcatatgtatttgtttctcctgccacctacaagtcatgagctagatttgtcacagcccgaaaaataacacgttatctgtgcatcactcaatttaaaggtagatttttgcttaattaagaaagtttctttactttgaagtcaatccagcaatattttattccccgtttcacagtttttcaaaaagaattgctagcctattaggatagaaatattagaagctttgtaatagttactgacagaattacagagtttgcctctcttcattttttttagttcttgttttagttttttttgttttgtttagaaataatagaaggaagggagatgtactgttataccttttaatttttttttttttttgagtcagagtcttgctctgtcacccaggctggaatgcaatggtgcaatgtcagcttactgcaacctccgcctcctgggttcaagcagttctcctgcctcagcctctggagtagctgggattataaggcacctgccactacacctggctaatttttgtatttttagtagagatgggtttcaccatattggccaggctgatatcttggccaggctggtctcaaactcctgaccttgtgatccacccgccttgacctcccaaagtgttgatattacaggtgtgagccaccacgcctggcctattttaccttttattaagttgtaaagtctggtaaaagcccttatcataaaatattatatgcttttagatgtgggaagagggctaaatgttatctttataaagttagagatttaaaggctaagtgacctgtttattacattggaagacaggtctggacgtgggattagaattgtggagtgtccttcctgtggctggcctgagttcctttctcatgtaaggaaaaagcactgagaaaaagatgttatctggatctctgaggttattaaaaattccaagcttatttaattaatttatttatttgagatggagtttcactcttgtccaggctggagtgcaatggcgcaatctcggctcactgcaacctctgcctcctggttcaagtgattctcctgcctcagcctcccaagcagctgagattacaggcatgtaccaccacactaggctaattttgtatttttaatagagatggggtttcaccatgttggtcaggctggtctcaaacccctgacctcaggtgatctacctgcctcagcctcccaaagtgctgggattacaggtgtgagccgctgatcctggccctattttatacttctcaaatattatacaaacaataatataaggtcattgtagaaaatttatacaacactgatgagtgaaaaggaggaaaagtaacctcatcacccaaggctagacactgtttgaattttgatgtaggagtatatatttacatggcatagaactttaaaaaaaaaagtgtaaattgatatttttagaaatgtctaccttttttgtattcccagtactttcacatttaatttgttacggcaagtaaaataaactagtcttagattaatacttgcttggcaaaagtgattttatttcttgagattttggcatacactgacaagcatgccttatgattactgcaaagtgtgttaagtgtattttttctcatacttaaatgttttcagaatcacggaatacatctaatacaatctactcttaatgtctgtgttacgacttagatttcttaggagtatctattatactttgccttttgtcttctagatactattggatcaccttattctgatatttggcacttcgttgattggtagaaaaatcgttttggccaggcgcggtggctcacgcctgtaatcccagcactttgggaggctgaggagggcggatcattaggtcaggagatcaagaccatcctggctaacacggtgaaaccccatctctactaaaaatacaaaaaattagccgagagtggtggtgggtgcctgtagtctcagctactcgggaggctgaggcaggagaatggcgtgaacctgggaggtggagcttgcagtgagctgagattgtgccactgcactgtgagactccgtctcaaaaaaataaataaataaaaaagaaaaattgttttacaaaaagttctggcacagagagaagttaagagtcagtaactttcttactgtttgtggatgtgtttgaacagagtagtgacttttggatttcatagtgacttcgtatgaaacctagagctggcagcatgaggattttctagatgaattaaatatgtggtatctttttgtagaactagctgtgtgatttcatgcggatgtgggagaaatgaataggaatttaatttgatgatatgaatgttgaattttgtggtccgctaaattttaaggattttatagtatttagaacaaaaggacaaaatagcttttggcatgactagtctttattttaaatgttttttaagttacaaatgtataatatttatgaatcaagtagatgaaaataactcccaactttcattgcccagagatggcctgtatggccagtttggtgtgtatccttgcagatgtttttctatgtatacatctacataaagatttttccaaaatgtaataattttacatgtaatgtggaaactatacgtattgttctgcaatctgtaaattttacttcttcaaagtaatatatatatattacttgggtattttacttctgtatattttctgtaaatatttttagtaaagtatacacattataaatattcacagctgtcattccaggctatttctcagagatccacctcctttaaaaatgtgtattctggatccattgctattctatgagtgcagctgaatttacttaactaattcctttattgatgaacttattgattgtttccaagtttttattatttctgtgggatagatatccagaatttcagatggccagggccagtggtattgcatttatacttttgatagatactgtgacaatttcttccagttgtactaattaaatgctagcttatttgctcccattactgaccttaaaggtaagagggagttatagtgagaaggcatcttgccttattcccgatttgacccagacctaaaatatctaaggtcaggagaaaatggtgggtggggtgaggtggggtgggatggttgggtaattgtggattggaaaagaaaaaattattgcctcagtttagggaatgaaagttgcatcacttatggtctaaaaaatgaagtgtgatgaagtttatttgtatgagcaaatttatggaaagatttttttgagttggtgagcagtctggattatagaatataacaaaattggttaatctgccctttaggttgtaaggaacagggactcactaaaattacccaaataatggggcattctttataaaggtagatgtgggaatagggggacaggaatctcatccataatcctgggttttctagcatcctggaaaagttgagggtctcggtcttgggaattgcagtgaaatgtctgcatatggactgggaagtggataagacctcagcagcaggaaactttggatcctcactattctggatcctctaaccttagtgtaaccggccaatcagcatgtgtttgctttgctcatgcccacctgcttctctggctgtttttacctggctttcttacctactatctgtgcatgtcttctctgtcatgttgtttctacttagtcagaattttggctcactcatagctccttatggcccatccagcttctctcttctttccctgttagccgcaactatggctgctaattgctggattctgtctgtatttcccaatcttaatcccaaagattgagaatctagtttttagtgagtcccttcatagaacacctgactgccctaaactcagacaccctccttggagaagggtgtagcatcggaagttcctgcctgggaaggaatcacaagtgtggcaggcaccactagtgagtgttttatgtaatactgctcttaggtaagtaactggtcacgagacagagacgacatgtcaccctaatcagcaaaatgtaatcctgatctaatgtactttctttgttaaaatatatacttacaatgtgtttaaagagcagtttattgttttgagtcaataaataactttcttccctaggaagaacctcccttttcccttatggattgtaaattgggaaatcttatgcccagtttcagttataaattgtcttaaattctgaaataatgatacccgaatcctgagatatggtctggtcttgccttttctgctggatttaaagtactatgaagtagttcatcctgtttatgtaatggtgataaaattctgaaaaatatacctggaacctgatactctttgaggaactaactttcctatgtcaatagttttatcagcagtatcttctccatggatattgagaagagaatctgatcctcccaaattttatgatgtatttgatagttttatcagcagtatcttctccatggatattgagaagagaatctgatcctcccaaattttatgatgtatttggtggtccagtgtttcagagatgcaagtttgttaatatcccctggaagatttctcaaggttgctttgttttcctcttcagggtcactattaagtatccctttttgccctgttctcttcctcctgaaccccattctgcttcactttcaaaacgatggctagagggttggatatgtcagtgatcatgaactgctgagtcctaaactttggtgtctgtgtccctcagaacctcaaagggcagtttccctgtgactttttaaaatgagaaccatgttcatgaagtgctgtcttagtttcagatcacttgaaatgtaatctgatttgagagacagtgtttaagctcctgtttaccaaaaggctgttttgattatcattttgcaggaattgttgctgggtaaaagacaaatgaacaacgtactcagaagagatgaccaaatggtctgatttcatgttggaaagtttcttctggtggtcttgaatctgcgttttaatctccttaaaaatgcctttttagcacataagcaaaattaaacattattgttttattaaaaactatgcagtgctccttattagttaggagaaaaatctcttaaatcctttttgttaaggacatgtgtaatttaaggctttcattttgacagcctggtttcagctgacaggtatgttaatctctatttgattgctttggtgaggagttgaaaatcacctaatgcctggcttagtgtgcatttgtaaatgcgctttcttttggttttcatttcatgcaataatgaaatgaattttcctactgttattttgttatagattgatggtttatctgattaccagatttaaataaacagttgaaccatattccctttgactgtgtccccttgtttatccttttttatttgaatgctgatgggtctttataagcattattatcagcattattatcagtacatatgtatgtatagagcctcttcatcagttatcttgtagcataacagtgctctaagaaagcgatttttttttgttgtttgtttttttagtttaagaatttcctattcttttctattttggtttaattttcattactcttttctttctccccttataagtgccaaagtttatgtgaatatgattatatatagaacatatgactatatataatctttttttctttatgtttacagaggcaaaagatatatttgtgtgtttatgtgtgtaaagtaatacatgacaaaagaaaaattatgtgtaatagaagtaatttgactctggggagaattttactttacgttttgaggtagagcaacctttagaaaaaatattcaaagtcaaaattctgggagggattttttcctccataccaggaggacttttaaaagcaattcaagtcgaccagataattctgatacaaacatttatggagcacctgccgtgtgccaaggactggaccaattactcagcatacttgatgcctgatccgttcctcattcctgcgagggttggtgtgattatctcagttttacaaatcaggaggcagagacttggatgatcacagtcagttgaaggtcacgcagctggatctgaacctagtcttggctgtttgcaaagctgtcacccttgctatggtcctctttgcctccttcacttttgctgtctgacctagctttatgattctcaaacttcaggataagaagtgaattttcttttctttttttttttttttttttgagacggagtctcactctgtcacccagactggagtgcagtggcgcaatctcggctcaccacaacttctgcctcctggttcaagcaattctcctgcctcgccctcccgattagctgggattacagtcacgtgccaccacacccggctaattttttagtatttttagtaaagacggggtttcaccatgttggccaggctggtcttgaactcctgacctcaagtgatctgcctacctcagcctcccaaagtgctgagattataggcatgagccactgcgcctggccaagaagtgaatttctagaagaaaggtccctatttttaaagtagcatcacttggcaattggaggaaactccaggcagaccctggttcagagcccagtggcatcatttgctagctttatgactgagagccagttacttggctcagtgtgttttgtggtgtttcagcaccaaatctggaccatcatattggccttgcagagttgttttaaggattaaagatcatgaatgtgcaatacatagtaaatgacaatgatgattatgataatagcagttagcactgaggagttgttattacttgtcagctcctgggctaaatgcatttcatatttagctcatttagtccatacaacaacccaatggacaggtattattgtctctgttttacatggaaagaactcaatgtgtgaagtctcttgttatttatattttccacatcagtgtacccctccattggtatggctaattgagaattcactgactagagaattcaccgtcatgcaataaacattagttaagcacctcctatagggtaattaagatagataaaagttctcttttcaaaccttatattttagtgattactttttacctatttatcctctaactggttttatttgtggtgttaaaaagggattaatcttatggtagcttaagcacttaaacatttcacatacagggaaatcatgaatggaaatgcttactttccaaaccactttttatgtgtcttcaaaataattaatgctactacattggtaaaaaggctcagaagatatgaggagatgaggaatcttctaaaaataccctcttactactcctctcgttctttcttccatcacgcaaagtacctaaaaatgcaattgataaaataagttgcataaagcagcaatcctcatggcctgtcatctctccagagcaatgatggggacattgggaggtttagaaaagttattagcattaatgctaaagtgctgacagctgaaaagagcacagaggaattctggcagtggactcacagttcattatagcagggagagagattcctacaccaagtgaaaacactgtagggtttcgctcatgtgctccccaccattgaaaccagactggaatattcagccaaaacagcagactgttagatatttaaaagaaggaaaaaagatgcaaatacactactctataaacatgcctgtcatctcctggctggtagttcaaggtgccatgtgggttaggaaagttcttccttccatgttagagaaagtggaaccatacttattaaatcgtgaaacagggtgggaagagtggagagtctattctttagaaagacctgagcaactgtgagctggctgaaggtcagaatttaaatctccctgctttttcttgatcagacgatgggttaattatcctccatctctttattcggtctttgttgcgccccggtgagtgccagcgttgctacatcttggtgatccaaagaagaagtgccctttacggtctgaccttgaggaacttggaaagtctgcaggagagaaacaaacagggaaatgattataccctttgaggtaattctctggtggaggtgtggtaactaatcgttccatctccaaagtcctcctgtctttcatcagtagcatgttatatagttgtactgttgatcctaaaggaagggatttcaattccaacttggaaattccagccatctattctgtcttgcggactagttgtcttgttccaagatagactagtagtgagagacaggactaatgttttcatacaactttgccattttgttcataaaaagtttttgaagtttagtgctgcctatacaaacatggttaaatgctaacactaactgaatatacatgtaagtgtgtgtgtatttgttttttgacacgcatgtattaacataatgttctagcttgtatgtaaactctggactctgagacaatcaatgtttaaactttcaacaaggaagagaaataacgaaaagaaacaatggtttttttgttgtacccagcaactaaatttaccattgttctaagaactcgacaaatgaccacaggatgtgaacttaatcgagttgtgcctttgaacaaaggtatcctagtgatagtggaattttttacttcctatcatcctgctcatgtgttcacttgcctgcctcttctgaaatcaccagcagttcagtatgacttaaccaagtaaatgaattactgcaatgcaaaagaaaccaacccaggaaacaagaggaatcaccattatttctgactctgtctcctagatcagcattcgaagccaaagatttccaccttttactggaaaaatactaaatgaagtgactcacttttaaaaaaatgacccctgcaatgcagcctagatttaattgaaggtggtatttaactgaaagtgagggcagtgtgtataatcttaatctcctcagtcggacacatgttcaattgtattatctttgagaaaaagtttttattgcatccagaagaaactaagcaagcatttaatggagaactgttaggaaccaaaatttccctagaaatattgcctttgattttatggaatatttttcttgatgcaattgaaatgacttgcctttgattttgacatctcttttggcgttgactatacatgtcatctctttgggagaggagagctgtatccatgttagtcatctctttcacctatcagtgctctattaatcgctgctctgccaagtactttttacatgcacatctcatttaagattgatatcaagccaatgaagaaaatgaagccaaagatttaaaatatttgctagggtcaaattgagtttctcactctccagagtctgtaaatcccctcttaaccattatgctgtgctgcttagagtggttttctctttgccccaggagaactctcactagataaaccaacagcatattcagtacatgtgtgttgcttctcagcagagaagttctcagctttgttgggcatttgttgctgttgcgaattgagttgtttagtttcctttcattattggcacatgcttgtgatcccagcacttcggaggctgaggcaggaggattgcttgaggtcagcagtttaagaccagcctaggcaacatagtgagacctttatctctatttataaatgtatatattattcacattaaaatttgttaaagaacaactttgattatcatcattattcaaatactcaagcaaaggaaggctctccatctctttccttggacagtacctcatagcataccattatgtttcaaggtgcattctatagtaagatgagcagataatgcttggatgataaagtttaaagtaaacttgtaaatcaaaatttgcaaaaaaaaaaaaaaaagcaagaaaagtaggttaaaggaacttgacgtctcctttttaatatcaaggtaacttgtcagggcctggaaggcatctatcaagttgtgaacactgtctcgtctttttaaatggtgattctaataaatggcttttttagtttctaaacctggaccattagacaacactgagattggtaggagagcaattgtgagaccagagttttgttgcattgagaggagtgcttgcttgccccagaccacttggagaaaaagtcaggaatgggttagatatgttttctttttctttagctaagggcatctgtctgactggcattgggtttggacagtagagggatagaggagacctacacacaactctctatgatttagtaggaggcaaggaagtaaaagaagtcacagaaaagcctccttctccctgaggaagtggacagagatagagacctcttccgtccagggtaggaagtccccatagtgcctgacttatctgtattctgctaggcttttgagcaataaattgagagttaagtgtatgtggaaagtatctgaacacaccgaaaatatctgaagattttttttttttttgaaacaagagtctcactctgtcacccaggctggagtgcagtggctcaatcttggctcactgcaacctccacctcctgagttcaagcgattctcctgcctcagcctcccgagtagctgggattacaggcatgagccaccgcgcctgaccctctgcctactttttagagtgctatcatctcactttttcttccttaatatacaaattatgtgaatctttcaaggttccacctaaatgcccaccccaaattcttgattcatatgattcttagggaaaatgacctgtagctgtgtaatgtagcagcttgggcataattatagcttatttcgtctggtagctttttaagttcctgaagaataaaaagcatgcctgtcctgagttttatgtagtaagatttaacacggttcgtaccactagttgggagctggttgttatttgttgaatggatgcatgaacttctgtcaatcttttgattctcctaatagctttctctgtgtttaattgaggctttccccacgtctttttcagagtctagagcttttggaatctgcttttatttcttaacacttgatttttttgggggtggaggaggagtgtattctgtgttcttctgtttgttctctatggctggaattacttttggaaagatgtgacactgtttcgattttgtctctgagcctttttactcagacaaaatcacaggagtttctctcaggacagtcatgttctttaggtgacttggcccttgctctagcaagcctaccttggttgagcgtttggctaggagaagtgggagagcagttgacgcaaataccgctgtcctatgacctgaccctggtatgcatggtgctgtgccctacggtcactatttttgatgataggactttgtccagtcagcttagcggaaaagatcatacatgttgaacactgcgaaagtgaactttcccaagatattcttttggggaattttctgagcttttgtggttctttacaagttacttgtctaatttgtacattcacctctgctgtcccatgggccttggcaagtgacagctgcagtgccgatgtttcagagtagagaagctttgttagagtgtggggttatctgggaactctcttccaatttatgtggtctagttctgtttaaattctttctccattacaattccctttagcaaaagttatgccagtaatttccatttattgcctccttaatgatgacatggtgttaaaagatgtttatatgatcctacatatcttagtactttcaaaataaagagacttttagtgatttactgctaggaggctatttctgtctaaatcatgataacatggacgtgatcttagaattagtagttatgcttttttcttcctcccctccataggagactatgtttctagggctggctttgactattaaatatgtctacagtcagtcctccatgtccatggcttctgcatttgtggattcagttaaatgtagattgaaaatacttggaaaaaaatggatgattgcatctgtactgaacatgtacagactttttttcttgccattatttcctaaatgttatagtataacatctgtttacatagcatttactttgtcttaggtattactctagacatgattaaagtatacaggaagatatgcataggttatatgcaaatactacatcattttatacagggttcttgagcatccatgaattttggtaccaatcccccacgaatactgaggggcaactgtatatcttttttcttttgtgggaagtggggccaaggatcggataatctgtgatcctcacataaaaatattctgaaatgtcagtttatatgattctttgatttttccagatctatatttctgtggtataggaaggtaataaaggttacgataaagaaacagagtattccccgtcctgcatccggatactggcctttttctgattgatagaaattggggttttctaattcatgctgaatctgaatctcctcctccaataatgaaggtccataggaaattctaccaggtggatctgtaatggaacatgttccctgtgtgacttaaggaattcagactcattactttctaggcacccttggtggaatgttcttcaataacatgggagagtgggatgcttttgaagacacaggtagagctgcagagaaacacgtaatcactgattttcgtgttgtgagtttattcacatcataggataatggcttgtggaaatacaaccctggcaggtctgagcagtcttcttttcccaacagagcatgtctgcttctgctgagaacctaggactagagctcaccatattccaaccagcgcccctctgggctcctgggctggcttttaaaaaagccttgttcctagcgggttggttgggtaaagcttcctggtatgggaaaggggcaggtatgcaggtagtcaccaagctggggagtgcctggcacagagccggtgaccaagacctctcaggagatgaaagtccgctgctgttcatgagatcatccatgcctaagaggtgtggcggtggcattagccttggctttagaaagttgaaagcacacgaataatgtcttcttttgaaggtggcttataacaacgtttctttgcctaaaaactcgtatttctgtcaggtttgctcaagctgaggatggcgatttgccacttcattagatgactcacgtcactgaaaaaagacatttagccccttctcctggactgtccaaacctaggaatttcctgcaggaatgccaaggagatcttcaaacagccaaacacaacttttgccttggtgtgcaggcgtgcttctgtttctgtcaaaataaattaggctgctaagtcgtaaattaggaaaatattttgctacttgtgtttcttatttagcaagtagaataaatagctggcctcaaaacaaaacaaaaacccaaaccaacctcaagtcgattgacagaagatgattctgcctttgccaagagtgaggacgtaccttctctgggagacaggaagccttcatctgtctccctctgatttgactcagtccttaccttccatgtacctctggtcaggtcaccttgcccatttctcccattgcccttcatattgggttggggtttgcaggcctaaggaggaagcacgggaggcctatccatatctgaactctgtttcctgtctctcttccaccaatgtgaggtttctcctcacattgcttttacccaatacatgaaagatttcctttgtcaagcttattggaatgccctgtgggagggatgctatgcaaaaacataaatgtattgcataactgcccagtccttagagatgctagagcatccttggcaccttcacagaccccactctctggtcagtccctagagagcagggtgaggtgcacttgagaggtggctttgtcctctaccccagtaccatggtccatggtgatgacctttatcccagctctgataaaaggctattttaggttttctaaaatacagttcctcacctagcccagaaaggaatatttccattttttccccctttcctcttgtctgattatttccagctgctgttcctttacacgtcagatttgtttctcctgtgtcaccttgaggcaactgacattcgtgactaattattagaaagggcagccttttagtttattttgatgaaaaagtctcagagaactctgttagatacactgtatttgagcaggtgacatgttgatgtttgggatttgggaaacagatccagcaaaagtagagtttttagcatggtagctggaggagtcagaaggtccaaggagagcttcatgaacttatttattgctaacgccctgtgtattctctgaactaattccaggcttttaaacttaataccaaacagccaggccaggtggtcacggggcttacggaagggtcatcttggagcaaagaaccacacaatgaactcttatccagctaacgttttttttctcccctgtaaaatcaaattaaatcaacctcagtttggaggatgtggaaatggggggagagtatgattggagtcctggccatttggtaatgccagtggtttgtgggagcagtctggctatgaaggatgcataaaaaacaactctacaatttaaacttatttcagaaaagggctttttgtttggcacacactgttgcaagccatttttgatccttcattgtgaaaccttcattcgttggcatattatataaggtcagcgcaaatacggtgttgaaaacacatggatcatggtacatccctagagctgtaaaagagactgataaaagatggtatgtactaacatgaagagagctccaagagatatactactgggtaaaaacagcaaatgacaaaatgaagaatagagttgctaccaaaaaggggcagcaaaccaatacactcttttggatttccagtgtagaggaaaatcttacctcagttcgtggcacacagttatcagtggtctgggcaggacctttttcagaattaccctgtacaacattatttcttgactttcttttatccttattcccttactcgtgcctttcccccttagtcaaccttttgaatatttatgtatatcctttgtatatattcttgtaaaacatgttattattttacatgcttctttttctgaggtgtaatccacataacataaaattatccatttaagattaacaattcagtggcatttagtacattcacgacgttgtttaaccatcacctctgtctagttccaaaacatttccaccattccccataccatgaaacagttactttccattttcccttctcccagcccctggcgaccacctgttctggatatacgtcatatccagaatacaaatggaattaaacagtatgtgatttacctattctggatacactatccagaatataaatggaattaaacaatatgtgatctttcgcatgcatgtattttcaaatcaatctttattgagatctaatttacgtagataaaatgtacccactttttagtggaccttgtgttttttttttgttgttgttgttgttatttttgacatctttcacatttgcttacagcaaccccactaggcaggcaccgtcatcaccctgttctgcagatgaggcttgaggctcagggatgccgagtgacttgcctgggattgcatgacagcttaggatgtggaggtgggcaggctggctctagagtccatgctgctccaccactgttgtccaccggcctctcaggtcttcacgtgggcgatttcagagcctgcctttttccacacaacattatactgtttatcaggttgataaaaagtggctatagaatattctactattcgtatataccataattgaactacttagcctttgatggatttttaggatgtttctaatttttgtttgtcagaaaccatattgaaaggaacattaaggattaaagaaaattctaaagtcatatatattcattatagaaatatgagcaagcaaggaaaataagctaaaaacatataaacattccccccaaggttaactgctctatgcagtttttcacatggtgttccagtttgtcttacacttttttttttttttttttttaaatatggctggcttttgtcacccaggctaagctggagtgcagtggtgtgatcttggctcactgcaacctccacctcctgggctcaggtgatcctcccacctcagcctcccgagtagctgggaatacaggcacacatcacgatgcccgcctaatgtttttgttttttgtagagacagggttttgctattttgcccaggctggtcctctatatatttttttttaataggaaaaaagcacttgagaaaggacgatatcataaatgaagttttgtaatagaaagtttatagtatactgtgaacatctttttatctaacaatagtgaatatttactaagtgcttaacacatgacagggactattttcatgttttaccctactcatggcaatcatttgaggtatgtggttattatggcagatgagatttgtgtgtttttaaatctacacaaatagttttgtgctctagcacttagtatttctcactttctaaattcagcgctatgttcttatgattaatccatctatctaccttgttagacatttgctgtcaccatgggtttccttatctcttcttgcaactcccagtttccacacacagcgttgcagggaacatctgtgaacatgcactcatggatctgtgggtcgagtcactgggagacacatccaacaggatgaatggatcatgggatatttatgtacttaatatgactaaatattggcagaggcagattctcctccataatggctatcctggagtctatactcttctgctttatcttttttgtggtttcaaggatgtatgtataaatggctaggaaaaaggaccagaaagagatataccaaaccagtaacactgggaacatttacaaggaacccaggagggagaggatgatcggaggacccttaggctgtactggtcatgatatgatgtgttgtaaggacagtgtcttcacgtgtaacttactattataatttactgtttacaaaaaaggtctgaaatgtgacctttacctgaagtttacagggctatgctatgaacacatttcaagttgtgaatgcctggtttaaggttagtcatggagcatggaatgagttcttctttgcaacttagtgctctttgaggcatgctctaaacagttatcaggttataccagtgagcccttttcagacatttaactgaggtttttcacatctcacatggctcagagaggttgagtaattttcccaggagcacagggtcaggagagttggccaaggcaatgtggagaggtgggtcagaacagacaacttcatgaatgaaggcttgttcaggagggcttattggtctgtacttaaggttagggaggaagtcggtgctctttccctgcaggtgagatggggaggaaacattctcaagaacagtaagtttcagtagcttccttacgcaaacactccactgaacgaatatattcgtctggtctgtttgttaagcacaaggtattcagataatctttgcctgacaagctgcttttgtttctgtaaaaggaaggtaacaggaaggtcttcaatttacgactcaagctttcttctttcacctcttctaaagtgagagaaacaaaggttctggatgactggatgagatattttttaaaggtgccattcaggttccttttgggtattagtttcaactgagatgtctcattctttctgtggaactaaaacgaataatgatcagtaagtcatttttgaaagtaactgtgacagagtggggcagttaaccaccacctctccattcccagcagctggtatgcacaccctgattatggtatagacttagttaataagagaaccagtgagtgtttgtgtcagaattttgctttcagaaccaggcataggaatttatacatgaacgccctgtgcagaaagaggaggtgtttgcacacagctacactgacagattattttccactcttgcacagtgactagtacagattcctctcatgagctcctcagagacgtaagacagggcgttgatgatgctttatcaagtagacagtatgtttgctacccacaactaagtaaaattaaaatataagaataaattggaaggcagatgcagatataaagtcccatctttaaggcaggaatacttcctatcatcaaatattacccagaactcactggtttagaggttgaaggcacaaagcatggttgagaaggctgaactcctggcctgtctcttcacagggttggtgaactctggtaaactctagaacagaaatgacccttataaacaggtgcacatatgtggtgagtacctgatgaatgtgtgctgaccaataaataattactactacttcctcttgactcatgtgtttgaaatgaagaacagtcactctagttgcagtctatacttgtgtggagcagggaagttgagcaatacatccatatttagtaacactcttgagatgagatagatggggtgggagagataacagtcattctttgccttttgggtggatctaagttaaaatatttttattgtctagatttatagctaattaataattttttttgccctagaatattgagggtgcaagattttaaagttggatttagaggaactgaagtttcagtttgttcattgtgattacgtaaatagagaaaacggactaatacgttatactttctctttttaaccatataatgactactcaccattgaaattttgatgagcattttttttgccttatttcagagaaagacaagtgaaattataattaagttgtatattattttgtgtagattgtctcttctctagtgttcctgctgaaaacaaagaggagattaaagattttcctgttcagattttaaatccgttattcaaagtttgaggctgggcgcagtggctcacgtctgtaatttcagcacttagggaggctgaggtgagaggatcatttgaggtcgggggtttgagaccagcctggctgacatggcaaaaccacatctgtactaaaaatataaaaattagccgggtgtggtggcaggtgcctgtggtcccagttcctagggaggctgaggcaggagaatcgcttgaacccaggaggcggaggttgcagggagctaagatcatgccactgcactcctgcctggacgacagagcaagacttcgtctcaaaacaaaacaaaacaacaaagtttgatagtttgcttaactaatgggagtaggtgtcttgatgtgtgtgcagcttgtatgatccagtaactgataatgaagtttgcaacatctctaagttagaaattttaatgaaaccacaacatattttctttcatagcaattctctgagccagcatttcaagaaggggtgggaaaaaaatggtgataaatgacctttgaggtgaacttttgatatttgcattgcaattctttgggtttacacttttaatttttaaaattgcaggtgatatttgtgaaaagtgtcagtttccaatatgttcacagtagtgatagtatgactcaaaagaagtaagcacatatatgcctattttatcaatggatgtcttcagagttggtgtgccatttttgcagcatgggtgagaattgaggtttttctaattacatgagtttctttcttccttccttccttccttccttccttccttccttccttccttccttcctttctttcctttctttcctattttttttttttttttgagatagagtctcactttgtcacccaagctggaatgtaatggtgatcttggctcattgcaacctctgcctcccaggctcaagcaattctcttgcttcagcctcctggatagctgggattatagacgcctgccaccacgcctgattagtttttgtatttttaatagagactgggtttcaccatgttggccaggctggtctcgaactcctgaccttaagtgatctgcctgcctcggcctcccaaactgttgggattacaggcgtgagcctccgcacccagcctaattacattagtttctttcttttcgtttgtttctgagacagagttttgctcttgtcgccccaggctggagtgcagtggtgcgatctcggctcactccaacctctgcctcctgggttcaagtgattcttctgccccagccaaccgagtaagtagctgggattacgggcatgtgccaccgtgcccggctaattttgtatttttagtagagatggggtttctccatgttggtcaggctagtctcaaactcctgacctcaggggatctgcccacctccgcctcccaaagtgctgggattacaggcgtgagccaccgcgccaggccttacattagtttcttatagtaagagaaaggtttcaaagttatatatatctaagaatacacctaccttcatagttgagcttttttccccaaaatacatgtttttctggtggtctctgtattttccatcactttaaaaaaatctaacttattaaaagttatttgattttgcttaagactttcatcatcatcagtaaaaatttatgagactgcttctgtgcatttgcttcctacgggcctaggggtgcaaaggaaaggggtagaatctaagattctagggttaaccaaaatcgaaggtttgtaggcttctctgaatttaggtggaagaaggtggagaatgtgattctgggtggtattgtgctatccttgggatagccactaagcttgttctaccagtcaggctgggctgagctatggtatggtagcaaacaaccccacatcacaggagattagcacaacacaagtgtatttcttgctcttgcacttccctgtgactgtgggagatatcttaagtcagctgtccttcctgcagcaactcagtcagcttcagtcttgtggctccatcctctgttatctctagcagcaggaggggaagagtcatgggagcactgctcaggggcttccccgcctcagtgatggagaggtgctcatcattgctcacatttcactggccagaacaagtcacgtggtcctgcctatttcagggtagtgcagtgcttttgtgctcaagaaggagacatttgtaagccctagtaatgtctatcacacgtgtctaaatgagaattggaatcttggagaagacattggaactagagatgagaatgtgaaagatgttatgtacagaaaagaaaatggtggagtggattcataagggaaagcacataattacggagggtacagttttccataatggtgtctctgcatgtatctttattcacaacccaagcaatatgctaccctggactaaaaatataaggatagtcgtagccactgtcagaaaagtcagaaagtttctgttggttctgttgttgatttgtgtgctatgtggacattgtctgcctccaaaagtgtactttcacttgatcattttagggttatatagtccaataggttagcagatccttaaatcttgttggtgacaggttgtattggccagagcttaggtgataagctggtgaaaatgcctaattttaaatctcaatgggattaggagagagtttatatatcttcttatacatattaaacattatgaggacactttctattacgttttttctcaggagtgttcattacatgaccttgacattggaatgtatgaccatatttctgctcctatccccagaacatctccggagaaggagcctgctgagtcaaataatgagccagtttctgtgggttttactgccttggttcttcctctctgatcttgcctttcccactactgttcttccttctcagctattcttccagtttactcttccctccacttttgcttattaaggtgtggactttgggagtagaccgacctcagttgggatctcattcctgtgattagctctttgacgttggaaaaatcactgtccaaacctcactgtccttatctgtaacacgaggctaaatacttgtaatttatgcaaaaacaacagacacggtacctggtatgtttttattgctcagtaaattttagttaaccattagcatcattgtcatgttcatttcaaggctcatctcaaataattttttcatgatagctttaaaattttttttgtatttcaccaaggctgtggatatgatttactccatggaactcagaaatcactttatatctcctctgacatttcgtattctttgtgtgtgaatatacttgagtacatcccatagggcagtggatatcctttcttcattgctgtatcttctgcattgccttcatttaggtggtgcaaataatatgtactcaaagttgaattgagtcaaaatgagacataagggtggaggcctatcgtatatttataaagcagtccacctggttgagtgaattctcataagctggaaatataactaccctcggaatagtattcagttacttccctcgttagggtgtgtgtatgtttctcagtgtttatgtaattgaaactgtaatgcaacaacaaaaaaggagaattaaagaaataataaaaataatgcaaatgttataaaagacagtcactatcatagggtagcagtttaccagaactcagaggagaccttagtgtgatcttggtcatttatactgctgaaaaggtagctttcatatctttatgctcagctgcttgcaaggttcacaactttaggattggttctgcatgtgtaaagctatgcctgataaggcaaaagaggggtataaatgaatctcacctgaaattggagtcttgtacagtgaatgggtttacctggagttgtgttcatattgtgaacccagcttgttttaatggaggtttccattagtcttcctgcctgtgttctcagggtattataagaagcatgaagatgtgtgtgagctttctcttccttaatcacttgaaattgatcactgtctttgaataccggacccgtaaaaatacccttttaagaagtccttattttttcatttctttaattctctgccagaagtgagtggaatattgggtgtctgttttctagatccataacaccataaaatgttaaaggatgtactatgctgagaaaagtactcccattttatatttagggattatgtgatctgcccaaagtcacacagggaatcaagagtctagatctcagccgggcgtggtggctcatgcctgtaatcccagcactttgggaggccgaggcaggcagatcacctgagctcgggagttggaaccagcctggccaacatggcaaaaccccgtctctaataaaaataacgaaaattagctgggtgtggtggcggacgcttgtaatcccaatgacttgggaggctgaggcaggagaatcacttgaatccaggaggcgcaggttgcggtgagctgagatcgcgccattgcactccagcctgggcaacaagaaagaaaccccgtctcaaaaaaaaaaaaaaagaaagaaaagaaaaagagtctggatcttgtttctgctgcaacacttgactcatcaggtgtttttctgtgcttgtgctagaaaggtaggaattgtactgtatgcactggatgtggatagatatgccagctgtgggcctatgtggaggcaaaaggaggccctcatgaggacattgctgtcagcgattgtggtaactacagagaatatgctatgctttggtggtagaccagatgaatattataggactagtagagttatatgaattgggggctttgatttgaaaatctgtttaaagggaactgattgctaaaacacatttcgttgtttttcttgccttaattgccaagataagggattataggattgtgttctactgagacactttttcaaaaatttgccactaagggagttgaattcatatacaaaaaattcgttataatgtattataattgatataattttctttatttttaaattattttttattttgttgagacagggtcttgccatcttgcccaggttggagtgtaccatcatggcttactgcagccttgaactcctgggctcaagctattctcccaccttagcctcccgagtacttgagactacagagacgtgccaccacacccggctaattttattttattttttgtagagttgaggtcttgctatactgaccaggctggtcttgaactcctggcctcaagcaatccccgtccctccccaccttcctcagcctcccaaagtgttgggattataggcatgagccactgtgccagcccatatataaaataattttccatagcaagtaatttagatttggcttcagaaattttatttttttaagatttaatattataaagtaattttttagttgcaattcaatatatgctcattgaagaaaaattggaaaatacagaaaaggacaaagaagaaagtaaaagtcactcatagtggtatcttcaaaagataaccacacttaatattttggtgtttcctgtatactcacaaatttgcaattaagttgtacataatgttttataactggttttaatttaatatattattcattttctcattctaaaatgaatgcagtgttatttaaaaattgctttcaacattttcattaaaaattttcaaacatgcagcaaagttaaaattggtactgaatacccatctctccatcacctatattctaccattaatatttaccatacttgctttatcacttacctgttcatctctccaccccctctattcatccattgatccatcttgtttgtttttccgtacatttcaaagtaaatttcaatgcagtgtattatgtttaaccaagctggtttgccttcttaattgtttttggtttacaccagtatacaaaggaattcgtattctctgaggatatacaactgacagcccagggaacttgcggagagtattttgttgggtgtagtgaaaaaggacatccagggatttaaaatttgccttggaatagagttaaatgtatgcattattagcatttgagatagcacaaaagaaccattaaaaacgatcatctcctttttacctgctgttatgcctaattcagactctagcatggggacaaggaaaatctttagagggaaagaaaaagctgcagaaagaaaatcatactttctgtagctttcctcactgctagagacctcaatgcttggtaggttgtgaacatggattgacttgttggcaggaaaagcacttcagaatcgtttcctccagcctaccagtgggacagttcagtcctaaatgtcctgtggatccaggtcttgccttccctgggcaggggttgagggactgttggtctcgtctgtaacttgactcttgtttctgatgtggctagatttcccgccagtttaccgggtcttcctatgtgaatgacagattctttcctttgtattggcaatggttggtggaggatggggagtgaggtggtgggataaccttggtgggctgaggaaacccgtgcttgtatctctctaccacctccttttaaaggtgccttaaggtgcctgtcccacggggtgcggcaaggtagggtgacctcgctttatgtgcagttcccagcatagcaccttgtgtatttaggcatttagtaaatgtcccttgacaagtagactgtccctgttaaaccctcagaatccctgtagttgttctactttgccagctagcacctggtgcctttcacaaacatttcaagaacacatatccattcttcaaaccttataatcttaactgtgttttcaagtggctggaggcccttaagatagaggagcctctgtgtttttccccctttcttttcccatgtttcacattccagggtgttcagtctcagtatcacgtcaacaccattttaagtgataagacgactcagctctggctgggtgcggtggctcacgcctgtaatcccagcacttcgggaggccgaggtgggtggatcacctgaggtcaagagttcaagaccagcctgaccagtatggtgaaaccccgtctctactaaaaatacaaaaaattagtggggcacggtggctggctcctgtagtcccagctacttgggaggctgagacaggagaattgcttgaacccaggaggcggaggttgcagagagccgagattgtaccactgtactccagcctgggtgacagagcgagactccgtctcaaaaaaaacaagactcatctctgacgctggtgacaactctgacatgttctttctcgtaaactctaccttggataaagcaccttcctaggagtgggtgtctgtggagccccaactttatatgaccaaggcaaaatgatcctgttttttttttcttttgtcttcatcttttcttttttttcttttcctgagggcagttgattcttggacattttaggcagattattttgtttttggataatccatgttcttccatgtttccttcaggcagttttagttctccatgactgagctagccaggaccttaatgggtcgaaaggatgtctggttcttcctttaccccactcccctttctctttcttctttcaggcagaacccctctaactcttagagctgtggtcctcagctgagggagattttttcctctcttccctgagcctctgaaacagtttccagtgtctggagacatttttggttactgcgcctggggagatgtggggaaatgctacggccggggatgctctaaacatcttcaggacacaggacagtacctcacaacgaagaattatcctgctcaaaatgtccgtattgccaaggtggagaaacgctgttctactgatagaggtgctctgttgaaagtcttcctgtcaatagcattctgtaacctccatggcagcattgcactcatcagtatatctgacttgagtcctgcatgcttccgtttgttgctcttaagggcaaatggaaatgcacacttaccatactctgcatatgatcatactctcccagcttcgtctcagttcacttttaaaatttattgttttacagcctctttactctctttttttttttaatctctctagatgtttcccagattcttcacatattatgtttctgaagttgtagtgatccaatccaggcacagcattctagcagtttggtcgctgctgcaaatgagggaagtcgttatctttgggctggggttggacagagcatcatgaccaaccatctgtaaatgaccacttggaaagcaagaagcagttatgtctcctgcttgttagagggagtcatgtggaagtaaaactttttcatgtcagagagacctggaaacaaatctttcttctgccacttaagaaaagtgtgactttgggccttagttttctcagacataaaatggggttaaaatacttcatagggttgtcaggagtataaagtgaatgtgtctgtactaacaataagtagcacgtgtaagaagggactttgtgttttactgtactgtagccatgatttctgttggagaaaatagaactctgggaaatataaaagtatagtttgaatttgatgatggtttttcaaatgttactgtgcagaagagttcctgggagcttgttatacttgtatgtcctcaggttgcatccctagacattctgtttaggaagtttggctgagtctgggaatttgtctttgtcacagtaacccagttggttctgatgcaggtggtccacagataacacttggagaaatcctggccttatggcaaccaggtgagcatgtagcgggggcggggggcccaaacttctcaggaagccccagctctggctcgttgttttctgtttctctgggctcactgacagagaataatctttcagagctctttcaagcaggacaaagctgttctttgttcttgcttttaatgacaactagagatatctttttattggattgtctccttcaacattattttgactcagtgtcctaagaagtcttttgggaaccagcttaggaactcagggtagagaaatctccttgttcattggctgagggaattgtgacttggggtgaggaagggcagattagaaggggggtggttttgattctcagtgggtcttggaagggtttgggaaccagaagtgaaacatggacaggatccctcctagctctaaactgaattcctttaggaatgggatgaaaaatggccgcattccttctactcgtaaattatttgtgtctagtttatctcttctttcattgaattatgcctggcaatctataatattgactgctttgtgattttaaggagtttctttttgcagctgtggtttgaggggtgtgaggccggctcactgacccatgatggccagagcttgctagctcctgaaatgaatgtttgtaatttcctgacatagggacaaaataaatggcccaggcctgcccataaatatgcatcagtgcttctctatgctgggtctgcgtgtgttctcagaggtctttttctgtgggacatgctctacccacacctttctgccagacacagtgtctcactgccagctatggtttggcctctgcagcgtgggctgcgaatttaaatatttaaaaagaaaatctcggaaggaatgtcccatcatatacttaataaatgaaagtgtgaggcagaaattaaaagtccactggggagtgtagttggaaaatgtaaaccatatgagatgtgcctttaagtttgaactccttgttggcaattttctgccatgagaacttcctttaaagtcctgtcggttgaatttaatgagttctaagctgtgaatgtaaaccttagatgaaaaatgtgaacccaagagctaggttgttctgggttgctgatttttccacccctgcatttaagatgtctgtcaaataagtcttaatgtacctgagttaataataggagagtgttctgtctgatgatgatgggcccctgagcccattggcaggtggacatttctgtggatttcataaaaataaaactaaagaccatataattctttataaactgaaacaaaaataaaaggtaaacatgtaatggttaaatggtagtgaaaaatgagaacgtgtttaacagaatagatttttaagttcccattttattttattttattttattttattttatttttatgttttgagacagagtcttgctctgttttccgggctggagtacagtggtatgatcttggctcactgcaacctctgcctcctgggttcaaatgattctggtgcctcagcctcccaagtagctggggttacaggcgcatgccaccacacctggctaattttttattttttttttgtatttttagtagagatggggtttcaccatgctgggcaggctggtcttgaactcctggtttcaagcaatccacctgcctcagcctcccaaagtgccgggattacagttgtgagtcaccatgcccagcttaagtttcaattttaactggtggtttccttggaatatgcttcttttagggttgagagtgaagtaagatagtagtttggcatgtatgtgtcttgtaagtttaacatgtgctgatccctaaggctaatttcatggcatttaatatttccatggatgtttttgtctaatcacttgtagcctttcccacttctcatgtgttttgatgtataggttttgatgcatagattttaaaagttcatgaaaatgttactttaatgttcaagagagagatgaaggtgaatggaaaacggaacattattttgttggccctatttggtcgttctggttgttgctggagaatgtgagagattgtgattcaggtcagatactatcttgaaatcaaatatgagttccagatactcttatagcccagatatttccaaggctttgctgacagcttaattatttcaagcaatatttgatatggctgaagacctgttgtccaaagaatttggatgtccttttgggctcttttttcaatgtaagccttgccaaaagatgtgaaaatctgcatgatataaatgttaaaatatggccaggcacggtggctcacgcctgtaatcccagcactttgggaggccgaggtgggcggatcacaaggtcaggagtttgagaccagcctgatcaacatggtgaaaccccatctctactaaaaacacaaaaattatctgggcatggtggcgtgtacctgtaatcccagctactcggcagaatcgcttgaacctgggaggcaaaggttgcagtgagccgagatcgtgccactgcactccagtctcggcaacagagcgagactctgtctaaaaaaaaaaaaaaagttaaaatgcaggattaccatttccttttacaaagtaatttatcatggaattccttgaagtggcacttcttcatttgtggctgtgaaatacaatacaattttgcaaaacggaacgattttcccagttttccaggatggagtccagtttctcctgtgatggtgtctgatctgtagatagccacttctttttcttcttcagatgttctcctaaaaggttgggactcacaagttaaggttagcaaataaaaacagggaagaggtgacgtgctgctccagggctgtttgagagttttcatagagaggctgctgctggctttcttttgaagctgagagcaaacctcagtggttttaactcatgtccaccgaatggtgtaaccccctaagtatcagggtataaggaatataggatttttcttttaaacattgcctgaagcctgaagtccctgaagtttcccccgccccctgctacttttagcattgcccaaaatatgatgccatagcaaagaatctggagacatcagggaaactagcaattgcataagcatatgaaacttttttagatgtgcattgaggagttagcaagccttaaatgaaagacacctttagaatacagtatagtaatctctctccctgtaacatttatctgtatgttatagatacagttctaaatttactcaaacatgtttaaatatagtaaactgttttaatgtaaaactatccttaaaacattcagagagttgtctcttgaagtgtttcatctgtgaactcttgccaatagcacttagccacctagtgaacgctgagtcttcggtgaagttacagtgccagtgagtgcgatgtgctaagtccgtatttgatttgccagtgaggacaaatgcacacactctggtttagatcagattcagatgatttcctactgtgctttgtgagtcattctagtatcatcggtaaataattcctaaatgaaatctatgtatttcttttttacttacttggtttgggaagtcattgacaggtgaatgattttataagcaatgtaatgagttgccaaatacagcaacttttcaagacacttgaagcttacaaacttgacattgttttagctttaatttacaccaaagttgggttatccctttgaaattattacacgacactgagataaaggagaattcaagtgctcagtcttagggctaaaggcaatagtttatggttcaataacatgttgggatgttgtaccacaattaatgtaattattaataggttttagaaacatgaaaagtgtttgggatctaattctcagtgacaatagcagaattgaaagtcataattattgtggctataaatgtgagtacattcatgtgcgtgtgtgtgtgagtaaagattgcaatggaatatgcatcatgaaaatagttgtgtttgggcaatgggatttctaatacactttttgtcattgttgtttagtatggttttatttttactttttttttttttttgagaccgagtttcgttctttttgcccaggctggagtgcaatggcacagtctcggctcactgcaccctctacctcctgggttcaagtgattctcctgcctcagcctcccaagtagatgggattacaggcacccaccaccatgcctggctaatttttttgtatttttagtagagatggggtttcaccatgttggccagggtggtctcaaactcctgacctcaggtgatccggccacctcagcctcccaaagtgctgggattataggcgtgagccattgcacccggccagtatggtttaattttaaggaacaagttaattatttcttttaagcctttacaaggaaaagagttgaatggaaagaatacctacaaatactggatatttacatatatattttttagttatacgtaacatttctttataggagggcagtacacatgaatacccatttgtaagatatgattggacagttctttccccctgaaatatctcttgaacacgggaagcacatccccttctcggtttttattgttccttcccctgcatcctcacctttccttgttcctgatgttggaggttcattgaacaatatgtggcagcccaaggctttcaaattgacatctggagcatgcagaacatattctggtggatgggccagcgttggcagggttttgggatggatgaagagagaatcaaggccgttcattataaaatggagtgatgattatagtagaggcgattacatatttagtttcagtacctaaatgtctcctcctttgcatttaacttccaatctatcagcaagtcctgtggctctacgtccaaatatattctcaaatccagccactttacttttcttcttctctactttgtctaccctagcacttgccatcgttgattcatgcccgcacatctacagcaacaccctaaccaaccaggctgtacctgctcttgccctgcgtacaatcttatctacacatagcagccagagtgacctttgtacaatgtaagccagattctgtaattctttttttcaaaatcctttcaagtactcaccttggtctacaggactctttccctgtgtttagtctcctgccaacctgccctaccacctctttccacctgcctcttagctgacaagcaccagccacaccgcctctgtctttgtcccttgagctctccaaaatcattcctatctgaggccttttgcccattctgcccttcatcttagaatgctcagatctttgcatggtcagccccttcttgtcagcccacatgtcaccacctgagagaggcttctctgaccaccatagctcaagtattgtccccaccaattttatttttgtcatagcacttaactgcaatctgaaattatttatattacccttttgtttttgagacagagtcttgctctggagtgcagtggcatgatcacaggtcactgcaacctctgcctcccaggttcaagcaattcttctgcctcagcctcccgagtagctgggattacaggcatccgccctgctaattttttgtatttttagtagagatggtgtttcaccatgttggccagcctggtcttgaactcctgacctcaggtgattcacctgccttggcctcccaaagtgttgggattacaggcgtgagccaccacacccagccatttatgatacttttaaatccatatcccctctcacataaaatgtaaactctaggaaggcagatactttttgctctgagcttcctttctaccaccctaaatagcacatggcacatactagaagctcagtgaaatatgttcaatgaataaacaagtacatattcttcattattgtataagatgtaaattgaggtgatcatgtaaaccataaattgaggttctttgcaactccaagatgctattattcttagtgtgaggaaggcattattataattattacacataatcagtagatcatatgtgtttgataacttcttcccactccattcccatttatagtggtagaattcctttcttttccttttgaaatggagttttgctcttgtagcccaggctggagtgcaatggcacgatcttggcccactgcaatctccacctcccaggttcaagcaattctcctgcctcagcctcctgagtagctgggattacaggtgcccgccaccacgcccatctaattttttgatttttagtagagatggggttttgccgtgttggccaggctggtcttgaactcttgacctcagatgatctaccgacctaggcctcccaaagtgctgagattacaggcgtgagccacctcgcgcagccaatagtggtggaattcttacactcatccattcattttgttcttgttactctaactggatggacttaagtattatctttggcatgtaacaaagtgcagctaattgacacatcaggagactgaatctgaatcttgggcttttacagagattgaatctgaattttgggcttttacaggattttcattcacatactgtagctagtaggctacagcttagagttgaaactgaaaagcatggccaccgaccagactttattaaattatgtgcaggagaattatcttggcagcaaatgaggcaaatcaatggtaggtaactgtcttttggtggttttgttttgagacatggtcttgctctgttgcccaggctggagtgcagtagtgccatcgtggctcactgcaacctcaacttcctctgctcaagcgatcttcccaccacagccttccaagtagctaggactacaggtatgtgccaccatgcctggctaatttttaaaaaaatttttgtagggacggggtctcattttgttgcccaggttatgtcttctgagagcttagagttcaaggtagaaacgttagttacaaaaacttgacaacgaggatgtaaaagtgaatacttcctatcatttgagtaaatgaaagagagaggaaataaagttcatctgtgaaaatgtcaatttaacaagtacttatcaatctaatcagcctagctgttaaaaaaaatgtaaatgtgtgactgtaagtcatattgaaactcatgctatcctaagcagctctccatctgcttctagttagagatgtgtcatacatctggggacctgggcctcaggctgtgagaaagtagtttcaattaaaaaaaaatcaatacttgtaatggttttctttcttataatatcatacccagtaacttgtataggttgaatttagacatagcgttataaagtttatttaatgtgagtatgactggaggctcaacataagttgaataacagcagatgcaatcagctggctgttcagctttgtttatatctttacccataatgtttgaggtatcatgttttctggattaataaaataaatttccagataaataaagtccaacttaatttcaatcctaggtgctggaaataattctgaaatttaattatgccttttgtactaatttctactaaggcaggcattgtcttcatctttcatttgtagtgaatttctgaaaaacccacccaaaaaatcaaataataaacttacatgttatgagatagagggaatgttgaatcttcatttttgtttttattttactttaattaattaatttattttgagacagagtctcgctctgttgcccaggctggagtgcagtggcgtgatcttggctcactgcaacctctgccacccaagttcaagctatcctcccacctctgccttccgagtagctgagactacatgcctgcaccaccatgcccagctaatttttatttttattttttaaatagagaaggggtttcgctgtattggccaggctggtcttgaactcctgacctcaagtgatctgcctatgtcggcctcccaaagtgctgggattacaggcatgagtcaccatgctaggccaaatcttcatttttgaatagcccgatacacatacatttctgaattattattctttggagtggatctgctccttctggatgcttgcaggcgggcgagacccttcccaggctggcacctcttgtccctgacgccgaggcatctgcttttccatgcttcaggcctcctttccagttccttccatgggggcctaaactcgattcccttattaggaggtgggtacctggccccttcggggataatttagggaagttatgccacctctgtggtagcaactgaaaatgtggcccatggaccagcagcatcacatcacctgggagcttgagaaatgtagaactcacccctgtcccatactaactaaataagcagcaacgttttcacagcacacccaggtgaccccttatgttgtctccacatctttcaatacaacacagtcctaacaccttagcccccagccccaagactaaaggagggaacattctcctgatgtcctgccaggctccgactcatggtattgtgggatctgcaggtggcctcacttaggagaaactctgggctggggctgctggaggcagagactgcagcatgctgctgcttccaccggggcttagcaggtgttccgtgcccttcatgagggtgtgtcttaattttccttctcactcaatgatgttctcagggccccctggggttgccaagacactacttttcactgcactggacatttgtgttcctgcagttcatatcctcttcccttgtggctcttattttctgccatcatttcagactatggcatcatgcccctgcttctgggtgagagtgtgtgaagaggggggggaagaaagacttctaccatgcagagggtgacctgacttcctgtattgcggttgtaacttaggggagggcctcaggttgtcagaggagacaggaaaagcaggagttgggttataagtgcaatcagatcagatggagaggtggcattaaagtgaatggattttcttttcctgtgtctgtgagtaggagaaatgttttagttacttgctgcatcatggatgtggtagccagggctgtttaattacctgagaagtggggctaattgtatcttgaacagtgagtcactttcctggcataattttctctgtgcccaatcattaccatataaaagttgtcagtgctggccctcaggagtgggatttgaagagggggagttaataggaagctggcaggagctggggctgagtgggagcagagctgatcatagggaggtggggataagtaggcattttctcaaaaggttgtagtggacctggttctagtttctatccaggtgtctgggataatcatgtggatactattaaccccaacagtcaacattcttaaacacttcagtgctagacatgtacatttatattattatgtttacatgtatagtctcatttaatatttacagccctcctgtgaggtagatgctattgtcatttgctttttgtagttgagcaatgtgcagcacaaagcacacaggcagcttgcccaaggtcacatagcttggggctgtgtgaccccagaccctccgtcataaccatcactcaatccagaggaagtagattggggtggaatggggcggggtttggaagtacagagcgaacatttggaaagtgttagatattaaaaaggatcattttaggaattgtgttggaaaacagagtgaaatgagaattttttttaaaagcctggctattgttaatggagcttggaaaagccccagcctcgttttggagctggtggaggtcacactcccttggctccttattaagtgatttcctctaagctccagatagaccttcctagaatctgcttgtggtgttgggttggtagtcagcagacctccttccatgttccttctttgcctgctgtttccctgttaagctgtgctaatgggggcaccaggggaattttggaaggctgtgggagggagaagggacacgcttcatcctgttactgttcttgtcagcttagcttcggaaagggtctttccctctgccagcagtaattggtttccatttccagtttccttctacctcttggaaccagccttctgccaccccctgagatgccatcccagtcccatgtagaccttcagaaagggctcctcttcagaggtcagggtcccagccctgtaggtttcctcctaaatgtgtagagtctaataaccaccacctcctccctttgattcctacagtcctacccaaggagtggtagctgcttcctacagcttcctgagtaactctgtgttaactcagtcttttccattctctagcacctgttgaataagatcttcgtattaaataatatgtcgcattacatagtattgcttccattttcctaatagcccctgactgattaatttccccaagccctagaatcctggcagaggtgtggcgagagaagctgatacgcaggagggaaccatggttctcaaatctaaggatatgggtgaattgctggagaagctaattaaaaatgcagatcccaggcctccagttgcaataattgtgattcagtaggttggatatagggttaagaatctgctttttaaacagacatcttaggtgtggctgatgtgtagttatcctcttcctgaggctttgaaaaaatctgcccaaatccagggccttcccatggggttatttcttgactctggagttgttgtactggggcttagacaccaattttaattttttttttaatagggcgtgggctgtggatatgctaataacctttgattgaagaccaccaaggttgtatattgcccctggaggctgaaaatccaacccttgtttagcccacaagctctgatgcaattagctgggagaaaagagcttttccccctaactgggtattgtccgcatgtcaggccctgcactccgttgtgtccagtcagagggattcctttttcttatttatgcaaagccaacgtgcctatagctgcaaagaagggatggagtgggactgacctggaagtagggactggctcttctttttgcatatagagcccttcccatttacaggtggcttgaggttgaagcagtaaggaatcagaagccaccaccacagcatacatattcaaaccaggacacttgtaccttttggccttgccagtgggtgtatccgtttatctgtgtgaatagcaatagacatttctttgtggaatgtttggcttccatttggttgatttaatcagtaaaacaagtgggttttgctgggaggaggtggattatcccttccaagcagaacaggaagtttttcaatattgccagatcgttggactttgagtttgcaaggggcaaggacttcaaagtgaccgtttactgactataaaagtcagattttctcagtaggagtgtgtccagcctacagtctagtgcctgatgcagtgttccctgacatggatttcgagggctgttgtgggctcttgtctgtccttcatgttgttgtttagtgttttatatcatctctctatgctcacatagaattattgaagtccctagtttatattagcctgccacatttcgtgtggccctacatgctgagcaggggccagtggattcagtttttaaaaattgaaattcggatggaacattgctcttcagaatgagctctcctatgagacctgactttagaattgaactggatgttctgcaaatcagaaatgcctgaaggcagagagcttccctaggcttgtaccttgaagttaactgccacatcccccacagcgacctacttagagataacacattgaataaaagtgctcttccccttgctttaggttatatagcccaccagtgcctgctctcctctgtgtagacccaacttggagcacacttcatctgccttgtctgcgggtgtcttccccagtgatgggctgatgtgcattccattcacttagccaacactcttggaggcctcctgtgttccaggcagtggtctaggtggaagggctgattctaggaataataaggccggaggagaccgctccacaagcatagaagttctaggatgaagtaggtagagagtccctgcctgggaatggtgaggaagtgactaattctccttggagttgttcaagaaggcaacatctcaagtgattcattcatagctcgggcgggctaggttgtcctctcttctccctatactccccatcaaaatgaagtaatctttttcttagaaggtaaacagcttcactggcagaaaggttatgtgttttactccaggttgcatgttcgtcagtatcaatattaggactaaaatcctacaatagagttttagctttgaggggctgaacctctgagtaagtgctcttgagactaatgttaaatgtttttgtttttaaaccggcaagcaatcatattcccagagtgatttttaaaaaaatctattgtgtttcattaagaaaacaaaaatgcctagaagtaaattccaatattaatcacgttgaattagatggaaattagagtctgttcttttttagctccttatctcacacatgcaactcatctggtggctggcttgaatttacctagactccctaataataattttcattatcattgaaagttattacaatttgtaaattattgaatttctttatattaggtatcccaatccacatactttctgcatgttcagtaagtgtactcactgtagggttttttggttttttttttttagttgttgcttgagatgtagcttgtggtccaaggtgagtttatttacatttgttctggtttgattcctctatctcttttaaaatcagaaccgaggactactttttatttttctgtggtattatcagatggttcttgatgagttatatacaagggctgcttgtcttcagtgaggtctgagacctctaaatgttttaacaggctttctcaggtaagatagtttatccaggtcagtggtgaaacataagtacatttcactgagtggccattaatccacctcatcctactgtttgctttttatgttttattttattttatttttttggtaagctctaaatcttttccagcaaccctggaaggaggctctactaacttgttcttttgacggaggcagaaggacaaaactcagtcagcttggtggtgacacaagccaggtcacttaggagggtcaccagtttgtagctgccttgagaaacatggtcttgctgcactgggctcagtggaggcgagcggtttgtgcactgttatccagacaggccagcaggagcgtctgttttataaattaatgcgtagggcaagttgtgtgtgtctcaccgttactgttctttgtctttgacttgagattgcactgtgcacatgttcctgccacatagaatgcaccagatgacagaagagtcgctgtgataaggttttctttctgtgtgaaatagtaagacgaggaggatggtgacatgtagcagatcagtttgggtcaatgtgccgagtacatgctcatactatgttgaaccatatgacatgaacatttttgatgtagaaaaatggcaatttcacacttgcaatctaataacttaaaattgggaccatcaagtaaggaagggtgtacctttgaaggcgaatagcagtaacacactcaggcaaaataacagtctgtggtgaacttttattagactcacaatgcttttataattaaaaaattaatcgtcaaccttattgtattaggagatgtcacacagaattctggattttcagcctttctgcaaaattctgactgtcttgctatgccaggtcagcgatctcagatggtgacagttggctgaagcagagtggcacttgtactcctgtagagctcacatgtgtgtccattcatccaagtcctctcctggccagcttctggtcctcatgtgactgactggcctgtgggctttgaggttggacacatgatataaatagagctcaaagagtaagctggggaaaggcaggattagaataaatcagctgaaccaaagccatttgttttgtttactatccatcaccagctagcacctctaaaaagaaagcctgagcccactcttgactctgttcactggcaaaggacagctgagcatacttaaggagttcttgcacgtgctaagagatggtcaaactcttattaaagttccaactttgtgcttctcatttaaatataatatggtgattagaacttccttccaggggccataactaatgttacaggctaatgtgatgccttgaaaaaaatcttgccatttatgggaaggggttactggacaattgacgtcttaactttaacgtaaagttcttatggactaatttttttaaaaaaagtactagatgtttattgctacattgttcatatggggatgaaaactagaaataaaggggatactcatcaacagaaggagggctgaataaattatggtacattaatactatgaaatattacgtggtattaaaatgacagattgacaggacaccagttgacctggggggatttccctaaggagcaacgctagctaagatttaattagtgcttactatgtgctaggcacagtttcaaagactttttttgtgttaactcatttaatcctcacaaccactctatgagtgaagtagcattattgccgtcttaccaatgaggaaactgaggcatgaagaagttaggcaagtcatccaagcataagcagttagtatgtggcaggtctgggatatgaacccatgcaatctggattgacatagatattttaaaataacttttttttttttttgagatggagtctcactctgtcacccaggctggagtgcagtggcatgatctcagctcactgcagcctctaccttccgggttcaagtgattctcccacctcaccctcctgagtagctgggattacaggtatgcaccaccatgcctggctaatttttgtatttttagtagagacggggtttcaccatgctggtcaggctggtctcaaattcctgaccttgtgatccacctgccttggcctcccaaagtgctgggattacaggcgtgagccaccatgcccggccttaaaataactttttaaggttagatatcaaagtgcattatacatgacaatctttgctatggaatattaattcacagctgtttctgaattggattgtctcttatattttaaactcttatgctcatcatgctgtatcagactttagaaatcatttagttctttggtttccaaatttagctctcctagcctctcttttaaaccagtctaatcttcctggtgctaagcaaaatgaaactcagttctgaccctgagccactttgccctcttttcccttgggtgccatataaacagtagatatagtttacctcctttatgtcacagatggagaaatgagtcccagagagagagcctaacatttattgagttgatgttttccagggatgtgaaatatattatgttatgaagccttaaaggtgtattttattatgcccattaaggaagctgaagtctagatagcagttaggtcgaaagtcacagagggaatcaataccacgtttggatagaatccctgtctaaccttcttttcaaggctcctactaacctaagatgggaactacaatgagctaccagaggcctttcagttgaatcttgccatttgctgttgacttaatcaggaagcttctaagaacttctaattagtatggcattctctgccataggtgttagtggaagaatgactttgaacagacatttcaaggcttttgtattagtctgcttgggctgttgtaacaaaataccatatactgagtggcttaaacaacagaaatgtatttctcacagttctggagtctaggaagtccagatcaatgtgctgaccacttcagtttctggtgggctctcttgctggcttgtaaacaggcaccttcttgctgtgtcctcataggacagagagggaaagtaagctctctattgtctctttttgtaaggatactaatcctattggaccagggctctgtcctgatgacctcatttaacctttaattacctccataaaggtggtaattatctgttaactgtatctctaaatatagtcacattggggattagggcttcaacaaagacattttaggggaacacagacattcagtccacaacagcattttagtcatccctgttaacttctgcagaggaagtgatcctatagaaggatttattccacttgaagcaggaatggtcacctttggcactttattatctagtgaactgcctgctacatggcagggatttaattactgtttgttgatgaattaatataagcaaatatctttttgctgcttttttgcactaaatgcactaaatgcaaagaggaagttattgtgtgagtcatgggagtagggactttgaacatactgttgaaactgcatttgacaatagtagtgatttttgcaaaataaacactgtagtttttcatgttaatttcacatagaccttagtgaaatgcaaagttagaatactaaattatatttccatgaaatatttctttggataactgaaagtataaaatgcaggtatgcagtgttctggttatttaccttaataccagcagcagtacagaggggaaaatgagaagaggtgtcaactaaaggaaaaatctgcatcatggtaatgaacgtgagcaatctcttacctctgattgccattgacataatcactatctaaaacttccaagtagctgttcttagtcgggaattacttagcaaaagtgaattgagatagagtgacttaaaagagtgaactgaaaagatttaaagccgtgcccacttaacttgtgcatatgtgcatacaggccataatcctattgaatgatttattgcacttgaaataggagtcaggaataaaatgagaaattcataaaatgttaagaactcttattccaaaaggggtgcatgatacttcattgaaaatatgctactaatgttaatgagtcatgtgtcagtatcatatattgttcaaaataaatacaaggtgctgttcagcatagtaattgctcttattttatttcatgttgctaacacttgtccagttcctgtatttacaagccccacattttttagcttcctcttaaactaatcagcaaagtgcataaaaacccttaaagcaagacagtgttggtattatttctaaatgtcctttagaattatgcagttaggtcacctcctttcctttcaaagcatggatttactctaatcctgggaatcctaatctagtactagcagactccaaacttttgatcatcacttacagtaaaacatgtcatactaaagcttgggcgtaagtgaaacaaaagtttcataaagcagtttttacccttattacattctgatgcttcccttaaacaatgctggcctccacccagttagttgattttgtgaccagtggatcctcactggcaatttgaaaaaacaccaacctggtgcacagaatggtagataaggaataagtatgcctagggtcctaatcctgtgctttccaattgctgcaggaaacacatccctatccttcacaggaccctgttttctcattcataaagtgagggggtgggttggacttgatgctctctaaggtgcctttccacctttaactttgttcttggtctcttctatagttgaagggaaatctttggatttagagtagaatctcccaaactgtttaatgaatggttaaatccatccatgttgtgacaatgatctcaggtcacaaagcttcataattctgtctagagatgagaagtagccagtcgttccttagttagctgtagttgtaaagcagtaacaattctctagctgtaaagctttaataaaagatttttctcaccacctacccctccatgtttttagaattcttattttttgttccttggaggttaggagacttttactgtcaaggacttaactatgagaggtatctctgtattacatacgcttgttttgtcctttctgggaattaatttattctttcctgtttttgaaactccttgatttgtgaatgttctggaatgtagattaaggatggagaagctgagctggggggagatttattgcaggtagagctgaggatggtttcccaccagcagctaaagatgttagttgatttctctgctgggtaccaggcccagtgctaaccagctgcatagcactttctctgtggctcccttcagtgatagtgtcttgttccggagactggaaaatatactttgctatcagcagactttttgtattgtttggctctgccatctggaccattctggattgaacccagtgggctgtgatctgcagggccagtgaagccaaactagtgggacctggagtagcagccaatggggtagcagctgatggatgagcagtgagattagggagaggaaggccctttgaagcaacctgtccatagcactctcttcccaaacagctctagcaaatgaggctcatgcagaccctggtctgggttgtttgtcttctgttgaaccatataggatggaagaaagttttttcctagcaaggccaaaacaagtgaggaagggaagcatgtgctctggcttgtgggaagtagaacaaaagcacacatctcggagtctggcaggcgtgatgctgatactggctcaggtacttattagctctatgtgaccttgggcaagttttctgagtcccggttttctcccatgtaaaatgaggctagtaataaaaatgtacaggctcataaggagtcaagtgtctactgtgcagtgggtggtcagtatgtgtgtgtggattttctttcccagtgaacacaaattgggcttccctggaatggtagtctttaagttggagacctgggtttggaggagtagggtgatctgctggggttgccaagtcgggggccaaacctgatgatgaggccacagggcggaagaaagggcagagcttcacccctgtaaacacccatttgggcccttccttggggtgggaaagccctgattcgcactagaaatgtcatgcctttctatcacataaattaggaaggctaatactgatctctcttgttgccaaatactcccctgctttcccttttatgatgctatttgatgaatcatttgagaagtattacctgaagaaaaactttagggagaaagattgtcacctctgaccacctttgcacaatcctgagtgcaggctgtttctgttgttggctatcttgcagtggtagaggatttatgtgatgagaatggcagttttggtgttatttgcagaattgagatgccttaacctgaaaacctttttgcccctatggagtataaagccgattaggagttcttttgtgctctgccgcaaatcattacatgtctacattttgctcttataaaatatggataatgacatgactctgtctcttaggagtctgagtgcattagctaatgatcatgaaaccttagaaatagaaaatttatatgaatgtcaagagcttttgtaattacacatttgcatcattttgcttggcatccttgaaagttgtgctttcaacatgagaatactagggttgattcttgtttttctcattgtggagcaagctctgaagaaataagcccaaagagtgttcaaacatcaattatctcagcttctcatgaaagccttgaagtagcttagaccagagtggtttggtttgggctgaggtggaagaagagcttgagatattttaaaggcactcaagctagaaaataccaggaactgaggatggaaatggctttcatgcaaggttgtatgtagatgctcatgtcccttgtcccctgtgtcctcagacatacattgtctggaaaatgcagttttttttttctcctccagataattattttaggatttaagaaactctttaaaaaaaagatgtcaaatggtaatgttctgaatacgctgagtagaagagtttaaaaaaattgatctttaggaaaatagttacagatagtaacctcacagtgtgccatttgatcgctgatgttgtttttatttcattgcaggcagtggagctactgctgtggttcaggcagccctatgcaaacccaggcaagaacgtgtagcaataaaacggatcaacttggaaaaatgccagaccagtatggatgaactattagtaagtaacagtgcagggaatacctgctggttgcttttcttaatctatgggtatatggggatggttgggagaagagcaaggtgttatctccagttttgacatatgcatttcttggaaagcagcccctaccacttcctgctccccagattaatgggactgtaccttatgattgtgttgtataatgaacaccttcccttgctttgagaaacagtattttgctcagttcgaataatcccaaggtgagaatggcctcagcgttggcactccacttgctgtatcaagggcacacactgtggcgtgacctaacatgacaggattactgactgcagttttggatggtgagcttctggccctccatctagaatgtgtgacacaaatggaagttgtcccccaaactatttgttggtcattttagctttcataaattatagcatcacacaaatttgagttattttttttttaaatgctctgtagcttgcatttggctaatgagaggagtttgtttttcttaacgtggcaatttgtacttcttattctaaatgagtactttatataaataattggagcttgtcagtgtggatatgactatagtagcaatggttggttgaaggaacatttgcttttggcttagctgactcattattaaatgaacagcttggcaaatggttattagttgcccggcaaactgtgaagggtttgagggtttaatctcataaatatcgttgttgttctaccggccaattttctttttttcccttttggccatttatttgaggataatagaaaactgcagtggaggagttaactgattggttatccccacactaatcccagtacaaatattagtccagtagctccatacaagctacaaagtataatgacagttggctgcaaatgaagaagccttttgttacagtctacattgagaatggaatgtcattaacaacagctttttgtctttactcagaatatagcttttattttaggcttaattacagtacactatagtataaattaagtacaaggataaagctgtacttttccagatctgtttggccttacattttaaattaggctacacaatgcatagatttcattgggttttattgaagcaatggattgccggctaaaactcagaagagaaccagggcttccacaatttaatgttaatttttgaaatttgcatacattcaaggcttttaacggccttgaaatttcagctgtgctttgctcttactgaaattcctgctgcatgctacttgtctgttgcttgctatcttagtgaccagtaatattgtgcctttgtcacccaaccagttttcaaggtcactttctctgagttggaaaacgcattttataaactgtggggagagttgggtcctgcttctgccactaaacttgttttcactttagtagagttacacaacagctctgcgcgatttaaaaagagttgaattggaagttttcttctaagatccctttaggaatcctgaaattctgtggctatgcataagtgtactttaacatttaaaaaaaaaatttggagtgtgcatttaaatatatgtactgtttggatgtatcactcaagaatttgccagtgatagttgtgtttttgttttttgtatttttttgagacagagtctcactctgttgcccaggctggggtgtagcagtgtggttttggctcactgcaacctccgcctcctgggttcaagcgattctcctgctttagcctcccgagtagctgggattacagacatgcaccaccacgcccggctaatttttgtatttttagtagagacagagtttcgccatgttggccaggctggtctcgaacccctgacctcaggtgatctgtccgcctcggcctcccacagtgctgggattacagatgtgagccaccgcacctggctgatacttgtgtttgattgtggtattctgttagaggtctcagccattttttttgccattagcagaatattgatacagaatatgtgtaaggcttgcgtgtacttgtgcctgacagttctggagcctgccttctggtttgatgctatggtctctggtttctaccaagccctcagttgcccacagccttcacgtttccctctgctagcgtttcctccacagtgtccagtgatggtaaccgtgtaagcttctgggtggaggtcagcagggaggctggtcattctggtttctttcctttgttttcctggaaccagtaagcatagcagtgtcatttggagctacttgtaacttaggtagagctgtctatctaaggactggtgcttttgtggctttgtgctttgctccattcgtctgaggtcttaggatttatgagtttgcttatgaggagttaatttattttctcattcttattttctttccttaatgcccgtgttgcaatagagtataatatatttgcattatttatttttcattttatattgatttattgctttgatgtttccttacccttgaatctttgaccttttggtgtgttgatatatttagagaggggggaaatggctatggttctttaggatgtacaactcccaggtcgttttcaaacaaaaataaatagaatttacagagtatagcctgcctgatttgccaggcttctgtggcccagttattggcacatgagatcgtgtggagcacagttgctgtcatcttttcaatgtctaatactgctgttgcttgcacttttattatttcagagggctcacattttggcagtgtttggacatctggtatcctaataatcctttaattccatgagtgtgtattatatacaggtcagtgcactgcatcgtctcacagactgtgccatgtgttaactggaaaccattgttcctagaagaaacaatggccactgggatctcttcttgtgagagtgttatgtcatagaaatcacaattatcaactatttgttggccactgggacatgtttctcccttgatgaaactgtaacacctcctgaccccgactcccagctcagcccccactgactacctatccccgtcctgtccccactccctttgtcccataataaagggggatttacacacacaggtcagaattgatggcacacaacagttttaggcaactggtccagaactcgacttctttatgtggtaggggctgtcagttgagtttcctgtaggtcacagagctggatccagggtttgctgaagaaggagtcaagcagtcatcatttctgaagggaagtgctaattacagtgtcagcttctttgtgaatgaggagaggaaaagaagtgttagatgagctcattggtgctaaataattgatgattcagatttatactgttgaaatgagtactgtaatattctgtaaagataagttagttacagatcaaataggcatttatttatttatttggtaaatacttactgagtttctgtattatgcttaagcccatcaaaaggatgacttttgggtgtgtatatgagagtacaaggctttatgcccactaaaaattcattttagtttaacagcaattagattagaacactcccaaataaatgtttttcttggtatgatatgaatagcaattaatctaatccttttttatttattcttttgaattttcatgtatgttttggagtttggccttttaactgtactctgatctctgaaggtataatgatcttagtgtttagttttccaggagccaaggatatgttctggtttgttctgtattccttactgtgccaacatagatgctttggtaatttctgaaatttgttaaccccacatttgttgttaactgcacatttgtcaagcccatcatggtgtaaatgactaattataactagtttaatgctctctaggagatacttacagttttagagcagaacttgttaacaccagaattatcaaacccccttagatgctaggcactgactttggtgatgggaaaacagaatggattccta[450 bp omitted]tatttaccctaaccccactttttgtgatgttcaggttactctactttattcagggattgatgaacattttggttcatcaccttatttgactttatgacttttagactttaaatagatccctttcaattttttcctattgcctcaagttctcatatttctagtctgcctttggtacccattcacagaaaattcagcctcatttgctcattcctacacatacatcaatgccatcaaaatttacagtttaattctcaggggcaggagagtcataggagaaatcatggcccggggacgaggcaaagcatttgtgtcattaaaaaaatgaaagaaataattaagtgattacgttatgaaattatggaatgctcattccataatttccatatgtgaattccatatgtgaacaaagtcatttcaagaaaaccatggctataaaaaagtgatgaatgttgatcctttgatagaaggaaaggaactccctgggtcaggggacttgctttctttgcttgactcccctacagaactgctcattctggaaaaatcagtttcaccactggtccttatttgtgtgatgacaaattctggcaaaattttatttttattacccaagtgctatgaatctatgtatttaaaagtatattaacaaaacccccttttcaattcacttaaataaaaatactaattactagcaaatcatgcatggtaattcaggatagagtcaagtcactttagcattacggtatgatagcagaaatctactgtaaattcatagatttgggtacacagtgtatcatttttttctcctatgaacataatgaaagagtttctctgtcattcagtagtcttcaactgtcatctgcttttttcttcctgtatcatctttctctagggattttggtctaactcactgacaatatttatagataaaatcaagaactttttcctcagaacaaagccactgccctcattttgctttctgctgtagcgttgttttgttgtttttcctttctcttgatctactgttcactccctccgtcacctccctctccttagaaaaatgagttagctatgatttgtgggttattggagaataaagctctagatatcttcgtggcttgatgatcatttgagaagaactgttattcctaaccattatctgatgcaggttgctctcatcctttttaaattaaaagatttggtgacctctgagcagttcctccagtcagaaggttttttttttctcttccttttaattgaggtttaagggggggagaaactctcaaaaccttgtttgcagtgttttagcaaatttatggaattatgttaatacttttgcaaagcttgtttattctagaaagatagtgattaaaaaacttccatctttttaatttgaccctaaaacagtataattttgtatgtgtgtgttttctttatcgcatcaacgaaagtatgtttccattctttttgaagttaagaattttctaattagtacattaataattcatatcccagctcattcatcgtatgtggtaacaaattgcatttagctatttgttgtagagttttttatattaaggatatagcattagcatgcaagcctacttcactgaatatagtatagttttgagcatttcaggtttcaaccattaagttttgttctgtcatctgtctcttgccacttagttttgtaattattttaatatattttgtagtactatttcgagcatttcaagtctcggccattaaattttgtactgttatctttttcttgcaacttagctttgtaactattttcacgtaatttggtgtttatgtttatccaggtatagtccaaatgagggcaggattggaaatagaaaatttttgtttattttgaaagcacaaaaacattcttaacgaattggagaataaatactatactgtatatgcaaaactaacatttttagagcactaaagttgtattagcttaggaacatgtataatttggttggagaaaacaacttttatttttggaacatcaaatttaaaagttatgtagcttattcggatactaattaaatatactaattgaatttacttttaattgttttctacatttgttagaaatagctcattaaaatgtctaacctctcatgcttttttttcagaaagtaagcaaaaattaacattgcaaaaacacttatgttttggggcttatatgttttcagtaacagggacccagcacatactcattttcagagtaggagaaaatggggaaaacatgcccagattgaatataattttagttacatctcactttttaaatatctcacttttgcctttcttctagacttcaggaaaatgttgcttaggttgagacaaatgctttagttctttcctatgttattgtcgttcttattttggtttcgttatttccataattaattaagctgttgctgaaaaaggagggctgtggaatcctcaggaggaaggttggagagtattaagaggaggctgcaggagggttgttccctggcagaaccccagatggcacacagtatccagggtgccacaggcgataccacaaaaagaagacacattacaccctacattgtcactgtgtggtggtgaacccaaatacagcagcagtggtaaaagttggcctctaggtttccagcagtacaatttggctgacaagaaaagttcttcctgtttctgtttctggtttcttgggtgttttttttttttttttttttaagagatgaagtcttgctatgttgcccaggctgccctcgaactcctgggctcaagtgatccttctacctcagcttggtgagtagttgtcattacaggtgcatgctaccaggccggccatctatttctgtttttaatgacatcttcaatttgaattttttcagtattcccagtcacaatttaatggtcaaaaagcgattgttcatacctgagtgtgagtctgattccactgtggcaccctcagcacttttagagcccaaaagacatcattattgtttgttgaataacttttttagctaactataaaagaaaatggcatcttcctattgagttttcatatagtatttcaatatcactactgtattttttgctttctcccccttgtttcatttgaaaaaaataagtggcttcttcacttccaagcgaattttaattttttaggacagtttttgcagagcacgcaatttcatgacattataacgaagcaagtaggccttgggatattcattctgttccgttagcaagtagacgtttgcccatcgggatttctctgctacttctgagagattttccagaccttcaattgccctgacactttacactttttataactgcttctccctagttttaaaaacttctctacaaacaccaattaaggctatcacaaaatttatgctttccttttcctgatttcttaaaaatgtttctatttcttaaaaatgtttctctttcttcaaaatacctagttcccatttgtaaacctgccttccattggactatacttggttaaactcagataccaaatcacatgaaaataattgtaaagttaagtggcaaaggacattcgttgattgatttgtaagtggtacaagacaaaatgtttgacttccttgaataggtttttctctgctggtacttttcttataaaggaggcaagagtttgctgtataaatggtatatcattttttgcaattaaaagaattcatgactgggtgcggtggctcacgcctgtaatcccagcactttgggaggctgaggcaggtggatcacctgaggtcaggagttcaagaccagcctggccaaaatggtgaaaccctatctctactaaaactacaaaaattaggtggcacacacctgtaattccagctactcaggaggctgaggcaggagaatcgcttgaacccaggaggcaggggttgcagtgagccgagatttcaccattgcattctagcctgggcaacaaggagcaaaactccatctcaaaatgaataaataaatataaatataaataaaaaaattcacaatgacattttcatgattgaaaatgacagtccagaaaaatacattgctcttctaagaccttgttaatcctgttcttccatgccttggttgacgtttgaaatcactgaaatttgtttttggttaaacctgctacttaacagtattcggttatttgtgaatattgattaggttacctttcataatgctgctaaaagaagtgcatgctggagaaagactttctgaaaagtgtttttatttaacaagattactcctataccatttaaagaattctttaaatgtttcgagggtattgcatacattttacagatgtatttggtcatctcttgcatttggaagtagatgttttatttgataatatttgtacatcatacatagattacattgcagtggggaaacgtgcctgggagctacatgtttctctcaccatttcattgaaagaaaaatacatttcagcacttagctcgcaagtaggggttctaagctgtggctgcacattagaaccacctgggagcttctgaaaattttcattcccaggctgtctcctaaaccaatttacagcagcctccctggggccgggactcaggtgtgggtatttgtcaaagctccccaggtgatttcaatatgcagccaaggttgcgatccattgctttagaataaagttagaagcatctcctcagatttaactgcatacaattttggagcttgagtaagtttgatttcttaactaagtacttgagtaggatattttgccatcattatcagataaagaataatttatttaggatttacataagttgtaaaatacgcaaatttggttaagtatagtttaatattttgaattcagaatcatttaaactcttccctttcagtaacaaaaatctctttccttttagtgttttatgaatctcacggtcttaggaacaaaagaaatcaggttttaactttttcctaattcttatatctttaaacttgtactatttctctttgttctgaaccctttgcataagtatctatttagataacttattccgaaagagtttgaggcagtttaccaggatacatgaagtatgacaaggtggtataaattaaatacagggtgaaattaggaaaaacatgggttgagacaatgtagaggttaaaaattcatgaccaaatgacctatccatgcattacagcaaactccttgagccagtggggccaacagatgtgtcctgtgacatttctgttggaaaaagtgacggctgctgccatggtctgtctctgtgcctttgaggcttagtcaggaattgggacacttgagattagggcgatgctcacacgcaacgaagaaactgagacattgaacagactgaattaactttgaacatttgtgttatgtgctaggcattctgcaaggagttttatacatctcatttcccctacctcacaataatctcatgtagatagtagtaatctccttttacagaaaaggaaactgaggctcaaagttgttggataacccgcctaggtaatcaagccagtaaatggcaaggccaagcttccaagccagctgtgacatagagtgcggcccttcagtagtagatcctggaggatcagatccttgctagtcacagttcctgattggcctcagtactatttgtaggagaaataatgttttgtgtgtgggggggaggggggagtggggggggcgtggaaatgaaaggccatatagcaatatgagaaaatctcttattatatttagttatggcagggtacagtggctcacagctgtaatttcagcactttgggagaccaaggaggaggattgcttgagcctgggagctcgagaccagcctgggcaacacagtgagaccctgtctctacaaaaaatttttaaaaattagctggatgtgatagcatgtgctcatcccccctgctactcaggaggcttgaagtgtgaagattgctcgagccaggaaggttaaagcttctgtgagctatgattgcgccattgcactccagcctggacaacagaatgagattgtctaaaaaaaaaaaaattaagtttttttttccctttttttattttcagttctgttattttttgggggaaggggaagttttttcctcccaactcctcatatttgtagggtaggatactttattttgtattcctcaccacacctagcatgacgcgcgtaatgtctggtttggcaaattttgcagggctggcataacagcagtgtgtgggtgtccttctttgatatgtctttcttgcacatggctccctgcagaggggtgctgctgtggctgccacttcagttctagcaggtggataggggatcttccatgctaccccattttaaggttggtcttcccactcttgtgaaatttcacttgtgatacatttcagatggagctgcatgaacagctctgtcagcctcagagaagattaactactgtgccatagcttggtttggcgcttgtgacatgtctaagtctcatttcctcggtttccaagggagccactgtgttcaattccttgactatatttttggcaaatgtgttgcctgcatttcagagttctgtagtttctcccatctttgacctcgtgggatttttgtttgtttgtttgcttgcgtttcttttttaaatctcaatgaagtttttacccttttctgtccttgtgaaattcacaccactttagtacaacagtctcccttatttccagctttgcttcttacccctctcctccagttagactctcctccagttagactcagccaggcagtactgtcggccagacccactactgggcacttttgacactgtcggcttccttgcagtcgtctgtgtccctcctctcacatcccccaaccttcctctctgccttctttcaaagctcagtctaccactttgccactcaaagtctggtttctggacccacagcatcagcatcacatggaagcctgctagaaatgcagattctcaggccgcactgcagcccttccgaatgggagtctgcatcttagcaaattgctgaggtgatctgcatgcccatccaaattagggaagcaccgctttaactcacgcttctgccttgggttgtgacctaattaagagaataggatgttagaacccattcattctgtcgaaagaatcagctaaaacatttttatattttcaaattgttcatctttaggcaatagttttgtcatttttagggatagggacaaacaaatatgcttggtaatgaatgtcttttcctaaccatatgaatgcggttagggcattaggagaagcttagataatttaaccaatagattgttaccaagggagctttcaaataacacccatcattgttttgaaaagaatggaggggatagttttgtggaaagatttctagttttcaggtttttaactttcttctatgtggaaatattacttatcctggggatcagtgatagcataggtcatatctcaagacagagctacagatgtttctccctaaggcgagtttcatcatgtccttaagcattaatgcttgtggaaaagctgctgtgcaggacaatggatggtgcaggagttggggacatggacccccctagccaagaagtgaagagggatggctcagctgcatggaagaagaatgtgaggttgagtgatcaaactgatggaaagccactcttgggccccctgccccttcttttacctgtccttatactgctcctgtggttgtgttggtgtggcagtatctgtgacccctcatcccccactcatttaaattctggaaccttttaatgtccagatggtgtctctaagactcagagttttgaaggaatagaatttgctaagttatatctataggttctacaggttttctaaaggagttacacacacacacacacacacacacacacacgctcactgcaaagtcagagaacctgatactttgggtgggaagtgatactggccatctaaatgcaaagggctaaaaagtgtgtttttctagactgactcaaccttgccttcaatgtaaaagaatttccttttgtatgaccattagttgttttgtgcattttgataaattatttaaaagtttggagttacagcactagaaaagcattcacttacatttagagtgcagctgcatttaagagacattgttctcgtttctttgaacactaggcatctgtttaaactggaccctacctaatgctacagaccttcagtgtgggccatccccgcactgagcagatgctattgacttgaaataggagtggccagggcagtgttccatttctccttcagaagtgtcttatggcatcagaacctaataccggaaacagatggaaactgaacctcaggtttcagatcttattcaaaggataagagttgctgaattgaaaagtgtcagatttagaaaacctgtaatcagtcaaatggatgaggggaatgatgaaggaaaatcattgttatatactgagaagaaaaaagaaaaattagtagtttctaaggagtttatctttggttaaaagcacttcatttttattattttttaatttttttttgagacagaatcttgctttgtcactcaggctggagtccagtggcacgatctcagctcactgcaacctccacttcccgggtttgagtgattctcgttcctcagcttcctcagtcattgggactacaggcgcacaccaccacactcagctaatttttttgtagagacaatgtttctcatgttggctgggctggtcttgaactcctgacctcgggtgatccgcctgctgcggcctcccaaagtgttgggattacatgtatgagccactgcccccagccaaaagcactttaaataaacatatatgttaaggaacgtatgagtgttacatattacagaattttggccaagttgtcggatatataggatctttttagtagtatgaggattaggcagtactggacaagcaaagataacgtccaaattgagatgttctgcttgggtaactttgagttaatgtgaagctcattattattgaatatattcataggatgcataaatgtacccttctttcatcaatacataatggcaaaaatgaggtttctttgatcatttaggttattcttgtcctttttatggcaccttgaaagtgagttacactggtctggtacctttgattgagagttacattagactgaagcttttatgggagtcatccgacaataacttaaaacgagaaactgaaatcaatatgaaactgaatattccagaaaaatgtgatttattgaaagtttccttttgttttatttctcagctttgttgttttatgtctttatataaaacaacaaagaataaaatatattttattctctacagcagtgtttccaagatgtgacccacaaagcattcttttcctgctctgttaatatggattaaactatggcagtttatctactgcaggacttctcagagcctttgacagtactaatattccctgtgattcttttagaatgagatatattatctgatctttcccaagcttattttacttcgcctgccgctctcttccctgccacctcctttttttagttaatggaatatctactgtggcagatagctgggaaataatactgtagcattttcaaatgtattttctcatttaccatcacagcagtcctgagaaacagggacagttttgttgtcgttttttggatgagggaggagctaagatccaccagagttcaggctggcaccaggatgcaggtgtcctagtaactcacccagtcttttatctccctgtcaagccttcggttcaggtatgaggctcttagtcctatgtggcagggctctctgctggcagagttggggggtcatctgggtgataacagtgatctgaagttcctgtgtctggtagctggtccacagggctctgtggtctcctgtagagaactttctaatctgagttgataatgtgggtgagagaattggtccttatataccttctttgaagtaatggcttaggcagcccctcaggtaggctttcgagtaggaaagttacccaggtactcaactgtgattcacttgtgttttgcttgccaattttcaccccatggtactatgtcatgttttgctctttttatagaaagaaattcaagccatgagtcagtgcagccatcccaacgtagtgacctattacacctcttttgtggtcaaagatgaactttggctggtcatgaaattactaagtggaggtaagtggattttgttgttgttatttatttgcttgttttctctccttttgttggaaccagcatattggagaagactttagattgaatcctttctctcctgtgtttgaaagtttgtttggtttctcattgcctagaggataacgtccagattgcttcacattgaccttcaaagcttttcataattttgcttaacttccgagaatgtgtatgtcctcttctccaggtatgaaatgcccgaccttctaggctgagaggcagcccccggaatgtattatgtgctctcatgcctttgcccctgacctgtcctctttctcagccttgcatctctcctttgttttccatgtgctcaggcctaaaaggtcacatcctctccacagtcaccgcttactcttcaaaaaagttagccagtcctttctccttgagtcctttctttttaacattgttcaggtccttaacacattgcagtttgctgaattatctcagtgccatttatcagaatgttctgtgatgatggaaatgttctgaggtgctgctatctactttttactaatcccatgtgactcttaagcacttgacatgtggctagtgtgactgagggactgagtattcaattttaattaacttacatttaaatcaccttgtatggctccagtattggacagtgcatatttaggttgtggactttgtgaagattgtctaatgcactttgaattcattgaacttggcgcccagtaggtgctcactaaatgtggtttcagttgacatggggagaaatgtgtgctacatattcacttgcagtgttgatcagaaatggcactattgtcatcctattgttgcatttgggaagggaaagtcacttcctctctctagcttcagatccctgcagtgatgcaagccattgacaatttaatttacaaggtgctttcacatcctgtattttatttcttttaatcttctaacatcactatcagagagggaatgataatgataaccgttgccttttttgaacacttactctgtggctagatcctgtccaaggcaatttactgaccttatcccatttaatcttcacagtgtccctgaatggcctgtgtcaccatccctgtttttcagaaattacaccaaatttcaagggagtttagcaacttgcccaaggtcacacacatagtaaatgttggtgctggaatttgtgactttaacatctgttgacttaaaaatttgtatgctgtgctgcaagtatttacaccttcgttttgcagacatgggcactgaagcttagaaagcccaagtgatttccttgggaacacccagcatacccacatctctggtgtgttctctttcgagggcttgattctctgggtatctttctgagacatgaagtatggtttaggatcagaggagaacattttgctgtgcctggacaacccaaaactagcatagcagaatttatatgatagagcctattttaatctgcagatgtcgagggaggtgttttaatgttttccttttttaaaaaggaaactctcttggatcaagcagaagcccaaaaatgagatgacgaaggcattgtaattggcttgggtctgcttgtgtaggtctcggtggggagccctggggagcttagttctgttctgttttcagtcttcctcagtcttattagtcattgtttccttgagtgcctacttcagtttttaattaaaaagaaaaaaagaaaaaggaaaagaaaaaggaagcctgccagagctggactgcagtattgagtgctgggactgcccctttattcagcagaggaacttgcgctttgccaacaagatgatcttaaggcattctctttttgtggggttccaccaactctgaggaaatgagaaattctgatgacttgagaccctgaatagtcccaaatgctctgctcaagctgaagattttaccttttgctttatgaagctgagaatcttctgttttctgaggaggatctgacagaaaatttctttgtctttttgagtccaatttagcctctctgggctttaggtaagaacagattttaaacaggtttccacaggtaaggacgtgggcagacgtggactcttgttcatttttcttttagcaggacagaaatgcatgcatgcctggtatggtatatccttatacaataaaaagaaaatgtttttggaattatcattttttaaatgacacaaaaatctaagagtcaacaaataaacagaggtttttttttcctctggggaaaaatatgcatttgttttcttctatttcattacattgaatctcttaatgaggggcaggcagctgtatctgatggggaagctcaatcctcttagttaattataaagagcctagagccaaattcaggtcctgaggtaagccgtttgttaactcttcagaaatgtcaaacccccaggtaattttggcttttaaactgacccaggggtttggaatactaattaatatgtgttgaaacatgaattcacagtgccaaggatactaatctgtatatggtaacaaagtactaggtatctgtttgtttattgtaagtgttagtgcctcaaatatatcaggtaaatgaaataaagatcagccaggctcagtggcttatgcctataagcccagcactttgggaggccaaaggtgggcagatcacttaagcccagaagttcaagaccggcatgggcaacgtggtaagaccccatctctacaaaaaatacaaaaattagccaggcgtggtggcacgtacttgtagtcccagctacttgggaggctgaggtgggaggatcgcttgagcctgggaagttgaggctgcagtgagctgtgattgctccactgcactccagcttatatgacagaggcagactctgtctcaaataaaaaaagaaaaagaaggaaagaaaataaagatcaggtagtgtcacaggaaggaatcttccggttataagcagaggtctagaaacaacatacttctttccccctcccacctgtgatttaggtcctcaaagagtgtgttttttttctctcagcagttcacttctgccttttctcctggcctcatactcctttctttgtcagttcagactttttgcaccctctttggagggttgctcttaggaatttttgtgagaaatactgtaaccagaaaaggaaccagccatggaacggccatgaacagccttctggtccctgacccagaatccttctcgttaaattcacactgaaagtgctcttgcaaacttggatttagtgtttttggtcatggggcccccattcaattgtttgtttgccttgggaatatttgcattaaataaagcccatattttgatgtttctattaaattttatacataatggagtcttgttctgaaaaggtgatgaaggtgcttatgttttaattcttctgtttgtctacttaggttcaatgttggatatcataaaatacattgtcaaccgaggagaacacaagaatggagttctggaagaggcaataatagcaacaattcttaaagaggttttggaaggcttagactatctacacagaaacggtcagattcacaggtatgacctctgcagagatgtttaaattcagatgttcatatcttaaagaggttttggaaggcttagactgtctacacagaaacggtcagattcacaggtgtgacctctgcagagatgtttaaattcagatgttcatatcttcagccctagtttgtaaagaatgttaaggaaacacatgttgcaggcaggtattgacattactttaacttagtctaaatagatgggaaaaaagtacttaagaaagaaacaagagaataaattttgatgaattatattggtatccttgggattgcttcagttgctttcactgaaataagagtggaatctaaaaaggactacatggactcatttaaaaagatcagttttggtaactactcttgaattatactagttgaactagacagcatctctatctttctaatacaagcaagactatccaaacattgtactatgtgaattatttttgatgtggtggtgagagggaaggaagaggtactcatcttcttttgtgacataaaatgttaattctttacatagtcaaatcacatagaatatgagtgcttgatgtttcaagtgagtgagtgctacttgggctcttaggaattattgcaagtaaatagccatttaccagtaatactaataatgtaattctcctaccctgaaatttatatttaattatttctactatatttttctttttctttttttttttgagacagagtcttgctctgttgcccaggctggagtgcaatggtgtgatctcagctcactgcaacctctgcctcccgagttcaagcaattctcctgtctcagcctcccgagtagctgggattacaggcatgcggcaccatgcctggctaatttttgtatttttagtagagatggggttcaccatgttggccaggctggactgacactcttgatcccagatgatctgcccaccttagcctcccaaagtgctaggattacaggcgtgagccactgtggctggcctatatttttcaataattagaaaaaagttactttagaaatcaaatttataaattgcaagttgtcatttttcaaagtactaagattacacaggttttatacggtgaagaaatataatatctattattataattagtatttataatcagtctctcaccagagagaagttcatttttcagaaagataattaagttggaattgcatcccaaatttaagtggaagtagaggagctttacatagactgggctttaatacttggtagaatgacagtagtgtgagtttatgggcagtgtctaactctgaagcataaaatagagagtctatttactgatgatttaattaaatttggataattatttcatagaaaatatttctttctaaaatcctaactctcccccacgagtaaactataaagtgacaggtggatccttataccttttttttttttttttttttttttttgagaccaagtttcactcttgttgcccaggctggagtgcagtggcacggtgttggctcactgcagcctccacctcccaggttcaagtgattcttctgcctcagcctcccaagtagctgggattacaggcacctgccaccatgcccaactaatttttatatttttagtagagatggggtttcaccattttttccaggctggtctcgaactcctgacctcaggtgctccacccaccttggcctcccaaagtgctgggattacaggcgtgagccactgtgcccagcctatccttataacttttaaaatctgtgctattatcttaatatttatgaaattattatgtcaaagagctgcgttgtatgatatgttttaaaatcttcctgagtgaatcaatacactataaagtctgtaccctacaatttattttctatttttttttctaatagggatttgaaagctggtaatattcttctgggtgaggatggttcagtacaaatagcaggtaaagctgataaatagaaaaattttttacttgattacggaagtgttacagtttcaaggaatgtagaatcattcctgagaaatgaataaatgcatgtaatctcttttcagaatgatatttacagaatgtttgggtccgaaggataacatattttccttattgttttgataagtcattagatcatcctgtgaaaaatgccattttagtacatagctttttgataaagaataattttattttcaattttattatgttttctacctttcacattttataatggtaatactcatataacttcaagaaatgcacttgtaaaaacatttttcgataggtttgaaaatttaaaacatcatacacatcaattaaaaactaatttatttcttaagaggtatctgaaagaattgtgaacattaaaaatctgggccttattttgtttttaactctgacccaacatggctattcttgacaaagctggtaggctggggatgcaatgaatgtcttttacatgaacacacaatatcaggtgagcacctttcgtgttcaaagcctctattttgttattggccctagagtaaccttaaaggcctgggataagatgtagccacgcccatattaactcttgctttacccatgtcgttgaaagtctgtctcagcaatccttttagctttcatggtttcttgggggagtgttcttggcattttttggctagacagtcattccctctactggagtgaccctgtcattgcagagacgcgtaagatgagcccacttgtacccatcacctagtttcaataattatcaatctttggcaattcttgattcatctgctgccccccacccccaccccccgactctggtgcctctcctcatcgtggaggctggattttgttgttgagccatctgagttagtgctttgtgtgtgcatatcttgtcctcatgagtggaccttatcccataggctaaggacagtttgaaaaagtacttcagttaaacaagtaacagctaagagacatctgtgggcaaagatttcaaactgtccagccccaagcagtctagttgttcagagtgcaggctctggtgtcagctgacttgatcgaaattctgaggccaccacttagtagctgtaccaccttgggcaagttaccaaaccttcttaagactcagtttccttaaagaagggtaaaaatataaactacttcatcttctttcatgaaatcaaggtccagtgatcttaacagtggccaacacataataggcaagcagtaaatatcaataactgctgttctaccatggctgctgctgctactgctgttgctactattactactattacttctgttactacgactaacaggatcacagtgatactcccttgcactgactggagatcatgtgaccctcaaattgtcctgcaagagcttcagctctgaggagagtttatgacttatcaaaaggtaatacttattaattatggaatttggaagctaacttgccattaatcttgctctaagatgataaggaagtacaactaattttctgttttatgatgaaatgatgatttctcactaaaagggtcaaaatagcagtgaactgcctttgaaatgtgaaggctggtcagcccctgccttattctgttacttggtcctctgccagtcatctcatcccattattcttgtcagattaatgatccgagcctctccctgagccttctggaacacattgtccttttctttttcccagtaagaatccccgaggtaagatttcctggctttttccttccatcacaggcctttgggtttttcctcactgccgaggagtctgttgtgacccagtacgtgcctgcactgtgcgggctgctgagttcagaagggctcaggcaggaagcccctgcacagggtaggtgtgggaattaagtgaattgatgtgtagagagggctgtgccttttctatgcctggcatgtgctgaggactttgtgttccagccatccgggacttccttggtatctttttgagtatgcgacttcatgcttgtgtaataacacaaactggaatggccatttcccagatgtatggtggctgcttgacaggcacctaaatgtacagcttctgcatctctggaactgtcgctttctagaattcacatttaatttctcccatattctctgacctgatcataacatccaactaatacagtatttaaagtttgaatttttaaagtgttcactataatataaggttattgccttaaagcatttttaatgtctccttggaaaggtagatgttactgctgtcctcattttataggagattgactttcttggtcaggtacttggttgctgcctgaacaaaaatgaggaccaggagtctctgggtcttttactggcatccttgtcggtgggtgaaacaggcgagatcggggggaagagtggaatgtggagactcagcaacggcaggggtgagacggtccctttttgttgctacctggacaaataatacattgtttttacccagtctgtttttgctctttcccctttgtatctttatgcctctgaggccctgtagtttgaaataaaagttaagcaggggagaagttaagtttgcatttatttctttgagtgtaatatacattgcccaccttgagaatattattgtgtgcactgtttttaagaaagggcatttttgctatcctaatagaaaacataatgatttttgtttttttttaggggaaacactcacttttacatatgtataaattccctttttcagaactttttatcagaaaacagaagattaaagggcctgatttagaccatgagaaaccctcactttattatgcagctagaagtgtggtggataggataatgagcctggttctgttgaacacagtccaaattctctgggaagaatgtacatttctattgaacgtgggtataaaatcaggaactaatgtgtcttgagtgcttcctgtgtgtcaggctaggttttggattctgaatgctttgagtctcattcagtcctcagcacaactccatgaggaaggtactattgcatccattttacataggagaaactaaattacagtggggaagtcagttgcccaggtcacacgtagaataagcggtgtagccatgctttgggtttggacagtctgactctagaaactgtcaactcacatctatgggatttccaggaggaggaccttaaatctggatttaaatgacctcactttcagatggaatataccccagcgatcactagctcttctgtgtctctgcataaatcgattcccctttgggccagggaacatattcagcaccttcttcctccttgctccttcaggctgaaacacaagggtgtccctggtaaggtttcagggcataggagaagcagccatctaagcgtcatttggtatagaattaagctcaataatgacaccacactcttttcagactggaaaacttcaggtttgatgtagtgaattagaacctgaggacagcctactcagggtttaagagaaaatgctttccttcttactgtaccttctatgcttagaggtccagtgtgtgtaacttcctgataatcaacttggatgccttggaaaatgtaataggttttgctgcactgtgtgatagaagggggagtggctactcgaaagtcatgttcttcccacggcatagcattttatcttccaatttgatgccctgtcatattgtcaggaagagcttagtgctttggcaaatgactaagcctgtttgtccagaattaatgagagacactattttgagcaaacagaaattcatatgaaacagatcactttgaggtggtttctgctaatctttttaatctaagatttaaaaaaaatagtggctactcttgatgttctataaaaatgttgatttcaacacctttgatttataaagaactttgtagaagcttactactacattatgtaaggtagatctcatgctcattttcacttacgtttgccttttaggtgtgtgtgtgctgtggtttgaattttgtgtgccctccaaattcatatgttgaaccctaattaccaatgtgatggtgttaggaggtggggcctttgggaggtaataagatcatgaggcctaaaccctcatgagtagggccagtgcctttataaagaggccccagagagctgccgtgcccttctaccatgtgaggacacgaacagaaggcaccatctataaacaagaaggcgggtccttactagatagtgaatctgccgatgccataatcttggacttcccagcctgcagaactgtgataaataagattttgttgtttttaagtcacccagtctaaggtattttgttatagtaggcccaatacacaaagacagtgcttatgtgtgtgaatgtgaatttcccttccctggttttacataacagaaataaaaactggtactgagcgaaagcagcctggaactctagaaagttaccatcaaaatgcctcacgtatgtgcatccattcaaatcaagcttatgccctgggtttttcactgtccaaggtacattggtagaactttgggtagcatctcttatttactgggagggagataatatccttatcagccttgaatacatcttcattttaaatctgcatcttgaacactgaaaaccccatgactaaaagtgctaggaaaacatgcaatgaaacttaacttgcttctgtcacttaggcgttatccattaaggagctagaggaagatgggcaaggtggttgagtttttacacccatagctgctaggttctttcattttccttctgtggcctttggccctcataaagtgcactttgatggggagggtaggggtttaagagttattttttgtgttgtagggaagagaggctgctgctttgagcaaggcacccgagcagcgctggagtcagcttctgattagtgtgggaaagcgctgaaagccccggaggcatccaatcaggaaatgatgtcatcacatttatgagcaccttggcccagagcatgggctctgacaccagacagccatagttcagtcctggcattgctccttctagctgtgtaaccaagttatagctttagcttctctgtgcctcattttgcacgtttgtgtaatgagaatatactgcggcattaaaggagttaaaacacattttattttagaatttgctaactcattgctttcgtattgaaattgggatggtgtcctctaattacttagggtgtggtaagctcacggtggctagggaggtgcgaggccttaggcactccatctgacctcctgccgtgttattttgctcttttctttttcccatcagtttcctcaatatcaccagagtgaagaatctgcagtgtagatctgactgtatcttcctcttgcataaagtttataagcattgttgatggaataaagcattgttgatggaataaagctccagcttcctactaatggcagatgagggacctgcctgtttttctggtcatgtctgcaagtgctttctgctgtgacttgaaatgcttatagcttcttgttcagggttcccctttcttacctgagtaacttcttttcatgacttattcatgaagaattctttccttgagaaacctttcatgatcatttcctccaccatgcccacctgcaccaggttaagcccctcaccctggtggtttgcaagggttctggccatactctagctagcctatgacacagcactgacattgggcctttactttcccatcttcccttcagactggatacttcccagagggagaaactgtgttgttcatcgcagcattcccagatggtacctgatacatggcaggtgttcctgaactttgggtcagtgcactctgcctagaggcacgggagacaccctgtctcagcagcaggttatgcaagtacatgtgcctgttggtggcaaagagaacagatgtaaggcatagctgagagttgaaatgagtaagaatatatcagcttagcagggagggaggcagaaatattttaaatatttaggtatgtatactactgcatattttaaaggctgaaaatagtttttaatggggaatatcacttctgattttggacaagcactgccctagcctgcaagccatgaggctaaagttaaggaagagtgaagcagagaacatgaatgaagaggcaactggttatactcagaaaatagaatacacatgaaaattaaaatctgttggggtggggggggtgcaagtgctttatagtgaaccgaaatatttgttttgagtttcaggaacagtttataactatgtgaattatggtttgatgaattacgacaaaattctcatacatgaatttttttttggcataagtgaataaggacagtaaattaatgtggctccctgatttttggtatctcgacaaatggtaacatttgataagagctctagaatgaaccaagaatgtactcagttctggaaactgagtttttcattccagctgcacaccatcagtgagaaatacttggggagattgtaagcagcttctcatgctttaacagctgctagcagttgtttgagcaacagcttaaggaaatgttactgggtgaacccggtggaggagaaccactttgctctactctcctgctggaatttttgctcagctctgcacgtttagctgcaggggggacagggttgagcttcacagaagagtgtctaggggggcatgaggcagatgggactcagtctccctccttccctctcttttttccttcctgtaagggcctgcaattcattattaaattaaatttcacatattaccaaatactatggaggtctgcctaaaataagagtttttagacttgaaagcagagcaattcggtcctttgcttattttttcgtttatttttctttttcccagaacctccatttgtatagcctgctccttctgtgggagaaaaggtaaacattagatgtttggtttcagtgtatcctcagtggttagttgacaggtatttattgagcatttgctatgttctaggcacagtcctctcagctgacacagtggtaagcaatggagacattgtgtctactgtcatggagtttaggtgacacattaaacagtcaactatataaatttaaaaaatgtgttaagtgtgaagggaatgcctatacctgggtaacttaagttatccacattaggactagttgaataggttgtaatggggataaattttaaatatgtattgtaaataggttttggtcaataacatcttataagttactgcatgtatcatatgttgattacagatttttaggacatttaaatagtgttaacctgtgtttacattctgtggaatatgatttaacacttgattgtatgtagtacacttgaggacacagtagccagtctaggcccccagtggtcattaacttactgtccttaccctttgctggccatagtttgtatcacctgtaaaatgatgtgcttaggctctcaaatttccttgcaactctaacaagtggataactttaatagagaactctatgacccctgtgctcctgaactgtgcttctcacagtctttcccagttcttttagtgggagaaccattcttctattgaatgggccagaaatcttgatattcctcgatccttgtcgttctcttggaccctacatcctatccaatatgttagtaaatcctatggttgaccatatttcatcagctccctgctgtcatcctggtccacagacccatcagttcttgtttggattattatggtggtctcctaaaaggacctcttcttctgcctttgcccctctgtggtctgttctctacacggcatctggattaatgctgttaaactaagttgacttgtattatgcctttcctcaaaaccctccaaccccttgccatttcagagtgaaagtcaaaatccttaaggtggctcgtgaggccttacaagatctggcccctcattatgtcattgatttcaactcttacatcttcctcttcagtcaaatcggcctccttaccttgcatgctgctgccccgggatctttgcatgggccgttccttctttctggaatactcttttccttacctccttcagatcttggctcaagtgtcacatcagtgagacttccaggcctcatattgtaacccccccccaccccatattttgtattccctgccctgctctgttttctttattgtacacatcagcgtactctctatcagtggctctctcaaggtgtgctcctagagcagcagcagcagcataaacttgataaaaatgcaaactcttgtgttctcctaccctagaccttctgaatcggaaactctagaggtagggcccagcaatctgtgttttaagaagccctctaagggttctgaagcaggctgaagtctgagaactactactatgtattatattttgtaattttgcttttatctgtatttacctctcccccttactcctgccccaacttaaaagtcagctccgtgagagcaggggtttctggtctacagtcccagtacttagaactggaagtggcacttagtaagatcttggcaaatagttgtcaaatgaattaataaacatctgactatatagtaaatttagattaaaagaatattgagcaatagttcagtgactctttaatgttaggagttttcagtgtgaggttttcttttatcacagatttggaaatctgcagattctttgaagattcaactaatccttctgaaaactttgtaaaacaatggtgtgcattgtttccttaaatacttgtagcaactggagttgtgttattttaatcttctcccatagggatcatatttttaacatgtacagatgggctattgtggcttaatggaagcttctgatagtagtgctggttgagtgaagatttgtttaaaaaagatcacctgcaggtatatgaatattgcattggaaatttagacttattaatatttgatctaagttgttcatgcctgtctctgcggatatggccggccaggagccctcgctgactttagaagcttgcctttggcttgggaaacaataatacctgtataatatacttacctggtgctctccttacagcaactctgtcagttcagcacaatagttccttcagatgaagcatctgaggactgctgagcaattgtggacttgtttaaggtcattctgaaagtcataaaagcacttcactctcaaatctcctcagacttcacttttgcttcttgccattaggtttcacccctaccccaccaatatacttcttaactctatgccttttgacggttgaggagcgccggggctcagttccttccgttgtaaagtaaggaagattgacaagatgttctccaaggacctatcttgcatcaaaatgttcaaataacccttcattagctgcagtcacttaaagacattctcagtactgttttgaagaattcaaatcagaggattgtcttgggtgtagagaggagagtaagccaagcctctgtcctgtggctgcttttaccagagcatctttaaaaatagtcctcccaccccacattggggatccagggaagaatggatatgtggtgtgggaattatctgtgtttttcctttgttcagtgtaattatcttatttaatagaaagttgaccactagtgaactcttgaaaaagctgtctcttggcctggaaccttcagcacatctgggctgggactcctgctccagccttcccttctgttgctgctccaggtgtgaccagtgactctacttcttactgaaaattcacctgctttggggcaagggttctgtagctctgacatagatgggcagattatctgtggtttgccattttgttcaactggtcctctccactgctgtggctaattgactgtatcagtcaactgaactttgagccaaatataattggcattgaccaccacttattctttttgtcccttttaagcctgtggtgtcttgattgagagaatggctgaggaattggggagggagtagcagcttctgtgtttttaccaagaatcctgttgaattttttttttttttttttgagaccgagtctcactctgtcgcccaggctggagtgcagtggcgtgatctcggctcactgcaacctccacctcctgggttcaagcgattctcctgcgtcagcctcacgagtagctgggactataggcacgtgccaccaccacacctggctaattttttgtgtttttagtagagatggggtttcaccgtgttagctaggatggtctcgatctcctgaccttgcaatctgactgcctcggcctcccaaaatgctgggattacaggagtgagccaccgtccctggcctgaatttttctttcaatttttctatcgtgaattgatttgattccttgtagaaggtgcaaaggatgtagcctatttgaaggaaactggttgatggcaatgtcaagagtctacatatgagaccccagtcatgggaaggcttgcttctttgtgtttcttttattttaaaagatgaaactctacctttatggactgtcttatgatttcttcttttgttgtcagaaaaggctgtgaaactgtcattctctgatgtttcaaagaaggttatgactactgctccctcattaatagatagggaagatggatttgataagtgactagagcatttgataagtgactctctagggcctagactcaggaaatactgtaggattatgtttttttgactgtgaatgacttggacaccatgccatggttggggcccatggcatatagagccaaacaaggccattgagcaccatttgctttcaagaaggaataaatagaaatgaaaaccaggagcctgatgtggggtgaggggaagggattgggtgggagtgagggtgtcagaagaacctctttggttctacatggttcctcttggggtaccaggttctctcccaagcaagatgggtggtgtgtcccaatatgtagtggtgtgtgaataactgattactaatagtaaagtgccaacatatttattgacttgcttaaaaggtaagcagattcaaggttatcactctaataatatgatatcaggttggtgcaaaggtaatgtggttattgccattgcttttaatttaaaaccgcaattacctttgcaccaacctgatatcacccttacacaattcattagaggttttcacaaatgagagagaaaggagtagtgccacataaatctgtgcaaagaatcatgtttacctatagcctctctcccagtaccatcacacctgcagtgagcaactgttactgataaactgttagtaagtattgtgattataaattattttcatgcacttaacaaagatttcataaaaatctgtgtattcccaaagaggtgtgccatgtatatgaatttattctactgcacatatgagacatagttgagaatcgctgggttagacaattctgtgtgggatatgatttatgtttttagaattgcccttggactaactgtgtcataagatacatgaacatgcacacttaactacttttttcctgctacgcttcctcgactgccatggttctcttcatctgagaggtgaaagaggaacctgtggagttggctgtgcattgagatcttccagtcccactgaatcacgccatagtgcctgctaggaggacagtaatctagagtagtgcttctcttcttcgatgtgcgttcaagtcagctggggatcttgctgcaatgcagattctgattcagtaggtctagagtgggactcaagattctgcatttaaagcctcacaggtaatgctggtctggtttatggaccccactttgaattacaagggtctagactaggatgtcgaacttacttctgtttcctattttcctagaagtgtgctattttctttggtgtaggtttatgtaaatatagccccagcagcaactactggcaaaaaagcgaattagattcttcttgcagtatgttttcttcccccttgagatgcctctgcatttacttattttaatttgtgcttctggcatgaaaagccatgcttgatactggagctgttttaaaatccaaaattgcactgtgtgctaaacggttttcttgctaattttttaccaagtccttttggggattgcagtgactttggcctctgatgcaatggttaacccttagcagtcaggaagtgtgaatcagtgtggctagactgaggaaaggcaggagactgtaagagttaagaaggctttgggtacaaataacagagtactggtctgaaaggagattaagcagcagaaacgttaattatctcacgtagcaagaagtctgggcatttggtttcatagttggtgcaggggacctagagatgtcacagaggtcatggactctttccttcttccacttctgcactgccagtggggattgggcagcacctgccagcatgggctgtatcactcccatacatcacatcttcatgggctgtcatcactgccagcatcacctcttcacatgaccattctcaaacaggaaggagaatggggagcaaaggagccctgtaggatggttattttattcaggagaaaaacttcactgcaagggcctgtactgtattactacctttggatcttacaggtcaggactagggcagagccacagaccattcactggtgaaaaagaaccatatgccattattggcttatatcaataaggtgaatctcccaaggcctggcaaacaaaatcaagattctggtaggaaagaacaggatatggatgttgggtagtcagccaacagtgtgtgctccaagaactgatactgagaagttatcatattctaagctcctcatggtaaagcttgaggacctgttgctcaaagaaggaaacgagcagggagtgtcattgggacttaacattcaggcctgttcaattttaaagcacctctttggagcggaaacatggctcctttgtatgcactgtgtcttcccttgcagcctgtcttctttctgttagttttagggattattgatggcagacttactagaatcaggatcccacagtatgcctctgaataggggccacatatgttacatcacacacgttgctatctggcctctttggccgtgggtgtgctggaataccactataataatagaaggaaaactactcctatgtgcaaagtggcattatttcaagaaggaagccagctcagtgagtgtgggtggctgctgctgccggtcttgttgcatcttgacttgtcctgctgagctttctgctcttcttcttgctctgagctatgctgtgttctgctgagcacagcgcaggtgcccagaagcgcaacgtccacctggaagacttaagttatccctctgcctcctttgagtcaggacagcagaaagctttctcctgctttggattgcagggtttcctagtaggttggagggaaggggtggccctcccagtttgcactcagagttggctttcagtgcccagaggtctggtgacattctgatgatggtcaggctccaggaaaaaagttgtgcctatttcctctataaacaaaaagaaaacaaacagaagtattagtatccaaaggctggatttaattatacataaacttaaagcagaaatggtgatttggtcagttaagggagcgaaagcactttgctaaagtataccataattgaataagcattgcaatcagaaggaaacaatactagaatcctgttggcttccatataaatgctgaattatggcctaggatgagctttcttgttattctcaaatgccctggagggagaaggattttgaccagagagtgctatgatcagaaactgcactttaggaagattaatctggatgtaataagtaagtctggattgcagttggaagaggcatgcctctgattctgtaactgctaactgctaaagccctgactttccctggtctgtgtttttcttctttcaccaagaaaatcgggtgaaagggccctgggaattagcagcagaagatggtgcttttagtgctgagtgtagtatactgggcccattagcatgtttcttgtatttatgttgtttaggtcatgtcatagtcattctattttagttaatatattcccccatgttagctctcactgcaaggccaggattatgtctaaatcaaaactctgttagcctgtggtatctaaacccactccgtgcatgtacacaattgtgcacacccatgtgtaccgggcataagtaggtgctgcaccactgacacacatcctagtacaaaaataatatgaaaataaggaaatacatggttaaaaaaaatgctctctttagtctgttcccaacagaattaagaaaatatttgcttctgttttctactcattattatacagtttgcataactgaagtcacaatgtacttctttaatcatccaacgttggtggtataacattttaaggaaacctgtgggactcgggaaggccggatgctggcagccctgaaaatgttcccgggtgtttagaagaacatttcaattttgtcagtcaagtcttgagagtctctcatgagaaaaaaacaacaactgggaatcaaaccaaattataaagagataggttttcatgatataaatatgacatttaggattaaccagtgaacctcaaaccagtttttctgtgttgggtaatcacaacttgatctttactcagagaagagcttaggagttgcggaatcttaaccccattattgcattttgcatttccttctcaataaagaaaaatacactgaactttccggaagaggagactagggctaagtggctgactcctttctgaaggactgtgaattttattcagaccttcgataacttgctgtgtgttccttggcaagtcatctaatctttttattccttcctcttttcttaattccaatatctactaaatcatcgtattttcttaagaattggtctaatcctctccatttccaacctctctattcatatacaggctctgttgattttgctcctgggctatggttgtggtcttctctgcttctagtctttttcctttcttgaacatccctgcatggtcactttttccaaatgttgttcttctctaacgagagagggaacaacagctgttaattgaatcaggtacaaattcccttacctggtgctcagactctgtggttggttgggcccctcaacaatctcacccagtacttccctgcttttaaaaataatggcctctgtggaaaagaagctgcttgtaggaaagaactctcagggtcccctgaagctatgggggctcctattgctccagactcccacccagccacttaggcatcagtgtctcttttaactcattgtagctacattttaggaagctctgaactctcaaacattgatcccgttactctctgatcaaagagagtcaatgttgttcatgcacaactcaggttccttttcaaagagaatagcagatactgtagaagtttgaggtaggtgaggcttgggtactcacccacagcttcccttacaggttttagagaaatcaactttcagaccaaattttgcccttcattagcaagcaagcccctaaacagttctcacaatttgttctgtaagctcaaggaaatcccagttctttttcctcataggtgaatgaaaaattcattagaggcagacatgccaagattccagatgcagtttttgctttatccttatgcttgctactaggaatccaaccatccacagaactggctagggtatagtctacagttggactggactggattgttttattctgttcatgcaagagtaaggagtatatctaaaatattttagccactctctggtgctaagaacctttattttcagcagtgaaagcccatttctaacatgtatcatacctctcaacaggtcactgttttccctaataataacccctttggacaatcagtcacctggcttatgctcatctatatttagatttggataatagaaatacttccagcagctgcctctggcatcctgagtcgagtgctatcagaacccccccagcactggacattcttggttagaatgccagctgaccacctaggttgtggtatcacaaacataatatcacatggcatatgttgaagtattttaggtacattttagacatcataaccacacagttggcagactttagttttgcggactaaattaggcaggagaaatcgcttttctatttttttaaaaatgaatttgttgccaactacagtaagaaagggagctttttcataaagattccaatgtttggcttttttgggaaaactgggatatccagcaatcctgggtctacatttctctatggcaactttcttctggtgccaagcagcaggggcctgccttggaccttggtgggagggtgctgacagtgggctccagggcttcacacagggcccagcactcctaaagtctcccgtcacagagactgagcatcaagggcccttgtcactgagactgtagctgttgtttttcaggaccctcttttctccattgtattcctgcctggctgctgtaggtgttttgagtttttgacccttgcagctgtcagtttttcttcttggctccacacttgtgctttgctcatgccgtttctttgtctggaatttgtttcctgttggacttgctcatccaagtcttcacctcatcttgaaggctggctccaagacccactttggagatagtcttctatgaccattatggttatagctcctctgcttctacacagacaatatagtatttgattttatacatcttatcctacttaggtgggaatattcttttttttttttttctgagacgggctcactctgttgcctagactggagtgcagtggcatgatcatggcttactgcgtcctcgacctcctgggctcaagcgattctcccatttcatcctcctgagtagctgaaattacagttgcatgccaccgcacccacctaatgaactatcatgcccgacaaatattgttgaagtcaagaaacatgtcttctcctattttatctctgccactgtaaaatatttatgcttatcccctcagcctgcttgccttgcttatgaaaaggcagtgagtagcttatcgatctacctaacagttgttataaagaatagtcatacatggtaaaaaaaaaaatgagtcttataaatatgaaagtaatatagaaattgaggctcggcatggtggctcatgcttataattccagcacgttgggaggctgagacaggaggatcgcttgagctcaacagtttgagaacaccttgggcaacatagagagaccccatatctacaaaaaataaaaataaattagatgggcatggtagcacatgcctgtagtcatagctgcttgggaggctgaggtaggaggatcgcttgagcatgggaggttgaggctgcagtgagccatgatcatgccactatgttccaccttgggcgacagagcgagactctgtttcaaaaaaataaaataaataaataaaaataggcctaaataagaagcccaataaggcccagaaagtttaagtccctttcgggagtcatacagttgggtaatagtctagccttaggcctaatcactgttaacactcagatcttgcccattagtcctgtaatgtttcctagtagatctgccactctccaaatcagataaccatacctgcagatcctcctcaaggcttagtagcattcacacatcaaaactagaccatgaccaatgttactgaaatcaaattacgcaaaggtgatgaatgcacatcaaattactcaccaagagccagggtgccggagatgctgtgtcattaacaaggtcatgcagaaagccttctgctggtgcacctgttcagcatggagggttgatgtacctagacgacaaagcatcatgtgcaagggcaatgctggtgaggccaaggaggtgatgggatcagggaataaaaagtaagtcattcagtaggctggagcttactgtctgaatctgagagtagtgatataggtttacgtgttatgctgaaggattttgactttttcctgaggggacagggagccttgaaagacttttttttttttttgagacaaagtcttgctctcttgccaggccagagtggagtggcatgatctcagctcactgcaacctccgcctcctgggttcaagcgattcccccgcctcagcctccagagttgctgggactacaggcgcgtgccaccaggcccagctgattttttgtatttttttagtagagatggggtttcaccatgttggcctggatggtcttgaactcctgacctcgtgatccacttgcattggcctcccaaagtgctggggttacaggcatgagccaccgctcctgtcctgaaagtcttttaaggagggctcaggcctgtgacatagaaaggcctggttgctggagcctggatctggggaaagaagggagatgggaacttaggaggctgctgcagaaatcttagcaagaagtagtggtggattaaatgaaggcagtggctgtggaggagcaaagaagtggatggattcagaaggtcttagaccctttttgttattaggatgacagcattatttgttgttgttgttgtttttcttaaagcagcatttacccatatcctccagttattcctggaggcagggagatggactggctaactttatgtgtagcctttgattctgtgtttctagagaaatgtctgtggttttgtacccaagtgaatctggctgcattccctttggctgtatagatgtaccccttaggaaacaaggacagcttttcactgttacagttctgccaccttgttctaactgtcatatgcaagctatctcaatataatataccaattttttgtgtatataacataagcacactatgtactttgctcaaaatgttctgttactgagtacatataatctgtatacacatcagccgtacataggagcaaattgtatatttcttctgtagtcatagagggagtagatattaggattgttgttttctgctcctgaaatttttgttctgagttttaaagacatttagccatctgtttatgactttaaagtgagtgttcaaagtggaggctctgaatgtatgtatcattacagatatattgaaagggtattgtcaataataaatggctactatacatctttttcggctgttttctaactttttaaaatgtgtaatgtaagcaggtagtatttttaaggaagtggaaatatatctaatgttaactatggatttttacctggattatgtcttttaggaagagactttagggtgcagagttgcttcaattgcatttaaaataatcaatttttccttaaagcagcttttacctgtatccttaatttatagatgatatgtatttatttcatattatattataaaatcattttaataaaaatgaaatgttggattcatcgttgaacttctttttagaaatataaattaagttgaaattagtagctttcaaagttttatcatatatattttttccagcagatatagtagatgcttacaaatattttaattcacctaactcttctctaagagaatgaattgtatcttctcccacccacaggagactgactggttccagagatttcttttcacaagacttcagttttctggctgcagtataagaattaaaagggctttagagttggaaacatatatgcatattaagttatttagcagtttaaacatatatacttttattcaatatgaacatgagagtagcagttggaacaaagactccatttgtcaattttcattccttttatttgtagttgaaatcctgttgggagtatgagtaaatttaaatataaataaaatgcaacattcaatgtatttctactcaggaaaccagttacaatgttattaagttacaattgcataaactaaccttataggcctacagcaaatgctaatacattttgaccttggtttgtacttgagggtgttttttggtaattgctgtcaccctgacagccaacaagggggactcgcaaaggaaaagcgtatgagagcgatttgcaggggctcagactgcacattgcgctgtggtgttttgatgtgttgcctacctgtttttattactacccaccagctcgctatcaagtagtccttgacctggctatcattgataggtacactagtcttgagtaattggtactttaacttatcaactacttttaaccactgtgtaaaaatgaaagcaagaatagtacgttaataattgccaggcattcccttctgtactgtacatacaaatagaatttttacacatgtgcctgtatgtatatataggttgagtatccctaaatcagaatatgtgaaatctcaaatgttccaaattctgaaactttttgaatgtgaggtgacattcaaaggaaatgttcacgggtacatttcagatttctggttttcgaatgaggggtacttaactagtttagtatataatgcaagtattttaaaatgagaaaaaatccaaaatctaaaacatttctggtcgcaagcatttccggatgctcaatctgtacagtatgcctaattaattcatcttcttataaaattaacttctatatataatgagttaaagttaagaaaaatattatttacttgtacaatccattgcctctgtacttatgaaaattgtccagaaaatcagtctttgctgactaagcttttttgcatatggacatactcgggcatgttggctttatatatcttatctttatatacctcagctaaaagctaacaccctttatatttaatttggtatgctaagcttttggaccggcaggcttgtggcccattaccagcgatggtattctccaaggtgtaggggatagcagagggcaggtcttccttttttttcctgagagagcaccgtagacatgtttggaatagttcatcaccactgtaaagctcacaaagaagagacatgctcaaaaaatcacaatttataagcaataatgtcttacataaaataaaggtgatttttttttccctttcagattttggggtaagtgcgttcctagcaacagggggtgatgttacccgaaataaagtaagaaaaacattcgttggcaccccatgttggatggctcctgaagtcatggaacaggtaaaaaaacaaaaaaagtgactttttgatggacatagtacaatcgtacagatcattaatatgctaacatttcatttgtatctagcattttagtagaatgcataatgtaactaagatttaattctcaattgctagctaattagcaaactaacgtgaaagttatacatcaacagctgtggatttctgacatgacatggacttgatgatgtgtaacatgcctgctgtatgattgtgtttttttcctgctttctttcttaggtgagaggctatgacttcaaggctgacatgtggagttttggaataactgccattgaattagcaacaggagcagcgccttatcacaaatatcctcccatgaaagtaattacaattggaaatactacatcggggttgaaatgtgattggacggaatctgttttctaattctcttcaacatcttcattcttctcttagacccgaggagaattaatggaggaacgcagccaagttgaacattgtctgattttctcagtggacagaataggacaaaagtagcataattcccagctttgaagcttgctttatagtctcagcacagagttaagaaaataatgttatcagattggttgatggaggttgatagctatgacaaatgctggtcattactcttttgatagcagaacaacgccaggttcccagagaatatctcaaaatagattatagtgatgtcatctctgcaaatgggtttcccagattttcagagcttttttttttctttctttttaagtggactacaacatttttacccctgctcttatagtgtaatgttggcaactgatctgatataagtgagccacagtgtttttaggatgctattttcacgtttctgctcttcttttaactggtttatacctcattatttctcttagttctgagatagtggtatcagggcttatttacccaactggattttgttttgaggctgaaatagtttagtgaaattataatgctattttacatagagtatggtctatgattgtttcatggttactggaaaaatttgggaggatttattttaaaaacccaagaataaaaagtgagttttactgattaaaagaagtagtatactcatattgtagaaagtttggatgtgcaactcagactaaagaagaaaaacaatcatccgtaatctcatcaaccagacaatctctactaaggtttcagtgtaattcattttattgtttttatatatatatatataaattttttttaacatagttaggattttagtgtatttgtgtgtgtgtgggtacatataccggattttgctagcagaaaatttaaaattgaagcgtaaacaattgaagtgacctcttggagaaaaagcactgaagtaatgctgaaggattttttcttttattcagtttttctttcttcattttctttcttttgcctcttctcagtgtttcccacctgaattcaaagtcgcacttgcttgtcccagcctgacgtcctctaggacttttcttcagagttcccagtctcccgctttctcctgtgggctattatcctccacaaacaataagccgtcactttcacgcttcatctattcacacatctgaaagtgtttgaaaagaggcttgacatgtatagcatttgcataaattaaggctgaattatgcattaatgagttttattgattgtacaggctagtagttttctacactttccactttttttttaaagcaaatacttttgaagttagtatgaaagagtggaatttttaccgttttgatttaaagttgtattttattttgttttgtccccctccgaaagcagcaaggactttggatttgatgacagtttttagcaactcagttatattctggctatccttcagtgtcctgctctctcagctttgccaagccttttagcaattttctgtatgttttctcatttttttaaaggaaatcatgttacctcctgggatgttgtggttttatttttagggctagtaatgtgttacagaagccttgagtacaggcagttccttacttatgaatgacctgtatacatgaacagtcactgcctcgctggccctctctcttctcctccacccgctttcccaactagcctgtgctggagctacgtgctcctcaaggcagtacacgagccagttcccagaaagctctgtccgggatcattcttaacacatagagcaagttttgtaagttctgtcaatggaataacaaaaaggttaaagggggcatgaacacatttgcagtggtaatgaatactttaaatacacaatttctgcaaagttaaaatcatgggaaagcactttgtatctaatcaaggatggttttttacacttttatgaaaaattcaaaactagattgtagcaattgctatactgagattctgtcttcatgtttgtttctgctgcaggtgttaatgttgactttgcaaaatgatccacccactttggaaacaggggtagaggataaagaaatgatgaaaaagtacggcaagtcctttagaaaattactttcactgtgtcttcagaaagatccttccaaaaggtaagtgaaacttagtggatgagttaatgacctggtttgagccatgacaaagctttgtttgtagatggggaaaggctttgtgaggacactggaaaggtatttcttgtctgggaaaccctgctgtggtccccagatttccaacctgttagtgaaagacggtgtgggtccaagagggaaagaagtgggtgaagaacgaaggagaggcagaggaaaaattgtggtgttaacaagattcactgtgcttgttaagtgtgggctctgtcatcaaaggaaatgaagtaaaacagaaatcaaaagaaattggcagtgctgcattcagaagctgagctaatattcttcactgtgtaggttgaactgacctctcaggatttgaatatcctgctagctccagtctaaactaggcagagctattgaattttgcatgagcttcctgttagttgcagaacaagttgttggtgctgtttaaaagattatcagtaaagaagattaaggagattttttaccttaaaaagattaatcatgtaaacagaagcaaatggctttaaattaacattagtgtttcctatttattcttgggttattgccctgcactgtagtgtgtctgttttctgagttccttttcttccttcttaatttctgtgactttgaaatatcctggttagtgatcatggagcccactgttctttgtcacctagaggagattgttaattatgtgaatggccttgcctgggtaaggtccctttgtgggttcttggttgtatgtggtgttatcctagcatagaccaggagaggcctctgagaagttcctatctatcctaatccacctgaggatccaatttgatccttatattttaaaacataataactgacttctcttctgaaactttctttttcagggaaggactctgctgttagaaatgattcctttattttgatcttaaatttttatgaaacttgttaagcctttacacagtaacttacagtttgagtaggcaagccttctctagtttaaacacagtttccataattgtacccattctttgtagctgctcacttcattcctttacatttgctgaatttgccttgaatcttttccatatcaatcacttttctcatggagccaggaatgaagactgctattagccatcttgaattatttattgtaaaagggatgattattttgtcatacctgtgtactatttctatgtaaacatctcatttgttatttatatttgattcatagggcttgttttccttccaaaattttttaatctttcattgagattatttcttcaacctccatttgggtgaaatgctcttagattctaattttgttttccaacatttgcttatcttccccttgaatttggtgtcatctccagtaaaattttttgacatcttcaagaaaacagaatttgatccttcatagcccagcaagagaagttcttgtctttccagttagtactaggttattatagatggtcttcctgattcttgaacgacagtaattgagattccacctagtggttgtgatttgtaatgtcacacaattccagttttttaagaaaattgttctgtagggtagaatcgttagtgtacttaatgatataatagtgtatttctttaggagatttgtatgtgatttggtcaaaacaaattagattgacatacattatatttaacaaaccctttttatttcttttcttttttttttttttttgagacggagtcttgctctgtcactgggctagagtgcagtggcgcgatcttggctcactgcaacctctacctcccgggttcaagtgattctcctgcctcactctcccgagtagttgggactacaggcgtgtgtcaccacgccaggctaattttttttgtattttagtagagacggggtttcactctgttggccaagatgatctcgatctcctgacctcgtgattcgcccgccttggcctcccaaagtgctgggattacaggcatgagctaccgcacccggtccatttttatttcttaataatcttgaaagtctttccggattttattcattatatgagcttaaatatcaggttccttctattccaccaaaaaaaaaaaaaatcctttagaagagcgtcatataacatatattcaaaatcttcaaatctttccttcagagaccactctcttaaaaacactgttgatgtacaaagtattaatcttttaaggtcttcttttagatattttctccgtaacttaatttgttctcactattgtgcaattgttctctataccaagcagctatagactgttagtggcacatcaccttcccaggtagctctttcttataatgaaaagacacgtaggttgagtttgcggggggaaaaatctatgcaatgtaagaatggaaaaaagcaacattgttgaattactttttagataggatgcaatttcaacatatgaattcatgactaatttgataagtaaacattgaatttcctgcacaataataaaagaaaccaggaatattttctgcctttgcttttgtcattggagagttcttgcccttcctctgtcccctttctatccctctttttgtgcttggttcagatgccacatcctcctagagttacatacctgtgggtgggattcctagctctactttatcaacatctgcatggcttagctttcttgtctgtacagtgggccttaaaatacccacttcataggatcgctgtgaggatgggaagagagaatgtgctgtgggcacttcaaactcatagcacagtgcccagggagtctctaagtactcacaagattaagattgccattcgttatttgccttttttttttttctgaccaagtggagttgttgaaacttttatgcaataactacagtatgttgaaaatatgtcttttgtagcacttattacactgtgtactcttattgatttacacaccccaattcctcaaaagtttataagtgtttttgggagaacctgtgccacttatccttatatccagtgtctggtttgtattatatactcagtaccatttcttgaacaactggagattgggagcttgcaatttgggggtgatttggacccgttgaagaatgtttcataaacagaaatcagatttgagtaggttgaagagtgaatgcaaaatttttgccaatttttattatttctcttgcctaaatgtagatcatctacctgtaacctgaaagtttactggtgccaaagccctggtattgctgagtacctcatgagcaatgagtgaaaaaatattgcgagaaaacagtgaccaggacagattcactcatatgcatcaactctcaggccgctgagagtaggctgtgtttttttgtcaacgatgagagctcatgggactttcctcataaaagggagctggggtgttgcagacctttggttcgtctgagtctgtgttctgcattgacgtagacagagagttgcttatatttgcataccagaacatcttgctattccttaaaaataaaagagccttaatcttgtagactacatgctttgtatggctagcaactgtaaaaagaaccaacttttttttttttttttgcaacaagggggatgatgttgcattgataaatccttaagaaaggaatatgacttgaatatttcttttgtggggagtggtgtggggaggaaagcagctctgcttgaggtcaaagggctgttggaacttattaatgcaaattgttagaactatttaaactatatcatattcatcttgaatcttttgaaaattattttaagtctcagtggactttggttcatccatatgcattagctgaatcctttaagagattttcttctgagaatgttgttacttgcagactgctgcattgtttttaaggatttaaaattgaatcattgttcaaagcctggaccattattttggttgctggtaacattttagcatttctcataaaactgtttgtacttacattatgctgaattgtttgatgtttgctagtggccatgtaagacgtgactgtgcttgcagaattttcttctgtagtactcagctaaaaggtaggctgtactggtggttccacattagccaggcattggcagttgctatggcataaaataaaaatagataaatgagaaaataaaaaccaaaaaaaccctaaaatcaaatgggcagcaggacctcagcttttctcacacttcctatcactgtcttccctctgtcattttcttttttttttagacagagtctcgctttgtcacccaggctggagtggaatggcatgatctcggctcactgcaacctccgcctcctgggttcaagtgattctcctgcctcagcctcctgagtagctgggattacaggtgcccgccatcacgcctggctaatttttgtatttttaacagagatggggtttcaccatgttggccaggctgttcttgaactcctgacctcaagtgatctggcctcccaaagtgctgggattacaggtgtgagccaccgctcctggcccctctgtcattttcttaatttcttccagttccattctttcattctttctcatggagatagtttggcatatgtaggattttatcccaaagtgataaacacttcagctgatttgagcaaagagaaacctctaatctgctatttagttattctctgtgtaaagttggaattacctattacttaacaattaagccaataaaaaaagaaggcgggttgtttaaaccaattctattttgttaccttattgtgtttttgtacttactgatgaaggctgagagtggagtggagtgcagagaaaggagttttctttgcagcatgcttttcccttttacatttttggttaccatggcaatgaccttgctggagaaggcaaagtattttcccagccccgtatctcaaggtatccctggtacttcccagctttctctctacagcatcctacacttgacccttcctgtgtggggaggaggatttttggtggggggatggtgcagaggagacagggaggcactttgcctccttacgttggcacttcctctgtcctctttttttgctagcacgagtctcattttcattaagtctttctcctgttccccgctgtattgaacagatgcatagattttggtgctaactgaatctagctccaggagttgtagtgctgtgtccaaatgtgtagcagcatcactttcccccatatttgattatagtatgaaattgagctgtagcagtttctgttctgtgctaggtattggaaacatacaaaggaattctatgaggtccctgccttggaagggctcatatcctagtggagtgaggcagggagacataggaacagaaaaatacatgatgggaatgtgggtagcatggtgcatgagtgccactagggagcaatgccttctacttgcaggagctaggagaggtatctttgaagatgacatttaaattggctcttgactgatgagcgagggtgtgccagttggttatgaaaaatttggaagcaagaaaagcagtgtgtgctttgtcacgaaagatcaagagatgagtgagaacatcgttgcagttgaagggtggcatctccggcgggtgtggggagatgaggatggaggagtcagggcctagaatacttgcttctgtctcaggccactgaaatgcatcaggatagataaaagaggatcagattttttttttaagacgctaatttgcgaagcagtggggttggtggatgatgggttggaaatagcaagggagaagtagtgagacactagctgaggggctgttttatttaactatattagccagagatgatgagggcttcaaacagaaccagggccttgagttttttcatcattctgattttcttagggttcttttcacattaaaaaaattaaaatccaagttattttctatgcttcttagtttttaaaatgttgtttcatgttgtgaggttcccaaacatgacattttggtccatttctgagtccaatgtaaagtgtttctactacatgttccctcaggagcccttctccttccaaggtgtttgaatgtgctgctgcccctcttgccgttgagcagcacactgctcttacctgctagattgtgacttgttggaggattatttatgtctgccatcttcattatagtatgcctagcacctagcataatgcctgacaaacagtgggtgcttagttaatatttactgagagagtgaaaggatgaatttggaatagctagaggcaaaaacatctgctggtgatcaggaagagtatacattaaaataacaactaaagttgaatcatttgaaagagttatactgtagtgtttagttctagggcctatttaacaaggtgcagattcatggcctacctgttgtttagacccttagttactcaaagcaattagcaggtagatacggagatccagggttctttgtcatgtacctacccataaccagtgttccacttgaaatctgaggaaaaaagcagtaatgatttacacagaaaatttctttgcacagaaatagtttctggggcccctgtagacttacacagtttgtgtactgatgcacgtaatgacattttctaattctttctatgcttgggtttgatccctgggaatattttagtggagcttcctgattccaaagcagcagtttccaattttgtcaagcatgaggattccttttcaacttgccccgccccaccccctgctacaatattatttgtgcgtttggtaattgttgcctaagataatacctaatgatattcaataatgcatccctcctcctttctctcccaatatcttattatgaaacatttaaaacatatggaaaagatgaaaaagtagtgcattgtttacttctataccatcacccagattaaacaagtattcacattttctataattgtgatatctatgttttatttgctgaactctgaaagtaaaagacttaatactttagcttgcatttcttataaacaaggacatgttcctacacaactacagtaattttccacacctaagaaaatgaagagcacgttcctaaaattatctaatatttagcagattcacacatctctaatgattcccaaatgtcctttatagcctctgtggcttctttctcaagcccaggatccagtccagggctgtgtgttacatttggttttaatgttttgtaaagtctgttgagtctagaacagttccttcagtccccctgaaagagatcaggccagttgtcttgctgagcaaccctatactcccgttatttgattctttctcatggctgcctttttggaaggaactattgatgaaggaagctattctttgtgtaagaatgtcagtcagtaaacaaggaagatagaagtaggaactcagtattctgctacttcctatgaaataactattgaaggcaaagatatgaacacaattagcagaaaggttttcaggaacaggatattcataaaatgtcaaagtattacccaacagaacacttgctaattgcagtgggggaaaacatgacctttgcaagggagagatttggtgcctggggactgatggttaaatttagcatcactaacagtggaatgacctaacaggacctgcctctgaggtgctgctgtaagaagtgtgtgccatcatctatgaagtattcttgccccaaatgcttaattaaatctctttgaagccttcagacctcacttagagtttacaggaaatatgggctagagaagcaagttgaatgacaccatgaggaaataatcacaccatctggtaatgcttctaaatgaatttgcattttattaatcacgatcgcatttaccttcacctggcaaacagcagtccatatgcacttgagacaggtttattgagcaggcaaacagagcgtggacacgatgtgtggaccccttgcagtacctgctgctcttggggaagcatagagcatagtagagtatactttctttgacagggtcatatggtagcttgtatggtttcttaataaatatagaaatttagctcacagatgtgtcagtctgcccccttttagaaacactaaattcacttagttaagtgtaaggatgaaggatggaaaattgattacgccccaagcacttaatgtacaggagtttatgtgttttgcagtagaggtatttggaaagaactggaaaattggcactattttatttggtgccagcctatgattaatttggttcccagttttgctattactaaaattggtcttccagaaatactcttaaggttaagttgtttcatcaaggcagtgcatttattaagtggtcattgtttcaactctaatttattattgatctttcaggcccacagcagcagaacttttaaaatgcaaattcttccagaaagccaaggtaacatgcttaaaaacccaagtaaatctgctatttttgaaatcactgtgtatttatgtgtatcatatttgatgttaaactgttgggaatatttgttttgcagaacagagagtacctgattgagaagctgcttacaagaacaccagacatagcccaaagagccaaaaaggtaagtgccattagccttcatgaccctgtaggaaccaatccccagggaaatgaaacccatagaaaaattggaaaaagatttccacatatgcaggatatactattcagacgctatatctcattagtgattactcagataactgcatttgccttttcgttatctcagctggttgttatacatttgggtgtggaaacaatttgaatctcaaatgatttcatttttccctttatcagctttgcttaaagaaggtcagaaaggaggggatgtgatgaggtttaaatactggagaggtaaaatatccttgaacgtctttcctttgggttttacagaagaggcatgctcactttttagataaagtttgtaacgatgaagataaaaaacacaacttttaatggtttgaatagctgtgagatagcattctttcctcatgaaagacctatggtcccttttttagtttaccttatgttaactgaattatggtaatgattagctgaacaatcttccattttaggttttagatttctaaaatggcatgtatgtatgtatttatttatttatgtatttttccagagacttatttatttgtaattacagatttcattgtggtatgaaacctaatacaatttaacctctggtttggtttagtttggtttttaaattatattagatatttataattaaaaatatgtatatagtcacatattttaaaaaggaggttcttcacccccatttacagttacagagaaagctgacatgaatctgtgttgtctgtgctgtaaataaaaatggcaaagaaatgtgctttagggattgtatctcatcttgccaaggtatacatagctgaatattaaattccagatactgccttttctaaaatattctgtagaaaatgcattagctgatgctttagaattgttttaaacagattttcaagtggactttaagaaatgtcccattctgtgaaggtatctgagcttctctcctggaccagaagaattatgtggggtgggctggtttctgcgctgtggctggggaggattgatgtgttgactttggagatatgagcccagttggtctctgaggggacagggagcgctgagcagacagtccatcagagtggaatatctgaaggggaagcacagaaaagctaaatcttcagtttgagggcaccagagtttgaggactcctatcagaagactgaaagagatgcctggagagattcccaggagtgttggagtctggcgtggggtcttttgatcaagtatttaaaatgtcagccagagttgagaaagctgttcaaaagccattagcttatatagtacatgtcctcaaaggactttttctttttcttatttttgggcccacacttcttttgctggaagtgtcatctgatcccatcctgttagctggtccctgagaggtgttttctaggctgctttctctctgcagctttggcctcacactccagctccttgttaagtggcctgccagcctcgctatcacagtgactccacagggcccaccttccctcccaagcctaaccttcctgtgctctgtatttctttccgagccccccagcctcagaaccctgggactatatgtgagccctccttccctaccttgtcttccccatctaaccactctccacatcttccctatgattccttctgcaattttggttgaaacctttttctccactatttttaactggacaattgcaataaatttctaactgttctccctccattccccgtttctattctttcttaggcatttctaacaagatttaactttctggtcttagttgctcaaaagtggtttccaaaattaaacaaaaacaaccagaagagcaaataaatgaaaaaatagaaatttaaaaaatggttcctgtctaataaagaccaagatccttagcctcgaatttatggcactatttcaacttccagtcttatattctaacctccagccaaactgaaccatctgtgcttcccactgtgtaacccatactttcctttggagctttttgaaatttgaaaaaatgaagaatctgttcaggctgtaaccttcatttctttgaagaaaaaaattacttggccgggtgtggtggctcacacctgtaatcctagtactttgggaggccgaggcaggtgaatcacaaggtcgggagatcgagaccatcccggccaatgtggtgaaaccccatctctactaaaaacacaaaaattagctgggcgtggtggtaggcacctgtagtcccagctactcgggaggctgaggcaggagaatcacttgaaccagggaatcagaggttgcagtgagccgagattgtgccactgcactccagcctagcggcagagcaagaccccgtctcaaaacaacaacaacaacaaacaacaacaaaaaacttattacatattagtgtgctgtgcattccaaaccccagtttgcatctatcttaaacaataagcaactagagtttcgtgagatgtgatttttcaaccatgtcttctgccatttacttgctctttgcttttagatgaacctcaggtcttgttccatcatccatcccttcaaatgcaaggtggccgcacagctcagtgtcacataggagtgaagggagaatgcaaattagttctttaagcatcctagagaaaagagagtggcctgttttgctgttatcctggctctctagtttcataatattggctgttttccgatcataattctaattttaatgagcaattgggttatcagctatactccacccctcacctgtaggttctttgacatactctgcccgggacagcatcgatcatggctcatttctcattcatagtaagtgcccacaaatgtttactgaccaaatgatcacatgccaaggaaaagccctttgaaactgttttccactcatttgaacccccacaatgcttggcatacacgtgttcctaggattcctgttaatagtgggtagtctccccgcaagccccgctctggcttgtgattctgataaacaaccatgatcatccttatgggaaacttcgtgtagacgtggctgctggaaagtaaatgtgattttaatcaccctgtgcaatgaaatgaaaacgtttattgtaggattctctgcttgtcttaggttgttccagtgtttaagtaacttctgtttaagaattggttcaggggagtcgttaatttatttgttcttagactgtcttgattgagatctcagccattctcctcttcactgtggcgcctcccagttgatcttgctctggcttctgtggtatagattgctcctcagaggctactcgttgatgttgatccattgatttttgtcttatcagttcgctgtttttcaaagagaaacagacagtccattgacacatgagtgtttaaatgatacctgggcctgtgggcagggctcttgggcatggaggcaaccatgttgattagaaatttgctgtcataaacagcattctcttctcctctcttctgctaaccaacattaagagataattttcaatgtgcatttttctttaatgtgaacaattttcatatttaaaggagaagaggggctggtattgtggctgttcttagaaagccccatggagcccaccagtgctgccctttagcaggagagaagcagaggcccgtcatactcatgtttggccaaaatgtgatgtttttgttgggagccacataattccacgagggtaggtgatcttgtcttcatccggattgactcctctaaatcacgaaaaaatagaaaatggaaaaagatcgacatggcctctttggtaatttagtatgcaaaacattttttttgggtgtgtggtaattgtagaaactgaggatatttattttcttcctacaggcagaatatttggtccattctgggttcttttgctgacagtgttgtttagggatcatcttgattttctttggctctagtctgaggggcccaggcatgtggtgaagggtaatataagattggatgttcctggacctcaagacactctatatattctaaatgagaacatgctagtaatgacccatgagaacagagctaagtgcagctgtataacttttttttcaagttttcactatctttgtgcatgagaataaaaggctttgtagccatcgctgcctctcctgtgactttctgagggacctgtctccagccatgtcttggggtttgaaagcttaaccacgtggtgttccatcttttactgtactgaattcattaggtggggaagggagtcaatggttcagttaaaattgaatgtagatgcttagggctgtgtgcatcttctttttttttttgattatcaaaatcagttcttattatatccttttctttgtattacagacagtatcttgctatttttacccatgtttcacatcaactcttttgttttattattatactttaagttctgggatacatgtgcagaacgtgcaggtttgttacataggtatacatgtgccatggtggtttgctgcacccatcaacccatcatctacattaggtatttctcctaatgctgtcccttccctagtcccccacccccctacagaccccagtatgtgatgttcccctccctgtctccatgtgttctcattgttcaactcccactcatgagtgaacatgcagtgtttggttttctgttgctgtgttagtttgctgagaatgatggtctcataatctgtgtgcatcttctacaggaacatttaaccctcagaattggctgatgtctaagttttatgttagtgataacatacttgaggcaccacactcacactcatattcatatgctttctgtggctttctaaaaccaacatatgggttgggcgcagtggctcacacctgtaatcccagcactttgggaggccgaggtgggaggatcacttgaggtcaggagttcaagaccagcctggctaacatggtgaaaccctgtctctactaaaaatacaaaattagccaggcgtggtgacacttgcctgtaaacccagctactcgggaggctgagcaggagaatcatttgaatccgggaggcagaggttgcagtgagccaggatcgtgacactgcactctatcctgggcaacagatcgagactccgcctcaaaaaaatagaaataaaaaatataacccacatatggcaggacagagggcaaggggctcgtagctatgcaaatgtctgaatgctcactgctcatccaaaaaacatattggccataggagggaatgaagaggaaacatgtaataggcagttctttcccttcttatggttgcctgtgttttcactggaagtagatttactggagggttattgcttgaactttcttaatcatgaaattaagtaagcaattaactaaacagtacaatgtttagtcattatcagaaggaggtaaagggtatcacatcgctgctgtctttggatggaaccgctgtgaagtggaaagactgggatgttatttgtgggtcccagaatttctaatattaggctatgagattggtttcatgccaaggccccaaggcccttggccccactggatccactgatatgcttaggaatcagtgggtaggaatatttcaattcacatttatttaatacttacaagtgttgagaacttgtcctgtttgtttttaacttttttttttttttttttgagatggaatctcgctcttttgcccaggctggatgaagtgcaatggcgtgatctccactcactgcaacctccgcttcccaggttcaagcgattctcctgcctcagcctcctgagtagctgggattacaggtgcccgccaccatgcccggctaatttttatatttttagaagagacgggatttcaccatgttggccaggctctcttgaactcctgaccttaagtgatcctctgacctgggcctctaaaagtgctgggattacaggcatgagccattggtgcctggcttgtttttactttttcttatgaaataatttcagacttacaaaaaagttagaaaaatagtgccaagaattttcgtatgtgttttctcttactctttattttgaaacattccacagtaggttgcagacagaatgccctttacctctaaatatacttcactgtatatttcctaaaaacaaggatactctcttacctagcaacagtacagttttcaaaattaggaaaagaacatcgatgtaatactattattttttagatcttatttgaattttgctacatttgccaattttcccattcatgtcatgtatctggtccaggattcagttcagaattattgagttgttacacctcctgtagtctcttttaatctagaacagtgtttcttttcccatctgtgactcctttgaagagtataggccagttattttatagaatgtccctccgtttaggtctgtgtgatatttctgaatgatcagattcagtttatgcactctttgatagacatacctcagaagtgatgttgggttcttctctgtatcatattaagaggcacatggtattgatttattcctttactggcaacgttcactttgatcatatgcataaggtgggaccttccagtttctttattgtaaacacaagtatcacttcttaataggatggatttatttacattcactgattacattaaacattaaaagataaagtgaatatatttactgtattgaatcattaatcttttttcaaggaaacatttatactttatgtcatggctctacattcataggctattaatgaggaattttattgatagatagaatgatagaaatcttgtgtataaaaacaccttgttggctgagtgtggtggctcacacttgtaatcccagcacttagagaggctgagatgggaggattgctagaacccaggagtttaacaccagcctgtgcaacatggcaagattctgtctctacaaaaaaaaaatttagctgggcatggtggtgtgtgcctgtgcttccagttacacaggaggctgagttgggaggattgatggagcccaggaggttgaaattgcagtaagccatagtcacaccactgtactccagcctgggtaacagagcaagaccctatctcaaacaaaatcaaacccaaaatgacagtacactggataaagaaaatgtggtacatatacactatggaatactacacagccataaaaaagaacaagatcatgtcctttgcagcaacatggatggaggtggagaccattatcctaagcaaactagcacaagaacagaaaaccaaatgccgcatgttctcacttataagtaggaattaagcactgagtaaacatggacacaaagaagggaacaatagacatgagggcctacttgagggtggaggatagcaagagggtgagaatcgaaaaacaacttactgggcaccacacttattacctgggtgatgaaataatctgtacaccaaaccgccacaacacgtaatttacctgtaaaacaaaccttcacatgtgcccctgaaacgaaaataaaaattttacaaaaaccaaaacaatacaaaccactttgctagcagatttaggcaggaagtggaggtgcacctgctgccccagtctctatgcctggtctggaaacagcaagagctatatctgtatcttttgttgggtgagctgcctaatctctctgagcctaacctgtaaggcagagctgacaatacttacattgtgttgctgtgaggatgagagatgatctgtgcaggatgtctggtgccgtgtttgacacatagcaggtgctcagtcagcagtggcagtgtgattgtcatgtaaataaggagaatgattattgtggctacggaagactggacattttagaagtatgtagtgaaatcaggagtgaagagagtgtcctgtaggtggggtggggtgcagatgggtattgaaggttgtttctgcattgccgttaatttgggtgaaatggaggaaaagcctatggatgcctacagaaagaaggaaaataattacagtagttagttcattgccattgcctattcacctgtcttcatgttttcttttccgatccatcaaggtgctggcagtgggtgagaaccagggctttctttcactacagtaaaccctccctgccctgagaaggggcgtgtatgtgtgaagagcctaagagtagtgagaattaaatacaaacacagccaatattctttcacagctttcagatcactttcatttatgcttccatatttgtcccaaacaattgttcttgaagacaggtagagcaggtgttactgtcacactttacagatggaaatgtgagaggtgaaaaggacctgcccaaagtcacatggccaaataagcaggagtgaactccagttcttattctcaatctatgctctttccaccaaatcatacctcagaatgaagaagaagagaacggagaggacaggaaggaaatatagatggagaaggtaggcagagttaagtggtgtacacaggaaaatgggagcgtatttgtcattctcagagtgagtcggccaccatttaaattgtgtgaggaggatgtctgtgctattcacaggcactaggagatgctacaggcactaggagatgctgcaggcatcattgcaggaatctgggaagtttgccagggttctagcaagtgtagagggaaggaggtgacaaaaaggctttggagattatgttggggagagagatggctagtgagagtttggttagcatcaacagttgttagataccgtcagaagctcagcttctcactcatgaagtggtaatggtaataatagctatgtttgggaggactaaattaggtaatacataatataatagtggttgggacaaaataataagtggcacaggttatagcaaaattttttaataatcacatatattgcttttattactatagttattatagtccagattgtttttgtaacatttatgattgctgccacagctgtgggcacccctgctgctgttcccatttctgctgctgctagaacagctgtttccattacaaccactgctaccagtagtgggcactcaggtgcacatgatacaaggacatagcacagacagtgaaactcacctttctgtgaagaacgcacaaacgtcacaagacatgcaaaactcaaagagtaatagagaataagcgctttggtatgtgggcatagcatctgtgctacagctacgggaaaggtcatgaagctggtagatgggggacatgtgaagggggaagagagaaaaacgatatttattgtgcacctttatgcatcctgctagatgcttacgtcacatttatctcaattactgcagccatacaacaatcagtaaagttctgagtataagatatgttaaataggttaggccagaggataagatacattagactattaagaatgatttttaaaaagctataaatattttgaaataccaacagaaaaggaaaaaccatctattaaaagtgagttaagctatccctaaagggttacaggattttaaaattgagaaccacaaatatctcctagttttccatgcttctgtgtacaggcctgaaaattaaggcctaaggaggtcgagccttaaccaaggccaactgcatcatcatgtcctaacagtccaaagccagtatcccagtttgttaccatttagtttcttcttttagtcgataaagagggaaaattaccctgagtttctacagaattgcttttttcccctcctggaatcttataattaacttataaaatatcgaaggttatgcattatcattaaagcagagaagagagagtgatttcaaatgcttgatggaatgatgttagttttgttccaagttttcccagtagagggcagcaatgggttttaagtctgtgccattgtggaaagctaactgagcaaaagttttggctttgtcgaaggcctcagacttggagttgagggatcaaaggggtgttaggtccctactgagccatgaacaagagacaccttagtcaattagggtgctactttactgggcaggagattgaagggtgatggtttaacgacttttcactattactatttttaagttatattttctattagcaaatcaaagcaatctaccatttgcattttacataattcgtgtcagaaacaaacatctcaattttgaagatgggattggagagcttccagtattttgtggtctcaagctatttttagaaaattctttggtttctgcagttctccttagagcttggtaaatacgggtagaagagagtcaacatgtacaataataacagtgaaggagaagtggacccacttccgcagttaccgtgcatattatgggtttaatataaaatactcccagtgatccacatcggcctgagtgcacatgtcctctctccactttgtgtttccttttcccatcctctcgcttaaaaccgaccatgtgccttgggaataaatctcattgaggaactcacatgctcacagggaggagggcaagggtggttgaggatattatttttcctattttagagctgagagaacagtaggccagagaggttaaagttactgatttcactggggctgttacagggacaggcgttcacagagtgtgagctcattggtgttttcactgcttttttattttaaattctttgctttttagttatttgagaactgagagttcctttggtcagaaaagagcttttggtcactagggggtgctattagaacagttcattgactaagaatctggacaggaattgcttaccagtctgtaaaaagccttgcagccgtagattttttccttttgctctgtgtctgtggcttgactggtgttcgcactgggggtgaattaggcagaggtgagggtagaggaaagagcaagggggaaaagcatcttacagagttactttcaattcatttggtgaattgagttgttgtttttttttttttttttttttgaaagcatatgttctgggaaagtgactcctttctggttgcctttgactgggagctgagaggatccactctggaaattgtaatttgctgatccccatttagggagaatgtctttatttttagattgatcttgaaagacagtgagctgtgtaaactttcacagacttggaggtccagttttggatatttagaaataatgacacatactctgaaattattgtaagagatactgtttctacaaatttagtttgtagaaaactaattgttactggaaatcacatccagttagatttgtgaggtctggatagtcttcaaacatattatgtgcttcctttttgcctttgggaaatttgctaacttttcccaaaagcttgcgtgcatgagctagcttttctggaactgaagtggcgtgttacttgctgagagaagctcccgactgcctcctcctcctcctccatctgtccatgcagtgctccccgagcatcctggtaacctactaggtgctgaccttccctacggtaggtggcctttattcagcctctcagctccctctaatcctagtgtaccatttctttcctttcttccgaaaggaaaataatttggctagagttgcggaaaaactaatataaaatattgtcagtaaatgcccttttgatcttgtcaaaactctactatagttgtactgtcttttctccctgattgaaaactcaatggcttcttgtcattaataggataagatacaagttcccgccacttataagatgaggtgcacatcacttggaggtaagggatcactccagggtcccatggtctatgtctccaggctttctctcagccacgggccacctcggccttcaacacatctttaccaaattagatgtgtttggtaattgtacttttctaccagtacactcctgaaatccccacatgcaccatgaaggcctctccctacacttgtatctctcccagcctagcatcttttctgtgaagctttctgatactaccctcccagcaccccaggaggttcatcagtctgttctctgtactactccttaccttgagcttaaatatgttgttgcacttggtgtcatttatagcttactttctgctagttttaccttctgtagcctactatcaattcttgtggagcatggatggtgtccttttatctctgtgttctcagtacccaacatagtattttggtcaattagtaactatttttcaaattgaagtttagcaagcaagatggtgatgaggatcgtcttcatgggagctggtgtgagagtgcaaggggaggtagaggaaatctgcttttagttttaaagaagaatagttaagatatttttcagctggtgctgtattcttgtatttgaagtctgggactcagggtttagccgaacctaaatttaaaatcaactttgttagcaccaacttgttgagagtcttgagtgagccattaacttgattcacctttgccacatgatcatagaatggaatggttagatattattaggtaataattgtgaattatgcactttgtattatttgacaacaaaaatgtagtccctaccactcagcatatattgactattgtcattttcttctctgagccaggatgcacatacgttttcctgttacctgaagctgcatttaattaggaagatattccaaaaatagctttaaattaggttttagtacgctccacttttggattaccttttacttatttcctcacttaggagaaataatttaaactttttatatcatgatcctgcaagtctttaaaatgagtaagatgttttggagtagggaaggtgaaggaaatggaaagtaatggcacttttatgcatcacggggaaaggaagggttctatcatctgtgggaggaaggcaaatgtttgcccctctgccctggcctcttaggttgtggtcattcaatcacagggaatgtggagaggccagcagggggtgtggtacatatgtttgagacatcattgttgggggtcgggagtctgcttgttttaggctaatcaaacttgattgacttaacaaagattcagggctctatttattttaaaaggccagaaataccttgtttttaaaaatatatttttttactttgaaatccagtagttctaaaacaaattaaaattcaagggactcgattaaggttgcactttgatatagaattttctaagctttccattgaattacttctgacacattcaaataccgatttagaagagtgtctaatgacttttaattttgttcttcacatatagacatatacaaaattaaggcgcccttgtacaactttcacagcaatcatagagctgggaaatgcaaacagtagcctttaatttaacccagattgaaaaggccagttgaagttgttttgggtgaggggtgggctttctctgtgactttgtggaaagctgtgagaggcagatgaaggagagaaaggctcaggagtagctcttggtcaggaagctgggaccataaaaatctatgcttgaaggttaagaccaagctttggctcttgagatagactccagccagccctggctctacgacccactcatggggtaaccttgagtggcagctgagctccccagtgccttgtctgtgacatggagactgttcagtggcttcttgttcttcttgggcaaaaactaaaatctttaaccggggttccagtgcttcgcatggtctagtcccttcttcgctcttcagccttgtcttgcattctccaccctcagttctctattgtccacttgcccatagcccttgtccatgttgctcttccccctggaagtgtcagctcttctcatcctgagcagacctcagtttcagctcaaagagtcatttctccagaaaacaaagttggaatcatgccatatttattgtcctgcaatctacctgcaatttcatttaagatatacctttggacatctttttatgtcaacaaacatagattagcgtaatcaaatggctgcatgaaattctgcaagaatgactataattaagaatcaattttttcttgataaatactagattgttgccaatttagaaatcgttaaccacactgggatgaacatcattgtacttgcattattacatagatgttacctattttgttagtctatttcctaggaacaggattgcttggtcaaagagtatatggtttataattattgacacatatcaccttacatatgtttaaagtgggaggtgttatgtttcaaatcccagcctgagtctcaggtccatcatctgtagaacattacttatgtatacacccatgcacatgggtgcatgcgtatatatgcttaattcagtgcctagcatatggtatttaatattatttatttttggcattggaatgttatccatgaacatttactttatttcattttttttcctagatctacagttagctgttttgtagagagaattccagatcttctggtggttctgcaaccttgagactttcagtactttaggagagattagattatacgaggtacttcaggctaattgacctagagcctattatgtagatcccagcttagggtcctgaactcttggggccattaaagttagttaggagagagccattggtagtaaaacgtattgaagccgttttgttctgcagtctgttcttggacacagaccgagtgtgcagtgttacaaggtgttttgcccattactctgtcactgtaatctcttctgtccagaacaaacaagtgataaaccagctgcctgcctgaaagtaagaccacgccgttttcatcatcccctggcttctggttgtagatgcttgttatgaggtccgatgtcagccattcatgcggtgccaggtgttggtcatgaccagtgcctacactcaaggatagcactgcagtttccataatcctatgatcttaaccattcataacttttagagttgagaaccctatttttcttttttcctgaaccattgcattgtttttaaaaagaacgtataaccttgagattacagcctcactggccctgggctggttttgaacctcatgtaatcacatggcttctctgagcctcgatttccccaccttcccaacctccaagggtttttatgaagttgaaatgtgacagtttatgtaaaacacttatgcagattataacagagattctaaaaatgctttttttgccttcttctcccttccctcattgtgcgtcagggaacattttgtaaggaaggagttgtgtattatacaagtgagcataaggaagtatttaaatgtcatgtgagaattgtcttttattttcttaaggaaattattgtctaaggttagtgaatttcatcctgctctttcgttcttccttcctgtctctgtagagcacaataacccaacagctacaacctcatgctttagataaaactgttcttgctcttctgccaacatacacagtcctagaagtttccttaaggactctgaattactgaagcttacttggaactctaccatttatttttgttttaattgtatgatttctgatttcttaatttactgatgaatttttaagttgaaattagaaagttagcctattgagtgtattttttaaacagttacaatgaatgcatctgtttgaacaaagtaaacatttttggtaataaatgacatctgaatcagctcgtcttcctctgacgttttctgtgatatgttatttctatggggtctctcctgcttttctctttaccttatcaagagatatttgcctgtcccccttttcctgacagaagcttcatgcctagttcagtggttctgaaacttactgtgagatacctgggccctttaaccagacattcacattctacaggtctggggacaggattcaggactctgcatttttaataagcaagccaagtgagagtggtgcgagtgactgagacagcctctgtgtcttgtctccttgttggagaggaagccatattgctaagttcactttacaaaaagaaaaatctggtagtcctgccatgtgattatatagctttaacaaaaatgcctatatttcacaagctactttcctctctttgcccactggcccacctcactgtcatttataattctcttttttcactctgaatgtcactggagcagcccttcctagttgttgcatgtaatatgtatcttatctggtaatattccatgtgtcttcgctgtgttacactgtgtgaaacagagctgcaatatttatctgcttaaacaatggcttcttttggtattgtttgataggtcttatattcattattaaagtgggcatatctgtctccagagagctctgactttactagcattattaatgtggcactcatttaccattgacattgtgctcctttctttgatgtataatagagggggggatgtgacattctagcttgtggaggaggcaagatggatgaattagcctttgacatatcctggtatggacatagaatggtgtggagagtttctatttagacaatggagaagagggctgggaaacagtttagggctcattttataggagagtttctaatcatggaagccgggcaaagatgaaatagactggaactgcaatcataaaggatctctagaactggaagataccctatttgtcctttcaaccagagcttcccacccagtggccagagcacactggtggacggtgagtaggtatagtgagccaggagagtaatcccctgatccctcagggcagctggatgaggcctgggatgaatgacattctggggccagttgctgtgaatcacttcatcatttgattctagtatgttgtataaatatcattttctatgtgcgccatgaggtagacaaaggttgtaaaacaatggtccaaaccgctggtattaaaattctgtgaaccattaaaaaaatcttactggaagttcaaaattttgaatataggggttgtattagtttgttttcatactgctataaagaactacctgagactgggtaatttataaagaaaagaggtttaactgactcacagttccacatggctggggaggcctcaggaaacttaaaatcatggtggaaggtgaaggggaagcaagacgcatcttacatggcagcaggagagagagagaagggagaagagctacacacttaatcaaacaactagatattgtgagaactgtgtcatgagaacagcatgggggaaaccacccccatgatccaatcacccccaaccagccccctccgctgacccgtggagattacaattcaagatgagatttgagtggggctgcagagccaaaccacatgaggggtttttgaagaaccttaggagtcccaagagtccagtgtgaagaccactgctctgaacctgtcctcttggagtagagaggagatactgagttctgtagagattgaatggatttttaataggtgactaagatctggatttccacttttggctcctggttcagtgtttttttttttttctttaaatgttgcttaagctgaaactagatgataaaaataagaattaatggattgtaagttaaagagcagggaccatcctaattggtcctcgctcttcaatgcttaacatggtgtatgccaaaatagttgctgagtagttgtaggtcaggtaaaatgactgtgatgggacttattctgtccatactgggaggttgggccagatgtgtttcaagcttcctccaataaagatccagtgaggtttttatatttatcagtatttagatggagggtgggcaggtttttttctgtggaaattgagaatagcaaaagctcttacattgcatatcacatttaagcttccaagagccttaggaagtacagaggaattgaaaagtggaatacaaattgatattgcaaacttttctttgaatttataaggagaaaattgctgtatttgtaatgaattttgcttgttttagactatttttcccctcgctgtatacatgtgagaactaaaataagttgggtcattttatcaacagcacagaaataaagagaagatcctaaaatcagctagagaagtaaaacagatcacctatcaggtaataataactagactgacagcaggtatctgagtagcaacaaccagtggctgaaaacagaggaataacttgatatcctcaaagtattgggaaaaagttaaaattttcaagattgaggatagtgaaaagacattttcagattaacaaaactgagaaaatttatatttaatgggcctgtattaaaataactttcaggaagatggaaaatgaaaattaacaagctaaacatctaacttgaattagaaaagaacaatcttaatctgaagaaagtggaaggaagttgataaaggtatgaataacaaaaattagtgaaatttcaaacaacaaccaaaaggatattgcaaataaattatagcttcaacagagatttttagaaccctataatgaactatgaattactgtatgccaaatgtctagacaagatggataaattttaagaaaaatataacttaccaaaactgagacaagtgaaaaaatagaaagatgagtagtcctataagaccaggtttttattatttgtagtttttattaaataaatctaacaaaaggtatataagaattttaggcagaaaaagtataaaatttattggaagacattgaagaaaacctaataaataacagaaaaactttgctcatggataagaagactcaatataggaaggacaccatttatccccaaattgattgatagagtcaatgctgttccaaattagactttccacaaaggtttttgagaaactcaacaagctgattctaaaatttatttgaagattttaggctcaagaatatacagtgtaactcaataaaacattgtgacattagggatagacaaatgataaagggaatcaaataaagaacccagaagtagaccctcaggtataaggaaaacttgatgtatgacagggatgtattatagatctgtgtggaaaaaagaaggaactattctgttaagtaatagttccgagatgagatatacaatctatatgaaaaataattattggcaaggcacagtgactcatgcctttagtcctagcactttgggaggctaaggcaggaggatctcttgaggccaggagtttgaaactaccctgggcaacatagcgagaccgcatctctacaaaaaataaaaataaaaaattagccaggcatggtggcatatccttatggtcctagctactgggaaggctgaggaaggaggattgcttgagtccaggagttttaggttacagtaagatctgattgtaccactacactgcagcctgggtgacagagcaagaccttgtcttcaaaaataaataaacaaaaataaataaatattttaatctcacagcatacatacatataacttcattcctaacagattagacacttaatgtaacaggcaaaactttaaatcgtttagataaagaaaacctattgctttggagctcagatatttttaaataagagtcaaagggtctatctataaaagaaaagactgttaaagtgacacgcattgaaattaaggacaactgtttatcagaggataccgttaatgtaatagaaagacaaacctcaaactgggaaaagacatttttaaggcatacagccaacaaatgattggcatctgaaataaagaacttcttcaaatcagtagaaaaatgaacataaacacacaaaaaacaggtacttccctgaggaagaaatatgaatggctcaggattatatcaaaggatgtgcagcatcattagtatttaagaaaatgtatatcagaaaacatgttccattttacccctaattgatcagcaaaaattaagaggcctggtaataccatattttggtcaggatgtagacttgtcacatctcttataacagctggtagtagtgaaaactggcaaaactggcacaaccaatttggacaagaatgtggcaccttcctgtaaaagttatttctgtatcctgtagccccacaattttacgcttcgagaatccatatccagagaaacttttgcacaccatgccagcagatgtttgcaataattttcaaaacaacaatgtataaactcaagaaaatagcccagaggagaatgagtaaatgctgtctatccacacattagagtatcatacagcagcgaaaatgaacagcatagatgactttcagaaatgtaatactgagtgaaaaagagcaaactatagaagactgtagtcagagtgatactatttttgtaaagctaaaaaataacactaagtgatgtcctattttaggatatacatttgagatgatattttttaaaagcaggtaaatgataaacacaaaattcatggtagtgactgaggctagggtatgtgccatgtagcaatattttaagttgggtgttattgttccagttcattacttacatatataaatatatgttgtttgtatatgttgaatattacatcgcaacaacatgaagagtcagacttccaaggttccagtcatgacactctgttcagtagaggttcaacaaagggcaaggtacctaacctcttcaaagctcagtttcctcaactgaaaagtagggtggtaacagtacctacacattgagttgttacgactattaaatgggacactccacaaggattaagttagtgcctagtacactaaatttacagtgcagcaaatttagcttttgttgtctttttcttaaagcatgaagtgtgatggtttgtacttcccttggaattaaagtagatagtgttcctatgcaaaatgcacttctaaactgatgatatgttagaaatgaggtgttggcaagatgaattgaaatatgcgtgaatattgcttatcgattcattgagaagggttagtgagtttagtacagatttcttacctatgacagaccaaacaagaggcctgctgaaggggggaatgacctttatggactccatgtctgtgaaattctggaacattagcaaaagtaccccatcgtttctttttttttttattttcttttcttttttaaattttgagacagggtctcgctccgtcacccaggttggagtgcagtggtgcagtcatggctcactgcactcttgacctcccagtctcaagtgatcctgccacctcagcctcccaggtagctaggactacaggtgcatgccactacgcccggctaatttttgtattttttgtagaaacagggtttcgccatgttgcccaggctgatcttgaactcccgggctcaagcgatcttcccattccaagtgctgggattacaggcatcattcactgtacccagcctatgttgtttcttgcctgcagtgagagaacactggagaaaggcagtttttcaaaagtttgtcacaagttggtataccgtcgagtcaagacatctcccaaactgtgctcttgacatagaggtaatcacaattacagcagttatgctttaggcttaataaccccagaaaacattttagaaagcttgttgttccagtatacaatttagaatgtcatacatattctgtagtaagtagaattttgccagggtttttgaaacagttgttttggaattaggatgagaacatttaaaatttggttggcttggaaatgatttgaccatacacgttgagaatcactaactggattcctcggtaaatgccattagtgatgcgaaagcaggtgtccgtataaagtgagtgattcttgagctctttacccaaagtttaggacactataaacatttttcacatgtgttgtcagaggacacagtcactatgaacagtgttacagtagctattaccacttggtgaattaatagggaatgtgaaaatgagtaaattttcccataatgtcccagagtttgggtcatattcccatgcattttcattttactcttcagtgtacctgtgaagcagagaaaaggctggctatttatggggtggtctgtgtcttacaaagttaaatagatgtgaaatgatatttttaacgtcaaataatgagtcagtccagacttcctttatgtgatggcaattccctgataagagatatttgagctaattccatatttaagtgctttacagaggatggcaaacagaaatggtgcttgtcatgcactaaatataattatcctaacatcttttaggagaggtattttcttctttcaagaaggcacgtgacaagtgaggttagacatccttctgggaaactccaaattcccaaacctttcaaagtatttccctgcatcaaggtgtgttacagaaaagtcctctaattcaagactaaaggtttttataagacccattcatcatgttgtgaagttattcgtatgggaattaggaccagaagaaagcaaagttgagaatatttgagaataacacctgaggataaaatcgcagtcaccttctgactttcgatttaatagctatgaagttaaccaatgattactttaaaagcaggaagtattttgtaagcagtgccattaatgctaagtagatgtttgttgtaaaataaccgagatgattttttaaatttaaaattacgtgacatgaagcaaccacccttctccaggagactagtctgttataaaaatagcaatcttcaaaacattttttgattaacaagttttgcttgaatgagttttatattatgtattccctgtagttctagattatatccacatactatatatacacataatacatacatacgtatttatgtagacatatatgtatgcctacataaatgttttttctttgagacaggttctcactttgtaacccaggctggagtgcagtggtgtgaacatggctcactgcagccttgacttcctgggctcaaaccacccttccacctcagtctccagagtagctgagactacagatgcgcaccaccacgcccagctaattttttggtacattttgtagagatggggtttctctatgttgcccaggctgttctccaactactgagctcaagcgatcctcctgccttggcctcccaaagtgctgggattataggtaatgagccactgtgcccagcctggattatatttgaagctgtaccccacatgtaactaatatagtacataatctgttcttttaaattttagttttaatatatgtatatatagccaataggagaagaggtatgaataatagctataacagtaacacaagtaataacaataattattaagtttaaactaagtcaaagattgcgccaagtgcttgatcaatatcttttcattgaatcatcacagaatccctataaggtagatactgttatatctcagaattgcagatgagaaaactgaggtgcataaaatgtaagtaatttatccagaggctcacatctggtaagtgttagagcagggatttgtacagaagcagttgttgcaatcttgcctcctgactgagtatcattactttaaaaacatactggagtcaattagctgcgcatggtggtgcgcatctgtagtcccagctactcaggaggctgaggcaggagaatcatttgcatctgggaggcggagtttgcagtgagctgagattgcgccactgcactccagtctggcgacagagcaaggcttcgtttcaaaatgtatatgtaggagtcatgatgtattcctgttttcagggtttgtacactaggactgcaaggtaaccctgccttaaatgaaaccctcattgttctttaaggaacacaagagttcttatcttgaatttcagtgctaaagtgaagttctggaataaatatagcccttcagtagggcacagccaatttcatttctcccagaattggagtcatttttcacacaaggtcttgcccttttggttattaatcctgaaactctggctttaaaaatctcaattaaatgtgcatgcaatccttctaaaatacacaattggtatttcctatggatataagcttctttaagaaatggtgtttgcttatttaacattttccctttaattttccagggtgtacagctgcaccttgtccgcctgagcttgcatttgaaattgactttcgagcccaggctccctttcacaaggccctttcttcctatgccaattagataacatcacactgtgggaattttctgaagtgggccccctgaaacaagggagcctgcctttcagattgtgtctgatctacagactttgttattttatcaaatgacttccagttacctgcatggtctggagcttgttctgagtttgttgatcattgagttattttgtccctaagagagcgcaggccttttgttcccagtgaagattaggttggaggagagtgtggagaagctgtgaagttcatcagactgagtatggtggactgagttctctttcattctcatactaacaaactttcaggcaaaagctagaggttataaaaaaagaagtgctttgaaaattcaacctgcctaaccactgtcaggatcacctttttgaaattgttcttcacatgttgtttatctgctcaaatatgaacacacagtcttagtatttattcattttaactccaaaaggtaatgtactgtgcagttctttgtcttgctttttttccactgattatatttccacatctgtacatgatttcctcattcctttttgttactacctaatgtactactgggtaggatatactataatttatttaacctgtcccttgttggacatctaggtgtttccaaatgtttgcaattacaaacaattgcttcattaattattcttgtgtatgtgtcattttgcatgtgtttagctttttcaaactggaaatgcaaggtcaaagggtatatacatttgtaatttgggtagatactggcaaattgtcttccagaatgtcatggtttttaaaaccctcatctcttactactcaccaatcagaatggtaagcttcagctacaatgaagccctaattagtggccctggaaaacatgatgtagatttttacccctacactcattttctgaaaatattctttcgttccattccattctataccttctatcctacccacccctaagcatgtgcaggtgaacacacatacatacacacatgtaactccccctatgggctcacaccttcacagttcctgttgcttttcttttctgaatttttgtggtgtattcacactgtactcactttgacaatcttatactacttgcaataatgatttctttggcaatgtctttttctcgttgtgagttcctgcttgatgactaggccagtgttttgcatgttgtgggattttttttcctaatgattagaggaaaatagatttattcttctggtaaaaataatacttattatgagaaaaaatcaactggtaaataaaagtgctcagatatgtaaaccttccctcaaatactgccatccaggaataattactcttagtgtttcattacacatcctttcagccatctctttatgaatgtatgtacatatatatccccagataggtgtgcacagttttacacgtgaccttatactattctgactattgggtaccttgcttttcttagacctttccccatgtcggctggtgtggttttatataattcttaatggctatatggtagctgtttctatgcacataccatagttcaaccagtgctgaactgattgacatttgtggtttatagttttttgtctgagtgaatacaacttttggcattagtgcctaactctttagataagttaaagtcttagaaatgaaagaactgttttaaagtgtggatacacagattgtgagatctaaataagtaattatgaaagagaagaaagtttacagaaatgttgagcctttttcttaggaagctgtcaaattcaaattggtattcatagcctccggtaccaaccactcagccatcaaaaagtgttgagaaatcttacacatatataaaagaaaaaaaatgttaaagagatagtctaagagaaataacctttccatgtattcatgaatgtgcaaagaatcattgctttcttcctttatcctgctgggccctaactatctttctctttccccaaattattttggaacgcttgtgtaatttagaatataaaagcattttccctcctactaaggtacaaagaagggcaatgttttctgtttcttggagaatagtttgcttaggaaaatacacagtctaatgaaagggtccgcagctgtgggctattttgaagcctacttgaaaacattttgatgtgtttatttctttactactctatttcagaaaagattcgagatggcttacaaagatgcaaacagtgtagctgggtaaaatttatttgataaatgcaaaaaggaaggtaaaggaacataaggataagaaagtaaatagaaagccaggagtgagattagtttacgaaatacacatgaaacatgaaattgtcatcatcagcagtccagaatgcttgaatatgggtgattttttctggtgcagccaaaatattaagttcagtatacttgctcaaggtagacctcagatgtgaccctgagccagtgtgacagggatgtagcctcatcatccctgtgattggaacacaaacctacacagaaggagtccaaatagtcctcatattgaatccaaagagaaaattcacccagagaagagatttttttttttttttttttttttttttgagacggattctcgctctgtcgcccaggctggagtgcagtggtgcaatctcggctcactacaagctccgcctcccaggttcatgccattctcctgcctcagcctcccgagtagctgggactacaggtgcccaccaccacacagactaattttttttgtatttttagtagagacggggtttcaccgtgttagccaggaaggtctcaatctccttacctcataatctgcccgccttggcctcccaaagtgctgggattacaggcgtgagccaccgcacctggctgagaagagatttttaaacagtataaattcatggtcccagaatgtcatagctggaagaatcttgaagggctggcttgtacagccttctcagaatttgtgagaccttgtagttgtgcattgaaatgggctctggagagtgcagaatctgcatatgacttttatctttaatcagtcactgaacctttccaatccagtttccttgtatacccaacaggaatacggattggtttttacctcataagatcatgcaagggagggaaatgcaaatgaaaatcacaacaggatactacctcatacccgctaggatggcactaataaaaaagatggacaaaagcaagtgttgctgaggatgtggaagaactggaaccctcccatgctggtgggagtataaaatggtgcagccactttggaagacagtctggcatttcctcagaaggttagcatatggcccagaaattctacttctaggtacaaatggaagagaaatgagaaggttatgtccattaaaaaaaaaaaagtgtacatgaatgttcaaggcagtattatccatagtagcccaaagtggacacaacccaactgtcatcaactaatgaatggaaagaaagacccatattggatgattccgtttatgtgaaatacccaaaacaggcaaatccatagagatagaagtagattaatggttgcctagggctggtgggtagggggaaattggggcataactgctaatggggataggagtttctttttggggtgacagcaatgttctaaaattgattgtggtgatggttgcacaattctgtgaatatactaacaattgacattcccattttacatagttgagttttacggtggattatctctcaataaaaatgtatatattttattttaatttttttgtttttattttttttgagacagagtcttgctcggttgcccaggctggagtgcagtggcatgatctcggccccctgcagcctctgcctcccaggttcaagcaattaatgtgtcccagcctccagagtagctgggactataggtgcacgccaccatgcctggctaatttttgtatgtttagtagagatggggtttcaccatgttggccagtctggtcttgaactcttggcctcaagtgatccacctgcctcatcctcccaaagtgctgggattacaggtgtgagccacagcgcctggccaatgtatatattttttaaaaacatagcacagttcttagtgtagtgcagtaagtagtataccaagtaagctctcaaatgtaggctttttctttttctttttattatactttaagttctgggatacatgtacagaacgtgcagatttgttacataggtatacatgtgccatggtggtttgctgcacccatcaacccatcatctacattaggtatttctcctaatgctatccctccccttgcccctaacccccgacaagccctggtgtgtgatgttcccctccctgtgtccaagtgttctcattgttcaactcccacttatgagtgagaacctgcagtgtttggttttctgttcctgtgttagtttgctgagaatgatggtttccagcttcatctgtgtcgctgcaaaggacatgaactcattcctttttatggctgcatagtattccatggtgtatatgtgccacattttctttaaccagtctgtcattgatgggcatttgggttggttccaagtctttgctattgtgaatagtgccacaataaacatacatgtgcatgtgtctttatagtagtatgatttataatcctttgggtatatacccagtaatgggattgctgggtcaaattgtgtttctggttctagatccttgaggaatcaccacactgtcttccacaatgcttgaactaatttacactcccaccaacagtgtaaaagagttcctacttctccacatcctctccagcattaagttttttgtagattctggatattagccctttgtcagatggatagattgcaaaaattttctcccattctgtaggttgcctattcactctgatgctagtttcttttcccatgcagaagctctttagtttaattagacaaatgaaaaggctgagtgaggtgactcacacctgtaatccctacactttgggaggccgtggcaggaggatcgcttgagcccaggagttcgagaccagcctgggtaacatagcccaggcctcatctttaaaactaactaactaaataaataaataaatgaagacactgaggctcagagaggtaaaatgacgtatcctgatcatgtggttacctttggctaaactagaacccagatcccctgcagtctaaatctgcacgctctcccccagcagcacagttacaaaggctggcaaggcatctacttttttttcgaatgtgaccctccatcgttttgactttgattggccttcctttggtcttgagcctttctgctgtaatgattttcaagtttcccaattgtgagtgcaatataaaccttgaaatagtctgcaaaacttgtaattagccatgataaactgtatgaaaaattgattcgtggccctgcctgctattgacttttgagatacttattagcccagctaagaattacccaggcattttgcttttttcctttttttccccatgtggcctgtctttggccctttgactttcaaattgttccacttgaaataggctggacagatgggtctccatttcaaaagcaatggagactcttgtctcttgagttttctcagtagcaagcctggcataactttttgaaattgcattgttgctatgaagtgaaatttgggtctcctattatggtttttttctggtatgtttttgttatgctgctaaaaacatgcttttttgttcactgcacatgggcattgccaaattattgtgacatgaagaaattctgaaggtcagtatcaacctggtattctcaattcagtgaaactgacaagattttgtataacttgaattatattaattttctctaaactggtgttaagaagtgtatgaattgtcacaacctgaaaaacatgtatgtttaacttacattgtcaaaagtttggtcccctataggtacagctgaggttattgacaaatactatggtaaaatttaagctttctgataattagatgtcaggaatacccaggtttccagaatagctttcttttcttagaagtagttagggaatgaagccataggactcttcttgggaccataaaagtagccacttggtaataaacattaataaaaagctaacaaagaagttaactcttcaacctaacaaccccttttgtgtttggattggtgatttcgctctctagatgttaagaaacactctgatgtattagttcactattgatgatcattatctattgctgcataatgaatcaccccatcacttattggcttagctcagcaacagccattttattattgtctctcttggttctggggcttggctgggctgagctgggcagcctttgcatgggctctctcatggcgttgtacctgtgagtgactggtggcttctcaaggcttgccactcacatggctggaggcaattgtagatagccatttgctgggacctcaactgagatgtcagctggacacctacacctgacctctccacatgatctctcctccttacagtgtagtcactggattccaagagtgagcttcctaaggagaccaggcaatgctctatggcctggtatgacggagccttggaagccacgtagctccacttctggtgttgttacaggcttcgccagattggcggggagggaacaataggttctacccatcagtagtagagtgtcaatgatattaatacattgttggaagagtgtgtgagatgggattttttttttattattttgaaaaacacaatcttatgccgtcactttttgacttaaaggcaatgttaggaagaggagacaagaaaagaaaggaggaaaggagccccagagtttggtagcagagtgacaacagtcagctgcagatggcaaaaatgggagcagaaaataaaagcaggggatagcacagttcagatggaggtgtgggagaggcaggacaagcagcccctgtcaatagggtgtcacggatgcttattgggctgcacttgacattgtggctttgaccgtatcccagtcaggcatacgtggtgcaataactgatcacgttcagcatctgggaggcagtggggccgctcttttgttgctgtaagaagctggccagggtagcatatggtaaagtgcaataggtataaaaccaccttgtgatacggatttctcatcttcctttagagggaagtaaaggacgctagtataaaatgattgtgctgaccttgaaggagaatatgggcacttgcagttgtcttctctcacccccttcccatgcaacagatatttgattattaaaagtacatgtgcacttgattttaaaaatcctcaaatatttcttgggtgccgaaaatatgctaggcactagctaggcgctattccagattgcatatttgactaaagaagaatgataaagaagagtaaatctagtgattacttagtattgttttacacagttgtttcacttaccccatatgatttctaagaaagggttagtgttcgtttgctatgaggcttctagaaaatcatttagcttctattagactctgttttacagactctatctgtaataccaatttgtgtggctcttgtaaaattaaaagcacacaggaagtatttaataactgctaaatatttttaccttttagttcctttaaaggctgtgattcagtcaaatgttctataacaatcacatgatatacttggataaattcaagcatgtaatagttgattccgtttattccactagtcttcttcgtcttcttttttttttttttgtttttgagacaggattttgctctgtcacgcaggctggaatgcagtggcatgatcatagctcactgaagcgtgcactcctggcctcaagggatcctcccacctgagccttctgagtaactgggactacaggcatgcaccatcatgcacggctaattatgtgtgtgggatggggtgtggggggagatgaggtctggctgtgttgctcaggtgtgtctcaatctccttgcctcaagccattctcctgcctcatcctcccaaagtactgggattacaggtgtgaaccaccatgcccagccattctactagtctcagttgaacacctggaatgggccagttagtgagccaggtgctggggattcagggatgagcaagtcagataaagtcctcccctgtagaacctaaatgaggtgggctcctccatgaaaaggtgtggcaatgcctaagacttggtaaaatggatacatgaacaaatacagtcaactgtgcatttgcacaaggggcactttacataccacatctgtctgaaatattaaaggatttgagtgactaaaaaacagccatgatgtagtagaactctggcattttcaaagcagtcatctccaagtgtggtgtattgcctgaattgtttcagagtgttggtaaaagtgatatacttggtggtacttgccaactttaaccctgggttgtgctaggaaatgaagtttagtaggacaaggacccatagtagtatgtgttaagaaagggccatagaacagtaaattaatagcgttttcttctctcccctatagtattttgggcacgtttatacccattgaaaggcaggtttttttttctatgcttattgatttagcctatctatttataacagtataattcagaatataaatatggaacaagtttcataaggaagtttatctttaactcagacattatatcattaatacttcaaatctcattataccattatgacctgaatgctacatttttcttcctgtatggagagcttagggaaaaattgtggcctgatgtcttcatccattcacttatcatagagtacataatgatctcaaatatccaaaaatggttatattcagctgcatatttctaagaaaataggtaggtccacagcaggttcttaaattccacatacttgggtgtaggacacagggattcattccctgagagtttttgaagctgaggagacacctgggttttgtttttccagggtagaattcagtacaaatcagcaattgttgaacacatactaagttgtgggtactggactgtttcacccacatgatctcatttatctgcataataacctgatgaggtaggtattatcaccgtgtgttacaggtgaagagactgagacttcgtggttaagtcatgatgactagcaagcagtcaggttggaacttagtgtcaaagtctcatgcagaggccttttgttggtaaacactgtgctgtactgtcacccagtggaaggattctaatcacatccttgttctagtctttattttctaaattctctgtaataaacacgaatcaattttaaattgaaaaaaaaatctcagccaatataacttaaaataggtaatgcagttagattgcaaaaacatatatttgtgtgtgtggtatgaaaatataaaactacatgaacctgaacactgtaaccctatgtttagcaattatatagatattataattaatgctttttaaaatgcaataggcatatggatattaaggtttctgcttcagttatttttcttgggaaaataacacctattgatttaagatccttagtcccagattctaaattgattttcttatttcattgtcaacataattggggatttgtctttcaacaaaagaaaagcaaagcatagtcgtcatcttggtagacatttatgtatataggaaggtcataggtgatttctgaggaagtttggtgattaaagaaagagataccctgtagtcccagctacccgggaggctgaagcaggataatggcgtgaacccaggaggcggagcttgcagtgagctgagatcgcgccactgcactccagcctgggcgacagagcaagactccgtcttaaaaaaaaaaaaaaaaaaaaagaaagagatacacgagtggctagcagattcagcgcaggcttttgatgatagtggggatttgagtgttcttttcttcctttttttccccttcaatgccacaattttatttgtgattgaaggggaaaaaaagtgttctgggagactaattgtagatcattgaatcagagaattgaagattgttctttagacctctttggaggtctttccttagtgagtgttgggtagaactcagaaatctgcatttttaacacatgacctaggtgaattttatgatcaagcatatttgagaactgggctagaataaagcttgcatgaaaaaatgcagtaggaagttaggttgtaaagctggatcgagtccagagtgtggaagccttagatcttaagccatggggttgggatgcggtgctgtgagctgtaaggagcccatgacaggtgccttgtaggcagagaagcaactgtagaagttggctcaggagtgaacagtagaggacagtttgaaggaggagatcaggctggaagaagctgttaaagacagctaggcctgaggtgatgggggtctgtactagaactgtggcagaggcataggacaggggacaagtgacattgaagtgctagacttggcatagcctagtaagtgattggacatggaaggcaaaacagaagggggaagacaactggaaggatttgaggcagtatgaataggaggatggtagtaccttttctgaaactggtgggaactggagggggcctggtttgcagggaagatcaggagttcattaggacgcatttgagttggaagttccattgggatttccgtttgaaggtgtcttctcaatggaggtgattgtggaagccatgtaataagattgccacagaggacatgacagagagaacaaaggagccctggggagtcctgggggaacagtcacaggaacaagtggaggatgcagagaactatgagaggaggaaaagaaagtgctgtcccaggaaccaggaaggtgaaggtggtcagcagttctgaatgctgcagagaggtgaaggaaaatgaagactcacaaaaggacattggatttagcttgtttttcatagtaagagaaaaagttggacagtcagaattaatgagtgaatggatgaagaagtgcaagtgggtgatttttcaaagtttggttgtaaagggcaggaagacacacatagcttgggatgtgcagaggcttctgaggtcagtggagacctgtgtctattcaaaagttcagtgtggagggggagaaaaatattgaaaatgcacaaagacaacttttcatttggtgcacatttattgttcatatatcaagtaccaggactgtgtcgaggctacagagataagactcactctgtaagtaacccaagagaagaatgaaagttggcagtgtgaatttgagcctggatgactgggagggtagtggtccccacagatcaggggaggacttggcctggaaacaaccactgagcatcaggatgaatgctgggttggaatggcgcacagcatgctggggagggctggggaggaccctgtgaaggacttggtcctatagttgtcctgtgtaagatatgtggtagtcttccttccctagaggcaaggaggcccatctcaggtggagggaccagcatgggcaagtacttgcaaatgtgttggagagtaattgtttgtgtgattgaaatagagggaagatatgcagaggtgggcaggagccagagcaaaaagtgtccctgtgtcttgatgaggagattgggctttccccccaccacccacaaatgaggagctgtgataagaatttcagtagagacatgcagcgaccagtttgcctttagagagagctctgaggcagcagtgtggcagtgtgttgtggtttagagggataagactggaagcaggggtcaggttggtggactggtagttggcagactgtgctgtgcaagtgaggataggtgggaacaaaggcagagcaggcagagaataggtagaagagatatttaggaggcagggttgacatgacttatggtttggctgtgtccccacccaaatctcatcttgaattgtagctcccataatccatggggacccgttgggaggtagttgaatcatgggggcgggttttcccatgctgttcttgtgacagtgaataagtctcatgagatctgatggttttataaagggcagttcccttgcacatgctcatgtgcctgctgccatgtaagatgttgctttagctcctcccacgccttctgccatgattgtgaggcctccctagccatgtgaaactgtgagtccattaaacctctttttctttatgagttacccagtcttgggtatttcttcatagcagtatgagaatggactagtacagcttaggtcttgaaaggttttcatgggaatgggagtttgagaagatggtgaaggataaggagagctttatggaaaagctcagactgactccctgctttctgacttacagactgtttggaagatgggaggaaacatttcctgggaaagatgctgaacattctgaatgtgttgagcgagagattcttgcagggcttccagggggagatgcacaggagaccaatatgcatgtctgcaaatcacaggagagggtggcctggagagagaaacatgtgtgtccaaccacgggagtgacagctgagaacattgtgtgcgaaagattccgtaccctgggagtgcgtagcctgcacacagcctcttaactcaagaactgattctcttccgtgttctgaattttctgagtgccttttgcccttctgcttttagccatctacaatgcggccattggactcttattgggattaggtagaaaaagaaaaaaaaatgatggtactcaaatatacctagttttactaacgatgagcagatgtgatgagaggattagatccttagataaagaagcttaggtcctgcagtgtgacctgggttacttgtgaaactcagtttttctcaatacctgttctcctctatcttaccatggattctgaagcttgaattttttaaacggtattttatctttattcactgtgtgagaatatacatatacagctatgttatttcttgtttgtttttaaaatcagtggctggcccttgttaggaaaatagatgaattagaatacatagtctttgagaaccatttacaggtaaatctgtgttatttattttgctgctctagcagtcttctgttagtatgaaatgaattaacaagatagaatttatggccctttttagtattgaatttgatcacagttgagacattgcccctgagataaaactcctgtctggagcatttttacagtggagcttccattattgctttccttgaggactgagaattgtcctgatgatgtaaggaacaggtgtctgatccctgtgaagatggtgttctctgttagcaataggaaaacactgacgttcctactctgtccttttggctgaaacagcagcatctaaatcggagcttgtttaagtggatatgatggctctaagagagaccctgacaacaatggttatagatttcagagtgtggaccacatttggattttggggggatccagttttgaataagtaaactgaaaaagtcatttttgagacagtaggacaaaattgaacgtagactgatattagattctaaggaattattggtgattttgttctttgggaaaatgatattgtgatcatgtttttaaatgtccttatcagagaagcatactgaagtatttacaggtaaaatgataccatgtttgggatttagtttaaaaatactgaagcaaaagagttggaatgtatagataaaatcagattggcaaaatgttgataatgttgaaggtgagtaaaagaggtttgttatcctattttcaccttatgcatttatgaacattttcattaaaaaaaaggtaacaaaaatgaatgtagtagccaagaagaagagaaagttgaaggtctgtttttctctcattttgacacacaacgtcagcgtgtcacacctgtcagtctttctgcacatagggtgataatctttctgcctttctgacccaataactgaggaatctgacaccacagctaaacagtttgtgtgatgacaacactgtcccaccaggacttggggcagctttctggcagttcctatctcatctccctcagaggctctagcctccaatgggaattcaggggattccttgtctccttatatttttgtgagttttgaatgagagagacatgagaagataacttgggtggagtgagctgtggagatggagtagaagtttaaatgtgaggcatgtttctgcatagggaccttgtgatgcagtcattggctcttctttcctatcaatttaaacttgtgctggaatcagacccttcagtctttcaaaccagagtttaagtctgtgctgtatcatgtgtgtgtgtgtgtgtgtgtgtgtgtgtgtgtgcacctgtttgtgtttctatcctcacatctgaagtctctgccctttgcagacagcatgatagtgaaatgagttgattacaaggggaaaatgattttagtgaaccaacatgggtctgtttgcttctttgaattattcccagcacgataggatgttaatatgtcatctcagaggcagatgggcccatctattttgatcatcagctctgtcattatttggcgtttagaaccatgcctttcctcgcagtatcttcaagatacttagaggaaggcccagagttttcttgacaccagctgctactttgcttaagcagatggaataaattaagcccctcagcctccctatactcatcactattaaccacatccccacagcgaaaaggccggtgatggcaaaagatggttgttttctgaggacatggtaaaatgcctttgagtctcagggtgagactcttggcccagaatgttcctgtgtcttacgttttagcctagggtatttatttgacttgttcaactaatatttctacggtacctgttgtgcactagtagtgtctgtgttgagtgctggttcacagaggtgaacagtttcagagcaaggttttctgttgactgctcgagtttcagttatgttggatatggggaactaaagggtttcagaaactaatggagtcctctttacttttctttttcttcatatcccttcagcagttctaggatacaatgtcactagctcctgacatccctctctaaggggaaagcatgagggaagatggggagaagtttccttgtggtgcaggtttgctctggcaagaccttcttcagggagcagaaaattgttattcattcattcattcattcattcaacaaatgtatctttggtccctactaaatgcaggatactctaaatatagggacacagaacagatgtaactgcatcttactttcgggatacatgctttcccacttccaaattttcttatatgctagaacattttctcaatatctttggaattttgtagcaaatgccaccttaacaaaaacaacagtatccattattctgtagacagaatgtagaagaacacaaactcagctacctcggagaggaatggaaaagcagagtattaataaacatgaactcatatctttacattactatgcattcaaaaacttaatggcagtttcattgaccaaaccaaatagcttattataacagtgagtcttcattccagaatttgttgcataaaaataaaatattagaccaggtgcggtggctcatgcctttgggaggacaaggcaagtgcatcacctgaggtcaggagttcgagaccagcctgaccaacatggagaagccccatctctgctaaaaatacaaagttagctgggcgtggtggcgggcgcctgtaatcccagctactcgggaggctgaggcaggagaattgctaggacctgggaggcggaggttgtggtgagccgagattgcgccattgccctccagcctgggcaacaagagcgaaactgtctcaaagaatacatctattaaaaatgttagaaatcctaagttgttaacatgtattgcaataaatgcaggtgaaaataagttgacattcttgatttgaccatattgtcatgttgaggttttagaaatatttttcattttttagttcttgaaaagttattaggcaacttatccttccattgaaagtcacatctttgtaccttgtttagaaacaggaagtggttacttatactttctgttttatctgcttccatgttgtttgtgttttttaaaagaagtatgtttttaatttttagatacttctgttttgactgacagtgtaactcataatgataaaaattcaaatgatgcaaaacctttactggacgaagaaggcagggagaatgttgcttttccactcctgatgttcctttagcaaaacattctaggacactctttgcctaggaacttacctgattagtgaatttggagggaaaaatcaggcacaaaactgtggccccactccgtcttcctcactttctcctggagctggcctgctcacccagggaggtacccttggtcactgaggaccaccggtgtgagggaggaatgtgctgattaacatcgctggggagccctaggggagtctcttcgaaatctagagatcagtttctcaactgagaaagaaaggctgtttactcagtgtttaagccacaatctcagatatcacctttataagtaataagggtgatttttgatccttttatgcttactggtctgatttctaagttagtttagtgataggaggagagagggttatttattgggcctccttgaagtgtacaacatggtgaaaaagtctccaacccagtaggcattaccacatcctgtaaatgcttcccaaaatgctatgtgcatatacgaacatatctagaaatgtgtatgtgtgcctctcctcattttcttttacacagtggtggatgctgttctctattagccttttctacttgttatattttgatggtctctgatacttgttactggctacatactattccataatatggatttgaattaattttctaaccaggaagaataaaaacatgtttctatttgaaactcacactctgatcaacagtgaggaactgtgaagttctgctgctgggggacaggatagcaactgatttctgtgcctcctttttcacatggaagaggcatatcatgtatatatctctctctatgcaggtgatagacttgacttggtccttgataatagagaccacactgaaaattgactatgtattgacctactttttcagagagcctattgctgccatttatccaggaactgtaagctgagtaatagaccaaatgtatctttagggcagttagtaataatttttatgaaggaacccccttggtagtgacatttaaaagttattctgaaatgtttgcatacatttgtatgttgaaaaaaatcagatatcttagtgaaattagaatattaggaatattttctatattacatcttgtgagtctgaatggagtttccattccacaaaaatcagtgcatttgagtgtctttccaggttttttctcgggtcattaatccctaagcagacgtagttcttgacagaaggttttccaagggggtggtgtcgattatatttcttagacctaacataaatgatgtttaaccagtagctaacccctgatctttatttcaggtgtctttgtaaggtaagaatttagtctctcttaagttatggtaattcatatcatcttagttttcattttttgtcctttcagttcagtttctcttaatatttcacttagagacattaacatattctgttatggggggtattgctcttctgctagctaatttgccttttgtttataaataccgatagtgaggctgctggattttagtgtatcagtcaggcttcaacaggagaaacagaaccagtaggagagacctataaagagatacattgcaaggacttggcttacttgatttatgggggcggtctaggcaagcctaacattcccagggtaggctgtcaggaagagcaagctggagctctagggcacagctaaagctgttgtccccagatggaatttcttcagagaagccttagctcagctctgaaagcttttccacgtattgaatcaggcccacccagattatcaaggataatttccctttacttaaagtcaattatggacttaatcacgtctaacaaatgccttcacagcaatgcctagcttagtgttggagggagtaactgtgggcactagcacagtcaacctgacaactagaactgaccatcgcagtgtgtttctctgttgcttgtcagaaatcttctggttccagccctgcctggagccatatttggttggctgtgtgcttctctttctcttcgccacccctctttcttctgcaggtaagctaactcttaacttattgctgtatcctaagcaacctcgactctgctctggagccaaacatttggtttctgcgttttcctttggtcttacatgatgtgtgttttctcttctgtgctatttgtcttaccaggacagagtgttcctatcgttctctttattagctaaagttacagatcagcttggcaccctttccagcaggagctttagttttcaaagacaatagttacaaaattggattctgctttcgtggctcttagctgttgccattgttctttgttgccctcacttggggaaatgccatattggaggtttgataggactgatgcagaataagaaatctaattgcttctctgtgctttgtgctgcctcctcagaatagttcccttccaacttccagaacattctctttcaagacattgccctttcatgttgggtttccaaagttacagtattccattctcattatctgaagagcaatgtttgtcaaatttgcttctcttcccgttagaaaatattcaggcattataaggaagttgctataaatgtgtctttcaccaaactagctgagtatttttaattatcattattaaattataaagtctttgtttctctagaattttttttctaattgcctatagaactttttcatatcctcattcttttgttctattccttcacattatagaaaaaggaaatgcctaattttagcagaactggtagagctttaaattccaagaagtcaaaaaataaatgttaatgggaatcactgactaaaaggtccaatatttagctcttgccacttgcctatgattaatagaaatgggcatttttcctcttggtaaattttagtgtataataacatagtcagatggagatactttgtaagtgtaaattaaaatctgaatgttcagaggcctggagtatacacaattagaaaacatgacttaaagtgtgtggtagagtctgttatctggtatgacaagggctgccaaatacgacctattaattttcaaagaatcactaagtatacaaaatgaaaacacattcagtaaatcccttatcaccatcgttatcctgatcatccatttctgtgcaacacatcaccctagaccaaatggctgaagacagcagcagtcctttagtaagtctcccagtttctgtgggtcagggattcaggctgttcagcttctagtgtcatgccactgcgccagatggtcaggtcacctgggggctagtctgggctacctcacagcacaggggtctgaaggcagttggaatgcttacatggcacttaaagacttcaaccgttgagtattccagtgagcaagatagatgttgcatcaccttttctgaccttccctcacttctgcctcatttctgttggttataggtaaggcaaaaatccacccagattcaaggagagggcactggactctgtctgttggtagtgaagtggcaagattcttggacatgtggggcaggagatattgtcatgggcatctttggaaaaaacaatttgctatctatctacgctctggccacaacaacttacatctcttccatgtctaaaatatgctcttgagcttttaagactctccaaaagtttcatcctgtggcagctccaggcttaggctcaaaatcatgaccttgtcctctaaatcagatctgggtgcagaggaggctcctcaggactggtgccatgggcacagctccttgatttttcaatcttaaagcctgtgaactaaagagacaaatatctgctggacatacactcaggatgcggcaggaatacacacgtcttaaagatttgcccaaaagggggaaaacgggagcacacaggtccatgggagttctggagtctagccaggcgtgggtggccagctccttgatcagggttctgtccagttttgctgttttctaaggctcttggctcccctctcaagttctgttctttaagccatccttctttttccacaagaaagagtcagtgtttgcagctaaggagccttctcagactgcttcctgccagcaaaagtttaggatctgaaggcctctttttattttgtattctgtttctttttgtctaacttggcagtattttgtagtacgatatcaaaaaaggtagtgggttttctgtgaatcttgttgggttcactccattagtgaagatccatgaccacaagatgctttgtctaccatgggttccctgtgagacagctaaggggcagtgccctgtgattcttggaatccctgttatttaatgcagaggttctgcaacacaaactattaagatcctcagaaggtgttaggtacgtttgaaggtgtctacaaggcaccaccttagacctttctgaattcttaaaaggttgtgcagtttcaccctgggtttgatttttgctctgaaaccatttcttggctcaagaattgtttgatgtgtggagagattgggaatgagaaacaggtttatatttaacagtttattctttagctcatctctctctgctcacatcttataggcagtgagcagaacccaggtgtcactttaagtggctgcctggaaatctctttagatagatcattgagttcattaggtgcatttccgcttcccactttactgtagatgtcagtgttgctaaactctctgtcactgcacaacagggtcctcctttcctctagcttccaggaacatttccctcacttttctttaagccctcactgacaaccttcttaaaacaacagtcatttcattatctcgcactgttgctatgtgtcaggcattcagaaagggcttgtcctgactcggggtctctcgtgcttgctgtcagccatcttggaagcaagtctgattgtcatagggctaattgttgctttaagtcactcagttttagggtgattagttacatgtcagtagtgactggagtgattaacatgctgatttctttcaggcctttgttatcctcaagtcctagcacatcctctgctctgctttcagaaatccagattttctcattctcccttccccccaccatgcccacctgaaagctttccatgttttcccattgtctgaattctaagcctctggctggtgtacaacaggggtgtgaactcacaggccaaatttgtcccaaagacattaatttttaggctgcacagagaaagttttttttttttttaacttgatatgttaacattagaataagtcaagagcattcacataaaaatccaaattatccacttctctagaagaatcagaagatctggctatgctggggctgtctccctgtggcagccgtcagtcaatgctggttgccttcttatggtgggacaggtgctcctcaggtcacccaagtcctcacttggccagcttttcctttgcattttctgcttgcctcctataggcctttgaatttgccttcctgattgtacaagattctttacacaacttttccagccttgctcttagccattttctgaaaccagccccctagatcccagtatcttgtgacccagccacattacatgagtcagtagaatgtgctaagtttttgctttctctgcttgctgggctaatgctctagcagctacccttccatactgtcccttgatagacagtcatcctctcttctgcagattcccatgatttgtatcttttttatagtatttatgtcttttaaaaaaaatttctagcttaaatgtctgtccacctgtctggactgtgaactactccaaggtgtaagattttgttttattcatctttggtctagaacttggtagacgaaggtagtcaataaaactttgttgaccaaatgaagtaagaagtgatttttaaaaaatgtctaaaacaagctctctgccctgaaggagtatacagtttgatatgttatatgtccagtgtaacacaaagtagaatgacatagaggtataggcaaaattccaattggatcgacaaaagcttcttagcttaaaaaaaaaaaaaaaaaggagaatgtggaagggcagatcaggccaaggatgtaggtaatgcatatgggaaatggtagagtcacaaaaatatgtgacatgtacataactggattgtagggtatctaaagagatgtggtagaaaatatataaacaaataaataatttggggctggattataaatagataaatagatttggttgggagaagcattgaggatattcatgataatagcacctgtcatgttttgagtgcttcttatatggcaggcatcatgttaggagcattatatgaccatgcccctggtgaacatgatggcagtgggggttgggatgagattcaaaggcattaactaagacaacactggagaagtgtcagaatgaggctggagatggaggattaacaaatgggttaggggtggcaaactcaactttgaaaaacagataaggtgtttatatccaacagaacacttggaaaacaagactaagaaatgcagtttccaaggatttcaatttagatgaggtcagggaggccatggagaaggtgtgttcactcagggcaacagtgtctagtgagctgagaatgtgtactgggctgggagcagtcacatttatcgtggaggcagagcaaagaacagttggaggacacagaaggacaagagaggtaggaggagaaatattgtggacacagatttggaaagagctaaaggaaaagaatggagttcagcagtgtctacaagacagtgttatggccacagggaagagcattgaattacactattaggaagtcattaaatctcaaagggagagagaatagcattggtggcctagtagggacagataccatttttgcacggtattaaagtgtgaggataagataggatgtgagggccacaattggagactatctttagcaaaacgttgacagtgaaagagaagagtgatggagtaattcttaaggaagaatgaaaatcagtggggtccctggcgctcttttggtagaagtataagagagacttaagcatatttacagatgatgtagaggaggcagggcctggctataagtgtcttgaaggaaggaataagtgaatagatacatgaggagtgctcccagaggcattggtcttgtaaaaagaaggaatccattgtctttgcacacagcagggaaagagggtgagagtgtgaagtttattaggaagataggggctgtgagtatgtgttagtatgtttttgcgctgctgataaagacatacccgagactaggcaatttacaaaagaaatagaggtttaatgggcttatagttccatgtggctagggaggcctcacaatcatggcagaaagcaaggaggaacaagtcacatcttacatggatgtcagtaggcaaagagagcttgtgcaggggaacttctctttttaaaaccatcagatcttgtgagatctattcactgtcatgaggacagtgtaggaaagacttgtccccataattcaattacctcccaccgggttcctcctgtgacatgtgggaactgtgggagttacaattcaagatgagatttgggtgcggacacagccaaaccatatcattctgcccctggcccctcccaaatcgcatgtcctcacatttcagaatcaatcatgccttctgaaatgagtcagaactcatttcagtattaactcaaaagtccacagtccaacatctcatctgagacaaggcaagtcccttccacctatgatcttatagaatcaaaagcaagttagttacttcctagatacagtgggggtacaggaattgggtaaatacagctgttccaaatgggagaaattggccaaaccaaaggggctacaggcctcatccaaatctgaaatccagtgaggcagtcaaatcttaaagctccaaaatgatctcctttgactccatgtctcacatccaggttacgctgatgcaagagatgggttcccatggtcttgtgcacctctgtccctgtggctttgtagggtacagcctccctcccagctgctttcatgggctggcgttgagtgtctgcggcttttccaggcccatggtgcaagctgtaggtggatctaccattctggggtctggaggacatcagccctcttatcatagctccactaggcagtgccccaatagagaccgtgtggggcctctgaccccacatttcccttctgcactggccaagcagaggttcttcatgagagccccacccctgcagcaaattgctgccttgatatccaggtgtttccatatatcctcctaaatctaggcagaggttcccagttcttgacttctgtgcatctacaggctcaacatcatgtggaagctgccaagccttggggtttgcaccctctgaagcaatggcccgaggtgtaccttggctcctttgagtcaagctggagcagtcacagctggagcagctgtgatgctaggcaccaagtccctaaactgcacacaacagagggaccctgggcccagcccaagaaaccatttttttcctgctaaacttccagccctgtgaggggaggggctgccacaaagttctctgtcatgccctggagatgttttccccattgtcttggtgattaacatttttttttttttggagaaggagtctcactctgtcgcccaggctggagtgcagtggtgccatctcggctcactgcaaactccgcctcccaggttcacgtcattctcctgcctcagcctcctgagtagctgggactacaggcacctgccaccacgcccggctaatttttttgtatttttagtggagacggggtttcactgtgttagccaggatggtctcagtctcctgaccttgtgatctgcccacctcggcctcccaaagtgctgggattacaggtgtaagccactgtgccaggctgggattttcttttctgtcacatcgtcaggctgcaaattttccaaacttttatgctgtttcccttttaaaactgaatgcctttaacagcacccaagtcacctcttgaatgctttgctgcttagaaatttcttccaccaaataccctaaatcatctctctcaagttcaaagttctaccaatctgtagggccaaaatgcctccagtctctttgctgaaacataacaagagccacctttgctccattggatggacttgctctcagggtagcagaggaagttattttaagtgattggggctggtgaactgaggccctactgtaagctgcagtagcagagagaggaatggagagttggggatctgactcctgctcttacatctcctagtattgtcacctcccagctgtatgagcttgggccatggacacatgttacatgtgtcacagttttacctctgaaaaatggggcagtacaatcattctcagctcacaagctactatgaagattaaattagttaatacatgtaaaatccgtagaacatagtacctaacattgtatgaataccagctaggggcaaggggctaggctggcaatgagggaaagtgttgtctagcacagtgtttctcaaacttgaatgagaatatgacccctgggggatcttattgaaaaggaagattctgattttgtgggtctagggtgggtcccaagattctgcatttctaacaagctccctcccaggtgctgctgttgccccagtctatgggcttcacttggaggggcagggttgtagcagcactgatgccccatctaggagtggccggtggccatctgtagtggcaccaggcatcatgcgcacttgactggtgctcttcttggctggcagttcaggattagagagtacatgttggggctgatcccagggcttgcttttcaagtgtggattggataggaaggttcatctggccaggggacatggggacattgagtactagtaagtgtagcatctagagtcagctgtgggtgccaggccttgcatgctgaggagtagagccgggagggggctggtggaagagcaggagaggacctaggctggagaggacagtggagccaggcagtaggtgtaggatggaggtgccgagagaggtggtggtcagagaggagcagtgtcagagtataaactatggagacagtaaaatatttattgctaacgtcttactgagtcacatttcgttaatttttcatgatttagaaggctttttgtctgcttggcagtgcctcaagtacatgataaacagcaattaattagaaatattttttatacttctcatcagtagtatgcctggtaacaggaatgtcactatgtgttgctttctgctggtgcagtaggttcttgataggtggacgtgaggctggtgggctccctggatcacttgggtttcgactgtagtcagcatgccatatgttcagcaggtggaggagaggctgagtgcaggattcccaccgaaggggtaaaaatcactccaaggagattcccaaatcccatttccagggagaagttaatgtggcagtgggagaggctagtgggtgctttccttttttttttttttttttggacagatggacatgccagattgagacaaattctactaagttttggtcagtatttctttgggtcagtaaattcttcttttgttcagtagagtgttagaatcacacacctgcatttctgacacatttaggatgctatcgtagaaattttacctggtggttcttcatatccttcctccccattcctgtgtcaggggccaggtgccttctttgagttgcatggggacggtacaactgtatttgcagatttgcagacagctcctgtttagagatgcagcactggagtgacaggtcagaccgctctagggactgttgtccacattgctgccatctcctctctgtggctgctcatcctagccctgcccagtggccacctacatcttgcctggtggccaccagcactggccaggaaccatgcttctcctttgttcatctggctgagcctgccttcttttcttggaatcagaacttgggttcatttatttaacgggttttcattaaaaataacatttagagaaagagaagaaaatataaaacattttctaaccttactactgccaactatgacctgaagaatttgtgagattatgaattcctttaggtatcacttaaactgagcttgtttctctgagaagcaatggattttttaaaatccctgacagagaaaatagagaataaattctttctaccacctcttggctttactaaatgagcaaatcatttagtagaacaagagcaatgtaataatcaatgaaattagaattacaagggtaaataatctccattctcatcgttgggtgtggggaagatggaagcttttctgcactttttttttttttttgaagttttaactttgcaaggtattattcaattcccgaataagaccatttactaaactgtgtgaaacttagatggctctaaaagataaaagttgtttctcatcatccctacaaactccctacaaggatgtaactttgtaaaattgatttcccgtccctttggtagacgtcaatgtcacataaatccaccatgaaacctgggtttcaaattatgctgcaagtttattcctaggagtaagctgaggggacattctcaaagacaagttagtattcttattctagtggcaattttaccaatactattccctacataggtttttgaatgttctttctcttaatttggtcaacatttgtatatttatttgtttaaccaatgtttattgcttaaaggcccatcccaccatttctttcaatgtctagagctataatcctagacattttgttttatctttctctcttccagcaaataaaacaaacagagagagagccagggctctaaaataaaataaaaatgggagaaaatgggccattttattgtttatagttggattctgcttgtggaaatgaaactgacagagcttgtaaacatagagccagagggggaaaggacgtaaactaaattttaggatgttaatctagactctctctggaaaagaagatttccttagtgtaatctcttgggtgagtacttaaagaatactaattcatcagctatccttgggttctacaattttagtaaagacagagttttgttctgtgtctgatagataattttacttgttttctcacttcttagttgacagtatgttttgtaatagatgtggctttaaattcttccttttcaatgtagtcattaacatatgtttctctatgttgctaccaccatgatcagcgttgctaagaaaataattttattgtatatgtcaacagaaaattattttctcttcctttagctatttctgcaagcattaaaatgagcaatctgttctgcaaatgctgaagtgcattttggcattttttctatagtactttgccaacatctataagcaccattaaaatcaccgtcattagaaaagacttttagagcaactcaaaatgcaagcggaagaaatatctgatgccaagcccaaaagaggttttactaagtactatttcaaagataaattagttaaaaagaaaaatttggggggtaggggttggagaaaaaagctttttttaaaaaaaaatgagcataactatttgcaattatgaaaaagtactttgtactttcttgctgactttctatgttggagctcaaatcttctagaccaactggtcaggattacttttacaggttctagatggtaaggccctcaaatcaaagccaacccctagcatgcattttttatgacttcgcattgatctgacatgtatactaaacttaaatatttaaatttaagttctgtgttgtttcccttggttttactgaagctcctgtgatgcaactaaatagtgtctattataaaaagtaggctttcttcacatcatagtctttcagtcttcaaaggacagttttagataacttcttgctggtggttatcgttcagtggcataaggagagtcacatttgagtgggagtctaaggctttgtttcttgccttgctttgccttcattactgtgtgatcttgggtcacgttctgggcctccatctcctcatctgtaaaatgaagaggttggactagattgtctggaagctccctttccacacgaagtttctctgaatccttggaccatggctgttgcattcacatcatgttcatctgctacagtgctttgtttaattacatcttagtaaattttttaagcaaattactttggtctcagaggctcacttcagtcatcctgtccttttaaaagttttgcttttccaaccacaaagacatttgggaaagcttgccctatggattacatctctaccctagctcaaaacaatttgaaataatgaggaagactgattataatctagacactagcatggctgctgattatcaagctgtgttcctagcaatctcacaggtctcataagtgctacaaagtgtgttaagaatggtctggtgctgttttgttttgttcaaataggttgagcagaatcctggggaaataagcataattgtcaggttctgcaagagagtgaggtggcaatagaagggtgtgctttgttgtcttaggtttttagattgccaatacccatggtctagtatgcgtcattaggcttcctgatttctctgcctttgctcagtcagcaggatgttgcttgcatgcgcttccttaggcaatttgatgcctaccacatggccttttgtatatggcaactaataaagtgttaactgaagtaaacatgaaaaatgagcttgatccttaattgcttatatgtgcaatgttcttccaaaatattttgttcttcatgtatatagtaatgcatttcaaaaaacacagcatttttggaaagaggatgagtttgggaacctggaggctgtgtagtctttttggatcttaaccgctagctatccctggattcacagccactcaggttattttcaggttggtgtgtatgccgtataacccaagttgcagcaccagtgaaatggttcacatttgactagtgaagaattgtgtgggcttgttttgattcaggtaagaagagttcctgggtcaagtggtcaccttcataaaaccgaagacggggactgggagtggagtgacgacgagatggatgagaagagcgaagaagggaaagcagctttttctcaggaaaaggtaaatgacatcgttgacgatgagctaatctgtgtaaattttatttttgtgattgtgtgtgtgtatatatattaatggatacataattgttttacagtcacgaagagtaaaagaagaaaatccagaggtgagctgtggctatttatttattattttgccatttcattcctttcttgtggtatcagagtctgatccatttaggggagatgcttcaaaatctcatggagtagaaagaaaaaggaaaggcacgaggactttgcagctcctaattctgtctgagttactttgggctgaataaatcggggcaaattactttgctttctgagcctgtttcctcatctgtcaaatgaggatgatcccagtacttataagaaagtcgccatgagggttggcaaaatcccgtacacaaaaccctccacggaatccttgtcacagactaggtaatccattaattttaactcttaggattactgcctttagaaaacatagtaaccatacaggcaaagtgtcttccatgttttttgtttgcaataaagtagatattaaaatggttagaaactcttggttgagtctgttggtcttggtttttaaatcttccaaataataccttagtaggttaaggagcactcaaaaaattttaacagcttccctttgaggcctggtcatcttttgattaagagatcgtatttgatttacttcctccatttgattaattatcctaatgcctaatgataactgtagttcacaagacctgctaattctcctagaggaaatttgagcatatttaaatagctccaaatattttacagacctagtaattaatgtataccttaataaattctcattaagaaaacaaaatctttggactacaaatgatatccatcccaattttttttaatcagcagacatttccttttgattaaatgtagtacctgtcatcatggagtttgaagtggcagtagccagcctgggtcttgtaaggaggaggacagcagagccacaggccaccctttcttctcctcttctttcctctcatccttctctctccatcttgcatgccatgtggataggcctttcctaggcatttttcagcttgcctgcctccccatggtagctctccttcagattttgttttctcctatgtttatcatttaattcacctctcaatttcatacataaaatataaactttggccaggtgcggtggctcactcctgtaatcccagcgcttttggaggccgagtcgggtggatcacgtgaggtcaggaattcgagaccagccaggctaacatggcgaaaccccgtctctactaaaaatacaaaattagctgggcatggtggcaggcatctgtactcgggaggctgaggcacgagaattgctcgaacccgggaagtggaggttgcagtgagctgagattgtgccactgcactccaacctgggtgacagagccagactgcacctcagaaaaatatatatataagctttgatcagagacctcatccccctttgttaggagcaggggtgatgagccccacgtggaacacattgaccacacagatgttgtgctaagttttcagaatgatcttaaccatgtatcatgaactctatttctccttcctttctctcattttatctaaggtgcagagtctaggcttttctgctatttctaagagtatttcttactaaaagtgtcagttctgctgagaaatataacaacataacatggttaaagtagcatcattgactcacaaaacatttgttgttcaccacaagaaatcttcattggacgatatccattggatcctgccttgctagtaaggctgatgggtgcaggtcataaggatttaggataatctcttactgtgtgcttgttgaaattgctctgatagctgatttgttatttggagaatagcagtatctttttggcaagaatattttctgcacagacaggaagggaaagactatgtagtgtgccgtgagttgatcttcaggcatcagtactgaccttcttaaatgggatatgaaagtcataggtggtttactgcatctagactcatttgatttctcagcaccatatgtctgttaacatattgatttataattaaagaagcatatgaatagaactcttatttctgtgaaaggatacatgtgtttgcatgtaaacacttccaccaaattttaggaataacaggccccacctgctattgcacagcttctcaggctagttttttgacacccattcctttgacagccttgacatttgattatcttgagctgtattaagagatgctacagtgatgcttcctgtgtcctttcagcttttaattaaagtgtccctctgatttgccaactaccccaaactgctttctgtaagcaaagcatgaagtattttatttatctattataaaggaaattaaaaagtgttaaatatgtaactattcagcaaatatgtattatgtccctactatgtgccctgtcttagtaggtttaagggatacgtcagtgagaaatacagagcaaaatccccgtccttgtggagctcacgttcttatgggagtaggtaaacaatatataatagccttaataagtaagtaaattatgtggtttgttacaatggaataggagtgatagaaagaaacagaatgggatgggggcttcagggagtgtggtgggaagttgtaattttagatgagttggtcaggataggccttactgagaagagacatagaataatgatttgaaaaacataggagaatgacatataataaaaactgaaagaccgcttttatcctgctccccttttcacccctgtaactatcactttgttccacagaagtcatcagtttgaacagagttttcttccagaccttttctgtttctttccatactaatatgttcattaaaaaatctagcgtgtcatttttaaaacatgaatggaattacaaaaactagaaaatatttttgcaacttgcttgattgtttttgcaatctttccaccttaggaactatagatctgcctcttttttatttcccagcacatagtattgtattagatgaatgaaaattgtttatttaaccatttccttcttggcgagcacttaggctgctattacaaataccattcccttaacttttttgtgtatgtatttcagggggcacatagataagtaaattataggtacttagaattgtgattgttttatgtgtctgctgattttgaattttttttttttttttttgagatggagtctcactctgttgcccaggctggagtgcagtggcgcaatctcggctctctgcaagctgtgcttcccgggttcacgcctttctcctgcctcagcctctcccagtagctgggactacaggtgcctgccaccatgcctagctaattttttgtatttttagtagagacagggtttcaccgtggtctcgatctcctgacctcgtgatctgccagcctcggcctccagaagtgctgggattacaagcgtgagccactgtgcccggcctgattttgaatttttgtagttgctatcaatagctgtaccaatcagtatatacagcttctgacagtgcaccttatacctgtaaacatctttgagagtgaaaatgcttatctgtgccaaataacacatttaaatgccagagtatttacattttaataagctttttcatgtttgtcattacattgcaattcagttgtttttgactataagccactagaagattgagatagtattttatgaaaaaaatgaaaaacatggaagtttgtgtttcttttgcatctagtagacactatacatgttcactgatgacatgaattgggtatgcactgcaagtcgaatattaaacaagtgcatgagtaggcatatagtatttatgagtaggtcagaagtgattcaagggatcagaagacatataattgaggtgaagttcagaaaagtagctttgttagtaccatgtttagacagagtaaggtgctacagtaaactagggatattttaggaaagcttaatgagtgaggggctatttgacctcctaggaagtatgaggtagaatgaccaagtattacagtattaatcaaagaagactgagaaggccagagtgggatgtttgtcagagggacattgagaagatccacctcatcctgggtcgtatttggagatcctcctaagtccaagagaatttccagtataatctgtaagattttagaattgcattacttatcctggaattcagatctggcttgagattcatagccatcacattgaaaaattggccttgtgttcctaacctgatattttagaaatatcaaagtattaaaaaaaggatgagttcatgtcctttgtagggacatggatgaagctggaaaccatcattctgagcaaactatcgcaaggacagagaaccaaacaccgcatgttctcacttataggtgggaattgaacaatgagaacacttggacacaggatggggaacatcacacactggggcctgtcatggagttgggggaggggggagggatagcattaggagatatacctaatgtaaatgacgagttaatgggtgcagcaaaccaacatggcacatgtatacctatgtaacaaacctgcacgttgtgcacatgtaccctagaacttaaagtataattaaaaaaaaaaaaaagaaatatcgaagtattagtcacccactagtaattaataatttataacaagtagatagctcatccttgtttcatttgtttatcatcatattctacttggttgatggaagccagtgaagactaaatgttattattaataatattaattaaacagatgtttaatctgtgcctgatttccacttggaactgtgttaggcactgtgggaatttcataaaagtaaagacagctcgctagctggatgcttttcatctctttgggggtcggggaaggggtggtatttgcaaggacagtttccttaggtagtgtttcctagcttatatagcgtcttaggttatataaaacttttcaactgttatcccattattgatcttcttttgaccagtggttttggaatctctttttgtcaaaaataataagtacatgttttatgactttctgtcaattttgcattatatcctaattttctacataaaaagtgaaattgactttatctttaaatttatagtttcatttgggttcatttaactgaggagggcatttgctaaggcttctattaaagtaacactcttttttatagtagcatctcagttaggtgacatgaaaataaacagttcacaaccctggctggaaacctttaaaaatgcagtgtctagactcaacccacagattctgatttggtaatttgggatgatgtccaggcaactctgatttttaaaaagctgctctcaggattctgattcacagctaggatcaaggactggctaggaaaactgcacaaatccctcggaatccagaagtccagactggaatccaggaagctggtgtgctcaaaattcctgaagatttgttttaaatgtccatcagaaatttccaaaataaaaataaggaaaaagaaaatgtttcagaaatcccttgggaaagttgtgtttatttaatcaagggtaatgaagcaggtgggaaaggtttctggctgaagcccagtagggctcacaaaaggtatattgaaaagttttgttatcaagaatctagacttggctaattatggaaatatttctgtttcctaattctgggattttgctctgaggagaaaatacatttggtatttaaattgagttaattttattagagattagatgcaatgtgaaaactaatttttttccttatattacttattgctattgtcacatgtcatttaagactgctgttagcttttaaaaattatttctgtgggtcaggcgcagtggctcatgcctgtaatcccagcacttggaggctgaggcgggtggatcacctgaggccaggagttcaagaccagcctggccaacatggtgaaaccctgtctctactaaaaatacaaaaaattagccgagcatggtggtgtgcatctgtaatcccagctactcaggaggctgaggcaggagaatcgcttgaacccaggaggcggaggttgcagtgagctgagatcatgccactgcactccagcctaggtgactgagtgaaactccatctcagaaaaaaaaaatatttctacgaaaacatgttttccaaatgcctgtgagctgtcaaacgtgtttgttctatacccatatggagatggagagagagatttaacttctccctccacttttattatggttatccttagccatcacagactgctttaacctgatattttcatgataccactttctaaaaggtgttgttattgcaggtgactgcccttttgagcagttgttagaaaagataggtatgtttttcagaaatccagaaatctgcaatatatctgaaaatgaacttttgattttggaataattttcgatttatagaaacgttgcagggacagtgcagagttcccatatattcctcatgcaatctcccccactgttgatttcttatgtattcctgacaaatttgttacaactcagaaaccagcgctgccatgtgactgtcaactaagccccagaatttgttcccatgtcactagtttgcctactagtgtcccttgtttttgccaggatccaatccaggatagcacattgcatttagctataatatttgcgaaaacaggaaaggagttcattaggcagagctctacgaaaaattggaaagcagatgttgtctctttcttgtctccattctgagatcttttcctctcttatcctgtcctagatccccatcagggtctattgccatggtggtgttcaacattaatccattgttcctgcctcctcctctgatatggtttggctgtgtcctcacccaaatctcatcttgaattgtagcttccataatccctacatgtcatgggagggacccgatgagcggtaattgaatcatagcagcaggttttcctatactgttctcgtaatagtgtataagtctcatgagatctgatggttttataaagggcagttctcctgcacacactctcttgcctgctaccgtgtaagctgtgcctttgctcctcctgcgccttctgctgtgattgtgaggccttcccagccatgtgaacctgcgagtctattaaccccctttttctttataaattacccagtcttgggtatttgttcatagcaatatgaaaccggactaatacaccttcccatcaaaacactcattctctcaaatgtccatcctatagcaaattgtttaaaaggaaatgaaaaaccctgataaattgacagctgcttaatatgttagctttcttacaagtttttacacttagaagagtatacccaaaagaccatgccctaatcccatagaatggatctgtagtggtgacatttggaggaatgcagttcgttgtcaaggaagatgttttgtacggtggcttcctgtattaggccatccttgcattgccacctgagagtgggttatttaggaaaaaaaaaagagatataattgactcacggttctgcaggctgtataagctgatgctggcagctgctcagcttctgggaaagcctcagggagcttttgctcatggtggaaggtgaagtgagaacaggcacataatttggtgaaagcaggagcaacagagagagtgggaaggaggtgccacacacttttaaatgaccaaatctcgtgtgaactcagagtgggaactcacttatcaccaagggaatggcccaagctattcatgagggatccatccccatgatccaaacatgtgccatcaggctccacctccaacattggagataacattttttttcttttttttgagacagagtctcactttgtcactcaggctagagtgcagtggtgtgatcacagctcactgcaatctccgccttctgggttccagtgattcttgcgcctcagcctctcaagtagctgggactacaggcgcaaaccaccacacctagctaatttttgtatttttagtagagatggagtttcgccatgttgcccgagctagcctcgaactcttggcctcaagtgacccacccacacctcatcctttcaaagtgctgggattagaggcatgagccaccgtgcccagctgaggattacatttcaacatgagatttgggtgggaacaaatatccaaactgtattccctccctgtccagctctcctgtgcatctctgcacattttctgaggaattaccatattgctgtgcatcagagtggaggctgtggtcccctcgttgtattcagggttacacctacacagtaaggttgcagggtgtgtgtggggttccagccccccgcctagttgattagccctccatcttgatgattgtgcagggcaggagatgggtcttcccaggggaaagagaagttttcacctcttagtaaatgccactaaggtttttcaggttacagtagttctttgactaaaggaagtcacaataatgtttataagtactgatgtggcctttggttgtatcacaaatttaaattaagattgtggaatcaccctgaaagattctttgcaagagatcatttgaagtaggcccagagcctctggctggttaatgaatacaggttgttttgttcttctaacgtagtcattttcccctaacatcttatcgtaaaaataaatagagcaacattaaaacattttatagtgaacgccgtatacctataatctaggtatcatcattactgtacttgctctatcatatatatccatctattcatccttcagtctatcttaactttttgatgcatttcaaagtaaattgcagacatcaatacacttttccctattacttcactaccaccatagttattttggaagaagcatggagagtaagaattttatgctcttaaactttagaaagctcttctcacaaataatttttgatgatttctgatttagaattgatagtaagtttagaaataggagaacctttttgttcattttcattgctgtttctctttgaggttttttttgttgttgttgttggtgttgttttttgtctttcaagttttgctccagggcagagttcccaaaagtagagctcaaggcaaaaataatttgggggtaaccttagagttgggtttctaactttgagagaggagtataacctatcactttagcattaatatcttttaaaaatgcaactatccttatgtattttttaaatacagtgaataattgctcatagttagattaaaggggcaggttttattaaccccaacgtcttttcattgagggtccgttaaccttagatgaaattatgcaataagaaaaaattatcctaggacatcttttggttatcaaatttaaaacatcaaataattcatgccttttcactttagcttagtggttctttaacagtataatgagggttatttggggaacttggtaaagacacagattctcttccatctctgtggaattctgagtcacaggccaggaggggcctaggggtctttaacacttgtcctaggtgattccaacacaggtagtcaaagagccacactttggtaaatattgctttatgatcgtttggaaattattgggtctgataattgggacttaatgtaaccacactcaccgtgtctccctttggctttcttgaatgctgtaacggtggctctcgtaacagattgcagtgagtgccagcaccatccccgaacaaatacagtccctctctgtgcacgactctcaggtatgtttctctgccagtcattccgtttgaggtgctttgtagacagatcctttaaaaaaccaacattttagaaagatagacaatttcaaggtagtgcctccaaatcaagggcttataagctgtctttttaaataggttgctattgactgtgctttgtgggacctccaacctttaaatgataggctcaagagtgagaattgattaccagactgctcctgaaattgctggtactgtggaaaagaagaaaaggaaagaaaatgacaccattctgttatattccagccacagaacattgtggttaattgatacttttattttttgctcctggttggatttctgtaacctgttttcataattctgttatcattgaattttatgggccaattcgtctctacaacttgccttgtaaaaataatagtccagtaactgtgacatgcatttataatgcatatttattaaagttatgggacagaagacgtggctgtgagccatggtgggaggtgttgagggatgctgagcaatccagggaaaggcctaggggcatagaaccagagcacaggcctgcattctggttctgctgtataattaacaggcaagcccttttgttctcaaagtggttgtactataaagcgtcaccactgtcaggatcataattttctttctttcaaactctgcatattcaatttaaattcatttctgttttacttggtctgtgttttataaaatagccatatattggagagataattagagtgattttgttggcttcaggaagcctgtttgaggtcagatacctaatgcggggcccttattttatagcttatatatagagggagtaaagacttgcagaggtgaagtggctcccccatagtcacaccactagttagaggccaagtcaggattcggtttaggtctttacactatatcaggcaactcagtaagagaccttgagataaactgtagggattggttgaatgataaaaggcaagttaagaataataatggatcagagggcaaagagagtaaaggaaacgggaacagggattaggataactagtactgtagagcattttatgactcactttcatctatatcattttattctccctgcaaccttttacggcaggcgttattcagagaatggcttgctcatggttgcatttcaggtcagtggcagtgccaagtcttgacctgaaatgccttattttttctactccaacaataaggtctactcatgtcccgggattccctgagaacagggagaggctgtgtattggagacattcatggttaataatcaatattcaagaaaatgggctctaggtgagaaaggcaggaaagataaacagtggctgaatcttctgggccccgccttcctctgcattgcagggtttaaggtgcccagcctttgtgatccccaagtttcaatagtaacagtctatgtgtgggttgtgaggtgccattttaggtagctggactttactacagcttatacaagttgtttatgatacccatcctagaactgaggctttccatatgaaacattcatatccacaattgtgatgggaattaggcaccattacaacctttacatggaggtgttacgatgccaaagaaggcctgcgtgtgtaaagatctagttttgaaatttccagaaagaaatggctatatgaatcaagtgatattgtgattttattcattcctttcctgatacagtttataacactgtttgctgttttctttttaaagggcccacccaatgctaatgaagactacagagaagcttcttcttgtgccgtgaacctcgttttgagattaaggtaaataatactgttgtttattctgcattgtttttcctatagtacaattttttaaatctccttcgttaacctttcataatattagcataaaatagaatcgttagcttatttgatttccccgaaccatgagtgtatgctgtattcccagggctaattgtgctcttctaattgcttgctaaagaagagtaagaaagaaaagcaccatatgagtgtgtctgcaggctcagtgtacctttcattatgttttatttccttgccttttccttcttagatttttttttcttttcctttttctttttttttacaatgtaagatcacagtaagagatttttaatgagtttctttcacacttcagcagtcggtctctgacagaaataaaccatgcttgtactacaggttgcctgttcagaacatttttcattggcaagtttgatcagccactgtggagaaatgacagatatattttgaaagaaatctcagtcttctaggaaatggatacaaatatggtgcctgacagtatggtctttgtctgcagtagtgtgaatgaaagcgttttccgttttaaggattttttttttaattatttaaaggttcatctttgtgatgttctttgctaagaatttgatatctcaagacaaaactgtttaaactgaattataaacagcttagtttaccagttctatcagaatactgtcacatctttgaagatgttttaaaagaagttatacatatgttcttctgaccattaaacaaataaagcacgtgcatatactaggcattttctgagttgtagctacaaaaagcgggttcatcagcaaggttagtttctggccactagggattttcagagttgtagctacaaaaagtgggctcatccttaaggttagtttccacccctctgagttatcatagtccatctaagtagaccattggcaccataatcacccctcacttctgatggtcatttatagtctgcattttcacgtatttgtcaaaggaacctcacagtaacccttggtatgattcaattcagagttaagaagtgaaattatcacaaggctgttttccttatatttgacagtagccttgattattattcacagttcgtgaatttagcaatcactaaagaatgaggtagcccattccctttttgtttgactttcgaacgaggtacttctttcatttatattttacttgttcagttattcattaattcagcccgtatttatgaggagcccactctgcgccaggagctctgtgccaggctcatgttgtcattgaggtgtagtggtgagcaagactaccaaggttttagtctagcccactgagcatgcagtgttggaagtgacctttagaatccaacagtctaatcgcccactttatatatgcaggaatcttttttttagtgtctctgctggatgtttacctagcttctgtgcatactaaagctcacgttttctccatgatggcccctttaatactaaataaaagccttaattgattgatggttcttcctcctgaagattaaaccgacttttctgttctgggctcctatgggctgtaattctcccccttagtgcaaatatcagactgtctgcataaaagtctcctggaaaatgtgtcaaaacacgtactactgaaccttaactttagatattattttgccctgggtgctagagcaatatgacaaatgtgttcccttatttttctgagagccatttgtatatttgcaaggaatgttcttctcttttcttagacaaaatactataagaatctttagcctttttctcatgatacagtttctatattgctcttgcaatcctagttgctcacctttattaatatttagtctgtatctgcctttgttatattttctcttgtgggtataggttgttttcataagcttgtggcttagatcactagtcctacatgacgctccaggaagaaagggttctatgttcaaataagttaaaaaacaatgcacactattcatcaatctgtgcatgtgcacacacacgcacatacacttttttttggaaatcataaggaatattaacattaaatattttaagaagttctacaggaagataatttgtttaactttctttaatctaaaacctatttgatctcgtaactctttttatgtggttattttgtgttccttttgtatgtagtgcccatatttaaatacaggattccagatgtggtctgagcagctggaatacagtattaagataatgtggttttttttttttttgtaatccacactctatatttctcctaaatcagcctgagttttcattgccttttgaaatatccatgcacatgggtgacatgttcagcatgactcagcagccaaacaaaacagctgatttttttaaagggctaccaagcctaattctgaactgcaactctagataaaatttatcttttatcactaataattaacctgatagttttgatgaatttcttgtccactgtgtgtttcaatcatcaccatcagtgtgtcatattctagtgtttagatgtatgtccattgccaatctgattaacctgccttttaatctttatccaaaacattgattaaggtgttcagtagtttgagggcgaagagtcttctgacatctgttggaaaccattcactgtcggagtgactttcagtaatgaactagtgttctttgatacagttgttcaaccagcaacaaattcaatgccttttaatgtacatctaacacaattattccaaaggatatcataaagggatctattatatatgttgctgaagttaatatgtaccacattaatggcattttcctgaatctaatgacatagaaacactttcaaataatagaaatgtattttagtatgacttattttcagtgaacacttgttgatatctaattgttggtacatttgtctagttaggttgccattaaaaaaaataccatagactaggcggctgaaacaacagaaatgtattttctcatagttgtggagatcgggatgtcagcatggctggtttctggtgagggctctcttcttggcttgcagctgtctgtctgcttactgagtcctcacatggtggagagggagtgagagcaagctctctggtgtctcttgggtcccaccctcatgagctcacctaaacataattacctcccaaaggctccatctctaaataccatcacttggagggttagggcttcagcatatgaatttttttcagggtgggccacgattcagtacatagcagttggtgtactttttttttcgctaaatatttacaagctagttatttagactattacttttcatatttgtgaactcatgaatctctgagaaattattgttggagtggggtggaaaggggggggatgtccttgtacttcagtttgagaaatagcctttgaaagttctaagttaaacagtattacttttttgtgatcaccgtgttctaaagtaaacgaaaatggtaaatacattcattcattctataaatatttattgagcacttactatgtacatggcattgttccaggtgctgtaatgtaccagtagaaaaaagaaaaggcagacttcttgccctaaaggagcttacattctagagccagggagaggaaaaattcaaatattcaaattggttgtatgatataccaggttgtctgaaggaaaaggtatgtgaggaggatagaaagtgagggggatggtattctatattatagaaggtatattagatttctgttgctgtgtgaaaagctatcacaaacttagcaacttagaacagcacccatttattatctcagtttctgtaggttgtaagtccgggtacagttgagtgggatagtctgctcagtgtctcgcaggctgaaattgcggcatgctcatcggaactcatggtcctctcccaagcctttttaggctgctggcagaatttaggtccttgcagttgtggactgaggccctgagctcctataggccacaagcagtttacaacatgattcttgccctttcaggagcagctgtggaccatctccactacgccaccctcactcccaaggcctcggtctttctgttcaaggtttttcacctgattaagcaggcctcacctaggataatctcctttttgatgaactcaaaatcaaactgatttggaactttaattacatcttcacctttgccatgtgccataacttaatcgcaggagtgacatcccattatcgttataggtcctgttcatactcaaggggagaggatgctgcagggcaagttcactaaggaatgggtttattggggtcatcttagaattctgcctaccacagaaggcctctccaaataaagtaatatttgaacagacagacccctattggaagtgaggaaacaagccacgaggccgagcaaacagcacttgcaaacgtttgaagcaggaagcatgttataagtaattggaaaagcagccaggtaaccagtgcaggcagagccaaggtcatgggcacagagagttagcaggggccaaatcacgtagggctgtgtagcctgtggtgaagactttggattttactgttagagggcagaaaaccaggaggcctgtgagcaaaagagtgatatgatctgaataaaattttaaacagagagctgcaattgatttatagagaacagaccatgtagagagcatataaggtggctgtgagagtccctaggcaggctactgccatgacatagtgacgatgatgtgacttggaccagagtgaggattaacggaagtggtaagcaattattggattccagattggggagaaagaacttgattactcaaggttttggcctgaaagtatggaggaatggagttactattttttgagatggaaaagagagtttgagttgcaggttgggatggaataaagaactcagttttgcacatgttaagcgtgagttgtctgtgaggatgtatcaggtagggatttagatgcatgatttcaaagatgtctcggctagagatgtaaatttgggaacagttggtgtctatggcatttaaagttatgaaatgagtggaatcatctagggagtaagtgaaggtagagaagagaagtgggctggtactgtcacagatgttgcataggtaagcatccactgattgagaaggagaggctggtgaggtagaggagagagtgatgttcctaaaaaacaaatagaggaagtgtttgaagaaaggaggagtgaaaagctgcatcaaatgctatcaataggtcaagtatatttgcaaaatgaagcacatgcttgaccttggcaagaatattttcagtggagtgatggggacaaaagcctggtccaactgggttcaagagattggcaagagagaacaggggataacaaatagataacttgttagtacagataactcttgtgagaaattctcaacacaagggatcaaaactgtggagtgatagctcaatgagaatattgggtaaaggaagattttttttaaaaaaagcatgtttacaggtgaatgggaatgattcaatagagaaggaaaaattgaatgagggaggggacagtgccagactgatgttctcagatgggtgaacagggatgatccccagacatctgttagataggagaaaggagaggtcatctcttggatggtgcagctaccatcaggggaaggcaggcaggggtggcaggtagaggtgcaaggagactgtaccttgcctggaagtcttcttctgtttctattttcccagtaaaacagggaatgtcattagttgagagtggaaggaaaagaacgtgatggaggttttagaagagaggagaataattgtgtaggagagcaggagagtaaattttctagggaaatgcagaaggattaacaggctggaacagggatcactggaggttaataatgacccagcatgtaagtgtctgtgtgtgtgtgcgcgtgcatgcgtgtgtgtgtgtgcacgtgcgtgtgattataattaaggaaacacaacatttaaaaacattcatagagggccaggcgcggtggctcacgcctataattgcagcactttgggaggccaaggcaggcagatcacttgaggtcaggagttcgagatcagcctggccaacatggtgaaaccctgtctctactaaaaatacaaaaattagctgagtgtggtggcacatggctataatcccagctactcaggaggctgaggcacgagaattgctagaacacgggaggtggaggttgcagtgagcagaaattatgccactgcactctagcctgggcgacagagcgagactctgtctcaaaaaagtaagtaaataaataaaacatttgtagaggattctgtgagcatagccatgggccaccatcttagaaacactgtttaagtcataaataaatatgagtcatagaattgctgtcaagctgatctcttgtgtgcaaggtggcagtcccctgtcctcttctctcaccccagcacccctcaaaggtctgacttccttcttttatagcctttgaagttacaagctctttgagtatcaaaaacccactatccagtattgttccctgccacacaatttgttcatacccattccccatttgaagtctactttggatcatttgcatcatctctgggcctgaacaagctattctctaaaccatcctgtgtgatagggagctggaaggctgcttttggctggtgttgatcagatttttaaaaatccatgccctcttttgcaccttcctcatttgtttccatctccattcaagactctgatatatgtgaatgcatttgtacatatacatatctacatgtacacacacatatacgcctgcatatgttacacatacacgtatatttgtatatgccctcactctctgtgaatcactcctcaatgtgatgcgtggctgccgggtattgggaagtagtatgcttgcatttcttatccccgagcctatctgggtgtgacatttatgtgtgttatgctccacaggctagtaggtaggagactttagttcaggccagcccttcctcagtccttaactaatgctgtgtgggtggctgccctctccacctcttggaaaggtcactgtgactttctttttgacatagcattttatggccctacctgctgggaacgtggcttccttcctcactgcacgcccctccccctccccccggaagctcaccttgattttgtaagtaggaaactgggaaatattttccttttcaaaatgtcacactctaggagaaaagacaaatacgttgtggctacaggtagtgtatttctccactatttatttattcctggagatcataggcaaaagtctgaggaggcaaaagggtagtttcttccttgaaaaaaatatagtgttgctttaatttgctgttatatgcaatatcagagaacaggattagaccttaaggctcaatgttaaatgctggaggtggttaaaatgcagatttatctttttcttttatgttttttgcaaattttttttgtccatagtatatatgataatgtcatctatgatatcaaaaaaattgaattatcataaagcccgtacaaggtaaggaaatcctcctaaatgctaaactcaggagaaaaataccaagtgggccaccttgtaatttatatactgtcagtagatggtaatacagtttctgttttgagtcaaacattatacaaatatttttccattagtatatttttcatcaaataaaatagtcatgcatttggcacaaaacatgtttattagaatcaggctcagtgatttggaaaatggtaaatctatcacttaaattattaattcctttgtattagatgctgttcatactttgacagctcagccctatggatggcatttacagttttgctgaaggcagccctgccaattgccatacatagatatgctggtctggtatgtcccatcaatttgctcatcatgaatttaccttgttattatgtagcagtatcattggaccttgagggaccagttgaagaccccagatcagcagagtggcttcctgctggtagggaaaaatgatctctagcacgggatacttattttaactcagcatgacaattgttgcatacttcaatttattattttggtttcgttattaaaagatgcacttagctatttgtaaagaatagacttagtaaattatgatttcataaagaaagctaaatctgttagaaacgatgttggccattgttttagcatgagtatgccagaattctaattccatcattattcaggaggaattataattcttaaactgttctctagcctataaaatagggttatttgtataattcttaccggtcaagtggctgggaggtttgattaattttttccctgaaaggttaaatagtgtaggcatagtgttcagttatgcagtgcttttttagtacatgttcttttttccctccacagcaaactacttatttactgctttctttgtgcaagtctttgttgaaaattcaaaaatgaataaagcaaggtttctgcactcagagagcttaccatgtaggcggagagatcagatcccgcacaagtgaccataatataaggtagaaggtgataaatgcagtaagaagagagataaaactaagaagctatgggtagttagaggaaggtgaaagcccttttgtttagatgttatctttggtgtgcttgttcccatagtaaccagtggtattgttttttgtgtgtgtgtgagtttttttttttgtttttttcaacaaccaaattttgagaagagtaatggataggacgaatccagggtcagtgtcatgctgtggtctttggtaaggggtttaccgtcttaacttatttctgaaaagacgacatttgtttttcagtagagtggtatatgttattacgtgggtaccaaattaatagaaatacagtgctctgatccaaaaaatgtctggcattttacttcattttttgggtgttctcttttggttgttttctttgagaatttgagtccctgatgcatatcttggctttattagtggtatccttcaaaaagatgaaatgcctactatgtgccaagcacgatgataagcacgttgtttgctgtgtcttgtttaatcatcataaaaccaccatagcatccatcctattgttaccagaatttcacatgtgggagattaaggtttaaagtcatgaaataatttgtttaacaccgtaaagctcacaagaagcagaggtgggtcttgaagctaggtcagtttaacatgttggtccttgttcttcttccctgaccctgtggccttgctctattcagtcctgttttgaatgcagtcagaaactcctgtactttagggattgttacatttacctgtcttcccattaacgtttcacataaatattcttttaacaatgtttcccaacaaactcatcattaaatgttatgacaggaatattggaaaatatttttcttggaggagatgctaaagatgctgctgcaaatagaaactggcatttatcgtgttttaataatttttcaagcactgtcacatcacttgcttgatttagtttttcctttcgtcctacatttgctgctgacagatgaaacagaaagactggagatgttaagtggctttcctgcagtcacagctgtaattctccagctggctagcatctgggtcttctgacactaattcaatgttattgatgatatggtatagggagatagtatacatataggtgatagagggtcgtgtaaggtgttgcctttggcatatacaaaatccttctgctggtaaacatgctaaaggaaagaaggtttgtattcagaaaaaattggtataagggaagcaaaatagaagcatgaaaaatcattcattctgcgataatactgttttttccttgacaactgagcaagaggacattgtgagtacaaatactttcagcaacagagaatgcatagagttctttaaagatattctgtattttcaagccgtaaatggtcatcttagaaattcagaaagtcaacataaattaaagaaataacatcatccataatctcaccacccagaaataattattagcctcttggtaaatatttttccagacttttttctacatacatgttaatgtagatttttaattttttaaatgttattgtataaactttttattttattataaaacaacatatgttgttttctaatctgctctgtttactttggtagtatgtcctggataccttttcatatcgatgaatacaaatctatagaatcctttttaatggcttccttatatttggattgaatgcaccaaaacttatattactgaaaaagtgttatttgatattgagggagttcccagtttttcagtattgtatcatataaaaggttaaatgtacaagaatggtgtttgaaaactgcccagtaggaaaatctctgttagctttgaattttgaccttagtgaaatgctcttagactttgagaagcctgaagatacagaactgagtaagcccagtatcaaagcacatggggattacttaggagctggttctggctcttgggtcagcagaggttgtcatcatctgtgtagcagcagacaccgcttcctcgctctgtgttggtgctgagttcttgcagcagggttttaacgaggtccctgcactaagaagctccaaaactgaatgatttcttaatgtaagagggttccattttgaagctgttcttttggatacttccttcgaaagcttattctttaaagaatcctcccttagctgcttgctgtgagcacccaggagttagaggaagtagcctgtgttggacctaacagttggaggagatgagagatcacctttatgctctgtgagccttacacaatggctagcatgttacagatcctgaataaatatgtactgcacaggtgccaactgaatgatttttaatgaaaggcgtattttacaaacaatatcaagatgcttcacaagatgctgtttgcagctctttatttttgacattgtggtggaaacatatacagaaaatactcctttgctagattgctttttttccaaggcaaattaatccttttgacataatctcctatattttgttcttttaaatacttttctgttaagacaaaaatggactttttaaggtacctactattttaaagatattttctctgcatgcttatctatataaagacatgaaaagattcatgagaataaagcaaaagttcatagaaggtgtggagagtcctggaaatatgaccaaacgatcagtccagcaggcaagaactgcaaggcaggttctctgtcagagaataaaagaagggatgctaaacaagggccttgcgcgagcattccctgccctccattgagacccagctgtgttactgtggcttggcacagtgtctattggcagttcccacctctaggtctcaggacaaactctcatcgttcacatttgaaagtgtggatgtgctatgtttctatccacagagccttctttggtaagaggtttcctagttaaaaaaaaaaaaaaagtcttcctcattcttttttttccactaaaagaagagtgaagccaaacacctatcagcagctagaggatggaagctggcctgcctctgtggagcttaccatggctgtctctctgaggcagggcattttcaggggagctctcaggtcagagaagtggggtgaattgtgccatgtcgcaagactagtcagtgtcagccccaggagtcaaatgccaatatcaaccttaagagtaaagtagagggggctgggcgctgtggcttgtgcctgtaattgcagccctttgggagaccaaggcaggaggatcgcttgagcctaggcatttgagaccagcctgggcaacaaagtgagaccctgtctcaaaaaattaaaaaagagtagagtggagggcctccttgctctcctctcatcttaagttccacagcattgtagccaggagtcagtcttgcatggtagaccaattgtttggttatgttttggggactctcgtgtcttctgtgaactattgcttctttctcatgagccttttaatgtcattacacagataggcgtgaagagaaaatgtcttaaaaatagtcagtaccttaaacagcttttttttggtggcatttaagtcaatgttaattacctgataccttacctgatagtagcctgaaattttaacaaatgcctttgtattttaagttatccttcctgtcgctgtgcagagcctgtctccctcatccttttttatattccacctttcctggctactgatgaggtaacctgctgctcttagcattctaaaaattctcctctccagttttattagggaaggttgtctcttaggacttgtcctcttgatcagagatgaataattctggagactgtttgcagagttatttcagttctccgttaccatatccctgaagataatgagtggtaagatttcttccttgagatgctgagtcttggaaaggtaacaagtatatttcagtttggggactttctttgcattaacttttctttccctgttgaaaccagacttcttggaatgtaatttaaactttatttagcaatccccgaagtgctagaaaactttattctccttggtaaaattcatacagttgttaactgatggtattgtgggaaatctctgctgtccggtgaatttcattggttggcctttgtattagttttctatcactgctataacagattaccatttacttagtggcttaaagcagcacagatgtattgtattccagtctgtaggtcagaagagtctcagcgggctaaaatcaaggtgtctatagggctgcattcctttctggaggcccttggggagagtctgtttccttcccttttccagcttgtagaggtagcctgcatccctcggctccttctgccatctgcaaagccagcagcttaacatctctctggccttgcttctgttaacacaagcaagatctctttctctgaccaccaggaggcttctctgcttttaaggacccttgtgattaggatggtctcaccaggataatccaaaataatctttcttcacaaggtccttaatttaattacatctaccaaatccctttttgccatgaagagttaacttattcacaggttcctgagatttggctgtggacgtatttcggagctattattctgacactaaagaaagattttaagtgtctctccttatttgtggtatataatttctaatttttattatgcttgcttcctggtcccacatttcttggtattacagggcctgatgcagtgcctgtcacattcctaacattcaggcttccctgaagtagggcagtgaactttcatgagcttggattatcattatggagcacctttggagtgcccagtgtatgccaaatgttacaaagaagatacagatgtgtgtgaagcttattttcttctatgttttgagacaatcatatggaagtatgaaattgcatattatccctttcagctgataagagggattacttaaaagtacaaggtaatttggaaggtgtgccttcctatgaaatctttcaagtagagatctggaatctgtagttcccatgtagccccctcctttagaatcggacacccagttctctcctaatgtacatgagtagtgtgtttctaacgcttcactattacaaacaatgccaccttacacacatctggttatttcccaaggaagagtaggaacacagacacaagtcaggcaagtgcagggcacaggcaaggagaattgctagttctcagctggtggctggagtcatagttactattatggatagcatttactgcttgctactcatatgcaaggcagtgtgttaaatgcccactgccttgtttcttttacttctgacaacactgtgaaatagatactaatgttattctcatttacagatgaaaaacaaccaaagcaccaaagttaatttacttgcctagagagttaaacactcctgtttagtacctgagcaggaattctaacttgtgttatctgatcctggtaggtcctcatttaaatgatgccctggatagcttccaatgaaagaaaagtccagaaatattgattggcagatacttggttaaggattttgtgctagggaattgggattttcttttctaggcaatggaaagtaataaaaatatcttttgggtgacaggaggcaacctggtaagaaaattaccaggacttttgttcactcagaaatcggagcttatctatctctctgcctccattcttgtcattatccagcattagccgtgtgttctggatgttaggtggtagccgggagagaattgattaactcaggggagtcttcatcttcttcagttcactttcagagatcctgagtcttgtgtggtgcttatttcacactgtttttctttgactgttacatcaactgacaatccaacgagcatctgggcaaagggctggtggttttacaaggtactcagtggccactggttatcagagctatcacttgttccttttgcaaacggtgatgaaaaccatctcgtcaatagcattaggcattaggcatttgccagatgatgcattaggcatttgccagagctgaccacatttagtctgtgtgacgctgttgagggtattacatgggtaaaggaaggtctggggtcacatcagaggcattgcagagctaggggaatgagatgatatgaccatctggacatggcgcctagctttgatgccagtagctggtgtcaggtggcggggttgctaattacagaaggtagctagagaacctgaagagtcaacaacaaaggtggtggaaagaataaagcaagagccaattattggaggcttgagtggttcggttagtgttttctagcaggtttcatttacccaggtcctgtactgtccctggggcctgcagatgacctcttagaagtggcccagtttggtccaatattcatgagagacaagaacatgaatttacctgaacttaaaaagcataggccgggccgggccgggcgcggtggctcacacctgtaatcccagcactttgggaggccaaggccggcggatcacgaggtcaggagatcgagaccgtcctggctaacgtggtgaaaccccgtctctactaaaaatacaaaaaattagccaggcgtggtggcggttgcctgtagtcccagctactcaggaggctgaggcaggagaatggcatgaacctgggaggcggaggttgcagtgagccgagattgtgccattatacttcagcctgggtgacagaatgagaccccttctcaaaaaaaaaaaaaagcataggccaagaaggaggtagaaaataactgtattttagggaactatggcaaaataaaacccatcacttgataaggatcttaatcagaatttggctgcatggaataactagagattatctcctgagctttcaccctctgggccacatagaaatgggactatcaaatataagaactactcttttaaaaaattttcagaaaataaaactctgtgccgtcgtctggtaatctgcttagctcagtgagtttccccagtgaggtaagtagttaagcaactttaatctccaaaaggaaatatgagttttggttgagtttttaatgaatttggatatggaagatgctgtcaagcatacctggccacaaagtattaatgtaaatcctctttaaaaccctttgactcatttttatttgcagagatacatcttgtttcataaaagcattggagggcttctgccctgggtaagaaagcaaaccacctttctgacacagagggccctggggaggaggtttggtctcctgtccccataagtttatattaatcctttaccttggagcatgctgcagtggctacttgaagatgacttttcagtccctacttggagaatttaccagcatgcccaccaatggcctttgttgtcttaatggagaagctctggggattttgtaaaaccaaactttgtacgtttgtctggaactcgttctagagttcttgctgtggagcagatacaaggtcagctcagtcaaaaagctgatggggtttttgtcctttgatcctttctctttttatggtttggttgcaccattttgctccctcccccgaaagagaagtctttctctgagaatgttcaaatgaattattaggcctctaaagcacttaaaatgaatgtgtattaccacagcatggctataccattttaaactctaacattgtaaatcacacaggatcctagtcagattggccttttgactacattagcctagctgttctgttgcagggaagtgtattgtttgcttatagagtatttttagcaatatccaagtagctaagaagaatcttttttttatttcttaaaacattctgtctcttttacctcttttctccaacatctgaaagaaaatggggaacttaaaaaatatcagggctaaaagatatttaacaatgcttcattctctttttttcctttttttttaagttgttttttcttcattcttttttaatcagtttattgtacaatctatactcgctgggtaaaaacaaaacagaagttttatgtttctttagttactgcctttaaagagttgtcagatcttcccttcccatcttttaatggcatctttggcattaggccataattttcctgtcacttggaatgtaaaaaagtttggtttaagcttccatttattatgcagtttcacctttatcccctcccatcacccacctgacccctctccctgaggagggaacacagttaccctttctcccctttttgggttgctttttcctcttggttgccactgcttctctaaaactaactggctgccagtgtcctctgaggccagtgtccaaaggccagctcttcagtagtgacccttgtgggactctctgaagagatataggccagctctgcttcctttcacctagggaggtgagcaagtgactcacctccacttgggaggagtggggtgatggcaagatggcttgatgtgggccaccttccaggtgaccccttcaccacaccaagacacgggggtaggtgtgcgtggatgctgaacggctgctccttctctgcactctgccgtgtctcactagttttcttttgtttgtttgtttgtttgtttgttttgtttttgagatgaaggagtctccctctgttgccaggctggagtgcagtggcacgatcttggcttactgcaacctccacctctcaggttcaagcaattctcctgcctcagcctcccacatagctgggactacaggcatgcaccaccacgcccggctaattttttgtattttagtaaaggcggggtttcaccatgttggccaggatggtctcgatctcctgacctcgtgatccgcccgcctcagcctcccaaagtgctgggattacaggtgtgagccaccatgcctggccatcttgctagttttcttttccttgctcaggcagtaggggtagggttgatcgatatgtctgctccctaagcaggtattgatctggggaatgagatgccagccttgcctccttgcccactcctttgacctgtggagtgcctctctgggggactcctgcagttgtattggtagtggggagcctcagtacacaccctagaccagtaactcgtgagggttccctgtcattctttaccccttccccatattttctttataaagataggagttggaggagtcagatgtcgtggttggggctagcatagccattttggccaattgttaataagccttaaaggagtagcatgatatttgcatcaatctttagaatatggggtagctgatgtctggttatttttagcttagcatcctaggaacagtgctagggtgacaggaaaagattcacctaatatccactgtcacagtcattcttctgtacgtctattgaactcctgctgggcaagttaccatgggaatattctaaaacataaactttgtccttgaaagatcttatattttggtttaagaaaataaggatataaacagagaaaatattgaataaccatataagacagcatgtggagaatagttcaaataaattaaattgagaataatggtgtcatttttcaaatatcagtgtcaactggggtggacggctaagactgcctctggcctgctgcagggggtgtgggggtgggtgaggcagggggcctgagtgtttctgttctagaggatgccttccagctctgttgtgtagcttctagctgtgctctgcaggttaaaagaagaggaaacacccagggtgtgggaggaatggaagaagaaatgtgaaaatgtaccaaggcacaggtttaggactaacttgattttttttttaaccagattaaattttgaaataacatcattatattcttgtttataacttttttttggtcacttataagatgcaaatgaacaatgttgggttttttttggtttttttgtttgtttgttttttgtttttttgacttgtgcctttactttcaacagaagttacaaggagcttgctgttcactgaatgcttttctttctcttctctgttatcaggttgattcctcttcagtatagttactcattttttcctgtacttacctgaaaggagaatgtaattaaccactgtctttggcagtgggtctgttggaattattacctgtttggcccttagtcatggttggttggtttacattcttggtctcctttcccaatcttatttgtcttctgtgacccttgcccagcatgcagttggcctctccttccactgcagacaaacaggtcttcgctcaccttcccaaaaagctgtcactggttcccttgggtttgcctcaccacagtgcaacaaagtgcatgaatttgggtatttgtagatttggtgcagtgtacattttaatcttcttcttctctttttctaaactcctggtccttttatactttccttcctgtttcttagataattattagaggctgatcttttcagtgttagcatctttcttataaacagtctttgggtcatatttcagtattttatcaagcttactttaaggacaaatcaagctgatgcccagtaacctctcttaggctagaattgactttatgatgttcagtaaatcaccatgtttaaggactccaaacttatcgtagtggccttggacttcaagttgcatattgagtgataaggaaaggaccatatatctatttttccatcctaatctctactatgttattggtgttgaaactgtagaaaggtccattaagtctaaggttaccttaaagggaggttatctctgctgttaaagtgacaatacccgtgatatactcaacagtattgcaaggatcttcccctttctctcaaaagtcagctattgttatttacttgtgctgctgcctacttcatgaaaaaaaggagccatataaaagtgatacattttaacatgttgcagagatgaacaagggctttcacacaacctccccagagaaaggaataataattattttgataaagtgctgttctatttgagaggttgctttcctctagctaaatcctcaataataatgcctacatctattattgttctaatataaagaattgcgagtgtagggaattattttatataaagagattctcactctagggaatttctatactggataatctgcagcctcctgagtgcaaataaaaaatggaaattaaaatcctctagctttgaagcatacataataaggctgctgcaagtacgaagtcagaaattgtgagatgatcaaaatcttcacagagtaatatgtgctaatgacaaagttcaggtcagaaaccaggaaaagaattgagaaagggctatggttgtgttagcagcctcctacatctttgttggtggtcagaaattgtgcctgtgttgtacttctgagttagttgtaacctattatattcctctttgctgtgtcactcctgcaaggagaatttgcagagaaaattcacatttgcattgcttctgtgttttaaaatttagaagcagctgcaacatgatttaatcaagtagggaaatatcgtttaactacattttgggggttgtttgtttgcctttttgctgtatatacacacttaattgattctgttactggggtttgtatttattttcaatttaaaaattaggaatcatcagcctccagattacttgcctctattagttattgatgagtgatttttttttgccatcaatgagtaataaatagaacacctcagattaattaattccatttgttgaattgacctttgtttcagacactgttctgggggtataaaatgaataaaccaagttaaatgataaaggaaaacatactctgattgctgagtaaaaggtgggctttgaactgtattttgtattcatagccgtcagtcaggtagttgaagattgactgggtaaagttgggcggtggggacggaggggccaggtagataatagttcttaactgtgggtgttagggacctaaaaactcagattaagcctgtagcttccccctcctgcccctaccaaatacatatttaacatttacatagtattttgcaggtggtttagataggtttactgatccccagaaacccatctatggaccctgcaaagctccaaaattagaaggaaggtggctgggtgcagtggctcactcctataatcccagcactttgggaggccaagatgggtggatcacaaggtcaggagttcaagaccagcctggccaagatggtgaagccccatctctactaaaaatacaaaaattagctgagcatggtggcaggcgcctgtaatcccagctactcgggaggctgaggcagagaactgcttgcacccaagaggcagaggttgcagtgagccaagatcatgccactgcaatctagcctgggtgacagagcgagactccatctcaagaaaaaaaaaaaaaaaaaagaaggaaggaagatagaattaagatccttcaaacctgttgttactgtttttccaggaatgcccagactccattgtaacccctacctttgaactgggctaaccggacttaaataggaattgtgccataacctatctctttgttgtttttaatatacaaagtaacagtagaaagttaggttgagtatgaagatgatttttaaagggagggcttttccgtagagagatggacagagagataccctagaaatatttagaggaactgaaagttgagtaagcattgatgtaaccacatgatataaatgaatgatttatttttaccttgccttgttccagagaagatttaaggtgacttacagtatgaaagcataaagtaggtgaagtaaaatgaagctaaaatgagattttaaaaatatcttgagagtggaaagagaattgggcagggaacccagagtgatataattacaatcactgagaagaaaatttagccttcagcttgttagcaaccaggaaattatagttgtctatttagtcctcctctcttgacaaaagtagacctataggattaaaagattatatagcgaggcaagcttttgcttgataccaaattcaagtggaatttatctcttggttctttctataaagaaccttggataacatggcagagagcttgacctactgttgcaaaaaatgttcttgagttattttttcttagattgacactccttagaagtcaagggcttatcttcattgaattacagcatacaacataaagtaatttcttcagagcctaaaccaagttcaggtctgttttctttccactgatcaactctgagagaagatcttgagcttaaagttaaggaaatgtttttagcagggaaagaatagcagttagtccaagttaggagttctgaccaccatctaaagtacccatttgctgtatgttgactgaagggaattcttaggtttacagatcagatgagtaactagcagcattaccattctcattggaaaattcaaaaatctgatgtcacttagacagacgagcctccacttgcagacatactgtagagaaggaactttggggatagatcatgcatttttttttttaaagagccaataattctttccccaaatatacagtggacagcatacttgtaaaccatacagtataggagaagtgatattagcctgggcaaattacttttcaagtaggtgtgatcaatggcttcctttcccataaaccttgtgtatcctttggaacttttattattttaaataatataataatattttataataataaatagaataatattattaatacctctccaagagttggactttaggagttggaaggattgcatattttttaattatagcaaatatttctcaccagcaataatattagttttagcatattaatgttaaacttgttaaaaacacagctcctcctggacacacctgctgaggtcagatcccatgatcttctccctagacggtaagctccaagtgggcaaggaccaggtctattttgtttacttctctatgttccatgcctcgcacagtgcccttgattcccataatgcacaaaatttaaagaggcatgagtatgggacctgtgtaacttaatgggttaacagttccatgtactaaaaaagagagaaacgtcactttatgtaattcagtgactatttttttaagtgcttactctataacaaggcagtgctgtattaagtgtcaagggaaaagaacccttagctttggagagaagataaacatatacagagatagtttcaatgttatgggttaagtccttgatagtcctggggtttcagaaatataaacattttgtcaattaaaggtatgaagatgccatatgcttgtattacttccttatgaaaatgaaacttcatataattattaattaaagtctatatttcacttaaaattctaggtgaagaaatctggataaaaaatttattgggaaggatttcatgttttgaactgttgtccagtgaggttatatggcagtaattttctccagtagggaattcctaaagttatcccattttgaagaaggtatgtattacatttttcatccacatgaagaagattacacttgagaacttagcgaaaagcatttgttgaagcccattactcagggcaagagctacctaatttttgtgatttatctgctatgacgcttttcaacttaagggtttatattttcctttttttgtgtaaaaagaaatacttggaacctatggtaatttttttggcatccttgttgattcagcccttttgtggttagttttttcttcctttattttttctatatctgtccacctgtacatttatccaaatatatatatatattgagcaacagttttattctcaatgttagtaatataaagatgaacaaggcaaaaaccacagcatacaatcggctcactgtgaggaagtcattgagtaatttgtagatcggagtgcggtgttgacaggcattgtaatgtacaggatgattgaggaccagagcccagagatggtactgagttctacctagagtagggtagggagtctgaggtagggatagagaggctcagggaggcttcccaagggaggcagtgcctgaatgggacatttcttatttggttgtataatatatcagcaatacctttatctaaaaataaattcctgggtggtgaataataggtttcttacctttcttttagccttctgatttttaaaataaacttaattgcagtataatttatatataataaattgcatccacttagtacagtatgtttgatgaattttgacagctgtgtacacccgtgaagctatcacagtcatcaagacacagaacatttccttctccctgagaagtttccttgtgtcccttttgcaatccattcctccctccacctctggcaaaggcagtcactgatctgctttttttttttttttttttttttggagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctgatctgcttttttcaagctatggatcagcttgaattttatagacttttatatgtattcatttgtgtccatcttctttcactcagctattttgagatctattttgttgcattccctttgattaaagaggaatatggatataccacattttgtttacttacctgatgatggacatttggggattttttttcagtttttactgttatgaataatgctgctatgaacattcatgtatagtctttaagtggtctatattttgatttctctttgaaaaatttctagttgtacaatggctgggttaggtggtaggtgtgtgtttaactttttaaggagttttgcaaagtggattttccattttacagtcccaccagcagtgtatgagaattctagttcctctacattcttgttaatacttggtatcgtcaatctttttaattttagccatttaaataggtgtgtagtggtatcttattatagttttaactttcatttctctgattagtgacattgaacctttctcatgtgtttcttagccatgtatgtcttctgttcagatcttgtttcagtattttactggattgtcttatttctgagttacataaattctttatataatctgaatgtaagtcctttgccagatacatatggataataaatatttttctcactctgtggcttgcattttggtttcttaatggtatcttttaaagaacaaaagttttaaatcttgataaaaaatttaaagtatctttttatgatttgtattttcttgtatactatttaagaaatctttacctatctctaggttgcgaagattttcttcgtttttttcctatgttttcttctgagggtttttttttttaaatcattttagcctttacatttaggtctatggatattttaagtactttttgtgcagtggtgtaaggcaaaggtcagtgtttttttgtttccttccagatacacacttgtgccaaccccatttgttagaagatctgaacatttgtaataagttttattgtcataataaaagaaacactttttcgtgggcttggggggatgcaaaaaataaactcagaggtagtctcctacctaagcaatacatgtattaacattttgttctttcttccaagcactttctccaagtttacatgtgtgtttttaattataccatagactcggctttgtatcctagtctatctaactataggtaacatttctccaaatgtttcagattttcaactaaaccacacctatttcactctgtgtgtttgtttgtctgaatcactgacaaaacacatttacatagtttaagttttagttcaattctctgccttttcttttaagtcttttgctcaaatgatggtgagtcattacagcacagcttctgtttcaaatattagtggatcttattaaaggaactctttccccctcattatgaaggtaatatatgttcatcagaggaaatttgaaaatgcagaaagttataaagaagaaaatgattacccatcggaccatcactcaggaatgagcataattaacattttggcatatttccttccatttcttttactttgcatatattttttattgttcccattatactatatgtgcagttttgtgccatgctgtttacacttaagattgcatcttatggttatttttcttaggatgattgtatcttgtggtaatttttacacttaggattgcatcttgtggttattttactgtagtttatttaagtgtcttcctatcactggagacttaatttggttccagattttcgccaccataaacaatgacctaaaaactggtcttatacagataactgtcagatttctaattatttcacatcatagatcattgatgttgaattattaggtcaatgggtaggtataaccctcttaaaaatttggaaacattgccaaacaactctctcaaaagctagtatcaatgtatactcttgatggcagtgaagaaagctctaatagactgaattattgctatcatttggtttcctcttatcattttgtaatctttgctaatttaaattggtagattagaaagtagtgattgaattttgtattttgcatctttgcagagccaaatctcaaaatacccaggtggacaaagtgagggagggcacagaaagaccttttggtagttacagggtttccacgcccaataaaataactcactcttatataaaaagacattgatttttctatttttactctaaaagaattcacaccatgtcccaaaatgttcattagtcgtaacaaagcaagcctaaggctttcccttgaaatgaaaatgtttattataatagcaaagaaagaaattaggttattctgaacgtatttgttcttagtgattacctgctgaagtccagtggtgattattttctttttcgagtaactctcaaattatccctttataatgaaatgctgaggagcagcctcttcctacaagtctctctgtctcttctcctttctcaacctctctctggaaagacttggagcatgcgcctaccctcacccttgctctatcattaagctctaggaatcctgttgctacgtttccttactggcttttagaaagcagaagcaggtatctgagtgaagcccttgacttctgagcatgcaatgggtgctgctcctctgaacctcatccagccagagatatctagacaagtctgaagctctgtgttgccttcgacctttaaaatctctactcctgaacctattgtctaattatatggataaacatttttaatcttacccaaaaacagtaagctcatttctagagagagcttacaagagcggttgaactgctatccttttctcatccctagagccagaatgaagataaattaggtttatgtgatgccaggcagcagtcagtaatgtggcacctgttttcctccaaaggcacatcatgacatgtttctgactctgatggagtccttgtagtatatcctcccaaaggttaaaaatgaatagagtgattgggggtcaggagcccactgccttagccttcttcaccagctttctcatctttcaaccatggccagcaagttttttttttttccctgtatggactcacagtactgtggttttggtattggcgcccacgctgatttgggctaatcccagagaaaaatatattgagttatgcatttttctttggtaaatctggccatgtctgacttaatgtaagaaatctgcaaagtaacattgaaattcctcagtcattcctctcccctccatctttgacagactcacgtattcgctgtgttatacatttatttacccgttaattttaggaaatgtgaaggctgggaagtcttggttctcttactgcttgctttatagtataagtgtctcctttgtgcttacaatgtgttatgttcgaggagagggtgctgaagaaggagagtggcagggtgtgatggcgtagggattttgtaggtaaagaaagaggcattcatgatttcaacagctaagatgagaattatcttaaggacagcacattagacacctttttgctcaccttatcctgctcacccacaaagtttccttccagctctgaatgccatgattgatcataaccttactgagcacagtcagtatggtactttgtttctatgtggtttctcttttggagtcctaacacattgccttgtgctaagtatttgccctgtatgtatctgagccgaacggtttttcttctttcatttttaactcacccatcagtgtaacatgtcttacttcctagatggacttgatcacgtctacctaattaaatgtcctgttagacattctgccgaagtttaaaaaggtacagtttgtatatatttttacttatgttatttttgttagagaaagggaaggaaaaactaaaataagataaaattctttgatttgcttttaataactaccctttgggatattttagaattgaagtagtagctatatatttgtttttaattattattctaaaattgaaaggaacttgtaagcaagcatgttggtgatgacgtgtcaggtgctgaagtgaaattgaatcatcttttatgtcccaagcaaagcaagagcaccatcacaaacatccttatttccatcttttaaaacccctcaaaggcagaaatcttttttcattcataaccagtcaaaagcatgaacaacccttctggatacaggaggttcccaggccaacctcaaatcattaacgaccaactttgatattggttccaagtctttcaaatacatggcggtttggcagtcagatacaagctctatttttgtaaaaagccttttcacttctctgttcaggtcatttttaaatgttttattaatgaccacatcaacaggctgaaggaggtcactattgctgagatgcagataaaaatgagtattatggtttttttctcccagttggctcagtgggaaatcctattagtgctctaagaagttatataattagcatggcacccgctgctcgtttgttgagccaaactggtttttaatgttcagaatacaaaacatggcagggccatcttcataatgctctgtgctgtcactggttgccaggagcgtttctgcgtgaccgatccataataacagcaatgatgagagccacaattaaatagcaccctgtgtttggagcactggtccttcaggtatcccttagtccagtgagttcctgaatgctggagagtgtgtaacatcagtgccatgtgtgctctgtcttctggtgcagaggaagagagttaccagcaatggtggccagccactggcaaaatgggtgcttttcttccatcccttttttcgtcagagacttcctctgatttgacaggatcacacactttaagcatgtttcagtcttctatatcttctaacttcacatgaacttggctctttgatttcaccaaacaaagccattactttaaatttatttataagggcaacaattattagctggattatcagaaaacttctcagattctcatgggcttgtttcactccctgacaattatcaaggtaagtcaatcccagtctctttgtttcaaaccccaagccagagtgtcagtctccacctccacatggtcagggcctgtttactcaagcaatgctgggccgcttgaggacatgcaggggcctgcctcccccaaatcttgttatgtatgttgggttcattgttagcagctgctgtaggactcagtggaggatttgatacctacactcttgtttaggataggtgaagggatgagacagaaaagatctcagggcagggactaagattggacttgtaaaacacaacacctaaagattatacatattgctgttgatgttttttcactaatactgagtgcttgcagaaggcactgtccatgccttctcctcatagttatgccatgaagtagttcgtgtcactaccttattttatagatgaagagagaaagacttggaaagttaagtaaattgccccaaggtctcatagctcgtcagtgttacaatccgtatttaaactccagaatgttatctccagaaaccaaggtaggacaggctgagtcggcctaagcaaccaagtactttgtgctctcctttgactcctcttgatgaaaggataggaaaggagtcagaaaagaggctgttacaaggagttatgctcccctgccttctctgttcaaataaaataagtgtattgtacacttcagaacagcctgaaactcagtgcacaggtggctcaggaacagcgttttagagccataaatgtaaagcttttgtagccatccagagctctgctacatataccaaggccagagtaggccacagcttctatatattgagtcttgtctgagctgaacccaccatcccaaatgttgactgttggctcactgctcaggaggaatagtttcgtagccggaagtctcttcaatggaacagagccctttacctttcttagattttgtcctaatgcgatatttcctctattgagcatagctctgacctgcaaagcacctcaaatgctctcagcccagaaactcttttttttttttctttttgctggtgttacttgagtgtttattaagggttaaggttgctgacttccgtacctagaaatgttgtcaagtatacttacatttaatatactgccatgcatcaggtaaggacgactattgtatcccttgattcagttcaacttcatgaatatttattgggaatgtacttatgttggcagacctgtgccaggttctttaggggagagagactacccaacatcttagctcctctgacccatctcttgaattctgtgtatttgccaaaaaggcttataactgttaacctttaccatccttttatttttcaaatgaacattcagcaactcgacttcttcttaaaccaagtaattttcttaaattaaagttgacagagaatcaatggttattttattttgcctcagacatagaggaaagctctcctatatgttacccatcggggaaagggccctcttatcttttccttcagagcttctttcctctctccagtcgcaggggcactgttttttaggtttttgttttgctttgtttttttgtacctcctttctgaaaagcacgtctgtcactttactgtgaagaggcaaatagcaggttgtttgcaggatgcactgtatatacacttctgaagagtgagaacttgtctttgtccagcctgacatcctttattaaatttttactcaagaggtcaggaaagataagctagtcttaaaaacttgtcagaagtcaacggtttaggtaaaggacagtcattgaagaaaccattatgaaggaaattgttgggtgtatctttttcattagttattcttaggtatggaaaacacattacccccacagtcttgttaagtccttaacttggtggtacagttacacccctgggtgttgcttattcaacattctcaaagaacaagtttttcaaatcatccaaatgtgagttatggctctaatcatacagattccatgactcatacacaaaaatcagctttattatttgataatcacacggcatgtgtttaaacactgaggaaaatgttttgagcgtttgaaatacgattacatattataccagtctgcttttaagtcttgtccttggatatatccttcatggtggagttgacattgcaccattgaagactatatttcatgaataagcacaagggtttttctacttttggcaaacttcaggtgcttggaaatttccaattagggtggctggtatctatgccaagtgattgatttcattttatttactttatttggaaccgttgaagggatgatgtcttcccaaaccattgtaataatgagtggtataagttagtgttccagaggccgagaacaaatttagtttttaccaaagggacaaatgttgacttttaaatatttgtcagaatcagatagtatattagtttgctagggctgccttaacaaagaaccacaaactgggtcgcttaaacaataggagtttattttctcattgttctggcgcctagaagtctacgatgaagctgcccaaaggtttagcttctcctgaagtctctctctatggcttgtagaagaccttcttgctgttcttatgtgatctttcctctgtgcgggcacatgtctgtgtcctaatctcttcttataacgacacctgtcctgttggattagggcccaccctaatgatctcacttaactttaattacctctttgaagaccctgtccccaaatacggtcacattctgaggtactggctgttaggctttcaacatgaatctgaactgtgtgttcagcccataagaaatgagaagggaaaaggcttcatgtggtggccacttctcagggccactctgtgttaataagagttgtgtgggcagaacagcagtggggcttaagaaggggcatccctgggaagcagataaggctgagcttcagatttcccttctcttacttgagggaatcttcagatttaaaaagaaaatagattttgtaaaaaactgacctggaaacagtgtcaggtatttgtcgtctctttaaatactgtcatgcaaatcataccccttctggtacccttgcccttctgggagatgtcaccctaaaaggggctttccaagctctgctctcagctttcaggcacccactccgctcttctccagggcaggccagaggagtttcagtcctgtgagtgttagtcattggagaaccatgtaaccccaacctccaaaaacaagcagatgcattttttctttctttttgccttgagagaatctttggatttttggtttgtttagacattctgcatgaaaagtcctgtcctcatccggtctcctggcaagtgtgccctgatgtattctcgtgcatggatgtttccttctgatatacattaacaacctagcaaatgcctaggaacaatgttactttctgtgcaactatgtattttataaataatcatttgctgaagtaatttcagaaaagttgaacttgaggatttatagtggctctgcccaagggtcattcatcctagactgtaaatgcagttacttacaggccttttacctgaagtggatcaaaaggggaaatacttgctccatctcattcatcatcaaatttaattatcttgcagtaccacctgtggaaaagtcagggggattctgcttacatttctaccctggaggacactggcgttaacacttcttattaattagttcttcacagttttttcctttgatgagtgatcattttccttttaaatttgctaatctttaatataatttcccctggattcgattacacatatacattaatagtaaaattacaggaataggaaaattaaagtatgtttctatttctgtgatttcttggctaaagtttaaagaatgtattgtctgctcactttatattttttgtgatttatgctggttctctatggctaactcacttgattaatcacacacatctttaaaacttttaagcaaaaaaaattacttcttccctattctgaagcaacaaaattgggagattattattattattttgagacagagtctcgctctgtcacacaggctagagtgcagtggctggatttcggctcactgaaagctccgcctcccagattcatgccattctcctgcctcagccttccgagtagctggactaccggcgcccgccaccacacctggctaattttttgtattttttagtagagacggggtttcaccgtgttagccaggatggtctctatctcctgacctcgtgatccgcccacctcggcctcccaaagtgcttggattacaggcatgagccaccgcacccggcccaaaattgggagatttagctgagtacatgtccaaggtgttggccagacacagaacttcctttggaagttgccacatccagcaacccactctcttaggtgttagccaccagctttccaagagaggacataagccagtctcctgcatgttcatggcagaatgttacttctgcttcctacagatggtttagctaaggggaaagatctatgtctaatcagtacatagactttcagaccccttcaaatacccgtcggagaaagcagtcatgaaatcgccctttgtagcacttgacaagacacttttggggcctcaggaagaagtgtgtataggcgatccatttctccaggttctttgagctccctctgttgaggtaaatcatcagtaaacaatgtgcttctgatgtattatttcagctcccagcagaaatgccatcactcaggcaagatttaatattgtgtcttcagcacctgggagaaaaaaactttcatcgtttgcaccatatggttgaagacatttatatgaaaaaggcttctgtcttttgtaacataagttgaagacattactcagtgtcccttataaagggtcttccataataaaattttccctgaaattaatgccaagataaacaaaatctgccttgcatgtttctcttttgatgaagttagaactatactatgcaacagtttcccttttctgccttagtttcaggcaagtaaagctaaatccggtgctcagttggagtaactgacatctcaagtatgtactaatgtctctttctgcattccttttaattaatgtctgttatttttaacaacaaaatgttcagttatatatttagtttaattttgaaactatttaacatccttcttgcaagaattaaaccaaataactagttggcaaaaaccataattgtccttaatagttagagtttgtaacagtttgtgccttaaagatataaacttctattgtcttaaaaatgcatttatctcagaatgtaccaatgtgtgcagctccacccacctcgccatatactgttcagtttgtataaatacacctactaagacatgatgtctgggtcccaaatggacacatattaggttcatgtcttatagatgcctttacattcctgttagaaagtacttagcgtgttggtttgggagcctcatgcatgggagagaggtatacatcacagagacaatgatgagtctgtgagttctctgcagtaaaacccaccacaccctaaacttaaaggcacaaataatgttaatgaaggctggtcctgtatcagttgattgaaaagaacagtgatctacagagatccttacatagtgagcatgattaacattttttcctgctacaaaaaagtgtgaactttgaccagactatcatgtttctgctcctacctgccattaacatgagtctggtatttatatgattactccttttcccctttgccccataagtgaaaataagttcaataaatatattcactagacatcctaaatgctgaaaaggactgcttgctacatgtgacattatagttccataatcttgacaggaagcagcacccttacacaatgacctgttctctcctgatttactatagctgggatgtaacacaagtgactttgtgctgtgtaggtgaaacattcttaaaattttatgtattcagctctgaagtaaatatgacaaaatattaccatttttaaaattctggatggtaggcacatgtgtattcattgtattactctttgcacattcctgtatgttgaaatgttttttataatttttgaaactattatgtaatagagaaaaaaaaagagtccaccatggttgtttaggttgaagagtgggtaaggttagggagaggaaacagccatgcccttcacctggcaggcatggagattttccagaggtttctgtcagagaaaatcaccttaacttagtttggattacttctagatgaaaactctttttcgtagctagggaagaagtctgttatttatatttctgcatgcgatttattcatgtgtcagccctggactgagtattagagatctctccatgaaaggctgacatgtgtgcactgctagtgtcggtgtcagctgtgtgaaatcctatgcagccagactgtttgctccctgcaggccgcaaacctaaaagggtccttcaggctgtcaggtagccagcgggaactgtcaagagtctcaagcctgaggttccagttgcagaagaacctgcagttaaccagtgtgtgaggccaaattctttaaaatatgttgagatatcttatttgaagaaaaccttgtgcgtatttgtgtatgtgtgtgctcatgcacacacgtgtgcatgtacgtgtgtgtacatacatgtgtatgtgtacatgcatgtatgtatatcacttagtctctgcttttgttgttgttaaagggaacagtgtgactttctgatctatctgacattggtttggggctgtgtgatgctgcatggcttgatgcagactagaattccagatgctactaactacattttctaggccaggggcatatttctgcacgtgtggaggtgcacgctgaaaggaattttcactttttagaagactcactgatccaaaagacacttttgcagtaagttaaatgtaagggcaagggtttggaggggaggggaaagtatgtggttcagctactattctcacagccttggagcatatggcccatggtggctggagatacacacatccaggagagcttcgatttcgggcaaggctgtgggccacagtgctgataggttcagcagtggttctcaacctttagagccacagatagagggcacaaactgtttcctttcccctaccttacccaccctccaacctcaacaaactcagtggttcttttttcctctagtatataatactttcaaaaattataaaaaacatttcaacatataggaatgtgcaaagtaataaatgcacatgtatctaccatctagaattttgtgtgtgtgtgtgtagagaccagatctcacggtgtgtcccaggctggtctcaaactcctgggttcaagtgatcttccctcctcagcttctcaaagtgctgagattacagacgtgagccactgggcctgacatagaatgtgttaaatggtaacattgtgtcatattgactacagagctgattatataaattttaatttctgccatcatatcaatcatggaagacactttcccgtctatagtgcctctcactgcatgcagcaattcttaactgagtgcaggggtataactgggggaaaagtcttccttttagagattgcacctcccctcaccctgcctgcagtttgagagccatcagtctagaataaagagcagtggtctagaggtcctgagtcccaggttctgttgtcatttcttccgttaatggctcctggcacaaacctgacacatagtaggtgatcaataatgatttatggagaatggcatgaattaaccagctgtgttatcttagacaagccacttaatctccttggcttcagtttcttcacctaaagaatcagagaaatggattaggtgacctctaaggcctctttcagttgtaaaattatatgattctgtgattggacctttacctcggaggaagattaatttgacaggagtgtgaaggatggatcagagtgagagccaagagaggggaatacacctttctctgaattagttcaagatttccttcgctactagtattttttaagcacttacttacattgtttttccctgtagtttacataaactgaccatcattttctgcaaagatcggaaacttgttaatgactggaactatgactttttctccctatttctatgtgcctcaaaatatgaggcctaataatggcttatagcagtagcacagagttcatacagtgttttcacacagcttgttaaatctgcgagggaagcattatttcccctttttactgcagaggaaaccgaatgttggagaggtgaagtggcttactgaatgtcattgctggtaagtggattaactccaaattgggctcagctgaccagtcttcaattcccgaaggagtctccagttctgacgtgaagacactgccataggaaggccccgggatgagcagggatactgcttcagagcagccgtcagcttggccacaggaagctgcccctttcacttcgtggctcttttatttctggccttcatttgtaggttccttctgtgtatcctcatattgcctaatcttttcatgtctcattaagtacaacaattttccctgagggctgcacattcgtctgccaaggactattccctgaatagcagctccctcaaccttttacagccctttttcctgctgttgtatgtctttagccttagcaaaagccatgtatacgtgtgtatatgtgagtgcatgtgaaatactctttacttattcagtcatttcttctcatctgtggtagacgatggtggcctgaccttggtcagtagcagtgaagtttgagagaaacggatgatacgagaactcttacagaggtataacctacaggtcttgatagtgggccatcactatcatttactgccataaggagctaaggaagggaaatgtatctgagaggaaaagtgatacattccgttttggagatgctgtgccttttggtgtctttttggacattgcattgagagataccatataggtagttgataatgaattttcagctctggggcagtacctgagattgagttatggatttggaattaatcatcaagggagagaatgagaaggggaaatggtgagggatggaacattaacactgaagagacagccatacagaggtagaggagtgtttggggcacacagagaaagggcagctgggggactggaggagaccagaaggaggtggtattacagaagccagggagaggcactttataaaagccagacttgtaaactctgcattcattcatctgttcaacaaatactatctgtgtacccagtaggcgggtaagggatgtgcactggtgaagataatgggtaacattttttaaagttccagctttagttcagctctgttgttcagactgtgattttggatctattctttatcctttctaagcctcagtttccttgtctctaaaataatagaggataagagcagttcctgctttaagagttgctttgagtttggactgagataacatatgtaaaacatcaagcatgtcccagcagataggaaatgctgttgtcttagtccattcgtgctgatacaacaaaataccatagactgggtaattcgtaatgaccagcaatgtattggctcttggttctggaggctgggaagtctaaggttgggggctgcaccatcttaatgtcttcttgctgtgtcatgccatggcagaagtgcaaagagagggtgagagagagcaaaagattaaactcacagcctcaagcgcttttagaattggcattaatccatttgtgagggtggcgccctcatgacctaaacacctctcattaggccctacctcccaacacagtcacatcagggatgaagtttccagcacatcctttttgggggagacattcaaaccatagcagctgtgaattattatttccccctctcacagttgaggaaacaggttacagaaggccaaataagtagtttgtggttttgaactcagatccccatctgcatgggtcacattatctcctcatcctgccccaggcggcctcctcgtgtgaagcagaagtatctgcccagctcactgggagccacagtccatccatttcttctcctaagactgtggggatggactttggtttggtgcccagagtaggacaagaggcaagctgaactaaaaatgatgtcctgaccaattcctagcttagcctttttaaaaggcccccttcctactcctgatagcggggagatagtccaggaattgagtgtgtgggtatccctttgaaattccctggacactaacagctgcaccttcacctggaatttcgggtaaaagtaaggaagaagagggctgttgatgagaaatcttctgctgcttaggagcgagcagctgctcctgggtccctgggaaacactatccctggcactcttacagagacccttggtggtgttgccaacctcaaagctcggggaaatagttgcctttcatcttcatttgagagcatccctgcggtggagggtatacaatgccagtgacacttactgtttctgatgctctttgacaatgagtggtctttggatttctaccgctttaatcacatctgggtcttagagtgtgagtgccctcatactgctgctggcatgggctaagagacggtaatgtgaggctgaaggatgcaaatagttctgagctggcattttggctttggagccctccaggagcaataactctgtcagattgtcctgacacggtacattaagaggtgcagataaaagctacatcctgtaaaatatatacttcaatcgcacctgccttctgcacctccaccactgggaagggatgggtgtccgttcgtgttctgcattaccagcctcttagccagctgcctcgtttgattgttcgttgtgtcacttgaagatgaactgaaagaacaagaagaaaaacttaatgcacgccaatctgtatctctgaacttctcacgttaaatagacatagcaaaaaaaaaaaaaaaagtttgtcagcactgaacatcaattactaaacatttttttaaagtcaggctgggcatggtggctcacacctgtaatcccagcactttggaatcctgaggtagggggaatcacttgagtccagagttcaacaccagcctcagcaacatagcaagacccttgtctctacaaaaaattaaaaaattagccaggtatgggggcacatgcccatagtttaagctgctcaggaggctgaggaaggaggattgcttgagcccgagagttcgaggctgcagtgagcaacaagtgtgccactgtactacctgggcaaccaagtgagaccttgtctctaaaagaatccaaaaaatgaaaaaaacgaatttcagttttataagtttatgaattgtattttcttttcgttaggtttctgtggctttatttttctttcccatgattaatttctcccatgccttcagtctgtgggtctgtgtatcatttatttgactctttttagtagatccttaaaaagaactttgaagtttaccatttcagaaaacttcatccccagaaatcggtttattactatcagcagaagttatattttatatttgccctcactaatgaatggtaatagactgaatctggcccacacattagtgtgaacattttaaaattagtatcaacaattaaaactatggaatgtcatataaaatttcaaatttcttttttctctgacaaatctgaatattgagcaacattgagtccaatcctgtctggccataacctgcaggcactgaatagtggttgtcccctttagatggggaagaagctttccagctggcacagtccccacatctccctggttattaatacattctgatttattcaaagttcctgcaatagtgcttacaaatggtgggtaagagcataaatgggtgcaacttaaatgaaggggaatttcataatgtgtgtcaaattacaaatgcatatatcctttgaccaaagaattcacctctagacatttatttttatacttgtatttatgcaaaatgacctaagaataaggttacttattgaagcactgtttacaatagtgaaagattggaaacagtctgttcatagaatgggaactggtgaaaaaaggctgtagcatcccagagaaaactatgtagttataaagaaaagaatgagaaaactctctacaaactaacatggagaaattccaagatggtattatgttaaaagagaggcaagatacagaacagtggatatactatgctatcatctgtattcaatatatatgtatatttgctggtacatgcataaaacatctcaagaagtatgcaccaaattcataaaacactgattgcccctggaagggcaaccaggtagttgggtgacaggagtgagagggccaattttcacagaatatttaatgccctattgtaccttttaatttttaagccatatgattgtatcacctacttaaaaaaaaaataaatgtcctttctgagttctgtatgtatttgcattttcagtgcaatgagctataagaggctgtaccttaccaaatttaagagtttttattttaagattaaaaggatttttaataaaaattatcaaaggcagccgagtgttgaaactgttactctcaagtttttatcatttcctctataaagttgctcagacttagtttctggccttaaatcatacctattttcagcttccctgaaatcaagagtgtcctgtgccatatcaattaaagtaaatgtactttcaattaaaggtgttaagtatgagtctgaaaagattaattctttataaaaagatgaccttcagtagttcgctccaattaggcatttttccaactatatttcatcttgatgggacaagtctactactcacaatcaatcactgtgatcttttcaaaggcgagtattttaggttcagagtcataaaaagaatgacttgactacgcagcctccataacttgaaccacaggtgatataggcagagattatgggtgttggatattactttttgtgttattaatatttgaagcatcaggatatgcatagtgatattctgggtacagttcttacacctctcttctcatgaccttactagaataaatatatttaaataagactgatggaaaggaagagaggaaatgaacaatgacacaaattaatgtccaaccaaattcctcatttttttcctgtcattttattattaaacacattataaatacttgctttcctcatggttgttttgttattggactactttagtttgaagtgaatcattgctcatatacagcacataaaaccaagactattaaggaaatgaatgcttggtgattgttttatgagaacatgcaaaatcttggggaataacattgctttctcttaaaagttaaaggaattgagcatttctgtttgtatttggtaccttcagtatggaattattggccttcactctgccattcattaaatttgtaaacttggagaagccattgaacacagtcatggaaaaaatggaaaacaaataatacctctttgcatatctcaaaggttaattattggaattaaatgagattatatatgatatataataaatgattatatatgatacataatctcatttaattatatataatatatacatatatgtgtatattatgtgtacatgcatatgtatgtatgtgtatacatttatatattagtgttacttaaaatgtagtccagtgaccctgggagtctttgagaccctttcagggagcccatgaggtcaaaactatttttataatagtagcaagaaattacttgcctttttcactctttcacacatattcagtggaatttttaaattcctgtgtctgtaacattcaacattgcaacagcttgcagaaacaattgtaagattcgagctgtcctaagcctgatattacagaggtttacaaaactgtgaagcaatggactctttttcactgaattgttttcattttgaaaaggaaagtaatttttcatataaaatttatattgacatataatggggttgtcattttcaaattaataaatttttttaaattgtcaattttaatttctaatatagtaaactttgatagatatagtccacataaacaaaatctctttaggggtcctcactactttttaagaacataaaagtgtcctaagaccaaaaagtttgagaactgctaatatatatgaaagcactatgtaaatgtgcagtggtgacgttggtagtttattaagaaactttgccaggcgcagtggcttacacctgtaatcccaacactttgggaggctgaggcaggctgatcacttgaggtcaggagttcaagaccagcctggccaacatggtgaaaccctgtctctactaaaaatacaaaaaattagctgggcgtggtagcacactcctgtagtctcagctgctcgggaggctgaggcaggaaaattgctagaacccgggaggcagaggttgcagtgagccaagatcttgccactgcattccagcctgggagacaggcaacagagcaagactccatctcaaaaaaataaataaataaatataaagaaagtttaagctatttaaacagtgcagcacacaaaccatcctcccactgcaggcactgttgtgaatggtacactccacctccagggcagggttctttagtctggggtccaacatgatttctaaatcctctgtagttacctacaattttgtgcataagttatgtgcggtaatccctccatatcttcgcaagggtacgtttcaaaaccactgtgaataactgaagccaaagatagtactgaaccatctatgcagtatgtttttccctatatatacgtacttatgataaagcttaatttataaattaggcacagtgagaggttaacaacaagaactaataataaaatagaacaattacaacaatataatggcataaaggatatgtgaatgtggtctctctctctcagaatattttattatactgacatgggtaaccgaaaccatgaaatgtgaaatcacggataaagggggactgctgtatctactttcttttagggtgaggatccacaattttcacagttttcagatttccacaggtcctaaaagaagcacagttataggaactgcggcagtccctggtcccattttagccctgaggggagtagtgataaaagtcaaggttggggaaacctgaagggagatacaaagttcaaggtccaaggctctcatatctcggtgtgggcttggacatgtcttgaggtattggccctttacttctccctgttttgtttatggaaaggtgtgagacttgggctggctttctagacactgaggaaaagggcattctttcagcaagtgccatgccctgtgtatccttgtgggcctccttgctcttagtgtggttggatgtggtaggacataaagaaccaaaatcaggctgtggaccaaaaagggcccagagaccagcttcattgtggtttgggcacagttcacagagaccaggaggttttacacagagctttacagtgcgaatgctcagtttcccagctcctcaggaggatgttcagggatgggtattcaggccatctctgactctgtcttagacattttcagaggctcagctaatactagttcatgtttcctactgcaatttctttctttctttctttctttctttctttctttctttctttctttctttctttctttcttttctttcttttctttcttttctttcttttctttcttttcttaaaaatgagatgaactcttgctctgccacccaagctgtaatgcagtggtgtgattttggctaactgcaatacctgccgggttccagttctcctgcctcagcctcctgagtagctgggattacagggatgggccaccactcccgggtaattcttgtatttttagtagagatggggtttcaccatgttggctaggctggtctcgaactcctaacctcaagtgatccacctgcctcagcctctcaaagttctgggattacaggcgtgagccactgtgcctggcttctactgcgatttcttaagatgtttttattaaccttaattctagcatctgttgatacttataatattttagtgttcttacaagaagttgaaactattctaattatagctcactgccccttattatcatttcttaaaattaatttgaatggaaaacttgtgtctcagatatttatgtatttaatatctccccagtgccatttaatttttaaattgcatatacatgtatatttttcagttttgtgtaagcctttacatttacttaaagttttatatattcatggggcaaaatgttgcaaaattgcccactgaatatataaaacttttaaatttagataaaattttaaactaccaaatgcatacctttctcttggtgttgtgctacatgatttaatgtgtagtgcttcttgaattctgtcactgagaccgtcttccctgtttgtttcacttttaaaaatgatttaataaaatagtatttttcaagaaaaaaaatggataccatttattttagactaaaggcttctgaaatttttaataaaattatattggccaggtgtggtggctcatgcctgtaatcccagcactttgggaggccgaggctggggggatcacctgaggtcgggagtttgggaccagcctcaccaacatggagaaaccccatctctactaaaaatacaaaaaattagccggacatggtggcacatgcctgtaattccagctactcaggaggctgagacaggagaatagcttgaacctgggttgcagtgagatcacaccatcgcactccagcctggacaacaagagcgaaactctgtctcaaaaaaaaaaaaaaaaaaaaaaaattaaggtttcctgtttagtgcagattttataaaatgaacattttgtttttggaattttgtgatataagcatgtttatataaggtaaattcaatcaaattaaagaaatctcttcattattactgttataactatcttttccagttaacaaaatacttggaggtaacctcaaactgtaaaatgttatccacatgttagtagcatcttgtgaaaatctgaatacatgtagttcgactaaactctgcttccctagactttaatgtattatatgttatgtatttcagaaactccagaaaggaacttaatgacatacgatttgagtttactccaggaagaggtaagttttaattgaagttattattttattgcctcaaagagcattgcagaaattgattacaagcatgtggttataatctgctatttaaaactgctttgtttaatagtgaaggaaggaaggagagatagacagaaggaaggacttttgatacttctaaggattccaaaccaaaccacagctgactacatgaatctcagtgacacatgcggcacagtatacataccaatataagttagatatattagctcaaccatgaaaataagtattgctatggtaatgcaggccctaaaggaaatgatggtgaatgtgatgagaagcataccacagtcctaatgagggttgagcagcagtgggatcatacagaaaggtaacatactttgcttctgtgatctcagctcagattacgtgaagtctctattggggagtgtttactaaaattttgaaaactctgaagtacaagaactttctagcttgatagctggtccatcagtaaaccctttgaccccctctgcggttattacctgcaggaagacacaaactcagatgtccacagaagccaaagtgaatggtgagcacttcaggaaactggaggatttcctatcttatttcacccatgttcagtagtgttgttttttttttttttttttttttttttgaacaaaggccaccagccaaacaaaatattcctgggcaatacttggccataggcttattggtccctgaatgctagtcttctgtaaatgcaaagatttcaggattcctggtatatttgaattaaactaaaatatgaagtatcttttaaaaataaatgtacaggccaggcacagtggctcacacctgtaatcccagcactttgagaggctgaggtgggtggatcacttgaggctaggagtgtgagatcagcctggccaacatggtgaaaccccatatctactaaaaatacaaaaactagccgggtgtggtggtgcacagctgtagtcccagctacttgggaggctgaggcaagagaatcacttgaacctgggaggcagagagtgcattgagtcaagattgtgccactgcgatccagcctgggtgacagagcgagactttgtctgaataaataaatggacataaagccctgatggatttgctaattgatctttctttctggaggtatccatctttgacaatttagagttggtttatgaagttgtacagcaccagctagtgttgtcaaaaagctatctattttgtcataatataaaaatattgaccaggccatgctgtgataaaatctagtaattatgtaataaatgcttcaattacagcaagtagaaagaacagattcttattttaagattgtttcttttcatctgattgtttaaaattgactatggcaatgaaaatcaattttaattttaagaggtaacaaagaagtgaatatgagctcaggacttttgtgggtaacatggccctgtcagcattactggaccatgggcactggctttggcagccgcttttgccgcatttagattaacagtccctgcttctgttgcacagacagaacccatggcattgtctgcctaatgacagccggccttcactgggtggcagagcacaggcccattgttaaaggaagtgatgtgcatatatcactgcacctctgtgactattgatgctgtctgtattctagactttgcttacagtaaatctgtgtgcagttcacatgcattatgcttgtgctgtatatacatgtgaataaatatatatggcacaaaatgtataacgtaaaatattctctttcctcacttgaggacaagccctttgtgtttagtgtgccccatgtgctctggaaaccagaaattaatacatgaatatttatcctgtttaggcaccagggatgttaaacagcttaaagaaaaatagattactaatgaaacatgaaataagttatttcacacttctgttctaaactattactagtatcttacttacatgcatacaaaataattgcctaatggcacgcacgcagatatggaatatttcccatttggatcagccagcggtacctgtttgccattttggtatgactcatctggtgcccaggagtcctgaaaacagaaggacatgctgtatgctttaatcatttgggaatgtcaatcattttggtactgttttagtgctatccctcagtgcagctttgattatttcatttttggctacattctgtgattatagctccttacttaagtgtaagatcttactgatactttagaagtgatgggtaacacatccagatgcttcagcagatgaccaatcagtagaaagataatgaatgactacctgctatctgctcagtgcctactaggtgttaggctctttaattcagttcacttatttccctaaagatttgggtaacatccaggaagatgccagttatgagactgaatgttctagcagcttcagaaagctaaatcatgttcagagtagagcctcttattatgctaccccaacttccattattatgggatcattttatcatgaagagactttataaggtgttttttttttatttttttcttttcttttttaaaaaatagacagggtttcactctgtcaccctgactggagttcactgcagcctcgacctcccaggctcaagtgatccttccacccagcctcccaagtagctgggaccagaggtacatgccaccaggcccagctaattttttacgctttgtagagatggcgtctccctatgttgcccagactggtctgtaactcctgggctcaagcagtcatcttgccttggcctcctaaagtgctggaattacagatatgagccattgcactgggccaaggtgttttttgtactgctggcaaaaagggcaaagcctaagacaagctcatcttacatggaactttatagtttagtaagattcctatatatttatttgccatttacttcattttattccattttattatgacttcattatgaaatggaatcagtaaaatggcagaataccacagtttctctggaagtataaagtgtaaggtgtgtttcaaatgatctttggctgctgcatcatcatcatagttaccatttattgagtatttactatgtgtcagacactgggcaagctctttaaacctcaagaattgtgaaacagaaatgtacctccagctgcacactcacatgtatatgcacatatgcaaacacatacacacacacacacacacacacacacacacacacacacacaccagcccacttacatagtcaccacatctgaagcacagatgaaataaggaaatgcagtttatggttagggcagcttttggtgtcacaaaccgcaatttcgtttagatgctcatttgatttagcagctgtactttcaggtgccccctgactttggaagacatttctgtcaaacccccgtctagagtgttacagcctgctgagccagtttcttcttatcaagctacaattctaaatatttgtgagaatatctgaagtccctggggaccaagtcagctctcttgaaccgagtcagctcccttgtaaaaacgtgggggcttataacagttcttctgagcaacttgcaatttatcaatttccctttacaaagccttcagatagaagattagtgtgatcatgttcattcgtaacctttcaattaagtaattccagctgtattcacttgccgcagcctctttagtcccatccttatgagattgcgaactcctgtcacttatcattgagaaagtacggtattttattcaaccacatttttctaagacaatgtatctgttgctatcaaatgatcagtgtcatgttaaaggagtttcttaatagcatacatttaaattgctcatcttaatagtccaacaagctcataggctgtttgtacaaaatacaaggttatatcagatgctacccattcaacctttgctgtaattcactccatagctactaatgataaaaaaggattgatgatggtaggtgggattaaccttggcaggaaagaaaagcagtgtcatagggaacagttataacttctggaggtgcatttgaagattaattcagatagtagccagagggcacaagttttttagttcgccaaaaatagaaaaaataattttgcataacttctgttgaataaatagcaagatgcaaatggcacgtggcaaaatgtatttcatgttgcttctgattttctcctgatagagtctgaattgttgaattaaaactcatgggcgattttagtaaatgaaaaatatatattttacattgtactgggttgttgatttttatgttatggttactaatacatattcatttcacatttggacagatacagcagatggtgtatctcaggagctcttctctgctggcttggtggatggtcacgatgtagttataggtaaattgttttttagtatgcactgtcattttgttggtatataaaatggaaatgtgtttggaagcaaaagtgttcattaaggaataattcactctgaatatttgaagaattcttcttgaattcttatcttttatgtagaagtatatttaagaatcatatttggacgggcgccatgactcatgcctataatcccagcactttgggaggccaaggtgggtggaccacctgaggtcaggagttagaggccagcatggcctatttggtgaaaccctgcctctactaaaaatacaaaattaaccaggcatgggtggtgtacgcccgtaatctcaactactcgagaagctgaggcaggagaatcgcttgaacctgggaggctgaggttgcagtgagccgagatcacgccattgcacaacaaaagtgaaactacggctcaaaaaaaaaaaatcatatttaattttctttttttcaaaagctcttaatgtaatcctgtctcatatatctggacatgatttatccaatgaggagcctcatttattggaaatataacaaagaacttagaagacccaaaagtccatgatgtaacaaaaataagatgctatcaattctgtgcactaaagcatgggaacctctgagacccttactcagagtttctatattctctttttggacacagttctaataaacttagaattcgttttttcagccctcagcaatattcattataaaatctcaggtttggatgggaacttaaagatcattcaggccggttctttcactgtatagataaggaaatgaattccttaagaggttcagtggtgtgtctagaaccatgcagctgggttgtggcagaagaatttcactttgaaactgtgggtctttctacctcctttagaatcataagatagctgcacggagataggggagcctgctcaacataggcctgctgatgggagcaagcaaccacccatagacctcctgacaaagcaaaggaggcagaaaagctctaagaggcagacatagccatctgagaaaatgtgtagcctggttccacctagggtgaggatgaatagctccatgctcttcagcaaattctgactttatagagattttatgatgtattactgtataatcataataaccctaactaatcaagattagttagcatattcataattatgttaattattaattatattaactctaataatgtattacttaggggaatatatattatgataatgccttattaaaatattcaaatcaaaactgatttttgaaatgacatgctccccttaaatgatatggtttatgtttggttttggttttgttttttttgagacagggtctcactctgtcacccaggctggagtgcagtggtgtaatctcggcccactgcaacctccgcctcccgtgtccaagcaattctcgtgcctcagcctcccaaatagcttgggactacagacgcatgccaccgtgcctggctaatttttgtatttttagtagagacagggttttgccatgttggccaggctggtttcgaactcctgacctcaagtgatccgcctgccttggcctcccagagtgctgggattacaggcgtgagccaccactcccagccccttaaatgatatgttttaatttaaaaaataacttattcaaaataagtccttccccaataatgctagagtatatgactgagagggagtttaaggtagatacacacacctatcagaataatttgttcctagtaactttggaatgtaaatcattacaaagtgaattattttatgtaaataagagtaattgagtttatagtgggagattagaattctgactaaagacataatatccagtatgttatttacatacaaatgatatatcataaatgcagatacaaagatacctttataattagaaaaaaacagattttttcctactgattatacattaactctacacattgatttcacaatgaagctccaactcctttgccaagtggctccatacatgaggggacacagacatattttaaaggaaagtgacttaacgtgcatttatgtggagtgagttgtattcccttatatatcttgtctttcacattttcctttacaatcttgtgagatttaaggccagctaagttctcgcctaaattttctaatcaaatgtgagagggaagctgagaaaaaagattgattcaactttggggtctactttaaattctgtctaagaattcattatgttcacctaccaattaccaattccttgatgaagatgaacactctccttcattagaaaacataagtatacacttttgtgtcttagtttaccagaagaaatagaacagttaattaatggctagatcaggagaccctgcaaaccttgaagagagctatggtccatatgctaagcatccagaatagaaaattaatcagcaagtgaaaataataatcaaaaacttctttgaaacacctactaatgtctcctattgggcaagaagccaaggatcagattgttcttttattggagttgatcctggcaggtggctaggaacacagaaaataagagagcttgacggaaaggcattaggtcacatcttcttttaagcatagtccttgcttcagacctacagtcaagtttaatgcacttctttttttgccccaggctcagctaaagttaggaaggttttattgttgttgttgttgaatttttaaaaggaggaaattaaggcagacttcatgtacaacttattgagtgtattttaaatacaatatataaccataaagcttttctttttctatgctttagttaattattcttccaaaaactcttcagcttgccttttttccccttcttggagctaaattatttctatttagagagtgttggagtaagaacaggcatatctaactctttgatatagtagcacttaaaaatgccttacatggacatcacacttaagtgtctacagacaatgtttatgtatttcatttgatcatcacatcaattctataaggtaaagaggacaggttgttttaatcactatgttgtagactgaaaactgaggtccgaagaagtatctagactgttgcaactggtaatgttccttgcgcttgggtcttgttgactccccaatgttgacactttgcatataatttataccttcacccttaaaaagtggatccaggtaattttaaatgttggtggttcttgtgtcccctgggagaaaagtagcttttccttgtttgtttttccatggaccagtggatgttttctattttaattgctgattatttgacaaactaatgtatttgatcttgttccctctaaccaatcctagcaaatctctactccctccctcctcatctatttccctctttactagatatgtcccaccagcatatgaatatgtttttatttctcttatcttcagaaagccctgtctttaccccacctcccattacagctatttctgtccaaccccttaacagctaaacttatcaaagacaattgccctggctttgattcctttcttatcactgtctcttaaatccacctcagtcagacttttgaccttcctactccactcaaattgttcttttcaaagctgtacctggggaaaacacacctgcaaaaaggagtggcagatgcacaggtaggcgtggctggagtgaggggagaaagaaggaaggtaaaggacacgtggtctgtgaatggctgccatgttcctaaacctgaggctcatcctcagtccttatcatgcttgacctattggcagtattgggcgtagttgacaatgcccttctccatgataagctttttcacttggttttaagtctccaccctctcctagttctcccatcttactggtatttccttctcagtcttttttgttggttcctcctcatctctctaacctataaatcttgatgtgtccaaggaccctttccttagatctcttctctttctctacttgctgctttgctgatcttatcaggtttcgtggtattaaataccttccactctttaactcccaaatttatatctttgatccagacttttattttgaattccagacttatattcagctccccttttagcgtcttcacttggaaatgtaatagacatccaagatttaatccacagcttcaaaatccagcccctggtgtttcttcccagcctgcccctccaggaatcttagactcttcataggcatcatctccacctttccaggtgctcaggccaaaaccctgggcattgtccttgacttttctttctctcatacttcacatccaactcatctgaatgtgcccaggatcctgcctttgctcaccatctcacatcccatcacgtttcaagcccctctcaactcccagttgagttcttgtattcatccctttgctgccattccagcttctgtacttgcctcccttcagcctgtcctcatctcaacagccagagatccaggtaaagtaaatcagatgcaaaaggccacatatggtgtgattctttatatgaaatgtccagagtaggcaaatccatggagtcagaaagcagaagagtggttgccaggggctggcaatgaagggggcaggggagtgactactaagtatggggtttctttttggggtgatgaaaatgttctggaattagaagtagtaatggctgcacaaccttgtgactttactaaaaaccactgaatcgtgcattttaaaggggcaaactttataatatgtgacttttagttcgattttttaaaagtaagccagattgtgttcatagttcaatcaaaactctgcagtggttctccacccacaatcaccatggcttccagtcctctgcactgtgtcccctctcacttctcagatgtctcttctcctgctcttccccttgctcaccccaccccagccaccccggctgttgaacttgctcttcttccaggacactccttctttagggccatatatgcccaccccctggtgcttaaatattacctcacaaaatggtcttgagcagcctcattaaaatcgcacaccatccccaactctctaccctctttcttattttgttattctacctaatctctccccattcaatagcctgtatgtttcatttatttattttgtcagctatataggacttccccttgagcatcagttttttaaggccaggatttttaatctgttttgttaattgccacattcccagtgccccaaactgcatttcacatagtaggccctccataaacatttgttagagataaacaaatcccattttgatatatatagatatatcgtaacatttactttagaaacaaaggatactttgagatataggattctagtgttttaagaattttgctttcaagattgcaaaattcaaagtgtttgcaaatatgaaataagttcacctgaggaaagctgtgtaaagaaagagtccagtttatatagaggtttgaatgatttcttacatgtgtattttttctgcttctataatataaaatagctaacatttaaatagattaaaaatctgtttctttcccatcagcattttcttttgaattggagtaaatgcttacagcattgtgaaaggctgaaaaagcaatagcatatgttatggagcagtgaatgttatcagttttactagaatatggcaaacacaggttacaaaaagtcttcaatacctagcttcagggtagcctgcttttagtgtgccgaccttcgcgaatcagaatctggattgaagaagggccagtatagtgacatgaagtgattgctttcgagcagaagcagagcagtgcagaaatgaaatgtgctgtttgtagactgaaatcataaacccacttgacttgtgcttaaactcggcactaccttaggcaagaaacaggaaacatttttaggctttgtgtaaatagccgttgataagattggcaaggcctcgcgggtgggtgttggtttaaaaaagtttgcaagatgaaaaactagaggacatgcatgcataaatttgcttatcttgcctggctgggttggctgacaaatggaaagagaccaaatctgagtccctattctagttgtttcagaggattcccaaggatgagtgatagtgagacagcagagaaactccttgtttcctttgctttctggtgaaaaaacagccggcaagaaataagttttctctgcaatggaagcacgggggaaaaatgcaaaacacaaaattcatatgtacaaaagaaaacaaaaggtctaagttctctccagactttgtgatataaatttttgaggaattagtttagtaagttttagaacctcagctatagaagaaggaacaccagtgggtatgttaggctaagcagttatgtggcctgcttaccgactcctacaaagctgctgaacttcaatctgcacggctcaatacagaggccagggtttgactgtgtgtatacaccggaagagaagctgcttgacagatgcctttcagaaatgtgcccactgactgccctttgctgtgtttttataccacccttccctagctttgtagcaacatatgtctgtttcctttaagtggagtttagaaccagatgttggaatttctgtttcctgagaagggagctgggtgcctgcattcatttctgtagttttcctttgacggattttgagcctcactgactagttgtcactggaaggaaaacttactttagtgatagatgttcccaaagctctctcagtagacttttggactattgttcatgcccccatgagatgctcttttcctgcacatgaagaatcatgtttaaaacctgtctgcctgcaagacttaccatacatgtcaccatcatgaagcctcctctgctgcctgacaccccactccttgcacagtttggaggacagcttttccttgtctagaatgccagagaaccatgtttttaccacctcaagacgtatggctttcatcctgctgtactactgcgtgcttgtcttcctttgtgtggaggctgaaggcatctttagggcaacgcttgtcttctattttattgcatccctaccattgttgacacacataggcatttaataaataaatatgttggataaatgaatacattgtataccatatgcaaattcagtactggattattgcatgaattgatgatttggataatgtaaatattgctgtatcttccaaaaaagaaatagtaattcactatgattgatttttttttttttcctctctgcgttttcccacgttccttgcctttctctcagaaatagaattgtcacatgacttttgagtctggtctcttgggaaaggaatatggtttgtctcaacagccttctggccaggaatggtagctcacacctgtaatcctagcactctgtgaggctgaggcaagtagatcacttgatgtcaggagtttgagaccagccaggccaacatggagaaactttgtctctactgaaaatacaaaaattagctgcatctggtagggcacacctgtaatcccagctactcaggaggctgaggcaggagaattgcttgaacctgggaggcagaggttgcagtgagctgagatcgcgccgctgcactccagcctgggcgacagagcgagactctgtctcaaaaaaaaaaaaaaaaaaaaaaaaaagagggccttctgtcccctagtgcttgctaaggttaagtattctgagtgtctctcaaagtatgagctgtgagatgcctgtcttatctgggatgcttattaaaaatgcacgtttctgggttccagcccagaaatatagcatcagctgtcttttgggcatagagtgtggaaatttgtgttttcaacaggtatcccaagtgattctcatacacactggaatttcatagtcactttatcttttatattttaattttttttttttttttttgagatggagtctcactctgtcacccaggctagagtgcaatggtgcaatctcggctgactgcaagctccacctcccaggttcacaccattctcctgcctcagcctcccaagtagctgggactacaggcacccaccaccatgtcaggctaatttttttgtatttttagtagagacggggtttcgccctgttacccagaatggtctcgatctcctgacctcatgatccgcctgcctcggcctcccaaagtgctgggattacaggtgtgagccaacgcgcccagcccatagtcactttattttatgcttataataatctttggagatgccttcagctcatttcatcatctatacctttttcccagtctcactaatctcctttgcttttctgccttacttgattctctgctgtctttaggagtctgttttaaaactgtgccagttaacttttaaaaattgtgtttatgtgtatgaatggtgtagatgccacatatatggcattggtataaatttttaccaaaatgagtagttacagttttgattaaaactaacattgctgctcaggaggcagtggatcctccagatggccttcagcttttatttctctacaaaatggcaaagtacgcttaggctctcaagtatgggagcaacaaaatctctctgctcagtcatgagcatatggttagatgtgcgaagtgctctgttctttctgctacagtcagggatatttaagtctgttatgagtgatccacaatttactgagcagcagtacacttttacgatgaaagtcttggaaaacagtgaacatatttcatctcatattcatttcagtgattatgctgtgatattcactgatattgactttcagtgaagaaaagcattcattattaaaatagtgtctttattacacaactgtactatgattttgaaatggtgacagggaataaaggaagaaaactccttaagccctttctgggtttagacaggcttgtggttagttgaattatgtcaataaatacagctgagtgattcctgattaaaagttgtctatgtgttaagtttaataccttagggaattaggactataagtactttgggggtgctgtgctgattacttttcttatatatttttaccagaaataaatgttgacctgttagatatgacgtagggtttctgttttcaaaaaggcactgcagcctatttgattgtaactcattgctcctggtttcccaattatcttttctttctttaaaaaaaatctttactgaggtataatatttattccctaaatagaaaaattggacattaatattaaaagctggcaaaattatgttttaaatattcacaaatgataggctggactatctaatataaaagtatcatccgtgttgtaaaataattctaattccattcagatgaatgactaccatttctagatgaattaagatattcagcagttgggccaggcgtggtggctcaagcctgtaatcccagcactttgggagcccaaggcaggcggatcatgaggtcaggagttcaagaccagcctgaccaacatggtgaaaccccatcactactaaaaatacaaaaattagctggtggtgtgtgcctgtaatcccagctactcagggggctgaggcaggagaatcgtttcaacccaggaggcggaggttgcagtgagccaagattgtgccactgccctccagcctgggcgacagagcgagactccatctcaaaaaaataaaaataaataaataaagatattcagcaattgaactcttgagaggtggtagaatcacagtgttgctttaaacatccaaagagctgtttgctctgcagagtgctgggaaaccaggcccaaatgaatgtgcagtgagagcacacgtgcacacacacacgaacacaaacgtaagcacagacagagcacacagattcagcattagtttgatcacacacctaagggttacatatattttttgaagttatttaagaacaatttatttaagaaagacagactaaagtaaaatgcatagaattcttgctttgacagaatatcattttttaaatctgataaaagcacaagagagtgcccatactcctctgcgccaaactcagaggaattaagcggaggaaagaattcctagaaaaaaaagaattcctagaaaactaaatcagaagcttaagctgtgatgtccattcataggattgaatcctctgccagcccagccactccctgtgcttatctgtctgcagattctaacatagaatgaccagctctccagggaaatgttggtagacctgtcatttgtaaagaacttccgatttggggatggggaaaaggagtgtttgaaaaccacctttcaaaatgtgggcaaatgttatttccaagaagttctagcataaaataacatctgtaatttccccaaagacgttctcagtttctgtgtcacatgattatgactcattgcagcagtaaaccacactgtaagccctgattttctaattaactttgttactttgtatttagttaggagttgtatatcctctttaaaaccattagtacagagatagaatccaattaagacctgtacttaacttcacttgggtgaaacaagagcttgccagtggattagttgtagatatctactaagtcagtagagtcttgcttttttcaattactttagattgccttgttttaatttatgttaatctgtcctttaactccagaatcaaatatgcttgcagattacactcagtctcgccacactttctgatcagtccctacttaagacaaaaatatatttctagtggaagtaaagtaggcttactttggtgcaggaaacctagtctttgtgatgacttacatttttctaacattaccaagtgtgtaggatttaaattaaatggctcttttgttgaacagtctacttgttaatagcctgacaggcaagtctcccagtcccagatgaaatctctctgctgtttttttacttcattggttaaaataaaagagaagtcactgcctcatgatttcttatataacaggtaataccgctccttgtttgctcaatcaaaaaaatttgaaagttaaggaagaaaactaaatccatatattttttattcattgtgggcttataatcactattttggctccatatctaattataatcttaaatttgatcctgcatcttatattaggttatcatttttttttttaaaaaaagaggactttcttgccaatcctaagaaagcctagttcttaatcttgcactacttaagtttagcatccaaaaggttgtgtaaaaatacatgtaccccagattcattttaaaacgagagatctggactggtcacctgccgatagatttagaaacttgtccttgtcatcaggtttatgctgtccccattgtatcatcaacgtttgtgcccaattttgttcctttgttgttgttttttttttttttttgatgtgtttccaaattgatacatcatagttgcacatatttgggggatacatgtgatattttccaattttgttcttgggctaatgtttttcagaatcacccactatactgcataacccacggtaaccattccataaaagaaaattttcttgccagattctgtgtctgctgagctatagaaccagatagcaggaattcatagtcaggaaaccatctgaacagctttaggtgcaaacgcatgggcctggccagtgtacccttctgacacaagtaaagagggagctgtccattaaacttgagaaatggatttaatgccttaatctttatccttgtagaatttggtcagcgatgagaggtttgttactcaaaatcagaccatcagattcaaagcatcttttcagtaatacaccccttggagggctaatttattacagtttctgagactccttaccagtttgtgattgttgactggatttttagaaagtcacgttcatggctcatttcttcattggctgaatagatctggggtcaagatcgtgctgtcagagctctgcactttcttgtctttctgcgatatgtagggtcagaaggacaagaaaggacatctgaatttctcaaccactgccctgactttcctttcagggttgactatcaattcctcacatatccttctaactattttgcctctaattcttgtatttgttcatggtattgagtaataagatgagagtgacatacaaggggaactcagtgtctaatagaaaggtagaatacaggttagaggacatgatttggacagcattactccggggaagcataaaaatgctatcggttattctaatgggcttctcagcctcaggcactgtaggcttgctggagctctcaggatttcttttaaaaagaaaaagaaaagttggctcttttctttagtgctcatgaaaatttttattagacaaggaatgagtatgagaaattaatttttgatatttttttcatgatgaactttttatgtcagaaatatagaactctgcacttagaataactctgaacagtggctttaggtgttcaattagcaataattaaatgtaagtttaatcttataggcataatctgaaatatccatgcaattcacctgtttgcaggctaaatagtgattagccagtaataacacgtatttccctgggatattattgggagtccccaaagggatgtcccaggggtccttaaatgactttctcagtgctggttaccatgtggtggtctcactagctccctgcccaaaagactgcttgaagaagcctcacctgtatcaccagccagtatgaggacaccagtgcccacaaggggagtgctgcttccagaaggtcacagggcactacctatgtggggccagagtggtacctgcttccatgcagaagtagcgggaggagccttctaccactctttgtcatccaggcccttaagcaactgtacttcattcattcattcaataaataaagcaagcatctcgggccgggcgcagtggttcatgcctgtaatcccagcactttgggaggccgaggtgggtggatcatgaggtcaggaaatcgagaccatcctggctaacatggtgaaaccccatctctgctaaaaatacaaaaaaattagccgggcgtggtgtcaggcgcctgtagttccagctactcgggaggctgagtcaggagaatggcgtgaacccaggaggcagagcttgcaatgagccgagatagcaccactgcaccccagcctgggccacagagtgagactccatctcaaaaaagataaaaataaaataaaataaataaagcatctcatctactgtggtgctgagtacacctgattaacaaaacagggtccttgccctcaagaagcttgcagtccaactcgagaggcagaccttagacaagtcagtacacaggtgtcagtgaaattacaaattgtgagaagcattctgaaggaaaaatgatgtgctataaaaaaagacaataatgaaaaaacatggggtcttcatctaattcaagagcaggggaagcccctctgagggagacatttgagtgaagtcgtagataggcatgtgtagaaataatggattttgtaaaagctgaccagtatggccagaacaggcaaatgaggaggtgggattgggaataaggatggggagggggcaggggccagatcacaaaggaccttgtaaagagccattagccataatgacttgcgaaaactgaatcctagtgtttcaactcgattgggtccctttgtagttaaagtataaatcttgtgcctctctagcctttttcctctccaagagggcaaataaatgctttccttcagacgcgtttcattagactcctttgctgcctgaatttgattttcgtttgactgaggtgagtaggaaccacagatagacaagcaaatcatcctggaggacttgagaaataaaagctgagatgatgtcccagtgttctgggttcatttatgtgcaaaggacattgaaaagcgatttgtaatttaatgtttgggggccaggaggactgcagagataccttccagtaattctgaatccaattattttatcaaaaggaaattaggattcctagaaaaggcaaaacaaacaaacaaacaaacaaaaaacaccaacttaggcattaatcacgggcatcttctttatattaattggtaaccaaagggccttcacttcatgtacattcccaaaacagatgaaatatatttccatttcataatattgccttattctcacacaaattatggtgtgggctaaggtagcactacatacaaagtagaactattatcattataatagagtacagaatacgtaaaatattcatgttcattgggctaaagcaaacctgccatttcaagtccattaattgcagtcgaatttagtgaatattttttcagggactaacactctaattatctaaattaaagtgagcatttaagtggtttcatgttcagaatgcaggtgcagtaaagtaagttcttgtttagctaacctttgtccgggtgaaccggatagagggctggggcagtgttttcccacagtggtgctttctggagtgggagtgtttatgcattggtaaagccatctgatagttctggtcattcctttatttttttttaaccttccctttaattgggtttattctttatgtaatactttcttttaagggaaagagctttccaatcttttgaggagtagaggtaacaaaaacatagaatgacatagaaattattatacagcactgtatagcctccattaaataacatcccccacaattcgttaaattgctggtttcagattggttggttatggttgaattttagtaaaatcggtttttctgtgtctcatggcgtagaaattttcatacagcactgtagtcgccattaaataccatcccccacaattctttaaatcactgttttcagattggttggttatggatgaatgttagtaaaatcagtttttatgtgtctcttttgaggagctgtatgactctccatattgtatattactttttgttattagcttttaaaaatatccccatcttatttcttagacttttaggatctgaaactgctgtagagctatgtgatgtagggaaggaacacaggttttaaaatcagatggctgcaggttcaaatcccagctctgtcagtgaagatatgtgacttggggaagttagttcatctctctaggccttcaatttcttccttaccctagagtgacccacttaactcatggaatggttatgagaattactggattacatgaaggggttagcaggatgcctggcctccaggaggcactcagtaaggggtagttcttccctctttcccttttgaaatcaattcacctggcctcctatcaaacatcaagcttcttttacaaaataccgtatcagtcagagaatataaagccaccctgcagtttccccaaatacagtgagacccagattcctggcagagaatggaggtagaaattgcacgtagggaagaatgactgaaccactgttgtcctacttatagtccacaagattcactgtgtttgcctctgccacctccacactagcagtgggaaaaccttctcctattacttctctggcacaaagagagctggaaagtagtgtaataacaacagaataaatacagacactcggaagggtgtaggcaactagataaatcattctaaccaaatagttcacttatagtgagcctggaggtaagtctagggttacctcctggtttagttttctgcgtgcttccagtaactgcaatgaccctctcttactgcctgggaggaccatccagcctcaaagtctagacctaagaggagagtccgagagagaaatgcaaatccccttgtcctcctcaggctcaccctttgctctgcagttccttagtcggtgatctacctctttgagttctagtttctttgccaaacacttacctctttctttgatacttgataacaagaatctccaccagtttcagggggagtctacactacctcaagtaaactcatacttctttcccatggaagagcagccatgcttataggcctcaagaagacaatccagacaggagacaatgcaataagccttctatttctacagaggactagccaaccaccatgaacttgacccaccgaattaggtgatgttctaaattccctgtgtagaatgtacccgtgatgcctggggggcgggctggacgctaagctatgagagatgacacattagtgcatcctccttcatagccccatggctgcccctgccaggtaggttctaggtttaacaaactcgtttgtacagacttcttcttataatggtgtcatttaataaactgataaaacatgagttcagaaagtgagttgtgtctgcaaaaaataaccaggatgctttagaaaatcttgataaaggcaaattattaaaaactgttgctaagttagatattggaaggatactgtgagaaaatagagacattttttaaatctaggattttttaaatgttcttggccctacatcacgagagtggatagtaaatttaaaagattaaatttaagctttatttgtatcacagttttatttttccctgcttaaactgcctgtatcttttacccaagcaaataccactcccacttcatcagataagagtatttcttctgtacatattaacaggaccagctacataatttgcagggcccagtgcaagatgaaaatacaaattcccttcttcaaaaattaagaatttcaatacggtgacagcagagcattaaagcccagcaccctctgagcctgggccccatgtgtctgcatgggctgcaggacatgaagctggcaccagcaacagacaaaagggctgggaaggagaggtagtttcacatgtcacccagctctctgacaatttctggtgccaaagagtttccccttgtaagagacacctgttcattgttgaattactgcttggaagggctttataccgagcctaaatccattctcctttaatttctgctctctgatgtagaacatacctaatcccaaagccacacttaatctcttcttcttaatgtacctttttgggtggcagtatagtttctaaaaccacctccatcttctctctcttgatactctctgttctttctgtatccttctgatgggcagtgctcacattcttaggtataaactccaaattcctgatgtggtatgggagtttgaaagcttggggactcctcatgaaaatactgtattggaattttggatacactgttttgttctgaacttaaagaaaatcacttaccctgtttaaaatattttaaatgttttggctgggcgcgggggctcacgcctgtaatcccagcactttgggaggccgaggcaggtgcatcacgaggtcaagagatcgagaccatcctagcccacatggtgaaaccccgtctctactaaaaatacaaaaattagctgggtgtggtgtcgtgtgcctgtagtcccagctactcagcaggctgaggcaggagaatcgcttgaacccgggaggcagaggttgcagtgagacaagattgcaccactgcactccagcctgggtgacagagcgagactctgtctcaaaaacaaaaaacaaaacaaaagaaaaatatatatataatatatatattttaaatgttttaatgatgaaatcaaatatatagaaaagtgtaaaatactgtagacttcatgtagtcatcattgagatttcattgttgcttaatacctctcccatcatctttgcaactcctcttaaaatatttttccatctggcttctacttacccaatttactgttattctgtatttatatagttgatttttgtgacctgaaggatttaactttgttggggcccatccagagtctctgtagctgtactggagacttctctccagggagccctaaaactaaaaccaactctttctggcataatttttaagtttattaaaattctatgaaatgaacctcgaaagcattatgctaagtgtaagaagccagacacaaaaggtcacgtattatatgattccatttacatgaaatatccacaatggttaaatccatagagatagaaagtagatttgtggttgctgggagctgggaggaggtgggaatgggggagtgactgcttactgggtacacagttttccttttaggtgatgaaaatcttttagaactgactagaggtagtggttgcacaacattttgaatatgctaaatgccactaaattgttcacttaaaagagttgattttatgctatatgagtttcacctccacacacacacaaaaaacaaattctatgaaataatatttaaatgtttgcattgtagcattgtatatacatattaaaatcagtagtattgattttttttctttttcactggtaactacatcatgagtattattttctgtatactcagtttgaagtactactacttctttgaagccaggaagatggtaattgatggtggaacaatccttatagataaattttgtattaagaaccaattaagtttatattatatttgagatggtggttttatttactcataacaatggaaaattctgtaactcagtagtagtgtcttgggtaccgatatgtacttcctttacattacttaaactgttcactggttggtataagactgtattccagaatgacatatgaaagtggttggagcaaacccagaaagttttcctttaaggagactccattgaaatgtctcttggacccaggtataaaaattgctccatttgcccttagcctattaacatccctttcaaaatggaatatatcattcctagtatgtgacagtattttatgaaacttaagaagacaaagagaatcttttcttccaattctgtatgtttttatatgaatgcagtcaatgcctaccagaaaaccatacggtgtaaaacttgactcttaacattttgaagaattggaatgattctccaggagaaactgcactttcaattagagtggtttaagctacaagtaacagaaaactctgttcaaaatggtttaaacaaggactttagctcacatactggatatccaaaggaaaggaaggtttcagggttgtttagcatctcagtggtatcagccaggacctggggtctttccttcccttagcccggctctccacagtgttgattttatcctgaggctcattcccttcatagtcttagaaggctgccagtgaaacagtgctgcatgtttccttgaactcctggcctcaagcgatcctcccgcttcgacctcccaaagtgctgggattacaggcacgagccaccacacctggccaactgcatgtttcctaattcacatttggcttttagtgattcttaataaggagcaagaaagtttctctcttggaagtccccaacaatcttctcctcccctgtgattggtccatactggcttatgcccatctctgaacaggcacattggggtggaaggctgagtctccatgagcccattgtggggcttcagctgtaatgcatgcacactgccagctctatagtactcccattaaatagtcttagaactttttaaatgtcttacataaatcgctcattctgggtgcagatgattcttcagaaaacttattacgttgcttttatattacatcactgcagtgtagcatatctttcaaatgtactattgagatgtgctatttgcagcccattttcaaaagctaggaatattaaagcagagaagaaaccaaagtttgctttcattggtgcatgcatgtcattggtgagtgtctcctacttaacaggaaagcaaaatctagattgtttatgcattttattttggattatgtatgctatatgtgtttatttttaatagacaaatggtcttttatagttggtgtacccttggtgcttcattgctgattatgttgttttgttccattttcttaactatatttggtatgcagaaattcaaccttaattatatattacaggtttttctttgactttaaaccatgactccttttgtttgaatatgttaaaaagataaatctcaaattgtgaaaaactgagttttaaaattacttcagcccatattttctgtctcaagtcttaatttaacacagttcttaaggaatgaacgtaggcactcataattgagtgcctctttgcctatggaattcttttcctctgttggcataccaaaattgacatttgttgagcttcaagttttaccacaaagcctctgaaccacattagtcaataattcatcccacatccttctttctgctctgaccccagttccagacagtttcttcaggtttttgctatagtgcagaggttacaacctggtggcctacagctctgatcttgcctgcaaatggtttttttgttgttgttgttggggggcaggttgggggagctgctgaacaaacaaaatttggggattatctgacaacaattgacaagtgggagagttgacataagaatccagttctggcttgtcttggaaaaatccaaagatctgaaaacaatttttggcataaaatcctgaatggcaaaaattctgtcccctcttctccaactgagttatgttatctcccaggcccctgaagacttttgaacttcagactcatttagagtgcattagtgctaactggtgccatcctgttttcttcctacaaacagagcacgtcatctccgcagacctagataaaagcagtttaagaatatttctgtaagcaaaaagacaaatatgattgttcaagccgatcaggctgtagatgtaaggctctacagctttttaaagattcctgtcttcctgataactcattggaatcaccagtatccttagacaagaccttggaacagcagaagaattcagtgtacacctaattgtccagttttggtaaaggtttaatacaagatcattaggatataaagtcctaacccgtttcctctaagggaggggaagtcatatatccagaaggattgactccacgccaactgtgagggtcattcctgctgatattcagtctctaatatggattccctggtcatttgttaagactttattgatagtccttattaatactaaactcagtatgtgctcccctcctaaaatgtacaattgcagcattgacctacatactgtattcataggactggataataaaacagcagtaacatcacagggtgttcttgctcaaagatgattacagtgtcatcctaatgtccccttattgctcttgaatattcccattaacccaactctaggacctcttccacccccatcagataaattcattttacagctctaactcatgtgcctttactcttctctttgggcagactccttaggtcaccctccattcccttttaagtaccagggtgctgcccagggctgggtattccagtgttaatgacaatcacaggcatacaacttaatgttctcttcttggcttagtttttccagtctgatttagatgtttatcatgaccagtcctatcactggggaagggtgtaagttgaaagaaagcacatgtgtgctttcaatagtgacttggttggccattacaacatttttgtgatgaataggattttgcagactagcaagctttgaaaagtgtttgtatctgccaaacattcccgtgtatcgggtgtttgttactttgcccaactgggtaatctggattgtccctaaaattgaagctatttacaccattttaccgtgacatcccattgaagtccaggttcctagtgtgtctttgccactttgggctctgtttgagcactgtggctagtaatgcctggtgaaatgtaattttggggaaatgtgggtcattcagtgactttgctgagacagagttcacctatcacaggactaagctccatgtacgcaggaatttgttgaccaatgaatcctagagcactggaataatgactagtgcctagtagacatccgataaatattattgagtgaatgaattgttgacaacttaaaacataccactgtacatattataaagatatgtgggttctttttcctgttgggttttaatcaaattgctggcgtttattagcagcaaaaattggggttctgcatttgcactgttcagatttatagattaagcaggatgggcattccagaggtttctgtcttctagagttatgtctcagaaaccagaagctggatgtgcaatcgttttttactacattacccaggcaagaattaattcatcatttttatttcaccatttctcgttataagcctaatgccaatatcttgttcagaacagtgccaaatttcaccttctgctaaacgaagaattggatatctgtttgtacagcacactgtagacctatggcagattgactctttggaaatagaaaaaatatatatttgactgacctccagccagccagaaataaatcctctgcataatcttgccaaaatgtcatttggttgtgaacagcgcccttcatttgtcttaggagagcctgcgtatcaggtaccaggccactgcaggcttttctgctcttcttttttctcccaggcagctgcatctttgataatgtggattcgtgaaaaaatctcattgtcctccttacctgtgtcatgaacttctttctcaccttattgaattatctgttgagtcaggaagtttttttttttacagtttagtttctaataaccatttgaagatgatgatgatgattattattggtcgttttagcccttgtgttatagctcacattaagttctcttctgatgccaactggaaattttaatctaccattactaagtttaaaaatatgttcacttttgcatatgggtagacaactttaatcatgatttttttttactgcttatcactgttggcttagctatgcttctactgggtgattgatgtgttttctttttttagttcagaatttcctgcaatttttaaaatttcctgtctataatgtgtataacataaataacacttaattggactaagtgatatttcatttttacttttctaggaaaaacatctcttattctggatatgtaaatagggatgaagacttacaaacctaatgttctttttaaatttcttgattattctgcatttagagttgaagtcatcagcttggccctgctaactctatcacccactgctgtctggctgtcctcacctgggacccctcaggtgccaaatttaccagctctcttccagcattggttgactatttaaaatcttgatttcatttatcttgttcttgcatacaaatgaaatgaaattcctgaaccaggtacaactggttctttggagaaaatggactccatctgagaatagctatttagtgaagacaattttcatgatagttcatcttaaggatctactttgtgatgttcttactaagtgttggacttttagaagccaccatgtgtagtcccccattcaccaaatgaagtttattattcaccccttcattcacaaaatgaagtttattattcttcattttggggaatgactagcattattgcttaaaggatgccccaggtgcgtacagaccactgggaatgagcttaaagccctgaagcagctgatgaatgtggaacattgatcacccacctcatccctaccctggcctaatctttcatctgtaccaaccaatggctatctatatggagaaagaaaaataacagcaagagatgtaagctgggaatgccactcacccttgttctgtgggggtgagcactctggtctggggcttgaggatgccttcaacacctctcttggttgaagctctcagtcactgattgctctcgatctatcattgttgctgcccttcccataaagcatgactctgagcaggcaggtaagctgccagtcttctcagtcctctttgttccatatgctttctagaggcatgtttctgaatatactcaaatacagtcattttttaaaggtggtttaactgtggtaatgatctcaggaattttatatgtaaatttctaaactgaacatttaatgtaaactaaatcagctctatcaccacctttgattccagaaacacttttttttttctcatattaacaagataaagccttcacctatggaagaaggattttttttttcttaaagcaggataaaagacatggaagcatccacaacaaaataatcctcaaaacagctttgcttttctacagctttaactgggaccagctgtcaaattcttgagtgttgaggtgtttgaaaaaccatggctgaaaggcactaagatcagaaagatgatgggatttcatgttgggaagcattagccccagttgtctaaaatggtcttgctagaaaacatggagagctttttgatgtgtgtttcattctctctcggttcactatttgggtccccaaagggatcttcatatatgcctgcgacttctttgcaggaaaaaaatcagcttttacatgagatagacgtcacactggcccctgctgtctgatataggggaggggactccatgcataaggggcaccagcagtgcctctctagtcctaattcttattttaagtacctgccttaaaagcagtaacaatctattttaaggaggtaaatgctatctgagaggcagaaggcactgtggttgtgtgtacaatcaccagagagccaaactgcctgcgttcaaatcttgcctctgtccctcccaagctgtgtgagttgaacaagttgcttcatctctgtgtgcctccatttcctctgcaaatggagcaaatacgagttccaacctcatagaatagctgtaaggattaaaatttgatacataaattgcatagtaaatctcagtaaatatgttaccattaatcattaataatagttttatttattctgaactgctttattactctagtttgtaggatttctcaaagtcaaaatgaggaactgtcaactcagggacttgctcaacagtgaaattaaaatctcattaaaaggaccacagatagatggggttatttgggggttatttggaggtttcgctattccttgggtggcttagtacaggcctggtctttgaacttagcacagtatggtctttgttaaaacattaggattttgccagctggggtttcctctgccatgcccttcctaggatctgattagaatttcaaggatcatcttaatgatctgtcttattaaatgattggacagccatgaacagaatacatcagtgagaaagagaagtattatatatatatatttttgtcccagcattagtatatcctattttttcatgaatactctacagccttccatagttaacttttctaagtatactctgccaccgtagaggtttctacgaagaggggtgatgctatcacagagttttaaaaagcttccgagtatatgcatcctcgcttttctcacagttggctaatctaaatctgtaaatcctcttcttaacactctaaaagtataggattatgataagccagagaaaaggggaaggggaagggagggtggcagttttgtagggaaactacagtgggtctggcactgcattgtctttgctcgtgcccagtcttttgaactatgaattgattgtagttagaaatcacagcttttcatttgatttcttccaatgggagggaaaagccagtcctgcccacggttaatgagatcttgctgcctcaaataacattggaataagcagtgctaacttgttctcttggagactacacatacagcccacagtcttgttggcccttttcattgctgtcaaacattcttctgatttttactccttagtgcattattgatgatcatccctaagtcagcactcttttctggctcgtcttctgtcttttgattgcttgtgactcgtcttcgtactcagcctcattactgcacactgcatgaggccttctccacatcctcctacaaatggctgccttccctaaggtaaccaacagctttatttacatgggtaggaagctacctacacctcataatgacctcacggtgttcctttcttgtctgttttcttaccagaagtgtttggtttgtctccttctgttttttatttcccaaatcaatgtgacatcgatttcactcatttttacctgttacttatcttaaaagtctaaatccatttctggtgctcaggtatctaaggctgaaagacagcaaattggtatcctctctctttatctaagagggaaggaatggaaatctgaaagtcaaacactttttttatgtttcatatgcacgtgaggaacttgtggtatgtgacccttttataaatataaaacatttctgagagtttggtaatctacaagtttagaaattgtgatatcattgcaaggaccaaagcaaaaattgtagtagctgttccctggattgctttggatcaaaatttttcagcatgatttaattcccctctagtccttagagcccagtacatcctcactgcaggctgtcttatttctcctgtcgttctttcaaataatttctgataacagtaagcaaaaaaactttttgataatcatcacaattgtagttggcattaagggcagtcagtgttcctgaagtgtatgtttaagattgtctctgcttcccccaccccaactaagattggaatttctaataaatcactgtgttgtacaagttggcagtgctggccatgtacatataacaggtgaattccaacctagagaaatattagtggagacttagaaaaactgtgactgtggacactatgatagaagtatttggcatattcggaatttcctttcttcccaaaataccgtgttttgtttaatgaataagatagacatgcagcccattacaacagccagtcttgggctgctaagagttttaagtataaggttgttgttaaagctattgaacttttaggatatttatttccttaaaatgccttcttacggcttgtggtaggtgttgaataaatgttttgatttcctaatgcatgcaaattaatatttattattatttactattagtaatagtaatgcatatgttgagtctttgagactgtgtcttagtatataaatggccacttttcccctaaaataatgtcatgtgtccaccaaattcagtaaggctagtggtttcattaagatgcactgccaggtagtgaagctgtagccagtgtactgtggaaataggtaatgaaggaagattggaacttccttctgtagacattctcaaatgtaggatgaacaacttcctcttgatctcagatgatgtgcagatatcctgcttggtgaagaaaggatggagttgggaaccctggcatgacccttgtaacatcaggacatattacaagctgcttttccactgctaattttattcatgcgatgttgtgtgaaacaaacaagtgcacaaacaacaaatcagttcagaagttcttcccctgaagaaaggttttttccagtgttgtttgtttatcttctttgcaataataactcttccttcttcattaccctggtggtaagagaacaatatcagggaagaaaaatgaattccctgataaagtatttcttatctgttcaattagcgcaactaatatagtgagatacagtgatttctcaattaatgaatcatctagagaaaaaggtctacatatggttagttgcattcaaacccataccccatgcaggcagttgtcttagaatatatgagacagagctgcctgcatgagagtagtaaagccaggtactgtaatgtccactttaatttgtctcaatcctggcaatgtacttcattagttttttttacattctatgtgagaacatcattttatgtggatggtgttcatgaagactggctgtatgtgcataaagcttttcatttgaaaatgtattttaaaagttaatttgacctattataatgttatttgacattctaaataatataatacaaatatttattattttaagtgtatttttaaaagttaatttgacttattaatatgttcagtcccaatcagcaaatcacacaactgttaaaaatattttatgtttacaaagccaagccaaaattttatgttttcctccccaaactttgatataaacactaacattttttagcatgtataaacatcattattaaccagtgtcctattaaaactccttttctatgatagaatgtctgtgcttttaggtggataaggcctagatgattggcctctaccagcatcctcatctctgtccctgatgcccagcttcagcctcgctcctgcatgctggaccgcttcagtgcagctctcagacttgctctgtgtctcacatgctctttggctacgtggaatgctcccactcacccagcaagctcccattcctcatttaagatgtaaattgagtgtcacctccctctcgaatcctacccagaactctccaggtggtttgcctctgtgctgatgttgcaccttgttcctgcccctccaacagcactcatgagaatatgttgtaatcatttgtgtatgaatctgcctgtatgagatgcaaggcaagatttgcattacttgtgtttatatctcctcagcatctaataggaacactagtttatggcatatacttgtaagaattcgtttaataactgaataatcatagtccacgtattagaacacacatctgcttaaaaagtaagtcatggatcttaataggcaacagcttgagtttcctcctatgcaaccactcaccatgccatcccgctcacctccccaatcttgacccccagcacagaggggccacattctctgtggtttcctcacaagctttctcgtgataaaatgtataatctgaaggatcttgaataagtactactgcctacctcccttggagagttggaaacagcagaaattaggatctagaaggctttgtgtattcaagttgggatgggagcaggcacagaaaggtaggatgacctagcttaaatccatatttcagtttagggagaaagacctggggcatgctgtcaggataggagtgatccattacagagagtgctgcattcccagcgtccagtgtcagagagacacattgcagaagggacgggtaaggatgtctcaaattcagtgcactggatcagaaggcacactagcatgcctgaacccttaatagtcaaattttaggaaaagagagaggctccatccctcctttccccaataaaggagaataatttcatcaccaccagtttctatttcctataatttccttccttccttccttccttccttccttccttcctttcatttctttttttttttttttttggatggagtttcactcttgttgcgcaggctggagtgcaacggcgcaatctgggttcaagcgattctcctgcctcagcctcccaagtagctggcattacaggcatgtgacaccacgcccagctaattttgtatttttagtagagacagggtttcaccatcttggtcaagctggtctcgagcttctgacctcaggtgatccacccgcctcagccccccaaagtgctgggattacagtcacgaaccaccgcacctggcctatttcctacaatttctatgctatgaagtacattcttctaaccataatgagagtttaaggctcaagtttaattgcagatgcctagaagagttaacatattatcctcaacaaaaatatgctgctaggttattttcattcgtccattccataattatctatgtgcacctcctaagagctagacactgcgctcaatattgggtgtacagcagtgagccaaatggattgtgtctctgtcctcatgctaccttggcctttactagtttgagaagggaaagaatttttaaagcatctaataaggtcaggaagattacttctgtgagatggggtgagtaacataaagtgaaagctggagatctgaagagaagcttttataacttcaccctgatcagctctacctatcttcatctttgtggggggaaaatagcagcttctgaaaaagtgctccctattcttggctaccaggtactcccaggtctttcatttgttaattcatcagtgcctattagatgccagctcagtgttgggtagtgactgagaatctagaggtgacagatgggtctactgtgaaggagcctcagtctagctcccttgtaagtagagtgaccacatcaatttatcatccaaactaggccatttctgagagtgtagaataaaaaggcacctcttgcagagtgatataaacatacctcctgcagctgtgcctgttacatcaccttcttagggaataacctatcaaaagtaagtgctgcctcttgaaggagattctgatgcttcgtcagccaacttgtgtctcctgtttttggaggggtcagtgctataactgtagcctccaagatgggtggaaaatattgacagacattttatgtaggttacatgcctttctggagaaaaaaaattcagcacttaattttttttattagaatgcactttttaaaagctcattggtgtcagaggggtttaatgcaaactaaaaggatgactaatcaagaaaataaataaatagttgtagacttataccatacaacaaatattgggacgcctataacaagaatgttcaagccgacttctctgtgtcctgtggcaggactggtcagactttctatacagatttgatgtttactaacctctcatttcacaatgactccacgaactgtatcttgcaggctgcctagtgggtctcagctctactagccagtatgtcaagtttctggcaaggacgtcggcactgaatatttctcccaccaccaccctaactagaaacagttagctgcccatgccaccctttgtgttatctgcaagatctctctaggttgtctttcaaggagaggtgtgacttaccttggatcagagaagaaggatgatggcagtggctgtgggaggggtagaggaaggagaaggttattgggatgatctttcagatttaatcatgtgttaaaatgagacctttgcacagtgaaataagatttgaagctggaggtacaaagtaaaagtccgccaaacccatcccagcttgttttcttgcagcaattaataataatttgtttaaaattgtaaaatacaagacaaatgttaaattgaacacaacaccgggacaagagacttttttgtgaagcatttgatttttttgtattccataagttcttttcactttcctagaattcttctcttcttctaccactgattgtgaagtttctgcaaaaagttccctttaaacattttaccttgttagagaaactatataaaatactcagccagttttcttatacttgatccaaaccaatccatcaagaatgggagaagtaggaagagcaggataatattatttgcagaaaagtctaaagcagtgccacttacagtgtgatccctgcactggcttgagccacattgtcaaccagctacattattaagcacgttgtacagttcagctgtctttttttctgggtagcaagactttctcaatgaaggaagcaatggttgacttacattctggtgcatactccataccttacgtggacctgcaatgaatattttgacaactggctactttgagttttcactgatctaaggcacaaataaggtgattttctaaagtctcatattaaatattataaacaggattagatttcaagtctttcatttttttttttactctgtggcctaacgtagtgtgaagtcttagttcacatccttgaattgatttgatttcttattattcaagaagtgaattattcactcttactctgtacatttcactggctgttaaacctttactttaaaggttttggaaattactacacattaaaaaaaagaagaagaagaaatgaagataaaacctttaaaggttttggaaattactacagatttaaaaaaagaagaagaaatgaagataaaacctttactttaaaggctttggaaattactacacatttaaaaaaaaaaaaaaacaacaacaagaaatgaaggtaaagtagatgtccttccccagagcagtgccgcataacataaacaaaggcttagctctctcctcctccacatgactggccacatgtgtgagagagcctctgcttgggactgccaccgtgtgctgggctcacagtccttgcagtttccctgggctttgtgcttatgccagatggctctgcctcagtcggctgcattggcccataatttaggtagcattcctcatatccgtagatttactatctcattaattttaacttttccaaagcttttcccagtccagaagccactaggttaaatctcaagctgtgtgtgtcctgttaataggtgactatcaaagcacctctctataaaatggatcaaagtaaagtgagagtgacggtacgaaaaagttgatcctgggaagttatgtgttgccttttcttttcctttggcatatttcttctcactgattagaacttttctggaattcacatggttcatgtgacaagatcgtaaagagagcttgaagcttatttccataagtgtttgttttttaatcaagtgattatatgcattgaaggagacacaaattatttctgatcttatacatagactatattgcagaacatttggcccactgttttaatttgtagtactagctgcatgtgagccttcccctcaacagtggttgtgagattgtcattagagtcctagagtattttggcttatatgcatatcatcttgttaatatttccagaatgtgctcctggatgtaagactcttctcttggcatccagacatgtagcataagtaaataagaccttcttgctgtaggcagaaaagacctgggacgactttgctttgtgcctctagaaatcacagttgggtggattccctgtgtcatatcacttcttccctccatgatgtgatcagttccttctctgctttatttaattattttcaaactcatgacctacacatttaaaatccgtagaagaaagtcagggtttctgaactgtacaaaaagctctagcacactttccaagatgcagaatgatgctgctggagctatgcctgatgcctctatgtatgttttattcatctactggatgacctgcaagaatgcctgataggcactcttggaacgttttacctctcggattaagaaacacctgtgttttcctaataaaaacttctgtttctttttagaaagaggcttctacctaattcagcaaaaccatacttgtatttatgggaacgtttaagacctttattgtcagaaagtagccctaaaaagacttcaccaaatatgcgcatgaaaagatgctctattagagaaatgcaaagtaaacttattacaggataccacaacagagttattagaatggcttgaattaaagactgaccatactaagtgttagcaagtttgtaagttctaatgtatagaactctcatacactgccggtgggaatgtaaaaatggtacaatcactctggaaaacattttggcagtttttaaaaaattaaaaatacttctatcatgtgatccagccattccactgctaggtatctacccaagcaaaaagaaaatgtgtatctatacaaagatttgtacatgaatgttaataacagcttttttgtaacagcagaactcagaaatacccaagtattcatcaagaggtgaatatgtaaacaaaccggtatagcatacaatggaatactacttagcaataaaaaggaatgaattatcgatcatgttccatcatggaccatggtcatattttttattgctcaataaaaaataatcatgatcaataatttattcctttttattgctaagtaaaataattatgatatgtgagagaaactagataaaatgggtatgtactagatgattctgcttgtgtagcatttagaaaatgtaaactaatctatagtgacagaaaacacatcagtggtttccttgagaaggcagcggatcaggaagaggaagatgggaggaattacaaagggacacaggaaaactgatggacatattcattatcttgattgtggtgatggtttcatgagtgtgtacacatgttcatactcagacttgaaaaacatgcaatttgaggtatgttagttatacttcagtaaggctgttaagcaaacaaaaagcctcatccctaagctgcttacattagtataagaaaagatgttaggaagtatttaggaaagtaattgttaagatttcaaaggacgtggccccactgataatccagtaaatgccatgaaaccacttttgcaaaaattatgaggaaattatgacagtggaagagatcagacctgactccatcttgcttctaacctttaagctgtccttgcttattcctgggagtaggccattaaccttgggatggtatttagtttatagtttaactctgaaaattttgtttcagagttaaagccctctcccccgcacctcccaaaaaaccacctcttgcctgggaaacaatctgcctttgtaggattaacatattagctacaagattagaaattatggtttaggggccatgcagcctctgtctgccaagagtctgaaccaccccaaaatgctcctgggaataccatcactattgtaaaacctaagatcggtgcttgagatattttgcagaccctgcactcagtgcaccagctggcatcacccaaactagtaatctggctcagtgagttttgcgatcccacccaggaacagaagacagcaacctcacttcaacccccaatgattccatctccaaaccaaccagtcagcactccccacttcccaagccccttcctcagaattatccttaaaaactgcaaccccaaatgctgtaggagactgatttgagtagtaataaaactcccgtctcccacacagccaactctgtgaattaccttttctccattgcaattcccctggtcttgataaattggctctgtctaggcagtggccagggtgaacccactgggcagttacagccatacaccctctccccagaaatgtgcacacaaagttttgcccacaattcagagggttccaagactgaaaacctctggttaagacacctatagaatccttactcattttcaaagaaacaaagtacttttcaacagctgttgctgccactcaacaatcccctttgttttttttttttttttccgaagcaagtaaactaattcttaccttcaactcagatgaattctgggtattcctggtaaacatgactttatttcaagtttagccattttccatacagcattgttatttctactttcttcatcctcattctgaagagaaattaaactataagcttaccagtacatcacctctgtaagctaaatgaggatacagttttattgattacaccatttcattgctttcaaaatgagcaataatcacataatgattattggacacttcccataacataatgattattggacacttcccattaccacactgtcagctagttcataaaactgtaccttaaacacattaaaggaaattcaggatcaaaataccaattttatggtaatattttaaaggacagatccagtatcagccagttttgttacgccaaaccgaatcagacatttgcactaggaccaaataatactaataaactggaatttacctgaactgtaaggagaatggcaggtgtatttctatgttttctttattcctcatacatcccttctatatgtaaataatactaatactcaagactgtttgacattttagtcttaaagtctgcatatccatagtacctgtaacattcctagaattgtaaccatcccaatgggttcttcctgcccactgcacaaataaaggccacagcattgcagtaaaaaaaaatagtttgattgacatgaggctggccatgccacacaggagaaggagttattatgcagaccagtctctctgaaggcttgtaggctaggggtttttcaaagacagtttggaggaagggatgtggttgggtagaaatgggtgcttgctgctgattggttggggcagagataaaatcatagggggtcaaagttgtcctcttgaactcacttgcttctgagtggggccataggagcagaggttggcgggtccaggtggagccatgggtgtcagacatgcaaaaaacctgaaaatctcaaaaggccaacctacagtagtgatgttatctacaggcatggctggcaatcatttatttctgcaccttaccagaattcaggctcctcttctccccctagcctggtggtctctcattagttttacaaaggtggttgagcttttgagaaggcctgttatcatttaaactattaatataacctaactgtcttccaaagttagctggcctaagcccagaaaaaattaaggcagcttgaaagctaaaggcaagaggaggggttgactagatcagatctccctcttaataatttttggaaaggcagttttagaattttttctaactactgttttttctcactatccagaattctatttctaagtgaaatcccaggaaaactgcttgtagtatactcacttcttttgttatttgcacttttataaatttgatcatgagaaatatcttctaaggtgactatactgtgtccttccctataggcagagtcttagggtttccgaggaaaaatttggagagccatagatttgtatgcagatagttttttgaggagttcttttaagatcagtatctgtgagggaataaaggaagcagaatttggcagatagagtaattgtgtttgaactgcagcaaatgcctccttcagcaaagggaggaatgaagctgagatgacccttagcgttgtcctgccttgaggcgatggggcctttttcctatcatgaccagtcctttgaagagagggcatgaccttggctaagccggctttctgcggtcatggagaattcccaaagaagaactaaactgatggttaccagccaccaataatgccagcagatggcactgcaaactccgcctcccaggtttgcggcattctcctgcctaagcctcccaagtagctgggaccacaggaacccaccaccacgcccggctgattttttgtgttttagtagagacggggtttcaccgtgttagccaggatggtctcgatctcctgacctcatgatccgcccacctcagcctcccaaagtgctaggattacaggcgtgagccaccgtgcccggcctacagtccaccttttgcactacttggatccacctgagaatggttcttctggattggttgatctcttttcctggggggaaattgtaagagggaaggttagtaatgtgagttatagtccttacacctggtcttgaggcctctctgatactcctcatccccatcatctacattctattgtagatttcctctgctcgtctcagtgggttatgtggttggggtggcctagactctcatccttgaaaaaaactgaatgaaaatggtcagtctttgaaatcatgtttgcctaggatatgataccaaatactcaattgaggtgaaccaagagtaatttatttgcattttgtcttttccatgatgagtcataaaatgcagaacttttaataacaaaagctttaaagactcaggaaggacaaggtggccatcatggttctccatgagtccatgcttaattaacattagacatattaacttttgaataccagttgtttctccaaattaggtacatagcactgataactgatgggttaccataggtaatttgacttagaccatggagttcattcaaattgtatatctaaacaatttcaatatcagctgatttagcatgaaaatcaatttttgttctacttcagttagcagttttataacccagtcagtcttttcattaaaattccaggaattcttacccagtttgaatgatgtgattctaaagttattagaaacctgtattcaagagtgcttttagggtcctttccatccttttgtgaacctcctaaaagacactatactctagcattttgcatgcttgtgaagttttcagaaactgcatgagcattaagcacttaaccgtggaaatgactttaaatagttatagttaaaaacacagttgacaaatttagttatttctgtggtctgcaataacaacataataaccataattacgattgatagcatatactcagacatattagaattttagaaatcccatacaattttggaacatatattaatatcattcactaaaatataacctgaagaagattaaactttttttaaatttttgacaatgcttcctatgtaactaaacatgttaaataattgcttgcctttcttttagatgcttcaggggccctctgtagcatctcaaagttagaggtcagaaaagaccgttttgaagctcaaatttgattttggaaaggctatcaaatatattaaggtttaaaacacttggtattatgaaatagaattccaggttaccataagtcattcatttagccaaaatgatgactcaaaaaatttttaaaggcaaaaacttttactcactgatagggggaagacttagcttttcaaacagtctgtctctttgccttctttttttgtcagtagtttattcaaaagacaaacaaaaatcttttattatcttttaatattacatgaaaatttgtttaagagagaaagccaaatttcatccttgcattagtgtattattaatgtccaccccaatttttaataaaaccttatagacaaatctttccagtcttaatcagtttaaccataaggtgagattctcataaaccttttataaccctttacaaatttttgttaaagagcatattagtactttaagaaaatcctgtttgtgcttttatttcaatgttcagtttacggaaaatacacctttaaatttagtcaatatattcacacacagaatttttttacatgattaatttttgcagaccttccataactgttcaaacctttagcttattcttacttaatttaaaacaatcctttcaccctctaaattaggcaaaaatttgcattcctatgccatcttacagtcttttaccacaaacgaatttcattctcctcacacaccttgcatgtaaaaccattttttcagtagtctcaatcatatgttataatggtaactcagcaacatttacttttgatgcataaattttctttcacaaatcttttcacgacttacacagaccatgtttggacttcttgacttgtcctgaacatccctgtttttaaacagccagttattttactttaggacaagaatttactatacaaaatcctttctggtataaaatccattttctttataaccttctttgcatagctagggggcatggctaattctgaatgtcctcaggccttatctagaatctaatgctccaaaataggtaaactgaacaattttcaaaagcctaagaagcagtttatgaccttaaagcatttagcaaacctaatatctgacctgcctaatttagtccaaatgtctttattttaccaataatctttaaagctgtttttatttcccaaagattactaaagttacatggactaagacattacagtttttacttttctgacaaaatatttaagcacttatttttctggaagccaattaattagagctcttttatataaacattacacacataacacatataactacacagacaaattttttatttgtcagtttttaattttttaaattggattactggctttagggtggagtccttggaagaacagggccaggaaagcatgcagtttctagggcctaataagcaggcacagctggaaggcaaaacagctgcccaaaaattaagggtcttgtttttatactagatcttggatcccaaaaagaccagagccttagattttgagggagatttatccatatctaattcctggggttccatgaggaaaacagattttttttccaaatggggtctctggcacctcctgtttttcccaaggagtcccaggctgttaaagctttaatatctactttttattaagctgactttcaactatagcgcctttttacaaaaagtccttttaaatcttttattatccaaccctggctagccaaatggccaatatttctgtgttcagaaaaaggaaaatttaagatggttcgtggaggggaagagaattaacaaatggtaaaggccacacagttatggtgccagaaagtactcattcctgaagccaggaattgaaccctgaacccgggccgccattgtgaaaagagaaagcaaggccacatggttacaagatcaagctcccaagaacctaactgaccagtttgctgggctgtcttcatcagcaggcttatgaggtcctaggcacacgttttatcctaagatacccctctttatggcagaacaatgcagaaagacacacaaaatacaccagatttactatagctcaagatcagcctcagaattcttttcttgtggtaattaaaactttacaagagagataaacagtgacttttaccactcattaaaccagtttgcacagagagaggccagagtctgactggtaagaaattcttacccttttgccatcatgccaggcttctgggttccctttcccttagcagccctagtgaccctgcttgccacactgtagccctggggccaagccacatcataaaggaaaatcatcttttttttgtttgtttcatcaaccacaggcaaaaagcctctcaattttgcaagttgctgcccaaggcgttgcatggggtaacccaattaacattttttgttctggccagagtaaaatacatgagacaaaacgcagacatcagccactcagcattgaactggcaaggctcaaacttgcccctggtggggccctgtcttgtttaatccatttttaactgagagagactttactgaggggagggcctctaaccctatcccttcctttactcaggtaaaatgtaccccattacttatccaaagtcagccagttggtgctgcagtctttttcctttgtattgggatagtaactaagctgaaagattagcagatttaatttttcatttttaaatgcacttccatgcattgctgtttattcagaacattccgcagtaagttacctttagtaagagccatttctgtaagactctactgctttctgtacctaatgtgtaagcatgaaggaactcagtttttcagaaattaaggatctcatttttacctaaaatattggcttttctcttgggttcccttgattaacttagcaaataatttttttcctacctacgtgcagaagaaaaatgaaacaaaggggtagaacacaaaaatccccacaaaattttaaaagccaaattttacacccctacaatattatcatttgctaccagtttctttctgacctagtcagatgtaagaggcctctaactggatccaggccagttagttaccagattaaatccattcctagacccagtccagtttgtgtcatgacttccaaacccagtttggatcagaaatttgctcaaagaaactcagagaactcaaaacacaaatccactggacctccaaaatctgagagagaacttacccactatctccagccgctccgagagattagtggatacaagtgggtcctgcagttaccttgcatgttcactcagtgctcctgggggtcattagaagctcttcttcagatcccacttctgacaccatctgtcaaaagaaaaacttcagccaaattaaatttaaaggactttaattgagcaatgaatgattcacaaattgggcagctcctagaatcacagcagatttagagagactccaggggtgccttatggtcagacaaatttatggacaaaaaaaataaagtaacatatagaaatcagaagtgaggtacagaaacaactggattggctacagctcagcatttgccttatttgaacacagtttgaacactcagcagtgtatgactggttgaagtatggctgctgagattgagcttgttacaggcgcacactcctaagttaggttttcaatcttgtctgcttattaagttaggttgcagttcatccacaaggactcaaatatagaagtacggagtctttctcaggccgtatttactttgctttaacagggcaaacgaataggattattgcttaggagacaaacgtttgtagaaactttccaaaacaggaatagttcttctttcagagagtctcaatttggggttcttagtgtcttagaatcctctaaattgtatgcaaacttttgtgagcttgtgcctggggagagggccttgaggatatttaccaaatacggtgtactagacattgtgctgggcactgatatcacaaagattcatttttccatatattcatgtattcaacacagattgatatccgtctatgtcaggcactgggagcatagtagtgaacaaaacagttcctgtattcattggagctcattttctgggtatgtggagttggtaaagggccgcatccagaaataatgtataaatatatatagcatatcaggtggtgataagtgctatgagaaagaagaattctgggtaacgagagagtgacgggatggtgggggtgttaatagggtagccagggacatttgagcagaaactgaaagaaagggagggaggcagtcatggagtcatggaggaagaacatttccgggagagggaatggcaggtacagaggttctgggcaagcccctgccctgaatgctccagggtcagcatggaggctgtgtggctggagcaggagcagcaagggagagagtggtgagggataagaggagagaaggagcaggaggcctgatcagatgggtttggtagaccattgtagagaccatggctttactctgagatggaaggccaacagagggttttgaatagataagtaacatggtctgcctacatgttagaagcctcccctgccctctgggtgaagtctaggccattgagggatcagggtggaagcagtgagaccacaggctactggacgagtctagtggcaagttggtggtagcctcacttggggagcagcagcggaggtggtgagaagtcattcgtttctgcgtatgtggatatatttcaaagatgaatgttttacagagatgaataagattttttctgggttttcagagtttgaatctagtggggaaatcaggtatgtgacagattatttcagtacacgatgataagagtgtaggggtagagagctggaggagaatggagttatggaacctttcctgggaggattcagggtaggaaatggcaaaagataagctggagcggttggccgaggccagaccatggagggtctcactgaccatgttaaaaatttggactttatcccgaagttgatgggaacagttaaacagcattgctcaaggaggtaacacactccaattctcaatctaggttatccagtaactctggtgagtattagaaagagggctcggaggaggtaagaccaaaggcaaggtaaaccagataagatattgcaattgtccagggcagagaggaataatttattaaccacttgctatacatcaagcattattctaagcactttatgtgtgtgaattaatcctcaaaacaaaccctatcagtgaggcaccattaatatcttcatttcaccaatgaccaatgcatggccttgtgcagaaagaggaggctaagtgaacttcgttcaggaaggtcacacagctgtgagcaggaggaggatttgaaccccggcaccctggctcacgaattcaggttcttatacactgtgctacagtgcatcccatgaagataagagcctggagatttagggaaaataatggggtgaatcttttattttgtcccaaactgagttagtaagttttctgtatgcgtggctggatttcaaagaaatctaattaaaataaaattttaatttatattagtgttctagcagtatccataagaaacctaccctcgtaccatctccttttctccttacttagagcttggattgtctctttctttgcaatctcatgctgcctttctgcatcaatctattcagggtgtctctttggataaaacaatattttgaagtcatcaccttgtcaggtaacccaagaccatgcttttgtctaatgttagaaatttcttactattggaagtagtacattagactccgtgttcactggttctcttttccccatagcttgtgtttggaaacagctagaattaagtgaattaactcactgttaccagaacatggggttgttgtgaaataagctggtatctcaggaaaaagtgtatcttttgactgattactcagaatatagacgtagactgtaaatagtaatataacttatttttctaactgtcaaaatgtgaataatttctcaaataacttaaaacagaactagtatttaacccagcaatcccatgacttggtgtgtatccaaaagaaaataaattgctctaccaaaaagacacacgcatagtatgtgcatcacagcactattcacaatagcaaagatatcgaatcaacccaggtgcctgtcaacagtggattgggtaaagaaaatgtggtacatatacagcacggaaaaccacacagccatgaaacagaacgaaatcttgacatttgcagtgacatggatgcagctggaggccgttatcctaagtgaattaacacagggacagaaaaccaaataccgcatgttctcacttgtgagagctaaacattgagtacacatggatacaaagaagggaacagacaccagggcctacttgaggggggaagaagagaggggggcaaggttgaaaaagtattgagtactatgctgagtacttgggtaacaggatcagtcataccccaaacctcagcatcacacaatacacctaggtaaaaagcccgcatatgaacccctgaatctgaaataaaagttgaaattatattttaaaaaatgtggagaatttgaatagtgcaaggaatgtatacagaaaacagtgtctggagaatgcctgacttagtttgccaaaaaagtgtcggctccgctgccttgcctccagtggattacccctaggatgatcttatttccctttctgtttagattcagggaagtactgagcatcagcgtcttttccgtgtggctgttactgatattgttacagtttcataaagaacaatacttatcataccttaggccaaatgttctccaaaacaaaaaaaaagtaaatagaaacttccagccctgacaggtattcaagcctaaagtatgatacagagaaacaaaaaaatagaaaaaaaattaactgttcacataaagataccctgtagggacaggcgggtgggaggagtgttggtaaagccctagtgacagggcttgagggccacagtccctgggggcctcagtgcatattattggtgtccctgtttgcccaaatggcagagattgtgggctgggaagggagggactagttcaaagaagatagcacaatgtctgctgcagaaaccaaggggcatgagttttatttgggaaaaccaagagggatttgaaatgagtcagtggctactgagcaagcagggttcagaagtcccacattttccagaaactcgagtgtcttacaacacaaaggtcagtgttctcagcacaggctcaggcagctctaaagcaacagccagccctacccagcccttccttctcagctcacgttccaggtaaggagcgtttttatttttgaaatccaggtgcacagtcaggagatgggaggaaacagtgacacccatctttttaatgagcattgctactggaaaagaaattagcatcaccctgaattttatgtgatgtcagttaaatgaaggtgttttatagcactttacaacaaattagaatcaaccaaattgaaaataagcctagcagctgggataagtaatcaggtaagtggccagttttgcttatttttactttgagctgaagacagaatttgaatttttaatgtcccagaggtgtgagattcacaactggggagtgtggtttctgggatgattgtttaagatgcaggcagctccatcttgcccttaggtctccaagttgcttgacacattccctggaaattggcccttgtatatatacgtgtacaccggagagagggttgtgaattagtgtaggctagagctctgcttttgactgaacattagagagcagactggaaatagatgacccagaacaaggcagtaaatcatccacattaactgagaaactaatgaaaggactgaaatttatacgaagaatttatggccactcatgaaatcagcccaaatcagaggaactattagaacacttttatgttttaagaaaatgggtactgtgttcatttgctgtaatttgcatgtagtcagagtgccctgacatgataaatactggctttggtggacaggattttacagcagagctttgcactccatgagccaatgtttcttgcataaatgacttgatgattttagtgtctaaaatatgttcagaaaactgttgaaaggccacaggaagctttgcgatgataactattctggaattggtgccctggggtgtacccgatatgtgtgtgcttgcttatgtgggcaaaagaaagaggagaaaaagaggaggcagatgggaggagtgttggtaaaaatgaaactgcagatcactcagaatggaagtattaaaagggcaacaaatgaagataaaatgatgcttgcaattatggtttataaagagaaataggccatattgagtacataatttttcttttttctcctctgcagctgatggattaaatgaaataaactaatctgcagaaaatccatgtatctaggttgttgtcagtcgaccttagagaaaattaaaacttgcgcagatttcttactactttctacttaaatttttctacttgaaacacttttctcaaaatacttgtatgtgtactattttatcttaaaatttttttatcttaaaaaattcaggtaacttcaatacctaactactgaagcagcagataattttactcataaaaaaataaaaatgacaaacacgacattctcccataatttcttcagcagtaacttctccttccctaagcaatagcccttatttgactttcaggactttatacttcaggtgtggacatggaaaaagtaagttttaagtttccatcatcattagcttttgataattctgttcattagcagtaccctgagccagaggagtaagcagaaaaaactgacttctctactggagtatcagatagatcattacaccgtgaagaacaaggacagatctccaatgaatccagctaatactgaaaacatatctgcagcactgagctccaaactgacagcgtctactctagtgcttgaccctgttcagcaaacttgggtattattcaaggtggcacttccctggtttgacagatcactgtgctctgaaagccttaaaacatgcgcttgagttgtagaggttatccactgtattttgttgccttgataaaaatgggttcagagaattgagtgaatttataggacaggggttcaaatgtgctgaccttctatttccagagaaagcctttgtttttttttgttttttttttctccccactacctctcctctttgttttgtactgccctctcctggctaataaatttcttagtaatgaatatttagagaagccaagtggcggaaacactgggggctgctatcatttctactttccgttagaaatttcagattttattatatgaaatgcagagttgacatacagtgattaattcagatgtgcatagatacaagattgctgaaatgatatcaattgttgtagaaatatctgtatgagagtaatttggtcatttatatggactttgcaatgtttatgaaaaatgattttgcagtttattgcatcattagtcaaattttctgagtcattgatgtgaaaatccactgttattggaaataatctggaaactttctctctacgtttatattttacagtggctgctaatttacagaagattgtagatgatcccaaagctttaaaaacattgacatttaagttggtaagtggaaagttatggaaagaaggaggtaatattttgccatgctgtgccagcagggaataataatctagtttaataacctactctgtaattttgctgttgttgttttcttttagaatcaatttttgcatttggaagcatttgactctgcagcgttagggaacgttttctgattgtgactggaagtgtcctcttctatgagcatagctttttcttatcgtcacacctttgactaagagcggccatataagaatcttgaagcctagatcattttgcttgcagtttgtattgcaacttgaccataaagacaaaattacactgaattcaaagcaacactcttaataaagctttcctaagacaaaagccaagtggttctaacttttaaaaatagaggctgattgttgtagaaatggtttaggtaattggaagcaattgtagaacaactcaccaaaggctggcggacaaagacacaacaatttacttccacatttcaaatcaacagtaacagatttttgtagaaaggagatatttcaacagttattctgcactagtagattgtaaacttaagtactaggtggccacagagatacagagtgccggacattctggggtcactgtgagaccaagatggtggtggtcagaaatggagagaagtccagatagtcaaaagtgaccgttttccaaaaaattttagcgaacagtacattaaggtacattttaaaaatcgtaagttaattttatcaaaggctggtcagaatcccagaagcaattttagatctagatgaccaacactttgctgtgcacaacatagattgatgatcttttttatatttgtgaaattaaatggaaaatgtgggtgaccaaaaatgctaaatgattagttacagtaaatgtgagcctggtgctaattaacttcctgggtcttgcttcccatctaattttagatagctaggctgtgtgataaaagaaaaacacaaagattttcacagaaaagatatatctgaaggaattctttttgctttgataagaaagtaacattttattcagatgtagagtgctaggttaacaaataggaaaatcccttttctggtttgggatgacactgtcacctcttaatgtgtgtgttttttttttttttaatgtgagagtatattgatgagaaaatggcagcctgtgtcagcatttcaagccaatatatgtccctttattcatttttttaataccacctcaagaacattttcctaatttgtaatatgcaaacagagataagagtttgaaactctcatgctggacttttctcattttattatgaaagaggaacagtaaccctggccctttcctactaccgaagattttgtgaaaacagccgctgtacaatctctaggtaaaccataagaataatgtaaaactctccctcatctcctaatcagcttatatgtttcttaaattctctctggattctgtcctcttccctgcatctccatttcctgcacccaagcaggattctctcatcttcacaaactaatcttcctgccaccagtttgtcagcttttggctctgtttaccaccctgtgcctgtagccagagtaatcctcctacaatcccaaaatgtggtagacacagtgtttccactgccctattgtaaaccgcacacccgggacaggctaatgaagcctggtctgcccccactcctccagctctcctgctttaccattatctctggtagtaggcccatttcacatctcgggaacctcgggctcgctggggtggatttgcccaggatcacacagcgatcacacagatcctgagtctggaagctgcagactcccccctggtctagcctcagtgcccacgctctcaacagccattcatcttggaggcagacccctgcagccttagggctgtacagttttctgtcattttgtagattcctcattttggatgactgggtacatttacattggctgggactgaatctccattggctgagactgaatctcctttgtaccttcagcagattgagtaatagtggcctgtcaggcacaggggagttttggaaacaagtccgtgttttccttcccattacagcttgaaaacgtagtagtgtggtgttcacagtaaatggaaattgatggcttattctccccaaagataaagatggttaacgaaaaccaaactcaggagggaccttatttctgtcacttaactttctgtccagcccttgttaggccccaggagggtttctttgttggtatcagctgccagccggtttgagatccacttggcagagctaatttgaactggtttttggcctgatcttgcataggacactaacatcccaataaactgcagagattcaaatgtatttaccttcattcatcaacttggttattttattcaggaataaaagatcaaagtatttcagcagcgtttttcctcgtaagctgctgctgcgcatggtccctttatctctcagctttttatcattattttcatctcagtgcctttcattactttttaaaggaaaacgtcaggggcctgaaaattgtctaaagaacagcagtgtcatgatactgtggttctttacctccctgcacagtggtttcactcaggggagcactgggacactttaaaaaattaatgcctagggccgcaggggtgcgcctccaggaatgaatggttgttgagagcatgggctttgagtctagaccaggggtgagtctgcagcctccactgtgtgatcctgggcaaattaaccccagagagcctggggttcccaagatgtgaaatgggtcctgttttaggacctaatgtctggtcttacgacagatattcttatttaactgctcttggtgcagcctgggctttgggaatgttaaaaggacttcatggtggttccagtgttcagcaaaccctgagaagcattccacagggaagataataagtaggatttccattgttggtatggccaggggctgggagatcagattcttctcttcacttttaacaaagtggttcaggcatagagggcatttcagctcaactattatgtgctttgagtttgatgtatttttttttagtagtgttttattgttgtaaaccttgagacaggtctttatttttaagccatttttgaatggactacttggcagttttgtaagtaggtgaatcttcctgctttcaatgtggaatttttgaaattgcattagaaaaaacatgaaataagatacacttaatttgcctttgaagatagaatacaaattttgagaacatgtaattaacatctaattggtacacattaacatgagcattatagactttagttactgaagtttaatagcattatatgtattgcagatagaaatttcataagcattttcacagtgactaaacggacttatttttagaggttcttagcttctgcataattggaggctgtatgactaaggcaacattttgccaagtgcaggtaaagtcaagcctgaaactgggtaaaaactacctaagcgttttaactttctcctcctactgaaggggtagaaaagtgagacaaagatcttcaaggaaacttccagttccagaaggtccatgtctctgtgcctcctactcccagcctaaaagagtggctgtccacatgtggcccccagactgacagtgtcagcttcccttgggaactggattacaatgtaaattctgagaccccatctcaggactaaggaatgagaatctcttgggggctgggacacaggcatccgttttaacaagccctccaggtgattctgatgcaggctgaagtttgagaaccaatgctttaaaggaaacttgtagtttcacactgggaagcactgggatagacgagtggttctcagactctatggtgggggggtgggggcacctcacactctcctagtgattccaaaatgcacccgcatttggggtggaggcattccttttcagtgacgccaggtaaccataacttcagctcctccatggggtgcaggccacacctgctgtcatggcgggaggggtgaggagatggagtgttcaggaatcagaatacaccctgagtaagagcgtgcatgatgtcatacgctgtcacattaggtccctgataatgtatacattttcctttggcaggggaggcaaactgttatctctgccttcttagggttttttggctgggcctggaagtaaaccgacataaacagattaacaggagaaaagcatacatatttatttaatctaagttttacatgacatgagaggcctcataaagaaatgaagacccaaagaagctgttagaatttagcacatatattgagttggatgaagcaataaatgatgaaagggggcaaggcagtggggggctgggacgagggttcatcgtggagaagtgactaggaacacgaggatgagtttaacaaggtttgtttgtgtagatgtctgtcaggggcttcagctccccatctctggtgatcagaatagctttcttcttccaggtgcagggaggaaaccttccacttgggagttttaactcctgcttttaggaaagtcagagggcccttcctgcatctgctgctgttgttttttaaagtgtctttaacgcaaaaccatgaaatagaagagtggcatattttggggtagcgtgttctgaacttctccttcactttgaaattgaggctcacaaagcgtgggcctcaaacttctgagtttccctgagacccttctaggggatcctggatgtcaaaactctttgtgacttgccttttccactgtgttgacgttggtgtaaagccgtggtgggtaaaactggtaatgtcggcacacatgcagcaacatcagactgcactaatagtcactgtgttcctcagagccaggcactgtcactcactgtaaaaaagcaaagccaatttcacttgagaattttcctaacaaggcaggaaacattattgactttattgaatttcagctacaggacacatcttttgagtgttcagtgctatgaagtgggaatccctccttcattatacgggtgtacattgacagtcttcaggaagagcacttgtgagattgtttggtttgagcttacctacatgttttttctttcttcatgaaacatcatttttacttgaaagaatagctgacaaactggtttttcagactcggatatttggcagacatttttttcagaatgaagtaagactgacacttaaaaaaaaaaaaaacaaaaagctgatggccgggcgcggtggctcacgccagtaatcccagcactttgggaggccgaggcatgtggatcacgaggtcaggagatcgagaccatcctggctaacatggtgaaacttcatctctactaaaaatacaaaaaaaaaaaaattacctggacatggtggcgggcacctgtagtcccagctcctcgagaggctgaggcaagagaatcgcttgaacccgggaggcggaggttgcagtgagccgagatcacaccactgcactccagcctgggtgacagagtgagactgtctcaaaaaatataaataaataaataaataaataaataaatctgacaatatttgttgttgataataaattcaagctttcaagcaaaaataggattttggaaaacttgtatcgctactgtaagcttgacagtaacccagtacttaaagacttttctgatgagattggtgatgggtgatgttaatgggtatgatttgttgacattgtataatgaattgttcatattgtataatgaaacatgtcaacatttagaagatctgcataagtcagtgatgcttaaagtcatgcatgggtaaaagatccactcaaagtgcaaggtagaccaatagattttaaggtaacagggtatgaaaacttcaatactgtggtttcagagtgtacattgcaactaacattaaagaaattgccacttggaaagttctagtgcagtaataaatgatatccacaactatttggaaaagctatcaaaatactcttccctctttcatatatatttgtatgaggctggatttttttttcatgtgcttcaaggaaaacagcataaaacagtagattgaatacagaagtaggtatgagaatccagctgtcttttattaagcaagacattaaagaggaaatgtagaagtcaggccactctttgagttttcttgcagtgggtaggggaactatggttattttccatgaagattttatttatgtttgtatgtaatgagtttattattgttaagtttaatgaattagtaaaggaatatttttaaaatgttttagttttaatttaagatagtataattaatttatgtaaacctattttatgtttttaaatgtactgtttatattattacttcaatatcttgacataatttcaaataatatatttaaaatactttttaaatctctcagctttaatttctaagacagtcagtctaacgaatataacccacataagcagacactttttggagtcctcagtaattcttgaagagtatcaagagatcctaagaccccaaagtttgaacattgctgttttgaagggtcattggttcctttctctgaatttcagagtcatttgcatatcaccctcatttgtgctttgcaagctgagagagccctggactcagcagtgagagcccaggtagcagaggaaggagggctgagcgccttgaagcaaacacagccaaaggtcctggccaggagacagacatttcagtgtagctatgggaggcactgaggacccagggtgggtaggaactttgtgaagactccttctgtgatgttctcaccgtaaccactggtttatcacctactctagtaagttctcatttccattactcttcacaagaaaggatttaatattctcatttctagtcagttcaaccactattggatattgtagttttattctagtcattttaacctcctgatattcacattgccaaatttctgatgaagatttgaagtacattggtgtacttcacatttggcaatgtgacctttttgtcaccaccagcagccatagtttgtctttggatgtttgtcagttgcctgttaattacacaggttgtctgccattattcagtgggttgagtaaatgatgttaacaagagctacacatgagagagaagggatgatttaggaaggtagataaagaaacagtgataacacaaggagaaaatggatagggaaggtgaatattacagtgtcagtgtgacaccaccagaaatacctcagccaaaatgccctctatgcctgtactactttgttgaaagtgataaggagaagagcatttcagacctcatcgcccctgtcaacacaaacaatgacaattttacttctctgaacatctttatctgtcagatgaaaccagagatatcactggataggtacaaagtaaattcctttctttaaatactgattaatatttttatcctttaggctagtgacttttttacataagcataactacttacataggatgttattttaaagataatcatttgaaaatattcaaggtacaaacattatagttagctgattatttaatagaaaatgctagagttgatgctggttttctgtactgtttttttgaacagttcaaaaaacagtacactatgaacagtacagttcaaaaaacagtatagtacatattctaaatgtatacaagcagtgctatgcagcttaattgtggtgattggaaagggcacgtttccatgggaaactaattgttgtgacaataatttagcaggaattaggctctgaaaaggtttgtatgatcctttggtaattaattgcccattcccagtcattcatcatacttttttctcccttccttgttgttcttatgtaatgtccaattctgatttatgtactataggatgagaggcagcttagaatggtggatctgagggggcggggggggagagagagagagagagagagagagagagagagtgtgtgtgtgtgtgtgtgtgtgtgtgtgtctaaaagcaagcaagggggagaggtcacaagaaaaacgaaataacttattaattaggaccagtgagaggtttgaagggaaatggcttccttttttttttttttctgaggtggagtctcgctctgtcgccaggctggagtgcagtggcacgatctcggctcactgcaacctctgcctccccggttcaagtgattcccctgcctcagccctcagcctcccaagtagctggcactacaggtgtgtgccaccaaacctggctaattttttgtattttagtagagacggggtttcaccatgttggccaggatggtctcgatctcctgacctcatgatccacctgcctcggccccccaaagtgctgggattacaggcgtgagccgccatgcctggccaaggcaatggcttttttccagttctgtctgattctgaagtaagaaaaataaagtatttgacacaccataatttttgccaattttaggcaattaatatgtctgaaaatataaacaaaattcttttatagaaaagaattgttataatacctttccctgtaaaacttattcactggtatttatatagcagttctctctaatgagcccatcgcagtacttggtgatgactttttcctggcaagtttcatagaagaaatgagtttggtaaaaactaaattactcctgggtgacctgttagatctcttctgcttattttcatgttgttctcagaatgattactaaggtgatttagttagaaagtatatttaaaataattttatttagtttttgaaaaatttgtttgtggtttcttagcaggggtgtttcactgactgttccaaagcttccagcctgggcatggtattttaatggataacaaatcccttcccacctctgttctgtacttcatagcatgatggccacagtgctgacagcacttagcttccagtagtcattcgagagagtggctggcgtctctcttctggaagaaatgggacacatggtcccataccaactgtgcctttgcttagatctgccatcataggaacaagactttaacaaccagcagcagcagcaaaccagcattgaggctttctttttcccttttcaggcttctggctgtgatgggtcggagattcctgatgaagtgaagctgattgggtttgctcagttgagtgtcagctgatgtatgtcccttgatgtcaccctgatctgtcatgccccaccgccacccctactcccttcaaccctccctctttctgcccatttcctcccaccccctcactcccatttcctagcaaaatcagaagattgtgaagaggccggcttcaacaaaatgggataaaaaaataattttttaaaacttacaacactccgagttctgctttattctctagcaatccacagtacaagaacaagcaaatgccacagctgcacgactgttgctcatttttccaaaagctatttaatattcttagcaatcaatttggatatcccttaagtgaaaagaatctgaaatacactcaggtggtcttatttattggcaacaaaaggaattttctatccagaagcctatttctcctttcattgttgttatttctgttataatactttaattgtacatctgacaatactgcctcttttatgttgtatttagaaattaatatacttataaaattaagatttattagccaaacttgaattctagttttaaaactgactgtgaattttatttttcatatatttatgcattacacaccttagctataagaaaaaaagggttttgattatatgcttcttgcagttaatctcgttatttaaacaaaaagttttgggtctgtctttggagtatttgtaacttctaaattttgaaatgactgaattaggaatttggatgcttattcttttagtctgtttgcctaaaaaccaatttacaatctgactgtctcttgggagagggaggtgccttgcaaactttcacattaagaatgtgcctgaggctgctttactctggaatagtctcagatctaaaatttcctctatataaggtggcatatgttaagttttgcttcattggaccgtttagaatgctatgtaaaatgttgccattctgttagattgctaactatatacccatctctgatttggctctccttaagtgataggatttgttattctaaaggtgataaacttgaaaatatcagaatctgagttttacttgaaattttgcagaatacccaggtggagtgaaaattggaagggttttgtgcaatgactaaaaggtaaaacgctgttaaggttcaagaatcaatactttcaacccaagtagccctctgcttgactgtatattatggaactagtaaaccttaggattttgaaaattggagtctaatctttcaaggaggtgggctcccaggatggtaccattgctctttcctagctaaccctagatatggcagctctttaatgtacttcaaaaagcaaatatatattactaaggaaaaaaagttatttataattgccttgtcataattgttaaggtgttctagagccatttgcatacaatttaatgtaatttcattccattctattgtttacacaacgattactcgaagatgactgcaaaggtaaaaggaaaataaaagtgtattgcacaatgag

SEQ ID NO: 36254 - DNA, 37382 bp, Homo sapiens
gggctgagcggtggggcccgggcggggtgcgcgggccccgtcgccgggtctggggccctgagcagtgaaaggaaatactttgacagatttccaagaactttccaggaaaacggggcggggccccgcgagctgaccaatcgcgacgctgaaggtggagccgagcggtcggggagggccaatagcagcgcgtggacccggggctgaagctacccagaggggcaggtcggagagatcagtggggaaagaccgggtcggggaagttaaggaggggcccgggctcagcaacccgcgcccagattgccttctggcattctgcgtcgttggggaagggccctcttatctcgcggtggaactcgtggcagggcggggggcggagtcccgggcttgtcctccctgcgagcggctcctccaaggaggtctgtcggcgtgtgcaagcgccccgtgttgggacggccgctcctggaccctaggactctgtgtgtcgggtgtcggattgggtggcatggggtgagatctggagcgggacttagggcagggcggggtgcagaggacagttccagaaatgagtgggtccactgaggtcaagccggcggtcaccacagccagaaagatccagacaagaacgttttctttgaaagagttgaaggagaaagcacgccccaacttttcgaatcaggcagaccatccagtcttggctggcactggtttctggccggccctgccagtcaggggagaagagactacagatttgagaaagcaagcagagacagccccagatggcccggactctgggttggtaccacccccaccccccgccagaaaaaaaatgctgagagagagtcctgcaactcaaaacatagggagataatctgggagtagggtgatagaggttggggcgggatggcgggggcagagtagtaacactcgctcttatctacagggagtacttgctgcatttgatcctctacaactggtgttgctcccgttatgcggacagaagacagccccagggaacaaatgctaggaaatggcagggtaagagcttggtcccagctctgaatcagaagcccacgctcctaccaggaccctctccaccttttttcagttcactggattcactatggagcatcttgaaggactgtagggtctgtgaatctcctccaaacccttgggccagaagaactgtgggatttggagaggttgcagggtccactccccacccccatccccctcccagtgtgtgcccccagggtccccagaaaggagtctagctctgagatcctgggcagggatgacagacccctggccttgttgaagggcctgaacgatagcatccagggaagacagggctcagtttgctctgcccagaatggcagagggcaaaagaaacctgaaagcaaaaccctgtgaaactggggaaaaaacgttaagtttcagatttcagggcagtcacttctctgtagctttcctgaagggaagccgggcttcatgagtgcaactctgccagccccctcctgagttggccagaagccactttcttggaatgggggtaggggggatggataccttataacccactttgagggctgggatacctggatagcctgatatgcggcccctgtgtggaccactgacttgccagtaggaactgtccactgtctcattactatgaagacaaaaggactttgccgctgccaggcaacagagttacaattttgaacttgggtctcttatggggccaaatcccaagctctctaccaaaactatacttcttccccctcaccatgactattcaactgaacacttactatgtgtcaagcactctcagcaatttgcagcctcatgtcattgtcacaactaccacatattatctcctctttacaggtgagaaaactgaggcatggagaggttacaatataacttagatctcccagctggcaagtaatggtttaagccaggagcctacacacttcctcctacttcctctatgggtgctggtgatctgccgactcctagacatccagctttaaggtcctcagtgaagcttctctgcccccaggcctgtccatgtcagagcaccatgggtgtccctttgaaagtatctcctacaggtcagtgattatgcagtctatgtgtaaaccaaagggttccaagggttttggccttccaactatttttgtgtgtgtgtgaatatgacagcactgtgcacctcacctgcatgctgggaacagtgatgtgcccctgttctgccccaagtactaagttgggtccctctggccaacttagtacttaattctcctgccctggctgctccctagaaaccctggctctgattgctgggcccacactgccacctagcggtgccccctctcatgccctcactagccaaatttccatagattcttctcttctaggataatccctctcctgcaccccagggattgaacttactgcaagattcccctgccactccctacccagaacaatcacaagatgaatcacaagaatacacagcagtgccttcccaaaagtctcgctcatttggcctccatcctctcaccatgtacagcctcccctctccagtaaggacagagtgtgtgtgtgtgtgtgtgtgtgtgtgtgtgtgtgtgtgtgtaggatttagcccccctcactttaagctattccaaagtctctgtccccttggacacacagctacatgaagggctgtgtggcagagtctgccatcatgaacccactcctgaccagacctagccatcctgcatgccaaatcctcccatcattgtggaggggatgctgcaggtggttgctggaacatgagcactaagggaaaccacatattctgactttcctgggctaagtgagtagtttcaaggcatctctccgatggacccatgtggggaatgcgtgtgcctgtggaagcatggacactggttatagggactgggaggggagaagcagcacctttgccttacttttcatacttctgtataatttgaattaattacaatgaggaagttttacttatgcaacttaaaattttaataaaagagaccagcttaaaaaatacaattataaaatttgtagagcaattataatctaattccattttaaagaaagaagacatcttcacagaacattcagtgggatgcctttggctggggcaaggagccagcctccaccctcagctgcctagccttctgctcaccagaatgacatcttgctcagcctcaggttcaccaggctcaaactagttgccttcagagagcagagagccttctttggctccccccagcagtagaagattccagatcatagggctttcaaagaggctctgagatcttgaatcagattctcaggttgggctcagggacatcaatcctgggtccagctgggcataaatgcatgtgtgtgtgcacatgtgcatgtgtatctgtgtgcatgtgtgttatatgcatgtgtgtttatacgtgttatatgcatgtgtgtgcacatgtgtaaaggtgtgactgcatgtgtacatgtgtgagagtatgtttgcacatgtggctgtgtgaggagccagaaaggactaggagaggaggccatggtttgaggataagagcccagccctgaggttgtgctttggagttggaatgggggctctgtcatgacagctgctgacctcagacaggtcacttaacctctctgggcttttctgtcctgtgtgtctgtagtgtggggcagaagggatagtgtgacctcctctaggctctgtaaggtcagggggttgcagggagagcacattcccagcatctggtctgcaagaagtgttcactatggccagctgaggctattgtctggagcctcctgcttcactgaacactgctagcttgaaggttgcctgaaagaaataggggcagagccccaaccccatctccactcaacatctgcacacagtgggtacccactaataagttgtagcaccctttcagtcactcattcactcattcattgacagaagatcatctttccaagagctacttctctgatgagcctgcacatgcagcccaggggtccgtgagtgtgcgtgtgttaaccagaggggctgagggggaggcgctcactgggcctaaattccggagccaagagtaggatggctggaagacgcctctgagtggaaccgaggtcctggtacctgcagtcctgtagatggcctgtagatgacagcagaggcccatgcagagcccctgcgctgagccgcaccttcccagttccaagtgagccagctcgctcaggtccctcagcttccggattgggggagtgatgtgatgtgcgcaagtagttcagatctgtcccagaagacagccacagccaccctccctatggctctagacaagttgttttctccccaggggtcccagtttcctcatctgtgaaatgagagttgcttaacagccggtgttgggaaaactggctcaaaatacgtaaggtagtctaagatgggcttaacagagacttatatgtgcaaggcaaaactagaaagctaatggagaatatctgtcactcggatgggagacagagactttttaaacacgacgccaaaagcccaaaccataaggtgaaatgttggcggatctgatcaaatggcaactcgggatttctggtccccaggatgctgtatataccaaagggaagcagcgagtcaagggcataagcgggagctgcaaaaagggggcagtcgccagtgctggagactcccagagccaccagagactaaagagtggcgaattcaacaacgacaagatgccacctccctcggcatgtttaaaaagttgagtacgctgagggttggccaacactaggcaagtcggaagcctagcaagccatactggagggccacctggcagcgtgcagagcaaacacccgactcaaggagagctttcaagagaaataagacgtcctgcgctgtcacgttctaggttgcgagtaaaacccgggacccgcacagtagcggactgccagtacaggggcctccctgggtgtccctggaaaccgaggaagtaaccgccccctcgggaagccacgcctcctattttgttccggctcgggggcgggacccagccggggcccgcctggccctttaaggctgacctagcggggccccaagttgggatgacgcgcagggagcggggggtggagtgggggagtgggggaggggggggtggggaggggggggaggtcacgtgggcgccggcagcgcgactctcggccctgggatttctgcggccgccagctcccgcgaccgcctctcctgcccctcgccggtacctcagcaaggtgcgttgccgccaggtacgccctcgctgggccccctctgcggcctcctccggggacctcgcggccattaggcgcccggccccttcccttcttgacacgtgcccgggcggtgctcgcttgtaccccgccgcgcgaccaccgccccttgctgcacgtctgtactctcaggccgttcgtcccgcactcccagcttgccccgggctcgcagcccagcccagttcagaggctccaaggctggggtgtgttggaaaagtctgggcgggactcactcttcccctttcccccaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaaggtcagtgagccctcactgaggcctggggtatcctggagggtccacagcggaagcctgtgagtgaagctatgtctagcgcccctgctaagcttcctatgctcagcaacatgtttcatcgtcatactgtcctgtaaggtcaggcttgtggtcctccctacttcacagatggggaaactgaggcgtagcctagctaagctttgagtgtcccagtgagcaaggggtggagtcactatggctagagatgctgtatccggaagcagggaaggggtgactcctgactctgggattctggctggacccatgtgttcaggcccaaaggggatctcttgttcagcttggctgccccttccatgtgaagctcctctgactggaatggatctgtttccctttgctggaagctgagaccccaccaaggcttgggtgggactgcttcttccctgtggcccctgcctgtctgggctggagtggtgtgagcctcccagggctggccagaggacaaggctgatgcccactgcacctgtggagcctcaggaggctgctgatagactcctgacgagtcgctggtcccgtgttgaaagggacaggccctgggccaacccacccctggttcctgggcagagggcgggccagccatctagccacctcagactataggctccctggagacctggcatgctgatataggtggcatggtgggggtcagggggatgctgggggcgggtacctggttccagcttaaggcatacagttctgggcctagggccacaccccatacccagaatcccttgaatctgtcatctctggggtctttactcatttgtagcttgtgccaatggatgggtagagcatggcagggatagtggctcctggaggctagaagtacagcaaaggcccttctcattttacaaaagattttttttttttgaggcagagtctcactctgtcgccaggctggagtgcagtggcacaatctcagctcactgcaacctccacctcccaggttcaagcgattttactgcctcagcctcctgagtagctgggactacaggcgtgcgccaccacgcccagctaattttttgtatttttagtagagacagggtttcaccatgttggccaggatggtctcgatctcttgacctcgtgatctgcctgccttggcctcccaaagtgctgggattacaggcgtgagccaccgtgcccggcctttacacaagttttaattatgagtccaagtgcagagtcctctagatatggctaatagctatcctgtgtttgccagtttcatgaccttggatgatatcctagactctggaagccaggtttctgcatctattcatggggaaagataaggagttgttgtgaacatgaaatgagattatacatttaaagcacttggtacaggacctgatacaggtctggagaggttacaggacttatttaaggcacaaggtcttaaagcatctgagcagggagctggacccagctctctgtgtctttcccaggaccactagggccaacagaggaggttgtctccccggagtaccttggaggggaacatgcgggtgggtctaggagaggatcagggttgggctggtggggctgggccccaggtatagcttctttgcccactaacccagcagtcgaatggggtcggggagcttttcagagtatcaggaatgggattctctgagtcttttagggaaaaagtggctcttctgagggcagacgggggtaagaggatgaggaatgagagttttcatccccctctgggcactatttaaccttccacctgtgctaggattgagggcaggctgggtgggtgagggattgaggccagagacccacttcttaataccaaggctttgaccctgtgggccaagactgagctctgaccagcccctgtggtgtccagatgctgtgggtgagtcagggatggggtgggagaccagaatttgtaggcccacacagtgccagctttaagtaagactggacttaaccccttccccatagatgctatgtctgatgagtgacttggggtaacttctgactgcaagaacttccacagcacctcatcagtgctctccttgttctggactgggaattgggtcaggcctggagtggatttccctctgtacccctttatgggtgagcatggctaaggctactagcttgggaccttcaggatctggccctaaattggccctcaaaggggacatggattagatgtggctcccactccaggaccttcctgttcttagtatcactagtgaccaagcctagaagtccttacccagctaagcaggcatttactatctcccaatattgggctaagcacaacctctggtacagttattttacctgtcttgtgagtggtagctgtggccacgaggaggaaggtgacatctccccacttatagcttctgcccattgcccaggaagaccaggacctggggacctcagtacatgggcaggcctgggcccagggagcttagccagctcatgatggatcacagtcctctccttgcatctgcctagccctctccccgcagttgccccagctcagcctaggcaacagtcgtgggctctgtgtctttctgcctccctggtgatgtactccaggttaaccagggtggcctgtcctcatcttataacttgaccttgttcaggccatctctgcccatttgtctcatgctcatcctcttggctctgttgcccaagatggaagatagtgcttaacaggaagcctgaaactcagcaaacactcataaaacaggaagagctgtggccactgtccttgtaactgttgctattctgtggaggccctagaggagcaggtccctccctcccagggagctgggcctcttccgctttcccttagcccctgaccacctgcttggttcatcttggcctcagtcatactcagtggctccctcccaaggctaccttctgctgccagtgcagccattctactccattgtaccccaagccctcattgctgtcctcttggcaggaactggaggactgcctttcttggagagggtgtatgggccaggcggtcctccagtgtctgcttctcctgctgacctcttgcttgtgccctctcccaggcttaactagttaattagtaccttcagctttccctctaactgggcacagccctgcagatttgtcacacatcagttaccccaccacatccaagatccagtccttcaaactttatcacatacatgaaaattgggacccaaagtgagtcacacggtttgaagtggggggtgtagcagaggcccgaattttctcccctcctgacatcctgcccagccctcttgtggtttttggcctcttggcaggcagaagtgaccatggcacttagtatctctaaataaaagcaataggctgggtgcggtggcttgtgcctgtaatcccagcactttgggaggctgaggcaggaggatcatttgagtccaggagtttaagaccagtcttggcaacatggtaagacccttatctctacacaaaatttaaaaattagggctgggtatgatgacttatgcctgtaattccagcactttggctgaggcgggaggatcacttgaagtctggagctcgagaccaacctggccaacctggcaaaaccttgtctctactaaaaataaaaatacaaaaatttgctggacacagtggcgggcgcctgtaatcccagctactggggagactgaggcaggagaatcgcttgaacctgggaggcggaggttgcagtgagccgagatcacgccactgcactccagcctgggtgacagagtgaggctgtgtctcaaaaaaaaaaaaaaaaaaaaaaagtagccaggtgtggtggcacacacctgtagttccagctactcaagaggctgaggtggaaagatgattgctcgagcctaggggtttgaggctgcagtgagctgtggtcatgccactgtactccagcctgggtgacagagtgagacccatctcaaaaattgaaagaaagaaaagcaataaaaggccttatggagacataatggtggggtcttctttcctgcccctgtgttatggactgtggggctgggggctcttcccctctgacccctaaagcattttggaggctcttctaggctcccagtgccctcttcttcccttctttgttaaggagagtagagtggtggggtggtggatccacatgtccaggagacctctgcagagtcctctgggtcaagtctttgtagcagccatcttccttctggttcccaggatctggggaggttgctggggctgctgcctctgggacagtttccttccccttgatgccagttggcttccgtgagccaggctgctctgcatgtgggatctcagtgatgcctcaaagcacaacacagaagagggcatatttctcctgacagatgggaaactaagctctggagaccaggaggagatctcacagggatttgagattacacagggatgctgggacttggctgtgtatgttctgagcctctaactgtggcattcaaagtctctgcagtccagcccacctcccttttctactttaggtgacatctttccttctccagcactgaagaatttcttctcatctgtcaagactcagccccagtgccacctcttccaggaagctgcccagagttcctggctttggggcaatggaaccttctttgacccctttgataatactcccctttgattcaaagctcttttatagcacctaggcccaaggcctggcatatatcagagattcatgaatgcttatgaaaatgaccaggctctggcccctctgagctttggaaggagcatcaggagctggactttttccaggttgcaccttctccacaggagaggggttctttgattacagctcagagataagccacagagaaatgctatttctactctcctaagatctgggaattcacaatggaatctaacagttccactgcctcaatagacctcatggagaattcctgggagaaaggaaatgcccattcatgaggccatttctgctccctgcctgctgtccaggctgcacctctgagtagacagaggggctctgtataaccagaatgccaaaaggaagatagaacatgatggatgcagagactgggaagcaatggatccagagcccagtaccctggatgcctcactctccctggggggatggtgcccactgctccaagggtgaggctggcctgttggggctggtactgttgagctggatttgaagccaggtgaagctgccaggcaggccaggccctttttcatttggcagccatcatcccctcacctaccatctccagaccggtcagatcagcctctgcagggccacttgttagagtcaacaaatcaggaggcacatggagggactatgcagccggtacaatagagtccctggaaatagtttcactgccccctgggttctcccaacgctgctccttacctagaaggaaagaatctgaggagccagagtgttaactgccagggatgagcaatttgctttttcatgaagatcctggggagggcatcaaaccctacaaaatgcaaatagtggaattttaggcagaggttgattgttctgagatggttcgtaccgtgcctggctggccttgcttactgttttcgaagctgtgctcccagcctactctcaggatcacctctgctggggcttctaggatcttttcccatcccatctaggaactgatgccagctctccaggattcaggccttggtgctgtggattctgatacccccataaacggctaacagtttttcagagcattctgcccagcgggccctgtccacagtgcacaacaaggcacagaatgagttgtcttacctaactcttatcactcccattatatggatgaggttcagaggtcagcagcttgcccaaagtgctcaactagtgggtagcagggctgagctgtgagcctaggcagtttgatgccagagtcctagcatctaagtcatctcactcctcatgcaagtctgtggggacacgggagggtctctgagacttggtccttggaaagatgctggcattgtcctctctggctccactgggagccctggcagccccagctgggccctgagtgatgctgccagtgtctacctacatctgctcagtcctcctcactgtatggaactctgtgccagtgattggacaggtggcagtcccatgaggccagcacacaaggaccatgatgactgtgaaggccacctcagaaaggtcgtgtgccttttcccaggccttgtgagtctcagacaagtgcagctgggcagagcccagagcaccacgggcaggaaatcagactggtgagtgggcgagtggaaactgtatctgggctgggccagctaggagaggcttcctggaagaggttgccagtttaattcagacctctggtttgagaaggatgtggatgacagaggaaggcacagggtgtatgtgtgtgcctgtgtgtgtgtgcactcacgtgtgtgtgtgtgtgtgtgtatgtgtatgtgtgtgtgcatgtgtgtgacaatatgcctggtttagacattcagcacctgctgtggagtaccagtttcccactcgcagacctgtgttctggcaggatgtggttgacctcagcagggccggtgtcaaagtcctgacaaagactgggaagctgagggaggaccagaggaatctgtggaggaagaggcgtttgtgtagggccttgaagggtagagcaccattgctgagggtgctgcagggactcctgggtcacttgggctgttgttcagactatatgggaaggactcagttttcattacaacagaggtctgttgtatctcttctgagcttcacacctggggaagtggagttagatccctcattttcctctgctggggacatcatcatggaagatctctgggtggaggcagtagttggaacatctggctctgtaagcccgcaacctcccttggctccaggctgccatgtctaatggtgaaggcccatgggcaagagctgaggacatccctaggtgagaggcattccaagcatacctgtgccatgagagtgtgcacaaagcgcttcctggagagctggctctgctgctctcaggacagtgagaccatggctcctgtgagcactggtgttttccctggagaacattagttctactgctctccctccatctattggacatcttgtgtggtcccagatgaaaggccccatcttggggttgagagaggaacagtgctctcggcttaaaatgctttctgtgacattctccccaagtgactttggactaaaggcagtttcataatcttttgcaaaaccatcatctttgtggtgcagttgaaccctgggtttgaatatgtggtggggagtaggatccagtctcggtgactgttactatccctgcattcatgctatgagacaacataggccggcagacactcagaaggcagggctctcatttggggtggcctgggtgcatttgctggtgaaacattattggtttttatgaggactcacttgggtgcgccctgcacctggggaacccagccccttgagggacaggaaagaatggcgtgaagggagctctgggtcctgggctcctccccaccctcctgcccgtttggaactaagtggattaggccctgtgcaattgtgattaaaatcctgctgtgtgggaaccgtggaggtttggcttagagcaggaacacgaggctcccgtttggggaacaaggagcctcaggaggccctttcagcactagacaggccagagatgctgaaaagattgcttttgtttttgaggcgggtttgggattagggttgcctttttctttagactagggctttgtctttgctgccttctcctcatggcactagcgatctttctgtcctctgcctcctcgtccctctcatttctccttttccacctgtttctcctgctatcgctctgtccccgctctcccgggccttgccagtttgcctgtctcgtgtgtttcaggcctcatggcctcttttctgcagcctggcaggctgagggcaggcggaggacagagcagggccaggtcaggtgctaaggactcatcctggtcagcgggcagctcactcccccacccccaccccaggggagggtgggggtggggaaggaaggaggagtgagtgctgtacccatgccactcacagtgtcccctcctgctgcccgccttgaccaggtgtcagcagccttggcagtcagaacagtggactcaggagttcttgggctgagctgtaacctgaggaggtcccccgccacccccccatggcttgtgtgaagtcaacttcagctgcagtctctgctgttgggtctccttttacggcccaatggtctgagacttttgcttgggacaattgtgtgggactaggcacagtacgacccccaagggttccctagccacagtgaggtatagacagggctgagatctgacctgagtcagagccttagagccagccagaggagctggtgggagtctgggagggctcaaggtatgaggtgcaacctaccgccatttttacagagggcagagctgagtgtgagctgcacctgcactagctggtgtgaacactcaagactctctagctggcaccctgcacctgaccacccttgccctgctaaggctcagaggctacattcaggggcctgagggaccaggaccttgagctgccacactcatttccccattcttaagggttcagcctccacaagagacccatagctcatccacagatgctcacccaacattaacagcccccttctcaggatgtggtagaaggactggcaggtgttctccgtgctttctggcaggcagtggcacagggggcagggggatggcaataagggcacccacttgctgagtgcctcctacatgtcaggcacaaacactgcagaatcagaatggattatcacgcccatgccatggatgcagagacaggttcagaaaggcagagtaactcacccagggtcacgtagtatggacatggccctgtgctggaacccaggcctggctctcagccattcctctctgcgtgtgtgctcctctggggatcaggagccacagtctgctcatcagcaaaatgagagcctgggccgggcgcagtggctcatgcctgtaatcccagcactttgggaggctgacgcgggtggatcacctgaagtcaggagttcgagatcagcgtggtgaaaccccgtctctactaaaaatagaaaaattagctgggtgaggtggcacatgcttgtaataccagctacttgagaggctgaggcaggagaatcacttgaacccgggaaatggaggttgcagtgagctgagattgcgccattgcactctagcctgggagtcaagagtaaaactccatctcaaaaaaaaaaaaaaaaaaaaaatgagggcctgggtgctctgcttggcaaaggcctcccttttggctgtgaagacatgttaggtgggcaatgatcatcggcagtgccagggaagcaggcaggtcgtgggggcctgccttgcccactgctggtgctgatcttgcaagtagacagacagcatagagactggtcagagggtgccccaggatgcctctcccacaccagtcagcaaatggtgttgtcaggggaacatttggctatggtgatgccaccagcaagggctatattctgccagggtcaggagctctgagggttatgactcaggtttggagaccccttccgctgtacttcatggactaattaagtgcttgagtcaggctgagccagtaccagggtgtgtccttaccctaggcaggcccaggagagggggagtgagtcactgccgcctagtctcgtggcaggaacaggcagtgtccctcagagctgccaggccaccaccctggtcccctagagggcagggcctccccctcttcctcatagctatggctccatggtgtgatcagagactaggaaagccttctgggagtaggctgggtgtcggtgccttgggagtcctctggctgaacgtgagcaggaggggagaggggccaggggccaagggagactggaagcctggatggctagtgcccctgctacccctgggaggagcctgaggagagcgatggctgcctgtactcacccaggcctgtgtggggagctgcagagacatgaatgaagccaaaggatgagggagagatgctgagcagatatgagatagaaggtcagtgttgggggtggggatggaaggttccctagggcctctgtgccatgcctctgggggtgagccagtgtatctccccacgcccacttctgattcctttgtcatcactgtgacatctcctccaggcgagagagaccagctgtcattcttctgaaagctggagagttttgggtcccctctctccagagctggccagaggcctggcctgctgagtgcttcagcaggggtcacctaggcgtgacctcacttgccctggccacccctgctagggagggtggtatggccctttgttaccctgtgtcagctatgtgggcatcactgccacacaactggccagttgggggcacatatttcattgctgctgtggggtctcttcatgaagagagaccactgatgggacattatttctgagattacaacaaaacacttgtgtttgctaaaatgttccagtcttatgatgaaaatgtcctatttttacactgtcatagaagaaataaaaccagggtaaagtttcacagattatgtagctgattttgatagaaaaatccccttttcctctttgaagttaaaggaagataccagaacctggatcttctgagtatgtactcagggggctcacaggtggtctctgtggcctcccccggccctctgtgggaaggctgtgggcagaatcctgggatcccacacctgtcaggggcagagggagttgtgatcctgccactttctcactgtagaacctctgggggaggggaggaggccatagctgtctcagggcctctttccccagctataacacaggagccatgtgggaggagagtgggtgcccagttcacagatgcaagctggggcttgggaaggtgaaaggactggccatggtcacacattttgcaggagggacattgttcaaaaggatgcgcagagttgtcgaggggtgtaaaggtgtctgccacctgggagagtagggggctgccacaaagaagtgaagatgggccccctcctatagttgaccaagcttgagagctgggtgagttccctgttgtgggtttctgttctttcagtcttggttcccattccccagggtcgctcccctaagatcagccaccctctctccaccctggagggtcttccccttccttattgagcctttcacagcaaaacaggattcgtggactcaaggttcttggtccacctttgaagagcccagtctggctgtgcccctctgaggatatgagaccatttcctgtgacctgctgaattggagaggttctgcctcccccaggtccccaaggctgcacctagctttccctgaattctgggaaacaaggaggggaggagtgtaaggccatttcaggaagacccaggggaatcctaaagccaggggtccccaagcaaacccaggaactgttttcacccataccatcatggcccccaataccttcagtgtgcactggacaccaagttcatctgagctctttgtgtgtgctctcattccctccttgtggctccctgggaacaggagtattagcactatccccactttccagattgggcctgtgaggctcagagaggctgaatggcctgcccaaggccacaggggagttgggaatagacctggacccctgtggctgcagctagtcctgctgtgcatggtccctggtctggggcactgggaccctctagcactcacgttcccactgttcttccctcttccttcctgggagcctcgctcaggtccctctttctagaagcatttccctccactcttcccatcccccagacttagcatttcagcctttgtttccaggttgtctggggctggtgggaagcagaccaactgaggccatcaaaatttagtaaattggaggaatcttgtcttcctaagacttgatgatttcaaaatttgtgttggctatcctgtcccagagcttcctgggaagacactaggcttggaacctcagctactccctcccctcccaagaactctggtgagaagtggtcaggtggaggttcccagcctgtcaagctgccaccctgccccccatcaggtgtcctggccttggcctagaaggggagtggttgtttaggggtcctcctttcttgtgagttccctcagaaggggctggccttctccatcttgcctgttctgccaggttctggttctggaaagaaaggagaagggaagggaaggagccaggaccagtttcccaggtgtagatgtcatcatcaagcatcccagttggcagtgactcatccatagacccctaaatccttgaggacagagtgcccatggcagcattcccagtcccagtccaggtctagcccccagacagggccagtacatgtttgcaggagttgggaggggatctgtacatgggcaggcctgtacagttgaatcctggttcccaaagaactctgactcagtggtggccatgtgcaaaccacgtgacccagagaatccacaaagcctccctgaccctcagtttcctcatctgaaaatggtggctaacaatgcagttgttgaagggcaagagctaatgggtatgacatgcctggtacagggcggggctccgtgaacatctgccattgttgtaacagccaccgagtagcagggcctggtccagaccaggggcgtgggccaagctctcggaaggagtggcagggccttctctgtttgctttccccaggctggtgttgtggggatgagtgcctgctccaagccttgaagctgcatggaaaaggggtgaagcagctatacatggtccccagtcttgactctcactgcccagctgtgtgactttgggcaagtcacttaacctcccagaaggacatttccccacaggtagaagggcgctgctgatccttgttgggttatggtgaccactgtgtgaggtggcctctgcacagtactggcccagcaccagggacagactgttgtcctgtagggagcgctaatcccacctgactccatcattccctcagcacctacctggggcctggacgtttggggtcagtggtatcatgtgagccgccctccttggaaccgagcctctgaggaggagaggtaaatggacagggtgagacagaggacaggatgtggttggaacttaatgaagcgaggtctcatctggcaggaggccaactcatccatagctgcaaaattggttccattacctcctttaatgagctacgaaagctcggagaatgagtttgtgagagaataatggcacatgtctgcagctctgatttgaaactgtggctaaaaagttagatattacactaccttccagctctccaaatagcaccagtgcccttgtcgggagggagagggaggacatggggggcaggagcggggttctggcattataaggaagatgctgaagctttaagaaggaaaagtctgcttctgaactctgaattcagggtcaatcccatcctgacgtcttccctgcagagcagaggctgaggctgtgacccattctctgagtgggcaaagcagctcacaagggtcacactggctggcagggccgtgtgtgttaatagcccacacaggtgccagcagcactggcaggggtttcaacaactggctgtaaaataaattctgctattccagtggtgtctcttatatcatttgagatgtgatcctcatgggaaataatcccaaataatcatacaactgggagctgggagagatcttagagatggctgagtcgaagacttgtcaaggagggagtatggtaggttcaaagtgttttgtcttattcacggcctgcctctgtaagaataggggttcccaacaatgaaacctaaatttccctacaacattctctacagttttgctgcctgagatttcgtgttgagcacgtgcactgagatttaatcttcagcattctggcctgcctttgcctgaggctgggatgagacccttaggtgggacaggtgttggaggccatgctggtccctgctgctcctctcctatctgtcctctggcacaaaacaaagctggaatcccaagaaaataaaggtctggtgatgttacctcagcactcctggcccacatgccaggcgatagctgaggcatatgtgctggcctcagtcttcatggaggaatccatattagatatgttcatttgagtctgtgtcttttgcagaattgctgttgaaggtgttgccagaaggttttctcctatataaggtttgatgtgaaatcccttttagaatttcgtcctagaaaatgttcagtgaatatctgtgctcctcttcatgggggtaataaaagcagcagagcctaactggtttccttctttgcaagacttccaggaagctcagaattataatttgtcctcatttatagttatgaacttacatgggtttctggtgcattttgtctttttcttcattctaaagagaatctgctgtttttgtttggtttggcttctgtcttgttttagaattataaaatgtctgaaatactgttgttaataagcagggcttgcagaaataatggtgcttggagggcctcaaggggtggtgagaggaactagatccttggcctccaggaggaagttccctttgctgtagggctgatgtctctcatactgtgagttgtcacaaaatccagagcttcagcttcttaatttattactgcctcgttgatgggagagataagtcagctctcttaccccggaaacagtgggtgttctggcagaggccatacaacagcctggccggggctgcaggttaattggccaggggtatggaggttggggtttggctgcaagaggtgttggggaaactgcttgtccaagctggtagcctcggcgcttcctgtatgtgagagatggagatactgtgggcactttaacttgagaagagcccagcactggggtgagctggatggggacacccatgtgtgggtgggtggacctggatagggggcccttcctgggcgaggaagtggctggaggagggtgttggggactggttcccaagagtcactgcagacatcccagctttgttcgatctctaagaagacagacagagtgattttctagttctgggcaacaagaaatgttaggccctgccatggtgaccagtgggagaggaggtctgaatggaggcatctgggcttggtcaccttcttgcacaggctgtcttaggttgagttgtagcaataagaccccccaatgtttcttgggcacctctccgtggccagttctctgctaggtactttggagaagtagaaaatattagatgaacaaatggacagatggataaatcctgttctctgcgagttcaaagtcaatattgcagagactggagacacacatatgcccacgggcccacacacccacccccatactccccacacacccatgcacacacccctacacacgatgtatgcatgcatgcacacattcatgttcccatgcacacacacacacccacatgccctcctcatacccctacatatgcactcacccacgcactgatgtacacatttatttcagaacaagcttcctgagtcttgtgcaagctgtggatttggccagtgctgctccaacttggggccaccccctcctctcatctcccctcagggaggggttgtctgggtgctctctcaaaagtcctgttctccttcctcctccagccttgccatcctgcagccaggtggccacagggcaatgacttcatcctcccaagcccgtgtttcctcaatctgtaaattggggctaatggttcccaccctgcttgcctcacagggtggcaccaagcattcccatgagataagggacagcagagtgttttgtaaactgcaaattgttttccaaacaggcaaatggtgctgttgttttcccagctatggaactcaagaattcctccacccacaagtaaaccctgtccttgggtggaaagggatatagtggtgatagtgaggggcctggcctgttttgaggcccccacattccacctggtgatgctagaggggcacgggcccttctgctctcaaattttgctggggctcactagctggtgaagtcagtaggggtcttggccttctggctgctggctctgggggcaagagagagaatttggcaaaggaggatgaggggagaagggaaagtgaaaaccagtatatcagagcctgaggcctgtggtcactcgctaaaggaaacatcatctcaaattcaatgcttgttgagcttcagtggggacccacacctcaggtgcatggccaggaatccccttcctcaggaagaagcccagtttccacctcacaggggtgtgtgtatgtgtacgtctgtgtgtgtgtgtgaatgtgtgtctgtgtgtacctattgggcactagctggagctgtggagctgcccaagtgccatcacagaccctccagttctggtggacccctggggagctcagggaacataggagaggaatgaggcaagggtgggggcccgttgggttgtcagaaatcccctcctatcttcttcttctttttttttttttctgaggcaaagtcttattttcttgcccaggctggagtgcaatgatgcgatctcggctcactgcaacctccacttcccgggttcaagccattctcctgcctcagccttccaagtagctgggattacaggtgcgtaccaccacacccagctaatttttttgtatttttagtagagatggggtttcaccatgttggccaggttggtctcaaactcctgacctcaggtgatcctcccgcctcggtctcccaaaatgttaggattacaggcgtaagccaccgtgcttagccccttcctatcttcttgtcttcccagctgtgactgggaaccatgacatcattgcccatttcaggtagcccccagtgggctcaggcatgtggatatggaggccatggggacccagaggctgctccatgggggcaatgatgtgggagtggtactatggtaggtactttgcaaggaacgcctgtctagaagtctgccttgttacccacttatctcccccaccctatatagcccaagccctacagcttaactttggggaaacagaggcccagagaggaaaagggactggcctaaggtcatactgagaataggcatagaacctgggcctcctgtgtcctggccctgtgctcattctcatgcctgggaagatggagctcttactttgggacatcttttgtgaagaatagtgtggagtcatgtacctatgtgaaggaggccaacttgcagaaatgccttgtggaatggagcagtcatgatgggctccctggaagaggaggtaaagcctggttcaacagagagggtaggtgaggtacaggctgcccttgggcagcagggagaaagtttgccaggttgtcatgtctcccatttgttgagcctcactggggcctcctcaatttaatctttttttttttttttttttttttttttttgagatggagtttcattctgtcatctaggctgtagtgcagtggcacgatctcagctcactgcaacctccgcctcctgggttcaagtgattcttctgcctcagcctcctgagtagctggggttacagacgcacaccaccacactaactaatttttgtatttttagtagagatggggtttcaccatgtttgtcaggctggtctcaaactcctgatctcgtgatacacctgcctcagcctcccaaaatgctgggattacaggcgtcagccaccacgcctggccaatttaatcttatcttgtcctcatgataggttgtgagaggttttccccctcatccttactctatagatttattaaatctacaaatattgataggcacagtggctcatgcctacaatctcagtgcttcagaagccaaggcaggaggatcacttgagcctaggatttcgagaccagcctgggcaacatgataaaaccccgtctctaccaaaaaaaaaaaaaaaaaaaaaaaaaaccaaaaaaaaaaaaaattagccaggtgtggtggcatgcacctgtggtcccagctacttgggaggctgaggtgggagaatcattgagcccaggagatcaaggctgcagtgagctgtgactgtgtcactgcactccagcctgggtgacagagcaagattctgtctcaaaaaaaaaatctacaactattacctgagttagtgctctgtgtcaggccccgtatcccagtactgggacctagaggtggccaggcagactggccctgccctgtgggcccacagtctgatgagggaggctgctggtgttggcctggctgggggatcagccatgtgatttggggccagttacttcccctctctgtgcctcaatttctcatccaaaaagtggtgataatgaagtcctttcctcctaatgtttataaagtactccaaacagagccaggcacattgaaagtacaatatctgtatgtgtgtttttgcttaaagagttatcaaaggaacaagctaattgtatgttgtgagcaagtgctgcacaggaagtgaaaagggcgatgacgtgagagctttctggggagctaggaatgttttctgtcttgatggaagtttgggtcccaagggtgtgtgcaatcatcaaaactcattgaattggacccttgagacctgggcattttactatatgtcaattatacctcaataaacaaagcatatattgaaagaaagaaaaacaaaggatgaagagggagggcttctgagaggagatgacattgaggtggaccacattgaggggaggcctggaggagaaggctctggctatggggaaggaagatgagaaaactgaggctctaggaggttttgggctcagggtcaactcaaggggtcaggagagacagctcaggggatttcttggcagctggacctgggcccaggctgagggctctggctcctgtgatgtactctgcagagaggccagtggggcgtttattatattttccggggacggccctctcccctgtccctatgcctattttcagggctttggcgtttgtagagggactattttaatccatgtgggaaatgggttcctaaatatggactcagtggggcagaagccttgagaggctccagctcagggcagctccacctgctcctctacctcagcaaagcacaggatgcaggcccaggctggaaggctctccagcccctccttggccatctaccgccctccttctttccctctggctcctcctatctccctccagtcctgggcccatcctcccatcctttgtttgctcggaagcccagtgtttcctgccaggccccagccagggacccccaagtgaacttgacctgcctctgccctcaagctgctcccagggtggtaggaggaacagaagcaaaaccagtaagaaaggtgctgggaggggccgggcgtggtggctcacacctgtaatcccagcactttgggtgggtggatcacgaggtcaggagatcgagaccatcttggctaacacggtgaaaccccatctccactaaaaatgcaaaaaatagctgggcgtggtggcgggcacctgtagtcccagctactcgggaggctgaggcagaatgacgtgaacccgggaggcggagcttgcagtgagccgagatcgtgccactgcactccagcctgggtgacagagcaagactctgtctcaaaaaaaaaaaaaagaaaagaaaaagaaaaaaaggtgctgggaggactttccagagagagaaagagagagagagagagagagagagagagagatggagacagagagagagagagattgatcgatctgaattgagccctgaagtttccccaaaaagagggagttgacccaacagagaggatgaggcaagaatgcacatgacagggaccagcacagacctagacacagaggcctgggggagtaaggcctgtttgggaacaacatatatatttttctggccagaacaaagtggttttggcccagaggtggcaggaagtgaggtgggaaaggaaggcaagccctgcgtgctgggggaggacatttatctggaagatgtgaggaagtgtctgtggccacaggtggattagagtcataaggggagaggcagggctgaggaccctaatgaaagcattccagctgtgagcttggacttttaagagagaagaggaggactctgatgtgggagtgagatgccacaaggcaggcagtgaggagggagtgtgggagccagcctgggaggcctgacaggagatggtcaggtcagactggggaggagagaaccaggcagggggagggggaggaggcaaagaaggaacccggtgcagggagggaggatggtacctcttggctcctgtggctgaggattggggtacccctagctagggccgccacaggacatggtggaggcaagtggggggcactgagctttctggtcccagtgctgagaaagaagctggtgattgggaattgtgcgggcactaacctgaggggtgttctggaaggcaagggcagcatgagcaaggatccatggtgtccaggcaggagtgtctgcccacagcagccttgacgcacacccccagcctgctctgggtaatggagcaggggcacagagctgctagagggcttgtccagcccctggctctctgtattccttgcactgcctgtattcccaggctagggttgaggggagcagctccagaaaaggagggacagccaaggggcagcaggctcgagaaaccactgcctgcctctcccctctctgggacactgccctgacccagtttgtctttacctagagagcgtgcatggtcacagagcctgcccctaacagtgccctgtgtaaagtggcctggctctccccatcctgcagaggaggaaattaaggctggggcagcccagggtcctatggctgctgagcagtgctgatccgagccccggtcttgagcatcagccctggtccccagccctcctccattaggaaacacagtgtcacagatggtccttgagtgagcaaccctttttgggggtggcttgtccctgctgtccccattctgggccatctcctcatgcatgctgacttcttcttctccccctacagcagggccactgtgaggccttgttcatttctggtgctggttggcagccacagtccagggctgagttaacccgagcaaggatcctgatgcccgcccactggatgcttgccttggctgggatgcaccctgtggggatgactctgctattataccattttacagagttgtgggctgcagcttggagctgtgaatgtatgcctgaggtcacaccgagtcattggaggaattcaatcccaaacccacatctcactccactcagctgtcatctccctcaactagggtcctcccttcccccagtctctacctctgggtccttaccggtgatctgtaagcatggaatgagggtggaggctgggcagctaggtcaccttgagatggccccacctctctcacagtgcgatgacattgtcgccctggtactgcatagcagctcccaggaaggctataaagttaccttgggagctgggtactgactgggtggtcatgaccaagcaactcattttagaagcacttttcttggtagtgagagttttgttctcatgcccactcctggagaatctgaagtcttaattacttttacccctacaggagtgtggccttgtctccctccactctgggccagtttctttgtgggagatagattgacagacacaggcctcaacctctcctgcaggaagtcttccttctcactccagcactctcctgatcatgctgagtcctgtagggcagatttgcgtgttagtgcaccctctcccctccccagcctttccccagcaccttctgcttctacacttacatttctcatagatgcccagggtgagaatcacaagggaggcaccaagggcctactatgtaccaggtgctatcctgtacaatttacatgtacaatttccaaccctagcctaggaaatggaacagctgtgtcatccttatggtaaaaatgaggctcaagggatgtgtggcccctggcttggggtcccatggctgctgtgtgattagagtggggttataaaacccactcaatttccatctgagaagggaagcaagggcttctttggcctctgagcccctcgaagcagtcagccacctcctacggactccttgaactacctgccaagctgcttgagcccaggactgaccctcaagtccagaggctcactggaccacaagtcagagaaacctagattcaaattctcattctgctccttataagctgtgtgacctggggcaggtcacaggcctcagagcttatatgtttttgtctgcaaaatgatggtagagggctctgagcctgacactttctatgtgcacccacctacagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatggtatgctggcctgccctgtctccacaccccctcggcatccctgtggccctcaggctccctgccacgcttctaggggctttctttgtttttcaggtagcagatctgggtgccactgtagcccctgaggggcaatggagcaggcagccgcaggccctgcctgtggatctatggagttggccataaggacattccctcaagggtgggcaagaaaccacaggggttaatatggcctccctgagtgtgatttctactctgtgaggaggactggaagagctgtcagagaaggctcccaatccctgaatatggatggatgggggatttggggaagaacaggacccacgcagttccctcagctttctctccttttgacctgggtatgtgctcccatggtcccaccaggaactgggtgcttggggcctagaaccaggagccagtggccttttccaccctgggcttcttcctgtaacaccatggctcagcaccagccatccttggaccggttagccagttcttcagatttggggttcagatcctgcctctgctacccactagctatgtgaccgtgggcagctcttaacctctctgaatctctgtaactcagatgtaagatgtgggaaagatcttaatgtagcatttaccctgtgcttgactccattctaagtggcccatgtgtattgcatattcaatctgcatgactatggggttggtgctgtcatccctattatacaaaagagatagctgaggcacagagaggtgaaagaaccagcccaggatcacacaacagcgctcatgaaacgtggatcccagggcatggcacacagtaggtgcccagagaacagtggtcatatgatgataattaacatctcatcccacatttggggaaacagagacttgaatggggttgggagtacccaagccctcacagtcaggtaggggccgtgccactgggaacacacaggcttcttggcagggatcagagcccaccaccctcttctagttccaagagttcagttcaacccacctaagctgacaacccaccatgcaccaggttctacaagggacagggaggctgacagtggctgttcagtaggggaggagcggagcagcagggtctgaagcctgggcctatgatttggggcaggggcaagggtaggatgatgtgcagtttccccctctctgcttatagtcacctcttttacagcatggaaggtggtgagttgttcagcaggattcaggagcgtggcgaccaggctttcactgagagaggtatgtgcatgtagctggaccagcaggaggattcagggtgagaggtatggaccagagcgttgtgtgtgatgctaggcaagaccctgttcctctcagtcttcccatctgaataagaaagggtgagactcagtgtccatccccacaagggactctctgagtctgagacactttgtcgaacttggactctctatggctttgggatggaggcctcaaagcctcttgatgctgtctcgcagttgagctggggagaggtagctcaggactgaggaaagaagtttagatgggttgggggtatcctcggaggaaactggggtgtctggggtggcgtagacatcccgggatagagaacctggatagcaggagtgctgtcactgtcttcttgtcttgtgctggcctgttagactgtgtccaggagggatgatagggtgggggcttgacctttgactggcatcactgaccccctcctcctctgtttctgcagaagctgcagagataatgcgggatattggcactgccatccagtttctgcacagccataacattgcccaccgagatgtcaaggtgaggctccaggattcaggttgggggcccggggaagaggatattgtcccactccacaatccctgatggcatccaggacccactggatggaggccatgttccctagtcacattcaaagcctctgctctgtgtcccagactgcttttctcagcctcttctctagtttcagcatactcattctgttctcaccaggtgggtccccttgcttctttcaaacactgagtaatccaaatagtaataagaataactgactgcctgcctaaagccagcgggccctgacaagcaatctcatttcattctcacccagccttgtgagataagtgccattacccattttacagatgaggaaaacaaggctcagaaaaacattaagtgacttgcccaggggctgtgtagttgctgcactgggattcattcattcatttgtttacttgttcagcaagaaattttgtgtggatgcaatgtgccaggcctcaggcaggggctgcctgatgctgttggttttttttgttttgttttattttgttctgtttttttgagacagagtctcactctgtcacctaggctggagtgcagtggcgcaatctcggctcactgcagcttccgcctcccaggtttaagcgattctcctgcctcagcctcccaagtagctgggactacaggcgcacaccaccacacctggctaatttttgtatttttcgtagagatggggtttcaccatgttaggcaggttggtcttgaactcctgaccttaggtaatccgcccgcctcggcctcgaaaagtgctgggattacaggcgtgagccattccacctggccctgttgcggcttttgtgaagtcacagccatagctttgacagatcaggccccctgataccagcattttaagggaaagaagccatttgctgagccctggaggaaggaacagaggtagtgccagttgttgggccaccttccagtcttgaggctggaagctcagctctccaaatttcctatcctgggaggactgggtcttagaggtcatctggatcagatggatgaaatgcaaaccaaggcagcacacacatgcatgtgcacacaagcatgtgtgagcactatcagagcagagtctgctcctcctgggccctctgccccaagcctagaacgttaccttccttggcttatttcctcctcagactgggcagaggcgagctgaggttacagctgctgcataaggtcctccctctggctgagcaccccaacctgtaaatccttgctttatttggaccctggcttttttttcccgaagagagaaaagccttctgcagaggagattcccttgaatagactaaaactgcttctctgtttttatcacaattgagaaggtcagatcttctcaaatggaacctgagaaatagcatccattggttctaaaccaccaccccatccttctaccaacaccccatccttctaccccggctctgcttgggggtctcttctgcccctctccatgggcctacatcctacctaccattcattaaaaaccagtttcagggacagacctccctactgccctcatctgccaggcccctggctactcctgggacacaggaagattgcccctgtgcagctcctggggtctggggtctgagcaaccagggccttctcccctgagcaacctcagatggggctgtccttctagccctgtaggattcactctgggctgggtatgggacatgtgcttggcaatactgacttatgagcagcctgccttcccccagcacccttgctctagcatttcatggcaatgtcaccaactcaggatcagaagttcctgctccgaggctttctatggcacttggtcattcacagccttggctgagcacctgccttgcttccccttttgtgaatgaaggtagcaccttgggtttctctatatttggcccatgttagtgggcaaggcccgggtctttttataaatggacctggctccttctgcactgggatggagtcggggagtctggctgaagatcaccttggggctctgctcctgcctggttcctaactccaaaccaatgttttctctttctggcccagcctgaaaacctactctacacatctaaggagaaagacgcagtgcttaagctcaccgattttggctttgctaaggagaccacccaaaatgccctgcagacaccctgctatactccctattatgtgggtgagtccttcggacatgagttgtaactcctcaccccaacttatacagctgtattatggggtagccagtgggttgcagaaaccaaagggttaaagcccagcaaggagggagggggagaattctgtctgcatggaggcgggtgacgtggggggccggaggctgcaaaaatattctcccaaacttcagcttctgcttttgaaaatagatccaggaaaattctggctgtggcctgtgagctgaatgacatcacagcagctctaaatatatatgtgataaaaggctgccatcagcttgggacggagcccaaccgcggttgtttttctctagtttttgtcttcctgggattcatattcagaaagtgggcatgcatttcctcctaacttggagggacaaagggtaccagtcacctgccttgtgggagacggtcactaaagccagggcttggaggtgtgcacatactcatgcttcctggaaaagttcactgcccttctgcaagtgggcaacccccggatctgaaaatgttccttgccaaaactgccccctaacctgagagtggggtgatgacagagggcttttctccctcagaagaggtcttcctggagggctgctgaaggggtgggaagttccctgagacagttgaaatggcactctgttaactaggatgtgttttgcactaagtattttaacttagaaatcttctagcctacccacctcattgcacagggaagacaaaggctccatggattggtagccaagctgatgatggaatgcagagccctgtccctggttcttccttgcctgtgacctaggctatgcattcagggaggcaagggacacaggacagctggcaggccaagaccctctcacctacggtagcttcccaccaagccccagactggccttctcttctcttctttcaccaaggttgagactggtagaggggctcaggcccaagggagctaggggtatgtctgaaagtggttgatttttttccaggagctttctcctcccccaacttcacacacatgctgcctttccaaaaggtgccagacgccagtctgctctgccctacctcccagcccaggtacctgctccccaccttgcccaggctttaggctcctgcctgggctccaagacccttgggtctgagagccctgctgtccctctgccctggcagcccctgaggtcctgggtccagagaagtatgacaagtcatgtgacatgtggtccctgggtgtcatcatgtacatcctgtgagtaccttccccaccccctgcctccatctcctgcccttacccccactgtgagccctcaggaccacttctgtccccccacccccatgtccttggtgaggagcttgtgtgtgtcactcctcatgcaggctgcccttcccttttggtcatgggacaccactccttcaggtgcctgagggtctccccatgccaagggctgatggcattcctgggatgtgcctgggagtccggagggctggtattattgctatggtgtctggttgtctgtctccccagtcaggggcttttgaggggaaatgggtccaccctggcactgctcccaccctatgccaaatgacttaccccttcccccagcctttgtggcttcccacccttctactccaacacgggccaggccatctccccggggatgaagaggaggattcgcctgggccagtacggcttccccaatcctgagtggtcagaagtctctgaggatggtgagtgaacctctctgtcccagcctgactcacctggcccctgcggctttcattctgggaaacatcactttggtgtcaaactgacctgtgttcaaatcttggctccccctctttccagctatgggaccctaggcaagtcccctaaccttcttgagcctcagtttctacatctgccaaacaggctcaaaacttgcctcctcaaaactccctctaactcctattcctcattcatattttcccctttgaggaccacaaacaaggctgccctgtatgagttatctactgctgcttaaccaattatcctgaacacttagtgtttcaaaacaagaaatagttgttagctcactctttctgtgggttgggaatttgggagcacatgcagcccctgccccagcagagcttgtggtctgtggggaagggtggaggggctggctctgcaatctcatctctcccctctcttccctggcccccctagccaagcagctgatccgcctcctgttgaagacagaccccacagagaggctgaccatcactcagttcatgaaccacccctggatcaacgtgagcccctcctcctcccatggcaggcagggtgtccaacaggagtggggctgccgggcaggagggtggtggctctgctttgaggccccagtgcagggctggaatgggcccatgcacacaggtagatactagggcctcacctacaacctggctttgtcactgccctagtgaggctccttccccaccctgagccttggtttttccatctgagtctgggagaagaggatggagtagggggaaccagtgctgtcccaggtgcctccagtttctaatccacgggcgtggggctccttccagcaatcgatggtagtgccacagaccccactccacacggcccgagtgctgcaggaggacaaagaccactgggacgaagtcaaggtgggtgggctctgcctcagtctcaatacaggtgccaggatttgggcaaaagggacttcaggggggtggctacccagggtctggggtctttggcccctttctatacctggagcacagggtgtcagtgactgtcgcagtggtccaaccatggcactccaaggattgggcctcactacgccattcagtgtggtgctcctggctcacttcctcaatgaaacggggctttggtaccaagcttggatgatgacctctcttataaccaacaacatttgggagggtggtcagcctggtttagacccagcagaggccacgtttgaacatatggagtagcagctccagtggcacaatctccaggccccagtgcgctggttgcccagcgagatggcattctctgcaggtcttgtggttctgtggtggaactggtttagttcactatcccacttacccttggtgtggtccgagggagtaactctccttttgtgccttagtgaataagctcagtgtctaccacagaggacggtagtgaggatcatgtgatgcaaagggcttggcccagtgctgggcacacagtgggcacagaggcagcacaggctgtcactgacattaaggggctgcccaggcaggggggtgatggttcctaaggtcagtacatcctgacctcttagtgcccaccatcctgtctgtccccaggaggagatgaccagtgccttggccactatgcgggtagactacgaccaggtgaagatcaaggacctgaagacctctaacaaccggctcctcaacaagaggagaaaaaagcaggcaggcagctcctctgcctcacagggctgcaacaaccagtagctcatggggccttggaggagcctggcctctcagcctgcataacagactgaaatgtgctcaggccctggccaggagggcccagggtcattcttttaacaaaaggattattttgttgtgttttaatttgtcactcggaacttcaggatggaggaccctgaccctaaacctccttcagatctctggcccaggctcaagccctagagatgggcagggcctaggggctgggagctgcctgctgccatagcagcacctttagctaggttggcccgagtgaggcctctgtgctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaatgctgagtgagcgagtaagggaggaggggcgattgagggttcacctctgccttggggaggctgatttctcacacactggctggccctctcattctcactcctccttgggccctgaggctgctggatccggtctgcctgcctccctgtgcagtccagccctgccttgctgcagccccagcccagatggcactcagcgctctcccctgagggagtccctgggcctagccatcccctcactattcccgacccaaagggtgacttttcatctgaacttaaggtgggagatatttttaacttttttccactttggaaaatgtcactgtgacaaaagccagcatactttccctgcacccatctgctcaccagatctcaggcaggaaagcccctctctgttgaagtcaggggctatcttttggtatacttgtgtgaaagtggctggttgggagcagagctaagtggcttcccattaacctgaggtctctttctttactctgggtcagacctgaggttggggaaggcgactgagccatgctcagaatgtctggtcctggcttgggcctgagtagggcagagagggcctttcctggctgatcagagcttaccagccccaccccaccatggtagccttagggtgctgagtgcctgatactgcctgacaagtgcctgacacgcagcctagttccttcctggcccctctctcactggctgggaaaccctagaccatgtcagataggacaacactgctgggttttacatccagatagtaataaacaccatttcatcattt

SEQ ID NO: 36255 - DNA, 37382 bp, Homo sapiens; identical to SEQ ID NO: 36254

SEQ ID NO: 36256 - DNA, 38197 bp, Homo sapiens
gagccgccgccgggtcccgctcgtctgccgcctcagcctcagccccaacctcagccgccgccgttgcgcttgctcccgggcggtcctggcctgtgccgccgccgcccccagcgtcggagccatggcgggcgccgcgtccccttgcgccaacggctgcgggcccggcgcgccctcggacgccgaggtgctgcacctctgccgcagcctcgaggtgggcaccgtcatgactttgttctactccaagaagtcgcagcgacccgagcggaagaccttccaggtcaagctggagacgcgccagatcacgtggagccggggcgccgacaagatcgagggggccagtaagtgcgcccacttcctgcctgggcccgccccgcgcgggggtcgtgggagcccggcccgactgcttgcaccccggccggccgccccagcgacttgggcaaactttcgggccctcccagactccctccgggccccgcccccgcttcgtctcgggtggtcactgggggcggggggcatccgggtcctcggtcacctgacaggacaccccccctcccccagctggggggagtgttccaggcgctttgccctgaggcctaaaaatcctcgcgggctggagacctgcggtgcaggcatcgggccccccagaccctgggagtggtggcggcgtcggcgaggggagctaaggcagtggcccccaccctgcacgggaacctggggcctgaccagacggtccccgcccactctttatccagaaagagcagtctgtgaaactctccgggcccccaggctgggctcttatttgcaaaggaatctttgggttccctaagtagaacttaggcagatgttgggtagggctggtcttggagcagagctgggcctactcatctccctctgggggagagggaggaaggtggtcttgtttggtttggagaagcctgagagaagccagtggctggaatttttttttttttttttctgctacttttgtcccaaagctgggttttggaggcctatgtgggtgggcagacactcaatgccagggcagggactccccttgccctgggaagcacgttcccaggagatgggccccataaaggcctgccccagcgccttggagtcaggtattcttctcaggagtgcagctagtttgtgagtctagccctttgtcctctgtccggtggcttcagggagcgggagcggcttctcttagtttcctgccttttcgccttcccaggcctgagcttggctgcttttgcgctggtctctagtgggaggagggagttgggggattttgaaaaaccccagatctttgagagttgttccacttagcgcgtgcctgtgctgtggtcggatgggcactctgctctgccctccattcccccgcctctcagtgtgaagagatggtgtgtctgcaactctagactgggttgcttcttgcagggacccccggagactagggttagagagacccaggctcagaaccaggtctgtgtgaaggagggagatcaggaagtgacaccccaagggggggtcccacaaaccttcttgggtatggtgtgcatgtgtgtagatagttgaggagattgggaggaaggaaggtcttgtggtgaggcagccaaccatcctcagctacaaactccagatctgacacagatctaatgcagctgctcaacttagaaatggcagcccccttcctcagtgcccccactgaccctgtcagccattgggagaacattttagtgacttgagagcctgtggattccaaagtaaaggaagaatcgacactgcaaagagctgagataaccctgggaacatcactcaggcatcaggctccaggcatggtccccttccttactccctatgctgtgttgagttggtggcactggctggaagttctcagagatctcctgggtaacagactgcattttaaaccacgcatattagcaggcaataaatgtagcacagtggttgatggcaagtctggatttgaagcccatatattcattgtgtgtttcccggccagttacttaccttctctgagccttgatttcctcatgtgtaaaatgggggtaataatatatccagtatatatggttgctccaggatcaaatgagacaattcatataaaacatctagcattgtctgacacataaatgtttaataaatatgagctgttattagcaataacattaacaatagaccgtggctgcccttcaagaccctgaactgggaatggtgagggggtgaggtgtggctataggtgaggatgaaggtgcaggaagggaggaggacggtgaccaaattcacatttcacttagattgctactcagaaaaaggcaggaaacagttttgttttgccccaacccatgtgcccactcacccacccaccatgtagaacagtgtttctgtagagaaagtgtttgcagttgtgcacatttgactcctgggtgtgacctttcttgtttgtaagttggggcctgaacagaaaagaggggtgcagagaggggatgatttatcatgcctcatgtatttgggggatggaggcaggcatacagaggacctgataaccccctacccaggggtgagcaggtgggtcagccagaggtgtacaaattcagtgatctcatcagttagctgggatttaacaggcctggagagtaggcagaggatgtaggaggaccctggcttttggattttgggggctcagattgaaaagagcctggatgaaaagtctggtcgatgcttgtgtgttcagacttaactaatggaggcttccactgaagccgtgccctgcttctacccattcgtgggctctccttgttggtgggttctgatccctgcggcctctgaggaggttggactgccagccgggttttctgccacctggactcttgcccaagcacctcaggtatctggcctttcctgctgaccctaccagggtaccagcagtgcctgaagcctggcctaagagagagacactgtgctaccttcagggtgttggtagacctgagggagagacagtgtggtttaaggagcactcatactgatatgtaagaccttcttctgccctgactctgtgccctctcttgtcagcagttgtgaaatggagctgacacctcctgatttctagggtggtcatttggctcaaaagcggggtggggaagtgcttaggtgttgacaagtttggttgtcctggtggtatgacaggaaccaggttggtgtttggccttttatgttgcagatactgacataaatgaataaaatgcagttatgtagagttccagctgagtgctattgagacctttcgtcccattttacagatgagcaaatggaaatggagaatcgtttgtgcccaaggtgttgtgtcagtgtgtgccagggcctcagctggggccagctcactagtcagaggctgactagcaaccccaagcccatgttccctgtggtccacgtggctcctctgtgagacacctttgtgctcagaccatgcattacagggcaaagaccactttggcttttgtatcccaagacagcctcagcctctctaggctctggctccacactttttcttctggtgttttctgagttgagatggttcagactcgtgtttaatgaggttgtccatttgagggtctttgtgggcccagtaaacactggtgtagacactgtggaggtactctgaatactggctgagcatgtccatggggacttctgaggccccaggcttctgtctttggctgatccttcactagatacttttctagatgccaggccctctgaggtgaaggagtatgggtgcttgcttttagggaaatgaaaacaggcaatgacaattgtgagcagtacctttgatgaagagggtgagggtggcggaagaaaacagctaactgccttgatgaggcaggcgggctcagaagggaggtagtagtggaaccagctggctggggcttgacccctgtggctggggagcagaccacaccaggaggcctgctccgagggctaggcccacagcacgggagagggcaaggcccaggccggtgtcatcaagggttttctttgtactggctgttactcccagtgggagaggggcaggagcacatgtccggatctccagagctagccatccctgcctgtgtatttcctgtctgatgtagttttttccaagggaagtcagaccttttagtgtttcctcagcaccccaggcttgccccgatgtgtgggtttccaggcccccccgcccagctgggatcctctgtttcctgtgaacctaggaaaagggcctgcttcacagataactggaggagctgagcacacccagtcctgggacccacaacacctccagcttctctccagactcttgtgtgtgtgtgtacacagatgcacaggattcagttggagtttagagatcttggctaccagctttgctctgggtagcttcttggaatgaggcacatttattaatatttgcaataagtattattatacctccccatttgcccagtgctaggcaccaaggattcaaaagtttattgagacatggtttgtgccattgatgaactcttggaaaagacagatgtagaggcatatgattataaccctgtgtgttacataccataatataaaggcctctaccaagaactgtgaggagctctgccaggaaggcattaaaggagaggtgacctttgaggtaggccttgaattactgaggcacctgtctgtgccgaggctaaggaactgggaatcactctgtgcaggggtagggaacagatatggtgtggtagagaggaagctgggactggttggagacagctatagccctagtgtgccatgtccagcagattacactcagtcctggaggcgacgggagtcagcggaggctgttgtgggactgacttgcctctgcctgggagaccacagtggcagtggtttgtcaggcaggtgttggggagggaggccagtgagctcctacggtttgcacagtttgcaggagagagctgctgagggcccagacaagaccttcttgctgaggcagggtggggatgccatggtggtagatgggagaagggctgggtcttgaggggtgagacagagcttagtagttaagcatttgggccctagactctgcttgaattaaaatcctgttgtgcagcttacttgctctgtgaccttaaagcatatgactacctctctgggctgcttatctgtaaaaaggatagtattaaatggcatttattttataaggtttttgtgaggatttgatgagaacctgtataaagtgcttagcacctgtataaagtgcttagcatggagtgtggcacagtgtaagtgcttactacgtaggatccctgacaggacagagatgaggattaagttctcaggaggacctggtggggaggagttcgaatgcacctgctgtcctaaggggctggtgcctggccaccaagccctttgattcagaggcaaggaggcccgcccatcctctcttgcagctctcagcagtccctctattgtcagggctctttcccactgctggttttgcagggagacagggcagttggctggaagcagctgctttgggtggtaaccccttctgtagagtgaaggtatgatattgtcctatttctaagtgcctagcccaggacgctatctggagagatcttgtctttgaggaagtgctctaatgccacagcctcgatgtggtagggcctgcctctgctgtcactgttctgtgtcagtctccgttaactcacagcatctcttcttactctgtgccttttcctgtgggatgtggcttcaaggagaccacagatgataagttggaggaagggagtgaggcctgagattgcaaaggtgtgatattaggagactgatttttccccctttccacttgctttgttagaactagagaagtcactgcagactgtgaggagagtcctaggagagatgggtgtgggataggaggatgggaatgttctggtgccccttgtagagtgccttgttgagaggagcatgggaacagtgcgtccttggagggaatctctgagagcagcatgtttacaggtggcaagactcaaggtggagccacgggtgaggagtggcttcaggctaccattgaccagatagtcccaccttgctggtaattgagctgaagtgcctggagatttgtggctagagctggtcagatttgggttcaggtctcagctcttactgtgaccttgggcagattacttttccctgtctgaaattgatctttagctgtaaaagtaatttctcctcacagagctgtatattaataataagggagattatatataagagtaagagattttatgtgaaaactacccagcacaacatttgtcacttagtggccacttaacagtattcatttcctttactctcacctttgttaaccacagagctccaatcttttccaccactaagctcggccacaagtggctgctccaacaacctgggctaggagtctgtttcctacttgctttctgtgttccttccctgagtctgtacacagaggactggggcatcaaaaaactctggaattggaatagcatattgggagttcatggaacattttctcacctgttgtattgtttgaacttcacagcagctccatgaatccatggagggcaggagttactatccctctcttacagaggagaaaaccaagccctaagggtaaggtcacatagcaagttcatggcagatcctaggatttcagattcctgctatagtattcagtttattctcccattctggggaaaatgataataggatggaccgttctataggaacagagggttattttgttttgttttgtttttcttccctctggccacatgtgtttgaccagcctagacttccatctgtggacaagctggactcattgcctcaatttcaaaacccgtcctgcactcatccttgccacaacaccggtgtcgagatgcttggcccacccagacctttcccacactcctacatgggggtgaatgtagccgctgattgggggtgggacacagaagagcctcaccctcttgactttctggtttgtggtgacacttccgcctaagcttctacagaacatgggaacctggggctccatgccccaaatatcctgagaagggcttttccaggattctctatgacaactcaagagcatgcattcattcatgtgctctttaatttgtcatacatttgttgtgggccttgctactgtgtgttgggcacactgagctggatgtgattactccagcctctgacttgttcatggtggcagtagatctctagcgtggtttgtgttccatctcaccatacctactctccttaaaaaaaaacaaaaaactagctttcttgggcctcagtggctcattgaataagtgagagacgacttgtgcttccctggctttagactctggcatttgctaactgtgccaagcactgtggagaccagtagtggacataaggttagggtagatacagccagaaaggagataaataggcagacagataaaattcttataggatttggtgagttctatgaaggaaataaggcaagaggctgctctgtcagggtaggtgagggtgtgctgtgataacaaatgatgcccacatatcaatggctggcaacaaggaaggttaatttcccctgtttgctatgtgtgctaacctacaccaccgtccctggagagtggcctcagtggttctgggtgaggcctctagtacagaacctgaacaccctgggcaaactaggctggagagggatttggagtatggaggtttagaaggaattaatttctatgacttaggatgcatgtggtgagtgtggctttgctgttgtggtagagtagagtgctgcctgtgtgggtcaagagactgtcttggctgacatctttgaaataggtatatttgtgtggcccttgcctaattgtcatctctgccatagctgcccccgccttccccaccaacccatggccctacttgagctgcctgctgagcctactctgttgtggccacagtatcctcctgctgcccagagtttgagtttctcgctacttctgccactcatcacacttgcttcccagagctttgctgggtgtgctgaagtctccagagaaagtggggaatatgggtgcctagagacttctagggggtgttttcagcccctagagagtagagaagtgtgagaaggggttggtccccgaatattctgtagttttggggaagaagcaatggggacagtggagttggttgccttaagagaggctatggtcccaagagatgggacttggagagtctctacttgcattcctggctaagcccttaatattctcgcacccctccttgcaagactagttccttttgaggtggttcttggctagcttttgagaggctgcagtggctgtgtgcccaggcttaagtcctagctttctccccactctttacctcctaggaaccgggcccatcctgggggaggcagggaggagctcctttttatagtccacatgtaggctttgtgtataggctctgctgcttccttccggccctggcccttcctggtgttggccggtggccctggcttcagcaagactcaggatgcagagtaaacggggcagggcgttctcctacagaagactggcatccctttttactgagcccaggcctggcacagaggaggctggagttaggaagcaagaaaacgaggtgacccagtccttgatcctgagaagcttgtgatctggaccatgcagaaaaccgctaatgcccagggctggcaggagacagctgtgcctaaagtgctgtaggctgggcctgagggccaagatggaatcgcttttctccctgtagcagcccatcctaccccctggggtccctccacctgccagctggcacacaggtgttgggtaaagcatctgtacaaaggctgtgaggggcctgggcgcaaggcagcaaggcttgggtacggaggagagtgggtggtcttactgatgttctgggccctgacagtgaacagctggccaaactggtgaggagttgggccatggcgagtttggccacttgtttgtgtgtgtttagttcttcctgggcacaggtggggagttcactttggggttggcttcctgttttcttggacacctggggatatggttgagttaaaatgttctgagggaaatgattgttgagggcatgggcttgggtcatagtgtccttggcttggccttgcccatggtaggagtcgggtattgaccacactgggttctggctgtgtaggtgtggatgtgtggtgggagaattccaaccccaccttgacttcagcctaaggcccagagagtgtgggcctgagttcacagggtgactaaccctaggaaggagtgaaggagagctccagttggccataggtcccacaggtttctcagcttacttgggggcaggaggtgagctaaggaatacaactccattccctcagttgggaggttgggcagcgatgggggcaggggtgatggtccttctctgaggcactgaagacccactttatggtcaccctattctgcctgatagtccaccacctgtttggaggcagctcccctcttcctgccctagtcacttcctccaccttcaacagtaattgagtataatgtgcctgtgttagcttgtccatcctaactgggactgtggccttttcttgggcgttcttagcatatctaccaaggaggttggaaaaggtaacatatgtcactttgttaaggattttgctgagggccttttgaggccagcagtgaaacacagagcattccctccagtgagaacagaatgtctgttgccagactgatcacaagaggatggcctggttctggcctgagaactggtctacaccggaagcatgaagctccatacaatcatgtgtgctagtaaagtttgggcaagcagctgtcctaagcaggtaaaacgataggttattcaacttcaacttcagagaaagaaatccaaggtagccatctctctcagtaggggaggtgagttcaaagaatttaagctgggctgggcacggtggctcacgcctgtaatcccagcactttgggaggccaaggtagggggatcacgaggtcaggagttcaagaccagcctggctaagatggtgaaatcccatctctactaaaaatacaaaaattaaccaggcgtggtgtcaggcgcctgtaacccagctactcaggaagctgaggcaggataattgcttgaacccgggaggcagaggttgcagtgagccaagatcgcgccattgcactccagcctgggtgacagagcaagactctgtctctttaaaaaaaaaaaaaaatttaagctgggctttctgggcaggcagtgagtgaatgagatccctggcaccttggagtgagatcagagtctagatcactcactggggccctgtttcccaggaagcaaaaagggaacaggagagtggcttggcttgggctggcatggcgcaaagggagtgcagccagatgctgtggcggctgggtcaagtagctctaaaacaggagagcctagtgggttctgctgaagcaggatgtctcagcaagcaggcctctgacctgacgacttccggtcattatttagaacgtctccagccccacagatttactctgttggaggcttaaggactaaaccaacatttactgtccaagaggtggcagtaacacagaaaccaaagaggcaggaaccaaggttggggtggtgagatgtcatggggttcagggagtggcagaggggaaggcctctattctccctttcccacttgtctccctacctcagcccctgttgctctgacgcttcccccaccactatgagtcctaggcccctgttgtttccttgtaggagggagaccccagatttttatttcttctcccaacccattccatttcctctcccttgtgagagggctctgcagagacagggcagcagagagagacttggagatatgctgggctgtggtcaggagggcctcatttatctagtgagcaggaacaggttatatagcagtgatgctttcatagtatttttcttgaataaggtccccaaaaccttattaagttcctggtaggcatggagcattgaagatggcagacatggtgcagtctctcaaggagtttacgctctagtggagaaaacaatcagacagccttaaaatacatgtatggctactataataaatactgtgaagcaggagtgcaccacgaaacctggagtcctctccatcctccccttctgtctgtgctggccctgcttggccacttccaacaaggattctgaggcattacagagcacacgtctagggtacaggcagtcttggctttgaagtattgttggctttgccactcaccaactgccaccttaggtaagttaattaacctctttgtgctcaatttcctcactcgggaattggggaccctaatacttacttcatagtgttatttgcaagtataaaatataaggcagtttttatcgttgtaaggcagtcttatcaagagctttatgcaatgtctatgcaaagtaaatatgcaagaaattagtgttaggatgccagatgctgctgttgctcatcgtctcttcccacccagcagaggtagtaactacttcatcctctacttctcagcttcttatagtatttgtctgtggactctaacgtaagctatctagcataatactcatatctaatttttccttccacattcaagctccttgaggtacttgtattccaagtatctagtttaatgtctctcatgtaggtgctcagaacgtatggttaattttgaataataaagccagtgggacttctcagagggctggattgggggctggtgagagaaaaggagatgcgaaggatcattctgaagtttggagtttgggtacctgtttgaatggtgatgctcttagctgacccagggggtatggcaagaggccttggttctggtgagagagagaagacagtgtttggttttgaggagttgtctttgagacgttttgagatgaagagtggggatagcaagtaggcagctgaattgaaggatctgaagcttaagaggagaggactaggctagagacctgtttgtgaattatctgtacataggaggtaattaagggtgtgggcatggctgacactgatgaggaagaaggcagagcaccggaagagaggaccttgacctgagccttgaccaaggccattgctaaatgcaggtaggcctgtagcgcacaaagaagcatgaaaaccaggcaaggttgtgcaggagaaatcaagggcagagcttcaaggagagagggcgtgatcaaccatgttgattgctctgaggtgtcaggaaggaggaccatagataagtgatttatgggtcaggcacggtgattcatgcctgtaatcccagctctttgggaggccaagactggcgagtcatttgagcccaggagttcaagaacagcctgggcaacatggcaaaacaccatctctgcaaaaaatataatcagcctggcgttgtggtttgcctgtagtcccagctacctgaaaggccaaggtgggaggatcacctgcacctggggaggtagaggctacagtgagccctgttggtgccactgcactccagcctggacaacagagtgacttatgggccaggcatggtggctcacacctgtaatcccagcactttgggaggccgaagtgagaggatcacttgaggccaggagtttgagacaagcttgggcaacatagtgagaccccatctctataaaatataaagaaaaattttaaaagtgacttatacccattgctctggttctccaagtagcctgagtgtactatgtgggggagcattttatgagggacttttgaggtcctgggcatccctgagacatggccctggtgggtccccagtctctctcctgtagctaggagcctggcatacacaggccatctagaaagaacttaggcagcatcagtctgcaagggaggcagagtttggagcacactagactcctgacacagaggctgacccatggctgcctggagaatcttctgggcttgtgcagaaaagttggggaaagccacctttccctactgtggcagtcaaggcttggtataggccatcttccctcccttctcatccatgatactctgaatgccctgtttgtggaacttagtggactcctgcacctctgtcttggtttccatgaacccctctgcccaatgtgtgcttgtcagccctccagacctggcttttacagagcactccaagacattgctctacacacactcagctccacagacacctccctgttgttctactcgttgcatgacctcatagttatctgcttccccatctgtttcctccatcaggcaggggttttctcaaaggcaggaactcaaatgccttattgatctctgtttccctaggacccagcccagggcctgacatggagtagatagatgcccgataaatgtttgatcagatgatggaatgaatgactgcataagccgaatagatcactgctgagtgctcttccagctttaatttctctgggtgggacctcctttcccttccttcctttggattctgttcttacctctgaaataggtgagattaatttagagtcctagggaagagggctgcctgcctggatggtacaaaggctggctgtggctgctctgtgtttctctgtatacccagtgtcagggatagcagctgctgtggggacactgcagagtgtcccagttctgccatgactcaccatatgaccatgacaagaccctttggaccctctgtttcctcattgtttcaaagagatttgtctagaatctagaccaagcttgtccaactcgctgcccgcgggtctggtttgaaggcagctgctgcacagtaatgggaaggacagtaagccccaccatcgccttccctttgccatataaccctgtgacctcagaagtccctgaacccagatccttgtttgtaaaatggaaagggatagctacccacccctccactttgaccttcctttggtggcagccagatgtgctcagggaaacctcagatttgtgagtatgtttctactgagaggcaggaggaggaatattatagtctcaggaagagggaggaatgagagggagaggagaactctcaccctttccacaggctttgggcatatgcagccagcttggaaatgctgaccatcctgtgacctggctactattgcatcaggcttccttcccacctgtgtccaggtcctatctttgtctcttctttggctacctccatccttttccttcagagctgcaaaaaccttgccaaagccgtatggtcctgatgggtgcagagcccctgtgcctctggctgcctgtgaagggggatctgcagtgcagtgcctgccgtaccccacagggagttgtataggaacctggggatggggtgactgaggtagggggccagaagtggcccagatgatactcacttctgctggaacttttctttgtccatctttcagcatcctctggtggagaaggcttagctccattaatgctctcctaggtcctggctgtgtattttctttggtatgggagtggggaactgggagggactcatctgtttgccacagactacatgtggagagggtgattggtgagaggtcattttggagatctacacacctcttctgacccctgggaccactctcctgaatctcctcatggtcttggcttcgggcccagcagggcgtgggtgctcggcatcctgctgcttttactgtttttcccaaagctctgttagcttcccgtggttcccactggctataggaatctttatgtaaggacttcccagtgtttccagactgtatttgcccccaggggtcacattccccccaactatgcctgctgctgctttttctgttcccgttgttacctcactgaccactgcattttcagtatttgttgtagcccctcagcctctgtggcccactgtgccacctcttccaggaagccatccttgataccatctttctggtaccatttttgagcatctgtggcctttgctgcctgttagataattagctctggaatctaactcccatgtgtttactcctgctcttaagtactctgaacattttgaggcctccccaggccctgggtttgtgttggactggtagggaatggagagaagagtcaaatgtggtttcttccttggaggagctcataggccagtggcctaagacaccagggaagcaccagcaggtgtgacaagtggtgacacacaagagaggagggggcacctagtgtgcccctggcctgggcctggtgggggcttaagtgaggaggtaggagtggcttgtgcaaaggctgaggcaggaaggagtatggggagacatgggctggtgtctgtgttgtgttaattggacttggacccttttgaggagggctgggctttccctgccttcctccagtgccctctgcagagtggggcacacaggccttgaggggttctggggtccacaggccacaggtgggggtagtaaaaacccccagaagggaaggaacctgtccaggaaatcttcgcttacctctttcaagctctttagattttaaagagacctttcatatttactatgagttgcagtttttttaagttacaaaatttctttactccatgcatgtttaaatggatagtttttgctaccatttacatcaattagcttacacactttgggttttgtgtttttgttttgtgtttttagagaaaggatctcgctttgttggccaggctggagtacagtactgtgatcatagctcatagagcttcctactcatctgcagcctcaaacccttgggctcaagtgatctttcccaccgcctcccaagtagctgggactacaggcatgtgctaccatgtctagctaagtttttttaatttttattttttgcagaggtggggtcttcctctgttacccagatgggtcttgaactcctggcctcaagcagtcctcttgcctcagccttctaaagtgagcgtatgcactttataaagggaaaaccctctctgaagagaaatatttcagacagggcatggttgctcatgcttctaatcccagcactttgggaggccgaggcaggcgaatcactggaggtcaggagtttgagagcagctggccaacatggtgaaaccccgtctctactaaaaatacaaaaatcagctgggcatggtggtgtgcatctgtaatcccagctacttgggagactgaggtatgagaatcacttgaaccccggaggcagaggttgcagtgaaccgagattgcaccactgcactccagcctgggcaacagagcgagacacccagacccagagaaatatttcagtgaaagcatgtttcatgttcagaaatttggggtacttttggttatggttttcttggccatatcttcatcatttggtgggtttagttttcaatatgtcctcctgtccctttctgattaaatcacttctgtatctcttacctcattggcatctcactgtagtccaatgaaggaggtgccaggagtggtgattctattttgcagatgaagaaaatgaggctcagagagatgggtccaggcctcctgcccaccttgccagtgcttttgttcataatacctctctacaccctttttgcctgctgagcggttaacaggcttataaatttgggggacctctgtctgttgggctatttggaagtggcttttttgagcacaggggatactaggacacaggttccaacaagaaacttaggtctaatttagggtcttggatttgatgattgggctccctctcccccttctagggcctgccatgtgtctgccccctagggcaggattggctggctctcactggctgtgctctgaggagccctgcctttgctcttctctttctcttccctagggttcctgctgtccttgaactctgccggggcaacaggaatactgcccttatgcacatcctcgtggtggccagacagggtggttatcccactttactggacaggaagagagctagtggcaggcctgtgacttggcctgatgtctcgggggagtcggggtgggagcaagagtcaaagacaggaagcagccctaccttcagaagagccaggcacacagatgggtcctttgtggttattgtcttctccctttcccaggttccagactggctgcccgccatatagcttgtcccttcgacagcaccctctctccccactcagtggattgggtgctgtcccagggtgggggcttactctcctgcagaggcaggttctcagctggccctgagggttgtatagcttcacagctcccagagtgcttgggcatagggtggctcagatgaggaaacaggctcctcttttaaagggaaagcaactgccattactggcatgtccaaaagggggatgctgtccaggactgcatggcccagaagctccgctctgagtaactgctggtctctaatctctgtggtctcaggccaggagtctgtccctgggctgagaagggaggggagaagagggaagagatggaaaaggaacattgctcttcccagtctccctggcctcgtcatataaccttttattttacaaattcagtcttgtggcattttgctttaatgcttagagctggccccaggtgccaggcagcaggcacatttccttctgcccaaaaaacaaaacacacatgaatctgaggttgggcgtggtaagggcaggccaaggctgaccgtcctatgtggatatctgtgaggtagtgtgcctacatgtaagggtctgttgtgggtctactcccacgaaagccttcatcttacgatgaaccagagaggactgcagacttgccaaggcctagctatatgcttggagccaggatttgaaacttgatctttggggatgcacgtgcctcagactattggtgagtgtgctggtggggcactgcaggctcaggaagcagcgtgtctgcatatgcttatctgtacacaagtctgtaagagtcccccttctccccatacaatgcccccatccctgccaggcttctttttgagctggcgaaatagctgcttgtattcttctcttcatggatcatctttatttcacccaagtttgggtttgcacctagtggagccttggcaagtggccttatttgtctccactactgccagcttttgtaggctccatgtcaatggcactaggcacacaggtagacaggtgggctgtctccagacttctctattaccagcacttcccagcatggccctcacagcaaccatgtgaggtaagaggaatttccagtttcctgatggggaaactgagaccaaaagagtgagggactgccaaggcctcatagctagaatttaagagctgtgtggttctcctcactaagctgggaaggggatggtcagggaaagcttcttgaaagagcaggagaaggcagatctccatcagggcagggagcagagcaaggccccaggattctgcctggggcaccaggaagcctggcttatgagaaggttctcagtcctcagagctgacatgtgatatacagtccaggcacaggtgtgtgtggtccctcattacttcagagccccttaagaaagactgaatctatttcttcatcagagtttgtgagcgattcaatataagggactaaatccccctcactgccccaagcagcttatcttgtcactgtctaccatagccacatttggaatggtaatgcccaggccattcctgaagcccaggcagcattcactgtgggcttggggacatggtgccattcctgaagcctgggcagccatcaccatgggcctggggacgtggtgctgggcagaatgaatatgctgcagccctgatgggctgtgctggctgggctttgccttcttgggtcaaggcgagcctgggcattaggcctttgtcattatgctatacatcaggcttctgggctgctacttgtgggatcctgcccttgttctcaaagagttcctccttctcactgccccatcttcttcatagtgacggcctcttcgtacccctggcttttcttttccccagagttcccctgaatgttgtcctctcatggttctgagttggggaggagtgctaggtcatggatttttgggtataacgtgtgactttcctactcccctaagtagttctccccttctcaagctcctaagttctgggaaggtctcttttcctgccctcctgactaatggcagagaggtctgacccagactgtgccagactggatcattcgctctgtcacctgccaccagggcagaggccattcctctctggggagtctccttgtgaatttctggggaccagctctggctctctcaagaaagaggatgctgccatatttgttctgggaggcaggaagatgaagggtgaggttgggaggtagcacaggatgtggctttcaagaacctagtagagcatctcactgtgctgccagggccaggctggtgccttcttacggaagacagtacaagggatcaggtgtggccaacaggaacttgggagcattggatgcctggcgtggagctgcgctatgcttacctggttcctatctcaggcacctgttctgccttcaactgatctcaatggaaatatgtgcaggagtgcaggcctgttgactctgtgtgtgtgtgtgtgtgtgtgtgtgtgtgtgtgtgtacagtcacactcacctttgcaagaaggtgtgggagggggatgacagcagctccacaccggaagagcagactggtttctgtttcaaaaggcagagtttgtggttgttctgcagtttctgatctagccatttcccctgatggaagctcctccttctgtcattggaagccctgtgttctcggttaggtcttttatggcccagttctccctgcccctgtttctacccgagtataactgttcatttttgttccccatccctatttggttttccctccttctgcctgtgtacctgcctttttcatttcttcagtcattaagcaagccctggaggggccctgcctggccttaggtatgtgagcatgtatgtacgtgtttgtatgcacgaggcatcaagtgtattagtaccacaggaaggagcttctcagttgggcccttggtggaagagaagggagccggggaggtggacatttccagactaggaatcaagatgaaatagggatgggaagcaacagctattcttgccctaggtgtggcttagtgtggatggagcagagagggtgagagggcaaaagctggggaggtaaattcctgagccctgtcacaaagagccttcaaggccatagaaggtgtttgttgtttgttctccttagactggcagtgggcagcctcgggaggggcttgaatgaggtctaggggggtcagaataatgttttatgaagagccagaagactggggaaggatggctgatgggtgagaaccaggggtcagggaaaacagcagaaaaggcaggactctcagctggaggacaggctggaggggtttgctgaggggacaggtggttccaggtagaaccagaaatgtgtcggggagctagggttagggccagaagcaatgcccactgttccaggtgggatagatgtggagttttgtgacagttgctagagggacaggacaggaagagagcatctgggggagttgggccgttaggacattccaggcaggttggtgtgcagttcgggctggaagggctcctggggtgggggctggccaggcaaatgctggcactgcatctggctccgaagttaccaggccagtctgggtttagaggattttaagaggcttcagagcttggggagtactcaaagaaagtcatagctgttggctaagccaagcttttttcctttgacctaatctaccttaaatcggtgatttctgggctggaatgtctgccctccagccagcaggcagcccctccctgtgctggagagtgtgtcagagcctgtgcacctttgctgagggagcagaggagtccattggatgggccccctccatgtcccacatatagtgctgggtgtttctagctgttacgacttttgatcttaccaacatctttctgatgctattgtgttactcttatgttactctcttcacaggtgtagcagtgaggtcagagtggctgtcactttattgagatcacatagctaatgtgaggtagagctaggattttagttcagccagtctcacccagagctcgtgcatgttttttctaccaccctgccttctagagaaactcagtcaagccctttgctttacacatggtaaaactgagactctgagaagttaaataaattattcatcattgcctcaagttttagtggctgagggcaggtcatctgctattcaagcccgtgtacctctctgactatgccttgtgaaggccacgggagcatgcaagggccttggatagctaagataaggaaatggtcccaggcaaaatggtggtctgggtccaggatggttgctgctcttggacagccagtgccttggtcaggggatggggtggggattaggccccttgctgagacttgtgtggggatggctttagcagttaggcatttcagggatgcaccagtcctctgggccagagcctactttctcccagggatcctgaggcccatcttgacctacccagccctgcctctgggactttatgatttgatttgtgtgtaccttgtgtcaggaagtggtcctcatgaacagccttgggtccctatttcttcttctggagtctagctcttttgcaggtcaaaatgtctcagtgagggaacaaagatagggaagggacaccccacagaaccacctttcccccatatagccctctctgacatctcagcccttacttagcaaaggcctatccctagactcaacccagccctcttattaccagagtgactgagtggtcttggctctgcctctggggttcctccctgagagagagtgtaagaatgaggaaaccaggctgccctcctttcggtgttgactctgggagaccccagcttgatcttggcctctttgctaccttcctagttgacattcgtgaaattaaggagatccgcccagggaagacctcacgggactttgatcgctatcaagaggacccagctttccggccggaccagtcacattgctttgtcattctctatggaatggaatttcgcctgaaaacgctgagcctgcaaggtgggagttaagggggtagaggaggtagaggatagttaggggaatgcctgctggctcctgcccagtgggaggtatgtgccctcggggcagctattgataccttgctcacagccacatctgaggatgaagtgaacatgtggatcaagggcttaacttggctgatggaggatacattgcaggcacccacacccctgcagattgagaggtaagaaccactcctgaaggggttagggctgggagcattagggaccagggggacagggacagcagacctttgtgtgcccagacatctcccaggcctgactgtagatggagaagtggccctcacctcaggcttctctctccaggtggctccggaagcagttttactcagtggatcggaatcgtgaggatcggtaagtactgagctgtggctgtagcccagcagggtggggatgggcatccagaaccttagccaggcctctaagtagctgcccggagagccagaggacccaggggaccttaagtggggccaggagggtgggcagaaggttctgccacgtgtagctttctgcacaaagtcctctggtggccttggtgtgagctggtgagaggagccagccacatgctgtgtgccctgccactatgggcagagactggatgtgtagaactggctttgggtgtcctggaggtgagggtggccagtagcgtgtgaagggtgccctgaaactctggctctgagacctggtatggcagccagaggggccaaggagagaagggggagcaaagaccagatagtgtgggtgctgcaccatggtgaggtcctttgacctgaaagaaatgggaagccatggaagggttctgaggagaggagtgatgtgacctgacttgggttactcaagatcactctgcctgctgtgtggagagctcagttaggagctgtttccacactccaggtgaaaaatgagagggcttggatcatgatggtaatggtaggaagtggctggattttggccatgttgtattttgaagatagcgccagaaagaatgtccttaacagattgattttggggtgtgagaggcattgaggataatagtatgctgtttggcttgagcaactggaaaacagagtcaccattgactgagatgagaagatcatgggactagcccatttggagggaagcttgggttcagttcgaggcatgttaagttttctgatgcctattagctgtccagggagagatgttgagtaggcaggtggttagagtgagtttaggtacatacacagtaggggctacagattttaacttgggagtatgtagataacactgaaagccacagggctgggtgagatcacctagggggcaagcagaccaagaaaagggcagggtccagtggctgatcccagaccacccccatattagagattggaggggtcagggacaactagtgcggtaagaggagaacccccagagtgttgagttctggcagcccaaggaagaagacagtggtgaaatctgaccgttgacccttggatttaacatggtgagaagagcggtgtcaccctagcggtgaggggctcaagggaatgagagggagcaagatgactcttgcaaggagttttgctatggaggggagcaaagaagagggcagtagctggagagctaagcaggggcaagacaggtgtttttggtggaagaagtaacaagctgttcgtatgctgatgggaaagagaccacagagggcaagatcggtgatgcaggcagttgcaaccagaaggcctctgtttcctcactggaaaacaaggaccctgatagcacctacctcctgggtgactgaggatcagaggagggggcgcctatatagagccagccctccctccgcagtgcttgatccactcagtgtggcgctcagccccctcggggaattttggtgcctcctcccaggctcttggggcccagaggaggtggtcccaccctcccctcccctccttgacaccaccttccaggagagaaagccccccccttcccccttcttgtccatcctgttgccaggtccagcagtgtccccagcctcacatcctgggcaggacacccctggagagcaggggcgcttgttctctcagtttctttcctggagccaggccctgtctagccccaggaggtgcccagttgccagtcattgtatttggtggagcatgcacctcctccttcctccctctcatgggttagtgggttctgaggaccaaactcccagcatcccagtgggcagcaggtagggacctgctgccatgctgcccccaacagggaagttgtgagtgagccctgccttctgtcttggataggctgactgccaccttggcacaggcctcagcagtgccggtaggaggggaggcctggagtgtggtttttcttcctcccatgcctgacccactttactgaatctgttcacatcttccttgccagaattacaggttttttttgtttgttttgtttttgttttttttttttttttttttgctcagatgaggaactgaggtccaaagaaaggaagggactaacctcaccccatgggttctgatccagtcttgccctcaggcctccaggttcccagaatagtgttgtttacctgtccagccccaggtgggctcgacccacaggtcagaggtcatgagaagctggatgagaccactggggatgtccctgttttctcagtatatcagccaaggacctgaagaacatgctgtcccaggtcaactaccgggtccccaacatgcgcttcctccgagagcggctgacggtaagtgccacccagggctgtctgtagatgggggcaggggaagccaagagcccttcagctgggggcctgactgcctgactggcactcctgctctataccatgcaggacctggagcagcgcagcggggacatcacctacgggcagtttgctcagctgtaccgcagcctcatgtacagcgcccagaagacggtgcatgagccacctgccctccctcaacccctgcccctgctcttccaccccacaccccagctctgcctgcctcagccctgctgccctgcttaggggcttttgggtgccatttctccagttcttctcctcttgaggcctgcccccatctgctgctctagcctgccttcttactagcccatttcccacatggcctcccaggggtcttgccctgaccaggttctgtttcctgcagatggacctccccttcttggaagccagtactctgaggtttggtttggagtggggaggtggggttttccctgggcccccttcatctctccactgggcgattcttgatccaggtgggaggcagtgggagtagggaaccatgctggaccattctgggaagctgtgctggctgggagttgggttctgccttccgtggggcaccttgttgtctgttgaccatactagctagcttaccttctctccctgcagggctggggagcggccggagctttgccgagtgtcccttcctgagttccagcagttccttcttgactaccagggggtatggctgggctgacattggcccaggctggtaggttgtggggggctgggctcatccctgactggaggcttctctcatcccctgccctccctaccccatcaggagctgtgggctgttgatcgcctccaggtgcaggagttcatgctcagcttcctccgagaccccttacgagagatcgaggagccatacttcttcctggatgaggtgagcccgatgtttcacccattttttgtcaagagaatgagtaggggtgaccaggaccccacccgggctccaggagctagacgctccttagggatgccaccttgtttctacctactgtgcaccttgcccacccccagttgggacagagcactctctctcctacccccaacctaccatcttgggttggacagggcagggactcactgtctcttcccttccacatgtttctggacagtttgtcaccttcctgttctccaaagagaacagtgtgtggaactcgcagctggatgcagtatgcccggacaccatgaacaaccctctttcccactactggatctcctcctcgcacaacacgtgagtgtggctccttcaggcccacccagcttcttccccaggagggcccatctgaccatacctacctgcctctccttgcctatccaggtacctgaccggggaccagttctccagtgagtcctccttggaagcctatgctcgctgcctgcggatgggctgtcgctgcattgagtgtgcgtggggtccagggctgggggagggaagatgggaggcctgcccgcttgaccatggtgatgttgctccccagtggactgctgggacggcccggatgggatgccagttatttaccatgggcacacccttaccaccaagatcaagttctcagatgtcctgcacaccatcaaggagcatgcctttgtggcctcagagtgagtcggaggctggatgacccaggggttaacttggctccaggtctctcgttctagagggacagagggcagaaagactcctcaaatgccctgtcccctctccctcagcctttcatctttgtccttcctcttggcctctcctcgtcacctgctccctgcttgagctgttgcttcccaagttacactttctgtttcctacgtgttgggcccactctcttcttcatgggtcctttagactgtagaacacatgctcttctcatcttcagaaaacatgccctggtttctttaggccagtgtcctgccaactcctttgccctcacagcccagaagattgtctctgttccctgtgtcccattccttcaattctgtttactgcttaaactgtggtcactggtctcccttagctcaccagggctctaacagctaactttggaggcttctcctctctcctggcctctttggtgtgaaacatttttcttgcactgctgagcagcctccataattgggccagctcgggactgcatcagttgccaccctttggtttccactgctgccacagctgtagaacccctctctgccccaccagtggctatggcctgcctcttttctgggatagtttttacagacaagaagcccccaggcccttggcttccaacagctcactgtgaggggctacttagacccagagaattgcagaatctgtttcactgtgcttgtcccccatcccgcaggtacccagtcatcctgtccattgaggaccactgcagcattgcccagcagagaaacatggcccaatacttcaagaaggtgctgggggacacactcctcaccaagcccgtggagatctctgccgacgggctcccctcacccaaccagcttaagaggaagatcctcatcaaggtggggtggcgggcttattgcggaagccccacacttctcagtgccttgcccaggccatggcttcagctgttgggcctaaacctgggtgaggaggtggggtgaggactggggtctgcattgccctgttctggttgcccctacagcacaagaagctggctgagggcagtgcctacgaggaggtgcctacatccatgatgtactctgagaacgacatcagcaactctatcaagaatggcatcctctacctggaggaccctgtgaaccacgtgaggactgggccaggctgggggtggtaggccagtgggtgtgaggaccctggctcacaagtccctctttggtctgttccaggaatggtatccccactactttgttctgaccagcagcaagatctactactctgaggagaccagcagtgaccagggcaacgaggatgaggaggagcccaaggaggtgaggaaccagctcaggtctgggggctgggccaggtcaggcctgggccagggtcacagtatctttgctgttgccttcccctgacaggtcagcagcagcacagagctgcactccaatgagaagtggttccatgggaagctaggggcagggcgtgacgggcgtcacatcgctgagcgcctgcttactgagtactgcatcgagaccggagcccctgacggctccttcctcgtgcgagagagtgagaccttcgtgggcgactacacgctctctttctggtaacacttcccatgcagatgcgtatgttcagtcagcgtgtgtacacagacatcacatcacccagagataatcagttaacatttgagcctttgatccaggacaataattaggctttacatggaacataatttcacctacatacacacacacactctctgtctcaccccccccccatacccctcccttttcggttcatttgaagcccacacctttggttcatgtgactgcccacacctgagctcctcaggagattggcctccctccttgaggctccctccttgagttccaccctcatttggggtggaacttggtctttggggccctggcctgttttccccagcctccctcactctgtgtcttccacaggcggaacgggaaagtccagcactgccgtatccactcccggcaagatgctgggacccccaagttcttcttgacagacaacctcgtctttgactccctctatgacctcatcacgcactaccagcaggtgcccctgcgctgtaatgagtttgagatgcgactttcagagcctgtcccacagaccaacgcccacgagagcaaagagtgagggaagggcctgggggcggacaaggcagggcagggccatgggtggtgctggccgggcctgactctgcctgttctcaggtggtaccacgcgagcctgaccagagcacaggctgagcacatgctaatgcgcgtccctcgtgatggggccttcctggtgcggaagcggaatgaacccaactcatatgccatctctttccggtgaggggtgtggcactgggttgtggggccttgcttgggtctgagctgccctgaccctgtgtgactgttttgtccttgtgaagggctgagggcaagatcaagcattgccgtgtccagcaagagggccagacagtgatgctagggaactcggagttcgacagccttgttgacctcatcagctactatgagaaacacccgctataccgcaagatgaagctgcgctatcccatcaacgaggaggcactggagaagattggcacagctgtgagggggctgtggtagacggggcatggcaggggaggcaggagagacccagaatcttaccagtctctggatgtgtgtaacagcaagacctggtgtgttgtagaagttcgtgggagggcccctgactccagctgggagccacagtgtgggtaccaggagggtgtctgcaggaggggacatctgagcagcatctttaaggatggggacaggcacataagcagagggttcctcatgagtcaagatgtggagtgaggaggttctggggctcacactgggagaggtgcacacagtggaaactcatccacctgggcttggcctggactctgtcctagggcagatgagatgaggctacccaagagtggttgtggagcctccgcctggtggatggtatggagggcagagccacaggaggtgagaccagtgagggaaaaagtcaggacccatggcagcacagctggtgataagggccctggacagaaggaaggggtctaggaccagaagatcagttgagagactgctgtcgtcagtagacagggctggctggggagagagaggcctgttgtccactggcacctgggactcaagtgatggagaggagcggcaggaggaatgtggggagtgggaaggcttttcctgactttgggctcagcagtgaaccaacaagccactgaactaaagcactgaatatgggtagtctgtgaagggcccacctgcacatagctcagaaatacttgggagtttgggcatttaggacctgagagattttagaatcctgggctgggccttacatgtaagaatgtgaagaaaggaaagggaacagtgaggccgggcctgaggcctctgaagccgtctctactgaggtcgaaggatccctgtggatcaggtgcaagtttgctgcactgggggaaagggaagctgctccagaaaccagtagctgctttctacctctgggctctggggcattaacatatcccattgtgtcctgtttccaggagcctgactacggggccctgtatgagggacgcaaccctggcttctatgtagaggcaaaccctatgccaactttcaaggtacagctcaggcctctgggcataggaagctggggagggtccccagctgcttggggcttcatttctgtgttctgggccatctgtggtctttgtggagaagtggtggttgtggttttccgaggcccaagaggttgtgagagatgtgtggttggtgagcgaccgcaggtctcccagggccgacccactccctagcccctaccccttaagtcagcagtgaccctttaaactgctcctgtgggtgacccctgtttccttcctgggcagcagcggggtaggagctgggaggcacactggccactcattccccggcctcatggagccctgttacacaggttcttttttgttttgcctttttctctaaaaaggcctgggccctatttctcaccccctcccctccacagccaggggacctggaaggaagtttttctttccacttcacagatgagtggtagggtcccatccaggccccatatgcttccaggtcccggggaggcactcagggccactgcagaccctgccttcttggcctgccagccctgactcctgggagcggattcaaggttctccctgtggcccagggtggggcttaaggttccacctgggtcccgaggtatttcactggcagaggccctgcctctctgatcatatctgtcctggagcttccctgcagggcagtaacaagaactataactagggcctgttgatggcagtgtcatctcccactggcctgaccccaggcagggaagcccaagcacatgtgtgtgtgcacatgaagccccaggttggcagtggcagggagagcctttctgctctgactggtgcttctcacctctgcagtgtgcagtcaaagccctctttgactacaaggcccagagggaggacgagctgaccttcatcaagagcgccatcatccagaatgtggagaagcaagagggaggctggtaagccagtggtgtggtaggcccagagtccaagggccccagtggagctggggccccaaagacatgcatttgtgatgtgcttgtctcctgtgtgcaccagcagtgcctgcctcaccctggcttaggcatgggaacccctaccaaaggataccctcctcatgggagttcggggtggttgctggaggtcagcaccctgtggctcccacaggtggcgaggggactacggagggaagaagcagctgtggttcccatcaaactacgtggaagagatggtcaaccccgtggccctggagccggagagggaggtaagaccagaaccacctgagtaacagcattccctattcccagattctccttggcatgcccccatcacacagtcccaagcacgcacgtgcatgcacagacacctgtcacatgggctggtcgcacagcccatgtggccatgcacgtagtctcccatatacctgtgctacatttggcagtcacaggtacacccacaagatgtatttgtcccatgcacacggatatcccctcacacacatatgcagtagccatgctgaccattggtgggctttgcttcccacagcacttggacgagaacagccccctaggggacttgctgcggggggtcttggatgtgccggcttgtcagattggtgagctcccatctgtttctcttgcccactgttccctagggtgagattcttctttgtatctctttcctgctcctagggaggaagctgatggctgaaccccaaagtctgccctcactccaagctctccccatgctctggacatccccttgacaccctgggctccctttgtcactgtcagctttgacccctgcatgtttacctatgccaggcactggggaacccgtcagaatcagcagaacaaagttgatgctgctggttggctgacatccccaggcctaatgggttgtaccacagggatgtgacagaggcttggagatggggtggagagggagacacggcctgaggaagaagcatgagtcagagctgagttggaacactggctccaccacaaccagcagtgacttgtttgagttgtagcgtcgtcatctgtcaaatgggccagcagagtagtccttcccctcatggggtgtgggaaggaggaaatgggatgagatagaactcatttgagccagtgcctgcggtgtggagtggggtggagggggtgagatgtctattcccagctgttatctgctctcgccctcccagccatccgtcctgagggcaagaacaaccggctcttcgtcttctccatcagcatggcgtcggtggcccactggtccctggatgttgctgccgactcacaggaggagctgcaggactgggtgaaaaagatccgtgaagtggcccagacagcagacgccagggtgagattctgctggaaccttctggggggcagtgtgtgggcccgtcaggcagctgaggcctccagctcccagcacaggccccctcagagcagtggggcagccgatggcctatgctagataggccacagcccctgccttagctagggattgagaagaaacagacacataagatgcaatgtggtgtgtttaggttgtgttgagtttgagatactgatgggtcgttgaagtgggtctgcttagtgggcaattggatacacaagaccagaggtaagaggagaagtcctgggctggaagcaggagtggagtgggggctgaggcatagaagggatgaggtggtgtcgcataggaagagaacttgggatggattgagaagctccatatgagaaggcatgggcgaggaaaggagcccaggaaaggcaggtcagacagactgcaggccactggtgagggagagggtctgctgtgttgagagctacagaggtaaagacaggaacgataagaacttgcaagtgccctttggattcagcagcagctaatagcccttgtgagacttttgagctgcatcagcagcatggctggcattagatggcagtgggcagcagggagtctggaatggcaaaagcagagcctttgtagggcctgtccttgagggagagaacaggtgactggggtttgagcaggctctcatgcagatggctgaaaggagcgagcagcgtgtgggaggagatggagcccaagcttagctggtaggaccagccttctggagaaggtggcctcttcccctgagcctgggggaacagagaagtattctcaagggttagggaattcctacttggtggccctttcaccaagtgcatttggtagatgggtctgtagctgctttggagagggcacccgcaagccaaatagagaagggatagggtgcttgccaggctgtcccctagaaggaaaaggtgctggcataccaggtggttgaaggactggatctgggggtctaggctgaaaagggaagagtctgaatgtaagagccactgaggccgggcgtggtggctcacgcctgtaatcccagcactttgggaggccgagatgggcagatcacttgaggtcaggacttcgagaccagcctggccaatatggtgaaaccctgtctctactgaaaatacaaaaattagccgggcatgttggccggcacctgtaatcccagctactcgggaggctgaggcaggagaatcgcttgaacccgtgaggtggagattgcagtgagccgagatcacgccactgaactccagcctgggcgacagagcaagactctgtctcaaaaaaaaaaaaaaaaaaaaaaagccactgaaagaaagtcctccaggagaggatgggttggggtgcttgtaagtgggcttctgtagagatttggcatggagatttgccatgaagagtgggtggttatatttgagttgggggcgctgaggcagtgaggatcatccttaggacacagatggaaaccaagccaggggcctgtatccccagtgcagtcacaggtaacacagaagaatcatttttaccccagcatgaggctgggtaataaatggtcagaaagtgtcatttgggagtgtggccaattccaggatccctggaaggtcactgggaacatgggtggtgatgaggagtctgtatcccccaccccccctaagagggttggagggcaaatgtgtcctctgggacagaaaagaggaaagatgatttcaggatgaggctgaggacagagctccctcatttactgttgggtgtggtgtctggaaggtacaggggaaggtgggagaggggcccagagcacctgcagtgtgggcatgcccaaggttggcaggggcttccttctcctgggcagggctgtagcctggggctacagggccttgtgtgtgtcaccagctcactgaagggaagataatggaacggaggaagaagattgccctggagctctctgaacttgtcgtctactgccggcctgttccctttgatgaagagagtaagggccagggcccaggcggggtgtgcatgtgcctggagggcctggtgggtgcaaaaagagtatttaggtatccccccaacacttcctgggtgggcgggctctgtaagtgttttccctgtttggcccagagattggcacagaacgtgcttgctaccgggacatgtcatccttcccggaaaccaaggctgagaaatacgtgaacaaggccaaaggcaagaagttccttcagtacaatcgactgcagctctcccgcatctaccccaagggccagcgactggattcctccaactacgatcctttgcccatgtggatctgtggcagtcagcttgtggccctcaacttccagacccctggtgaggaagtcccctgtgaggagggtgaggaggggcactgtggggcagctggactggaatacaccataatctgcctcttccagacaagcctatgcagatgaaccaggccctcttcatgacgggcaggcactgtggctacgtgctgcagccaagcaccatgcgggatgaggccttcgacccctttgacaagagcagcctccgcgggctggagccatgtgccatctctattgaggtgggtgctgctcatctgggcttcagggtaggaaaggggctgcttgccgttggagtctgtttatgttgagttctccaaaagtaggtattttcaggcatcaaggtggtcagggtgggtggggcctgagctgagtctttgaaggggtgaagatagcatgcagtcactgtatgcatctaggacgtgcagagccatggtgtgacttgttctgatgacttgttttgttctgatgagatcttttttttccctaaggggaggtcatttaaaagatttctgtgttaaaatagtaatggatttaacatgaagtagattgcaaaactcacatggaaattttggctaaagctcagacttcagataaactacaggcagcagctgctctggacagcttagggtccctgatgtcgtgagggactccatgggcagtgtcccgggggcccagcagagggcgcgctgcctccactccacagatgctgactgagcctccgcagtggggaattggagggagcaggaaggacaatcccaggcccttctttgtctgcctacaggtgctgggggcccgacatctgccaaagaatggccgaggcattgtgtgtccttttgtggagattgaggtggctggagctgagtatgacagcaccaagcagaagacagagtttgtgggtcagtctgtcttcccagtcatcctcctcatcctgctggggcactgcaagcctctccccaccagtcatcccatcctctcccacggtgacctgaagccttttgtcgttgccttcacagtggacaatggactcaaccctgtatggccagccaagcccttccacttccagatcagtaaccctgaatttgcctttctgcgcttcgtggtgtatgaggaagacatgtttagtgaccagaatttcctggctcaggctactttcccagtaaaaggcctgaagacaggtgaggaccattcctggaggcagtgcccctgcaatcttgctggcagggtggggctgggccccttgctctgtccctcgtgggctgagggccaggcttttcctcctcctaggatacagagcagtgcctttgaagaacaactacagtgaggacctggagttggcctccctgctgatcaagattgacattttccctgccaaggtatctgcagcaggggtgggctggcctggggtaggtgggaggagagccaggcagcagcctctagaagtgcagaggagtcattgaccctcttgtgcacctggcttcgttgaagcaggagaatggtgacctcagtcccttcagtggtacgtccctgcgggagcggggctcagatgcctcaggccagctgtttcatggccgagcccgggaaggctcctttgaatcccgctaccagcagccgtttgaggacttccgcatctcccaggagcatctcgcagaccattttgacagtcgagaacgaaggtgaggaagatggaggggtgctagagccaggaaggcagtggctaggtcctccttcttcagtgtttctttctcctgggtagaaaagttgtaatattgtctggcattgggctgcaaggccctgcctgccagtaaggacactcttcccttctgtccagggccccaagaaggactcgggtcaatggagacaaccgcctctagttgtaccccagcctcgttggagagcagcaggtgctgtgcgccttgtagaatgccgcgaactgggttctttggaagcagccccctgtggcggccttccgggtctcgcagcctgaagcctggattccagcagtgaatgctagacagaaaccaagccattaatgagatgttattactgttttgggcctccatgccccagctctggatgaaggcaaaaactgtactgtgtttcgcattaagcacacacatctggccctgacttctggagatggatccttccatcttgtggggccaggaccatggccgaagccccttggagagagaggctgcctcagccagtggcacaggagactccaaggagctactgacattcctaagagtggaggaggaggaggagccttgctgggccagggaaacaaagtttacattgtcctgtagctttaaaaccacagctgggcagggtgagaagctagatgcccctgcagtttggccctggagccagggcagaggaatgtagggcctgcatggagaagggttctgccctgcctgaggaggaggacacagcacaagggcacattgcccatggctgggaacatgacccagcctgaaagatacaggggatcatgttaaaaatagcagtattatttttcgtctcaatggtattgtaactaagttatttactcctcctgctcctcacccctgtagggaaaccttggagaggagagtggcaggtgggctgcctgctgtgttaagaggacttagtttgtgatgtaaggcactgtcaggaatggggggcgggccagggtgggaagagaagaaatagcagagcctattttggtgaggttttttgtttttaagtcaaagaagactcagtatgctttccctgaggaatgaaaaagggattgaggagttgcctgactcctgggtgggtggggtacaggcagttaggtgctgaatgaagctgccatccttgctgcagcttctaactggtaaaaagatccagggatggagatgggaaggttagaaaggcagccctcacctctgaggacagaggccggggtccaggcccgtgggcgcaaaggtgcctcatagcatagccagcattcagcacacacaaacctactgcccacatttgggctcagggttggccatttgctagttctgctgccctcttaagatctgactgccaaataaatcatcctcatgtcctt

SEQ ID NO: 36257 - DNA, 3057 bp, Homo sapiens
tccagttaggagccttgatgccggaggggacagtggtaggtggggaggttgagtgcaaagggttcaggctgtaagtcatgttgggttggaatgggggcacaggaaggtggggctgttggggagccacgctaagccgggtgtctgtagcagagccagagaaccgggacactgaagagggtgctgaagggggcgactctcagggatcgagccagggcccccgaaggtgggatcgaccagggtaggagacaggaaaaaaaaggagagcagcgggtgggggcgaaagcagggccgaggagagagcactttggacagaacccggcggggaaagggcggcgccgaggcttgtcaggggcgccccgcagcgtcccaggcgcacctgttgggaagaaaggaaggggcttcccggtgttcgagggaaatccagtccggaggggctgactcggagcttgggactcctggggagccaccgcctcctccccagcggcggtcaaaaccgggcaagcgaaggggcgtgaccctggtgctcaggtttcttcctcctcacctgggcaaggaggggtgggggccacgacttccggttcaggtgagtgtcccttcggtgacgtcaggtcatcctcggccgcccctccggtcccgcctccccctcccgcgctcccggggcgcgcgggccgcgcccccgacgccctacatatactcaggtgcgccccacctgtccgcccgcacctgctggctcacctccgagccacctctgctgcgcaccgcagcctcggacctacagcccaggatactttgggacttgccggcgctcagaaacgcgcccagacggcccctccaccttttgtttgcctagggtcgccgagagcgcccggagggaaccgcctggccttcggggaccaccaattttgtctggaaccaccctcccggcgtatcctactccctgtgccgcgaggccatcgcttcactggaggggtcgatttgtgtgtagtttggtgacaagatttgcattcacctggcccaaaccctttttgtctctttgggtgaccggaaaactccacctcaagttttcttttgtggggctgccccccaagtgtcgtttgttttactgtagggtctccccgcccggcgcccccagtgttttctgagggcggaaatggccaattcgggcctgcagttgctgggcttctccatggccctgctgggctgggtgggtctggtggcctgcaccgccatcccgcagtggcagatgagctcctatgcgggtgacaacatcatcacggcccaggccatgtacaaggggctgtggatggactgcgtcacgcagagcacggggatgatgagctgcaaaatgtacgactcggtgctcgccctgtccggtaaggccgcgggaccgacggggcggacgcgcccttgaccgaggtggcggggtggcgcgcgtgggagagccgaggccccacggctgggggccctgggttgccggggagctgcagggcgaggaagtggtcggctgggggcggcggggctgggcgggagcgggccggggttccggcggctgcacgtgggcgcgcacctcggtcgcccacgttcctcttcctcccccaacccagcctcgtccccggctcggagcagcggtgcttaggccggggccatcccctcctccattcccgggcaggccatggcctccgtcatctcccgtccttttctcagacagaaacggccccggggcgcggggcacggggcgcgccgagggccgaagggcggtgcggctggtcagagtgggccgccgcctgctgcctctaatcttatcggccgattagccgaagccacaaacccggtggcctcgatagcgggctcagagcagggacgccggctggcatgtgcgccgcgcggggcttcggaccaccgtctcggcttctcttcgctgcaccctttcacccttccccctatccagggcagtttcaccgaaaccccggcgccccgggcggatccttgagcggagagggcggggcgggagcaggaaggccgcgctgtcgggaggggcggggacctgcccgcttggcccaggtcttggacacctgggcgcccctggccctcggcagaacacggcgccggacagaagaggtccagcggttagtgggcgcggccggcggcacgaaggctggagccgcctgcatttccagcaatgacggcgccctttcccctcgcccgcagcggccttgcaggccactcgagccctaatggtggtctccctggtgctgggcttcctggccatgtttgtggccacgatgggcatgaagtgcacgcgctgtgggggagacgacaaagtgaagaaggcccgtatagccatgggtggaggcataattttcatcgtggcaggtgagcccccgggttctcccatctgggaggagcaaggctgggcaaggcgcccatttggggcctcactatactgaaaccctcattctgtctccaggtcttgccgccttggtagcttgctcctggtatggccatcagattgtcacagacttttataaccctttgatccctaccaacattaagtaagtctgggaaccctgcctcctaaggggacaggtctggggtcctggaatagggaggagggcagaggcacgccagggtttctaaccacccccttctcttcacaggtatgagtttggccctgccatctttattggctgggcagggtctgccctagtcatcctgggaggtgcactgctctcctgttcctgtcctgggaatgagagcaaggctgggtaccgtgtaccccgctcttaccctaagtccaactcttccaaggagtatgtgtgacctgggatctccttgccccagcctgacaggctatgggagtgtctagatgcctgaaagggcctggggctgagctcagcctgtgggcagggtgccggacaaaggcctcctggtcactctgtccctgcactccatgtatagtcctcttgggttgggggtgggggggtgccgttggtgggagagacaaaaagagggagagtgtgctttttgtacagtaataaaaaataagtattgggaagc

SEQ ID NO: 36258 - DNA, 27873 bp, Homo sapiens
cctggctgaggccaagctcggatccggtgccgagccaagcggggccgtgcgtcgccggggcttcgccttcgctcgcgtgacctccgccgtcctccccaaccctcgtcctctggccgcgcctgcggccgcacgcccagcgcccctcgcctaacctcgcgcccgggccgcgcctcctcctcctcctgctccccgccgcttccgtttctcgagggaaaggctgctgcctcctgctctgtcctcatccccggcttaggtaacacgttttcctccttacgacacccaccacagggtccccgcgccgctgcccctcctccttggatctggggcccgggctggtgagcggcgcgcgccgtcgcctctccgcgggtaggtgagtcgatggcgccgggagggttcctcgcctctgcgcgccggcctgcgaggtccctgccccggcagcgaggccgcccccggccgggcccggccaggcatgcccggcatcgccgctgcagccagcgcggaggggagctcgtgagtcccgcggcgcccttggccctgcccgagcggcccgatggggttggggggcgggaagaaagggtggcaaacaacgattttaaaaatccagtcattagtatttgtaggacgaagaagctgatctgacagttgtccagagcagtggcccagctgcaacaggtagatggcgcagctgtcagtgaccccttggtctcagccttggctttgagagatgcatctgagtgtccctagctgccagctacctccagtgacctacttgatgagtgtgaaataaatatgatgggactatatttagaaaaatctttacttccttgctgttaattctctctgcattttgaaaggtggttttgtgaggtgtgcataattagttggtgtgtccagagtggtagctggaaaaaaatatttaacctgggtttggccctatcatgtagacggttaggcgcaaagagtgtgaaaggaaacgcttactttagtacatctgtgaaaaacacttataagaaaccacggcttgttttttggagatttctcattttaaaggtatttttaaagtgttgaataagcagaagtttgcccactgtatgatggtgttcacttcaaaagaacagtgggttaaaagtatggacagaccacttaagtggatcccatctgttgagtaaaagattttttagcccttttacactgattcctagctttgaagccagaaaagttgataaggatcagccctgctcaacttgataatagtataaggatgaaagtaatccactgaactactcttgattggtgaattagctaagtgatctcattcttaccttttaaaatagagaacataagggaaaaaataaaggcaatggaagaattcattttttcaatacagatatttgtttccattcttatgtagagcctactttatttttaagtttttatggatttttatactacttttgaagtcagcttagtcatgaagagaattatgtcaaatacatagagttacactgtactttttgtgtagaataagctaccacttttcaagcttttggactaaaccaccgcttgcttggaaattgcagctttgactaatgccctttaaaatgatataccttattatagatttaaattatagctttccttgttatagtcctgaaaaaaatgaaaagataatttcttgtttgacatagaaggcctgtgagacaaaagttataaaggttattatatatttattttgctttttaattctgtctctaataacagttagaaaatgtctcattctatttcatgttatacagaaattgcttaaaagataattatgttatataaagtgatcaatgaaaacaaacgtcatcttcattttttaaaggtgaggatggtgtatataagcactttttcccgatgtgagtccttatgaatgttcttgttaaaatactttgaatcttgtaatgaagttaataaaactatgttaatgtgtttggctgagagcttagaaataaaggctctggctggcgtggtggctcacgcctgttatccctgcactttgggaggccaaggcaggtggatcacttgaggttaggagttcgagaccagcctggccaacatggtgaaaccccgtctctagtaaaaatacaaaaattagccaggcgtggtagcaagcacctgtagtcccagctattcaggaggctgaggctggaggatccctggaacctaggaatcagaggttgcagtgagcccagatcgcgccactgcactccagcctgggcgacaaagcaagacttcatctcaaaaaataaaaattaagttaaaattaaaaaaataaaagttctgcttcccgtctcctgtgattgatgttgggtactgtttctcaaacttgtctgattgtaaaattcctcagggtagtaggcaagtcggggagtgggtagagtataatagtggtttaaaagattcccagattgcaacttgagacttcctggatcagaatttctaagagaaaggagatatttcaaatagacaaaaatgataaaattttaaaatagtcaacaacaacaaaaaaggtgagtttgggaaatgcaggtgggaaatgactattgttggaatgaatagttgataaaacttattaggactcctgtacataaaatgttcatatatggaaactgattttattaatatgatgaggccactcatttaggaaatctgaaacttttatatttttttctggtcaagcttctgctgatcaaatttagcaaacatatttttgcatgtttagtcttttttatgtggtatgtaatgttaattcaatttcttgaatgtgataagagcattttattaatggatgactaatgcagattactgtaactagtaatccacagcaaaatattgtacctaataatttctctttcttttttttctttttttcttgagaaaaggtcacactctgtcatccaggctggagtacagtggtgtgatcatggcttatgcagtctccacctctcaggctcaaggaatcctcccaccccagcctcccgagtgtctgggactacaggcacgtgccaccatcccagctaatttttaaaattgtagagatggggtcccactatgttgcccaggttggtctcaaactcctgggctcatgacatcctcctgcctcagcctcccaaaatgctgggactacaggtgtgagctgctgcacccagcctaatttctttcatattatagatttatttgttacctcttccatgtgcctgattaaataattataggcaagacaggcatgcaaatttgaataccttattagtagcttttttttttttttttttttttgagacagagcctcactctgttgcccaggctagagtgcagtggtgtgatctcggctcacagcaacctctgcctcccaggttcaagcgattctcctgcctcagcctcccgagtagctgggattacaggtgcccgctaccacaccaggctaattttttgtatttttagtagagatggggtttcacagtgttagccaggatggtctcgatctcctgacctcgtgatccacccgccttggcctcccaaagtgctgggattacaggcgtgagccaccacacctggctccttatttgtagctttttaaaaaatgactctcaaccccattcaaaaaagaaaaaaaaatttatttggccctaaaacttggtcagttatatataaaaaaattaaagaaatagaatattaaatacctataaaataatttgacaagatgagttaccataatggaaaatgtcagaatttattttccttttccttcttcctctttacattgcttttctttctccttttttggggggggatggagagtgtgtgttatttgctcatttgtttttatttttaaccaactaaatatttaaaatatagtaaattatccatgtttaaattaatttaaatatttgccaactttaccaatagatatttaaacttgcccttttcctctaaagtgacagtggtaggctttgctcaatgcaaatgagagtaataattcatatcaaaggagttaaattcaagtgaccaaagaaaattgttcttttaacattgcttaaggaaagcataacttaaattgatgccataatttttcattatcagcaactcttaaaatgaggatggaggctgggcatggtggctcacgcctgtaatcccagcactttgggaggccaaggcgggtggattacctgaggtcaggagttcgagaccagcctggccaacatggcgaaacctggtctctactaaaaatacaaaaattagctaggtgtggtagcgcgtgcctgtaatcccagctactaggggggctaaggcaggagaatcgcttgaacctgggaggcggaggttgcagtgagtcaagatcgtgccactgcactgcagcctgggcaacagagcgagactctgtctcaaaaacaaaacaaaacaaaacaaaacaaaacaccggtgtggttgctgtatgaaatcaacttaaatagcctagtgcccttctttaaacctaattttcctatcgctacccccacttgttttttaaaaatataagtcaacaaatatttattatgcccttattatgtagatgataaacatcaaaagcttttgaaatgtgcatttctttgaacctgtaattttttgtttttttttaactttaaaaaaattgtggtaaaagatatctaatatcaaatttaccattttaaccgttttcaaattacagctcagtggcattaagtacattcactttgttatgcaaccatcagcactgttcatgtccagaattttttcatcatcccacacaaaaactatacccattaaacaatgactctaccctctcttcccagccctagtaaccaccatcctactttctgtctccacgaatttgacattctgagtacctcatacaagtggaatcatagagtatttgtctttttcagtctggcttattcatgtgccataatgtcttcaagtttcatccatgttgtagcatgtgtcagaatttcctttctttttaaggctgaataatatttcccaatctcatttatatgagaagtagatataaaaaacagagaagttttgaactggaacagatcatagaaatcatccaatccaacctctctgcccctgcttttcttttccttttttatgtttacaaaatggggaaaacaagtccttcagagcttacatcatgtggccgagtttatatacctgattggcaaaacagagcctaagaaccagctctcctgtatcccaagcaaggctctttctaccgcacaccctgcaggcccatccaggcccatccagacaataaacagtaagtgttaaaggagttggtgtctccaattagtatggcatgagttctaaaggaaagataaattgactttggaatcttccttaattaatgaaaaatgttacattcaaaatagattgaagattaaggctaggtgtggtggctcacgcctgtaatcccagcactttgggaggccgaggtgggcagatcacctgagatcaggagtttgagaccagccttgccaacatggtgaaacccatctctactaaaaatacaaaaattagccaggtgtggtggcatgcacctgtagtcccagccacttgggaggttgaagcaggagaatcactagagcctgggaggcggaggttgcagtgagctgatactgtaccattgcactctagcctgggtgatggaagcgaaaccctgtctgaaaaataaaaataaattagtaagattctagattctgattagcagtgatcaaaattataaataatattctattggaaaatattcttgcttcaaaccatacatctgacccttttttctgccttgaattttgcatcaaatttgtatttttaaaaaatttattctttctgatagttaagatagttacattgcatctgcttctatttgtatactatctgatttcaggtttcatttgtggcaacagggttctaaaaacatctcttagcatacaaaaacttaagcatatactgtagttggaacacagcagaaaaaaaaatatctaaatgaacaaagtttctctttagtgaaaatatttccaactatggaaaagggagtttaaaaaataaggtcactatcaaactttaaagtttttgtcggtttgtttgtttttgagacagagttcaccgtgtcacctaggctggagtgcagtggtgtgatcttggttcactgcaacctctgcctcccaggctcaagtgattctcctgcctcagcctcctgagtagttgggattacaggcatgcgccaccacgcctggctaatttttgtatttttagtagaaacgggattttgccatgttggccaggctggccttgaactcctgacctcaggtgatccacccacctcagcctcccaaagtcctgggattataggcatgagccaccatgcccagacaaattttaaggtatttctaaatggaatactttttcacaattttcagatgagttctgagaagtatccgaaattcatcctttataaaattgttacgttactacagaatacttactatgtagatcaactatttttttccgagcatttaatttactttacaaaaaggcaatataagttgactcttagtggaacaaggctccctgttctgttcttaagcaaccagtgagtgtagagctgactgttgcacctgttgtttccttaaattgttggataaaaatcagctgacattcccctttctaaaagtctctatttttaatgtgtcttacttcttgatcttagctgatttggaaaacacagctttagcacaggcttccatatacaagctatcagaacagcatttgagaacaagggacatctttgtagcctattgctttgagcagcttcagtgagcaaaaatgtaggctaatgtggtccattggtacacttgctcacaatagagcaagtgtagactgaccagcttagagtaatgtgtatgtcatcatcatttgagatggaattgaagtttgaaggttagggaggaaagagagagaaatgttagggttaaataaaagattcacatataccatatttaatatcttttctcacaaaaccaaattaaactcactattttgagtgatttaattaaattaatcttgtcacagataggtcacctctagatgaaaggggataattttagattctgatttggtgctccaaaaatgtggttcagttgctagttattcagatacagccttggtttgttcttgtaaatgaatacagaatatatgtagacttttatacaaatatgggcctgtatgtctaatgctgataaaatccaagtacaataaacagtgtgacaaggatgaattctgtattcacaaagctaagggaaaattcatcagccaacatttattgaacacctctgagttatgcagtacgagtcctaagacagcaaatgcatttaaatctcttgttagagcataaacaagtaaaccaatgcatagagtgttggaaagctgggatagagatttggcccatctccattcccccatggcccaggtgcctaagatggaggaggagtcagaaatgtctcctgaaggagccaacagttgaaatgattctccttttgcacatacatttttaaaaaacaaacctttttagtgaattagaaatatacacataaacattaggaatctcagcagttagctaataaattgatacaaagtcaacccactcgtgtaaccatcactcatatccagaacattaccagagctgccatcagtaaccccaccttcttctccaaggacaccaccattgtgacttccaacgttgctataggttggttttgcctgtttttgaactttaaattgattaaatggcacagcatatatcttttgtgcctgacctctttcacttgacagcatgtttttgtgagatgcatccatgttgttgcctattgtcgcaattcattcattttctctgctgtatagcatttcattacatgaatatgctgcagtttattccattttactattgatgcttgtttgggttattaccaatgttagattattacaaataatgctgctcacaagtacgtgtcttttaatccatacctgcatgagttttgttgggtaaatatctacaagggaaattaaattgctggatcatagattatacttatagtcaacaaattacaaatagttttccaaaatgattataccaatttcattcatgcccgcagttcataagagtttctgttgctccatacccttagcaaaacttgaaattttcagtcttttttattttagctattccattggatacatagtggcaccctgttgagattttaagttgcatcttcctgatgactaatatggtagactgtgtttctgtatgtttattggccatttggatatcctcctgtatgaagtgcctattcaagcttcttgcccttgaactgattctgagaaggtgagtgagcattaggtcgagaaagcaggaagaagggcgtgtcaaccagagggagcagcatgtgcaaatttacaatcttcccagagcaggagagcaaatggatagtgcaaaatcagctactaaaaggctaaacttaatcagagcccatgaggtaatgacagcaacatcacccggatcaacatgaaataagacccaggaagtacaggcagtcccaaactgtaatatttattggatcctgagaaatgtttgacagtcaaatatctgaaagttgaacatggcttatacactgggaaaacaatttagttttcaatgagctaaaaggcagtattgcaaatctctagtaaggcttgtagtacagtttccctctggcctcacaggaatctcaggggaggctaccattagcaagtgacacaacacagcgagccccccctccatatttagtgtgggcccacttccattcccctgtcccttctgcacaaacaacctccaatctttaaaactactccccaaggcagcccttgagtatggagcaaaggagaggtgggacgaagtctatgtttcccctacaacagcaatgtgatctgaatagaaccttggccactgccatcatgtggccacctacacagactcctggacagctgtacccccttggaaaaggtcatgagaaacaccttcttgtaaaacacccagatatttcacggaagcttggccttttccactagcagcaatagctgtcaggcaggcccaccacgcaatagcttcaaattgccattcctcagaagatgagagccagaattcaggatgtgaaccgtgggggtggggtggagtcaatgcgcaatgggcaaaaatgtgtactctgtaaagtgttgaattatctgccggaagagggaaatgtcaacagaagtgctttgacccgcttgcctattgattagagagcagttctgttttgtggcaggcccttatctatgtcatcacccttctgtcactgtggacaacaaaagggcacagccagcttctgctacaaccaggctcttcacatgagaaggagcactctgggccctagaatcctcacaaaatatctcccttgacagaaaaatggctctcccaagccagtcatagactgtctaccatgaagccagagtagtctcagcctctaggagccagggtttccacccagatgcccagaaactgaagcaatcagatctggccgacaaaaaggaactttatttgggttactcagagaattgcaagtagttcccaggctttggatttaatggagtagtaagttttaagaaaaggtttcagtgacccatataaacttgccaacctcttactttctcaagttaagacatgtgactgtggtttctgtgaggttgtatttcagagtcatagctatcatttattatctgccatgtgtaaagctctgtgctctgtgatatttttccagaaatatctcatttgatcttcacaacatcactgcaaggtaactattaatctttatattaaaggtaaagagagagtctcagagagggtaagaaaatacctgatgccacacagctagttagtagcagagttatgttttgaacccaggcctttctgattcaaaagcctgtgtattttccactatatagtttatcccatctgaaatatgtctaaattattcagataggatttttaaacctctgatgttctgataatggctggaaatttgagatttatctttgtggagaggtttgggtttccaagaaaagtcttaagaaccttttttccttctgacatacttcaattcctttagtagctctccaactggactagacaatcctacaaaagcaaaagagaccctaattctatctgacattgtgacacaattttatgttaaacatatagatacgtacatttggtttgagatggaaggaatgaaacttctttaagcccattttgctgaaatgtgacttgaaatagattgttacaaaacaaggcttatgagaggttcagtgctcactgcaatattaattacttggctgttaaagcgaatagcttttagtgggaacgactgcctcacagatgtttcttattgacgacataaatggggaggaaaacactatcccattttcacttttggccagaaaacaaaagacaaaggaatagattgtgtcagctaatagattgggtcgctaaggtaaccacggcctgtctttcaggagaggttttaggggctaaattatgttacttcaaaattcacatgttgaagccccaacccccagtacctcagaatgggactgtacttgcagataggacctttaaagtttatgtgaggtcatacaggcggatccttatccagtctgactggcgtccttgtaagaaaagggagacatgccagagattaacgcccacgatggaaaggccaggtgaggccacaatgagaggggccgtctgtgagccaaggagcaaagcctcaggagaaaccagtcctgctgacaccttgctcttggacttccagtccccagaactgtgagaaagtgcgattttattgttaagctacccagtcttaacaaactaacaccagaagaattaggtattgggcatgccccctgccatcaatgccatgacagttaagggagacatcagtggaacttaatagatgagcttttactacccagaagggtccttaacagaggctgaagatcagctggagaaaaggtttttctgagagtaaaagggaagtcaaatagtgacgtataatgatcaaacctagtgacagatatcaactaggggtgtgtgtgtgtgtgtgtgtgcattttttttttttttgctatataatgtaccttataatactaatgtacttatgattattatccaacaattactgattttcccttattttaatagttaacaattgatgaaaagatttcactggctagagtactggtcaacagtgggggcttctgccagcttgcctaggtttgaatcttgtcccacaacttcctagctctgtgattttcagtaaacaatctccttgtgcctcaggttcttcatctgtaaaatggagataatagtacctacttcctaaggttatataagaattaaatgagttaatacatgtaaggtgcctagaaggatgcctggcatatagtaagcacctagtaaatgttagctgtttcaattttaacctatctctgcacaagaataacagatagcaaaaccattgtacctacattgtttcaccaagatacctgccagcaggtgccagctgccactaaaattgccagcatagaggtaaagaaaaataagcaacctggagaactggagctattaaatctgtgtttagagttatacaggttgctgacaaaaatacagattcctagggcttgtctccagagattctgattcactaagctggggtagagtccagcaatctgtttttttagaaggccatcttgggtaattctgatacaggtaactctcagaacatccattgagaaatactaatcaaaaggaatttcttctatagtcaaggctattaaattatggtaaatgccataacttactaatcataagtctataataatttttatttaaagtacagtgttgaaataaagtggtcttaggtgaatgatgagtatgtaaacttactttttaaaaaatcatctacttcatcacgcagttatcaagcctagtacccattagtgatgaaagaatctgtacaacaaaccccatgacatgggtttagctatataacaaacctgcacatgtaaccctgaacttagaataaaagttgaaaaaataaataaattaattaaaaaatcatctgaaagataatttccatgagttttaataaatgtattgataaaatggaagaataaattctgcattagatgtagccttcagtttctccatagacaaattatttcaagttgagccattcaaggttaggatgaattgtgcaatgcttccttcaggtttgtggcctgcctgtgtgaactgagttgaggatacatggagagccagggccttggagaaagggaagtagctgaacaaatgctgggctcattagcatggctggtgaaagtggtttcaatctgaaactgggcagttcaacctggaacttgacaaaatatgacagtgttgcctagggccaaaacgaagagtgaactctgggataaccttggaactgaaaaacctgattattgtgttatgagaaattcctaaaatcggtagacctgttcattacagggctgcagtgaatagccagtacttctttcccattggtcaagttgctgtgctcgctaagcagcaactgctcaggtcaggtgagagtggtcattattgaggaaataaaggttgggcccaaagaggacaaattccagattactgcagcatttgtgctgaaactcaccagggttaaattgatgagctttctgcgtgaaagaagggagtggtggtgatttccggagcttgtagccagggtgattagctcgcctgagtgttattagggtgttataaggagtgtttcttggttattcaacagtgtagttagtatcgtttcttttaagaaaaaaaattgattttaacacttgaataaaagaaacactgctgatattgtttatcttgaaagctttcaaatcggactccttgagatcttcacgctactgttaaggtaaagaggtattttgatactgttgattcattgattcttctgccttataaccacagaacatttactaagaaataaaaattaaggttactgaatgtatacttttgtggccatgtattatactgagatatgtatgcatatctgtgattgtatattatacttaagttataatttgtggtatatatatgtcatatatgccatcaattatttctaaggcaacgtgccgcagctttattaacgcagctgtttttcctaatgtttagattcaagtcaactaaagtaaatcttcctacatagcattcattcctgaaataaaaggcatttaagtaggcaggtgcttttgtttgagttttcactagatcttttctatcacctgaaagctttttgcattattaccgcagtctcattttatttagacatttgcctcgaggggctgagacattcttataccttcatacttaattccccaagacatttaaaaatgtaatttattattataaaagcactgtatatttcctgtagagtatttgaaaattatagaaaagcataataaaaaatcatccataattccattactcagttataactaccattaaaacatcacctactaatcttcctttcaagctctttctctctgtgtatgtgtataaacacaaatggataacatactctcaaattatatatggtcataggtagtttttccacttaacattagtgcattgacatatttccatattattaaatattcttcaaaaacatgattttaccaactgtatagtattttgttttaccaatatttcagattattttcaacttgttgtaatattaatcctccttgtgcagaaatattttaactcaactctgattgccttaacacagattgagggaaaactggagttactgactaaaggcagtgacatctgcagggatcttgacacatttttgtcaaattgccctctggaaacctaacttgtttgcgtgcccattagcagagcatctgtttcaccacatctccaagagggaatgtaaactttaaaacatatacaatagtcaaagaggatgtctcgttgcttgtatgcccttttcttttattactactgagactagacatattttctcatagtggttgacctataatcttaaggagagaacatattttttagcaaaattgtttaagatcaactattacaaattacatcttactcccattgcatctatgtcttcagagttgtactaattctcagcctcccagagtccattaagggaatttttttttttttttttttttttttgagacagagtcttgctctgtcacccaggctggagtgcagtggcgtaatctcggctcactgcaacctccgcctcccaggttcaagtgattctgttcctcagtctcccgagtagctgagactacaggcgtggagcaccacgtctggctaatttttgtatttttttttagtagagattcaccatgttggccaggctggttttgaactcctgacctcaggtgatccatgcgccttggcctcccaaagtgctgggattacaggcatgagccactgcgcccagtcccggctaatttttatatttttagtagagatggggtttcaccatgttagccaggctggtcctgaactcctgacctcaagtgatccgcctgcctcggccttccaaaatgctgggattacaggcgtgagccaccatacctggcctattaagggaatttcttttaatgaaggaaactgtattatgataataaatagcctgggcttgtgtgcaggagcaatgccaagccttgcagtttagccttctgtaaccctgaagaagttacttaaccttgctatacttcagcttaactataaaacagggttgataatacaataattctcatgagataggaatttttcaagcttttccagtaagaggtagctattattaaaaatgagaactgtttctctcctaattgcaggaaagccccaacagatataatcaaggtatgatagcataacactcttagaagccagaacttttcaagtctcaacaagttgcatgtttcacctcattattcaaccgtttactgggtaaaggagcagcatagatagtgggacttttttttaacggggtgtgaggaagttggcaatgagatggcttgtgctactagcctaagaatgacctcagggccttgcaggacacacagtgcttgctggtctgaggctgggcgcagtggctcacacctgtagtcccagcactttgggaggccgaggtaggaggatcacttgagcgcaagagtttgagattagcctggtcaacatggtaaaactccatctccacaaaaaatacaaaaattagcctggcgtggtggcatgcatctgtagtcccagctactcaggaggctgaggtgggaaaatgacttgagcccaggaggtcaaggctgcaatgagctgtgttcacaccactgcactccagcctgggtgacagagtgagaccctgtctcaaaaacaaaaacagcaaaaaaggtgctagctggtctggtacttagtactttagaaaagttgccctggataacacggtgaaaccctgtctctactaaaaatacaaaaaattagccaggcatggtggtgggcgcctgtagtcccacctactcgggaggctgaggcaggaggatggcgtgaacccgggaggtggagcttgcagtgagcggagatcgcacagctgcactctagcctgggtgacacagtgagactccgtctcaaaaaaaaaaaaaaaagaaagaaaaaagaaagttgccctggaactgacagcataagtcctcatccatttcttctcccttcttcccacagggtgaaagaaagcactacttcaatattgctgctaagcatatgatcattctaaggtcattacaagaatttgacttgcctttagcattgtgcttgtgtgtccatctgcctgtctctctagggatttagattttcattcaaagatttttctgtcactgagaatttaattcttggtatatttttgagagtgtaaattttttttcaagatttaaaacaataagcttcaaatgttagattgtatctagagtcttccacactgaggatgtgaatatgatatagactagctgttcaccaggctgaccaggttgactgccaaatgggttgttagtagtgccagaggcaccctgacatcactctctgaactgctttctctttcacattcttgtatttttccagctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaaggtaagaaaggtcatagccaaggtaactgcaaaatagttgcatctgtggctttctccatcatagaatagcatgccttttgctcctcacccctatcagtatactagcaccttgatttcaagtaaacatcttggattttcttcctccttgtcatgattacagtattgataaaatgttcattgcaggaaatctttaaaatacagaaaatgaaataagaaaataaaaatcactcacaattctaatacctagaaataaacacttcagtatagaaccttccacttactaatgaatttcttcttaataaataatacatgttttctggaaaataagcaaaaataagaaccctcttagtcccaccactggagaaaaccacagctatgctttgataaatattataacattttccttctatgtgtatgtgtgtacatgacacatacaatgtattgcaacagaaataagagcacactgctttgtaacctgttttttttttaacttgatatgttaagtcctaccttgtggatctcatcatttatctagtggtttcttcagttatgagattgtagctggagacttaaagtctcctttattctagtagaaaaatactgttctttgttataaacacacaaagatgtttatatgttaatataacaatgattacgactctttctggagctgactagagaaaccgtattaataagtagaaataataatactagcagcacttataaatgctatgtgccagccactattctaaagtcgtcgttaaatatattaacttatttagctcttataacaatttgatgaagaactactattacaatgcaatgggtgaaaaaagggaggcacagagaggttaagtaacttgcctaaggttgcacatcaagtaaatggtagggccagtttttgaacacaggcagactggctccagagtctgtgttctttgcaatattatattgccttttatatgataatctaaccattacatttgggagaatagaactttatggcagaaagcattataaaatattgaaataatttctatgaaattttcaaaatattgagaatcatttagaatcgtttcagtgaaatcttgaccacaggcgaagagatgaaatgccatcatgaaatctctacaaactatactttttcatgtcatataaaatcttgctccgataaactaaatgaagcaaatttatttttcttttttacttatcaatatagttgggtgcaagggatggttgagcaactggattaaaaatgtatcaacattaatttttatgggctaatatttgcctcaaagcattataaaaatttcaggcagttgtttattcatgagctaaaataaatgatattccattttagctgtataaaatatctttatttcatgaggcttttgtcttgtaatctcagaactggtctttaagcaggcttgggagactgagtttcagcccttgatgaatgggctggttgccagcccttgttgatttgtactgtcccacaaaataatatgaataataagtgttgtgggcattattaaagctattggtcatctgcaaatgaccgagttcaaatatttgaagcacgtccttgcttttgttccctgagaatatgtgtatcaaaatttaggacatattttgagaaaaattatctttattacagagaggatcagaagcaaaatgcatcagaaagcttcgtgatcatacagagatgacagaagattcttacttgactccatttattcactctatatattgatacttaaattattggccaataaaatctttctcttttttcatatccccttcctagcctgaatgatgatacatctgagagtggggaaacaaacgcctgaaaataaaaacaaaatcgaatgttatctatcctctaattccttctatccagtctcaagtcgtgcttttagatacttgatcaacgaaattgccttgtataagctactgggatgttgtttaagagcaatagttaaaacatgtcctttgcaaatattcgaattctatggcccttaagtagaaggatgaagtttctagaagtacttttgcaaactaaacaggacataagggaaccaggcatctaccatgattttgactttctagaggggcaaaagaacagaaaaatattagaaaattaagcactgagccaagttgacttcgtttttttatacttggattggtttctagaattggaaattttggaatttcagttctgattgtgctatttaatttgaaatataaaattgaaatctgttcagaattgagcatatgtgtgggtttttgttttgtttttcgtcatactctgaatcattcagtttccaggcttggaaaaaaatatttttggagaagaatccaatgagtttactaatgactggggtaagtataagaatcttaatgtgtctttgtaatttaattatcatatggtattctagtctctagtttataccatgaactaaatgtttggaagccacttactgtaaacaacataatatatttgaatgttaaggttcattcaatttctacctcagaatatcatgccatttaacttaagtagagagatgtggtatcttagaataatttagcaagtccatgtatcattttagatataaatctgtggcatttaagtaacttataactcaagctttgggaaaattgcatggccctttgggaatctaatgtaagttattaatgccccaaagatgcccatctacaaaattatgcagacaatttcagatcctaggtttaaacccatctgtgcgctcttgggggaagtccatggaccttggctaaaagtacagaggtggccatggttctgaaatactgtgtgatcttgagcaaattaactcatcatttctctaagtctcagaacctctgtgaagtacttggattaactaaaagattccttttagtactaagttttttggtttgtttgtttgtttttgagacagagttgctctgttgcccaggctggagtgcagtggcacaatctcggttcactgcaacctccacctcctggattcaagccattctcctgcctcatcctcctgagtggctgggattacaagcatgtgccaccacacctggctaatttttgtatttttagttagagatgggatttcaccatgttggccaggctggtctcaaactcctgacctcaggtaatctgatttctttcagagaaacaatttttttttttagtttgtttggatttaatagtagaagaataaaatagtgaacattaaatactgatcatgtgacaaatacttatatatctagaaacacaattacaaagaaaaaatgagtttctagattaactctgaaaattttttagtctccttcatgcaccacatattaagatgcagttagttctatgttagtaatacgggaaagaaatcttttaaacctctgaaggttaaaaataacacttatgcctgacttataagcaatcttacatttaaaaatctacgcttgactacttcacaaacagctattttaatacatcatttgtctagaattatagaggcaaaaggcatagccacatccattttcctgtttgttaaaagggcagagaaatgtggagagaggaagaggagagatggtgatgatgatattgcaggcaagaccagatcataggaagggatttagatttccctctcagtgggatgggaggtctctggcaaatttcaagcaaaggagtgatataatttcttcctttgaatgatcccataagttttactgagcccagagtaggtgtgcagtaagtagccattattagctttattattccccaactttaacagtctaatttactttgaattaagttaatttaactaaatttgactgtttcttgctgattcagtcatcactgtaatagatgtatattgtgcttcccacactttactggtcatgtaatcgcctcaggatcttggttaaaattcagtaggtcggccgggcgcggtggctcacgcctgtaatcccagcactttgggaggccagggcgggtggatcacaaggtcaggaaattgagtccatcctggctaacacggtgaaaccccgtctctacttaaaaaatacaaaaaaattagccgggcgtggtggcgggcgcctgtagtcccagatactcaggaggctgaggcaggagaatggcgtgaacccgggaggcggagcttgcagtgagcggagatcgcaccactgcactccagcttgggtgacagagcaagactccgtctcaaaaaaaaaaaaaatttcagtaggtctggggtggcatctgaggttctgattttttttttttttttgttagatggagtctccctctgttgcccaggctggagtgcagtggcacaatcttggctcactgcagcctccgcctcccaaattcaagcgattctcctgcctcagcctcccaagtagctgggattacagacatgctaagctacctgccaccacgcctagctaatttttttatacttttattagagacaggggtttcactatgttgaccagggtggtcttgaattcctgacctcaagtgatctgcttacctcagcctcctaaagtactgggattacaggcatgagccaccacgctcagcctaaggttctgactttctaataagctcccagctgatatagacactgctggtccttggaataagaagggtagaagtagctacctagatagctactagatagctaggagtatctaaaacgttccaaagtgccatgttttcttagtttttaagattttttttcctccactgctgtcacttcttgttgctattaacttgcctattttttaccagcctcttccctcacttctgtcaagggctgaaaccagattaatcaagggtctaagaagcatgtttaaagcgatggtaaagcacctggcctcggtaacttatcgtttcatttgaagaagcagctttgcttatgttctggttctcaatgggctccacagaggagagctatttatatgtataccatttagaggcataaagttttactacatttaaagattggtatataccattttatgttacttagcataaacaattttaagttaaaagcaatatcatataaggaggtagaagcacttcggtgtgttgaaaaacctccattcttttcaataacatattcagacacggacagggtgacttaagtatataaaaagtcaaaagacaaattttaaaaagattaatgatcaggaattcaggaattgttaactggcctatgtatcccttaactgggatacaaaattgtgcccacatgggcatttttctagggaggtcttttgattcctgaaacccatctcttactattcaggttaagtgcctgggtagccactgagcatctgacttgatgaagccccaccaggtgattctggcagtcagccaggcataggaactgctgggatggatatattgccctcaatctaagtgcacagcttttgattcactctctcactggctcactctctctctgtctctcttgcttgctctctcgctctctctgtctcaatctttgtctcattctctcgctgtctctctcgctctctgtctctcttgctctgtctctctctgtgtctcttgctctgtctcgctctcttgctctgtctcactgtctctcgctcactgtctgtctcactcttttgctctctctcgctctctcgctctgtctcgctctctctcgctctctcgctctgtctcgctctctctcgctcgctctctgtctcactcttttgctctctctgtctctctgtctctttcactctgtctctctcagtctctccctgaatctctcgctctctgtctcgctctgtctctcttgctctctctcgctctttcgctgtctctctcgctctttgtctcttgctctctgtctcttgctctgtctcgctctctcgctctgtctctctcttgcttgctctctgtctcactctttccctctgtctctttcactcttcctgtctctctctcgctctctgtctctctcgctctgtctcactctctctgtctcactctctcgctctgtctctctcttgcttgctctgtctcactcttttgctctgtctctttcactctccctgtctgtctctcttgctctcactctgtctcactctgtctcactctgtctcactctctctgtcttgctctctctgtctctcgctcttttgctgtgtctctcgctctctctgtgtgtctctctctcactctcttgctctgtctctctcgctctttcgctctgtctcgctctctgtgtctctcgctctctctctgtctctctctctcgctctctctgtctctctcactctttagctctctctctctgttctttctccactgaaactcttgaaatgtaatggcttatcgtgtggctttaccctaggggaaaagattaccttgaggttgtgttcaacagaggaggaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccataggtaagtataggaaagtatgtttgttcttatttgcaatcttttttttggtggtggggttggggatgggtgttggaaaaataaaaattattgagtgtagtttaactctgctagaagtttttaaaattttaaagttttaaaacaatgagagttgaggtgtatgtgtcatgtgttctgtatatatacatatatattatagccgtgtgtatatatatacatatctataacaggtgtgtgtatatacacacacatacatacaggcacacatgcaaagatgaattaacttctcttcaaaagacttcagggaccagactggtaagtaaatgagagaatgaagtgagagcagttatgaccaattgagcacacataccatttaaagagcacttagctttagcagattgttaccatatgggagtacaggccagctcttcagatttttaaagagaaaccaaaatccaaggttttcagcgatatatcccaatttctaaccgttagctactaattcagttaaagaaggaaacaatcaaaaaaacacagtacaggtcaagcaaaaagctgaatgtgacgcatgagcagtttgtgagccctgcatgagctctacattttttttggtcatgattgtgatagaaccataatgtataatccattgttttgaaaatgtaacccttttttttgagacagagtctcgtgttgcacacaggctggagtgcagtggcacagtcagaactcactcactgcagccttgtcctcctgagctcaagcaatcctcctatctcagcttcccaagtagctgggacccaagtaggtggcagagttgcatgccacctcactaggctaattttttatattgtttttagagaaggggtttttaccatgtttcccaggctggtctcgaactcctgggttcaagcgatctgcctgccttggcctcctaaagtgctaggatgattacaggcatgacctaccatgcccagccagcctttatcttcaatgatgctattaatacaagttctaggtaataattttaataagctcccccttccttttttttcttccccacccaacacaatgggaccattcaaggaccaggcaaactcctctctgggcccttcccatcctacaagtgcattcacaggatgatactgaaatgggtttaatcttcagataattatatcacattcagccagtggatgatatatggaaactaaaaacctttccccaaatctttgatcatttaagggtaaattggcatcagttatagtttctgagggacagagatctcctgtttcttggttccaccctgaattgattctgtttttgagctctttgagtcttttgccaggcacatccttagccgtgtgttgactccctagacgtcagcagtcagctgctggcatgtacatctcttaaggggaaacctagtttctctgcctctgtttcataggagctccgttaatttctttttttggtgccaccatcattgtctctttcttccttctaacttgagggaccaaataataatagtaaaagataatattacctgtgacctattacaggaggggggcttttctttttttcttttcctttttaaaatgtttgtgggtacataataggtgtatatatttatggggtagatgagatgttttgacacaggcacacaatgtgagataagcacatcatagagaatggggtatccatccctttgagcatttatcctttgagtaataaacaatctagttacactctttattttaaaatgtacagttaagttcttattgattatagttaccctattgtgctatcaaatagtaggtctttttttttcacccattggaaggaggcttttccatctcacattgtactagtcctctgattagtagtatttctaaaataatcccaccaattattctggttattactttttcaatgcttttgataagtaacaaatatttgaatgcctgttatatacaaattgctatgccacaggaactatagacacatcctctcccttcaagagttctcacagtcaggaaaatgaaacacaagcaatttaaaagtaaagtacaagaggccaaataacaattcaatacagtgacatccaaaggtaaaaaattattggttaccaaatcagtagaagagagaagtcatatggaacagagtcttctaaatgatctttacctgaatccaaacacatttgtttcctttttcagattcaacttatcagtatataaaaggttctgctgacattaaatccaaccagggaatcttcccctgtggacttcagtgtgtcaccattttaattggtgtctatgacatacagacaggggttcccctgatgggagtcatcaatcaaccttttgtgtcacgagatccaaacaccctcaggtaaaaggcaaatatttttggtatattatggttgttagaacttacgacctcagctttgcttgttgttaggattatcactatatgacattcccatgacttaacacatgggagtgttgccattgaaagtctgcgtatttgaattaaagttctattttcaatcttggatttgcgtaattttatttcaggccaagtgcatgctggtagaaattttaaaattaatactatcctgtagaaatcatagttttacatttggaatatagtaatcctgttccctgtttctagaatccactcaaaaccagataagtagagtggtggtaacactgccttccaatacattgggaataagacagctgccatcgctgtatagccagttgaactttggtataattttagaagttcaaaacaaaatgtgaaaattatccaatgaaaagattggtaggcatggccaggatcagaacctaactcacactccctttctgcctcctcccttccactcttccatgcactcttaaacagagcgtagaaagtggccaggactcagctgcctctgatccatggcctgtgctttggggttgactccagggcatggcaaagtccaggtggaacaagcagttcagctttttattgaaataggtcatattttttcacttatataggattacatatttttattgaacctgagctgcttcaagtaacaatcatttgctctttaatagtcataagtttatacctcttaagttttaatattttccccctacccccaccatcttccaaactaaaaataggtttctgctatctttaaaaggttaataagaaattaaaaagaattggaacaatatgcagacataatcatggcctagaaatggaggtggtcaacaaaatagtttatggcacagattcagagtgagactttgtgggtttgaatgcagattctaccactttctagctgagtgggcctcagcaagctacttactttctctaagcctgtttccttatctgtaaatatgtaacaacatagacagtaagttaagcattgataaagggaaggtgctataattattgtggttgccaaaactaataacattgagtccatctttctttgtgttggaagccaacgtgaaactagtgaataagagaatgaaaaggagttaccaaataaagaaaaacttgttatagggattgtagaatatttgcagatcaaaaagagatatcacttttctattcctttttccctactaaactttaaatactaaaagttgtaatgaaattttgcaatggttctggaagctggaaaccccataaatgttttagtgttgtcctagattgatgtgataatgccataaaattgaaagcatttctaattgcaacaactcaggcagctgcatgcatataagtaactttctgaaataaactagctacctgatatctattcctagacttaaaggtgttaagattcaccatgttatgatgaattgtgtatttcttcgtatcattaagtttgaaagtgacatgagtaatgaaaaacaaatgtgataatcatcaccaattgaaatttttcttctacaggtggaaaggacagtgctattggggcctttcttacatggggaccaacatgcattcactacagctcaccatctctagaagaaacggcagtgaaacacacactggaaacaccggctctgaggcagcattctcccccagtttttcagccgtaattagtacaagtgaaaaggagactatcaaagctgcattgtcacgtgtgtgtggagatcgcatatttggggcagctggggctggttataagagcctatgtgttgtccaaggcctcgttgacatttacatcttttcagaagataccacattcaaatgggactcttgtgctgctcatgccatactgagggccatgggtgggggaatagtagacttgaaagaatgcttagaaagaaatccagaaacagggcttgatttgccacagttggtgtaccacgtggaaaatgagggtgctgctggggtggatcggtgggccaacaagggaggactcattgcatacagatccaggaagcggctggagacattcctgagcctcctggtccaaaacctggcacctgcagagacgcatacctagaggaactctaaccccggtgtacctgtataaactgaactgtgaaactgtttcggttatctctgtcttttgaggatggctttgtcctgttgctggttaacattcaccttcctcttttgaggagtatttttccattatgtattcataataatgttaatttcaataaatgacattcatgcagc

SEQ ID NO: 36259 - DNA, 49803 bp, Homo sapiens
agagaaccccagaacatcctgtgcccgacgggacaatcccagagcctcctctcgcaacagaaccatccagcgagacaaccccagaacatcctgtgcccagcgggacaatcccagagcctcctctcctaacagaaccatccaacaagagaacctcagaacatcctgtacccgacaggacaatcccaggacctcctctcccaatagagccacacgagacaaccccagaacatcctgtgcccagcgggacaatctcagagcctcctctcccatcagagccacccaacaggacaaccccagaacttgtattcaacagaacatccccagatcatcttctacccaacaagacaaccctaaaacctcttgtaccaaacgagataacctcagacccacttgtacacagcgggaccgcacacagtccttttcctttcaacgagacaaccctggaacctcctcatctcaatgctgcacccaaaaggagaatctgagaccatcatctccccaccgctccactcaatggaacaatcccaggaattcatctccccatcgtactaacaaagacatcccctgggcctcgtttcccctccggccaactcagagtgatggtccccgaacctcttccccatctcgctccaagcaaagcgaggttccctgggcatccatcgccctccggccaacccaaggtgacaggcctcagacatcctctcccagcaggccagcccagcatgacccaccccagtcctcctttggccccacccagtacaacttgccatcccgggccacctcttcctcccataacccaggccaccagagcacctcccgaacttcctcacctgtgtaccccgctgcctatggggctcccctgacctctcctgagccctcccagcctccatgtgctgtgtgcattgggcaccgggatgcccctcgagcctcttcgccccctcgctatttgcagcacgaccccttccccttcttcccagagccccgcgcccctgagagtgaaccgccccaccacgagcctccctatataccacctgctgtgtgcattggacaccgagatgccccccgggcgtcctcgcccccccgccacacccaatttgaccccttccccttcctcccagacacatcagatgccgagcatcagtgtcagtccccccaacacgagccccttcagctccctgcacctgtgtgtattgggtaccgagatgcaccccgggcctcctccccaccacgccaggccccagagccttccctcttattccaggacctccccagggccagcacagagagccttgtcccttccatggactctctgcacgagtgcccccacatccccacccctgtgtgcattgggcaccgggatgcaccctccttctcatccccaccacgccaggctcctgagccatccctcttcttccaggatccccctggaactagtatggagagcctggccccctccactgactctctgcatggctccccagtgctgatcccccaagtgtgcatcgggcaccgggatgcaccccgagcctcctccccaccccgccacccacccagtgacctagcgttcctggcaccctcaccttcaccgggcagctctgggggctcccggggctcagcgcctcccggggagaccaggcacaacttggagcgggaggagtacactgtgctggccgacctgcccccacccaggaggctggcccagagacagccagggccccaggcgcagtgcagcagcgggggccgcacccacagccctggccgtgcagaggtggagcgcctcttcgggcaagagcgcaggtgagcccgggggtggggtcagccaggtgggctggggaggaggctcggcagcaggacaggtgaagggttagggtgccaaaagaaagtgttcaaatccccctggcttgccatttaccggctgtgtgaccttgggcaaatcgctccatttctctgtttctgcatattgggagttttctgttttgtgtgtgtgtgtggttaagtgatgtcatgcacagcccagtggttaacagcaaagactgcagtcaggagggctgagtccaaatcctgggtcaaagccacatgtcaactcgtatgacctgatatagtgagttaacctacctgagcctcagtttcctcatctgtaagggaggggaacatgagcacattcattcaaataagggtgaactgtctttttattttttattttttgtttttttttttgaggtggagttttgctcttgttgcccaggccggagcgcaatggtgcaatctcggctcactgcaacctccacctcctgggttcaagcgattctcctgcctcagcctcccgagtagctgggattacaggcacgtgccaccacacccggctaatttttttgtatttttactagagacggggtttcgccatattggccaggctggtctcgaactcctgacctcaagtgatccacccgcctcggcctcgcaaagtgctaggattacaggagtgagccaccgtgcccggccaaaatgagagtgaactctcaaaccctttgatccagactcatgggttttttttttttttcttccgtgcatgagggagaagaagaaagtacccatgattttttcctgccttggcaaagaaaactcatgggtccctatgcatttcagaaaacagttatgtcaatttaaaatgtatggccagggccgggcacggtggctcatgcctgtaatcccagcacttggggaggccgaggcgggcggatcacaaggtcaggagatcgacagcagcctggctaacacggtgaaaccccatctctactaaaaatacaaaaaattagctgggcatggtggcgggcgcctgtagtcccagcaactcgggaggctgaggcaggagaattgcttgaacctgggaggcggagcttgcagtgagccgagatcgtaccactgcactccaacctgggtgacagagtgagactccatctaaaaataaaaataaaataaaaatgtatggccagagctacctattttaagaaagaaagctcacagaattatggatttttagcagtcaaacatcctgggacacctgaagtccaggtgtcttttgagtctccttggtcagcagcactggccccctggaaggggagcatttcctcctgatcaggctgaggtttctctccccagaagttccagccctcgagttttcaagaatcagagctagaattccattagttagggtcaagagaacaacagcaacaaaaagcagtctggaagtctcaaaactttccatgtatataattcaacgaatttttagtttatttaccaagttgtccaaccattgccacaatctaactttagaacattttcatcaccctaaagggtatggaatattttgtatctaaaattcctctttgctgctccttgggaaagttttctcctggatttgaatctgcatgagaaaccttatcagtcttggctgggtgcagtggctccctcctgtaatcccagcactggagcttgcagtgagccaagatcatgccactacactccagcctgggtgacagagtgagactccgtctcaaaaaaaaaaaaaaaaaaaaaaattagccgggcatagtggcacacgcctgtagtcccagctactcaggaggctgaggcagcagtattgcctgaatttgggaggtggagtttgcagtgagctgagattgcgtcattgcactccagcctgggcaacaagagtgaaactccatctcaaaaaaagaaaaaaaagaaactttatctcttgttcttcaaatttccttttccagtaagcttgatcatttaatatccagatgacaaccgtgtggtctccagcattagtataattctttctttggccttaaaaacaaaaacccagagcagttttaggtttacagcaaaattgagcagaaagtgcagtgttccatgcacagcctctcccactaccaatatcctgtactagataggtatgcttgtttccagctcctggcctcaagggatcctcctttcttggcctctcaaagtgctggtgagccactgtactgggcagtagggtgatacatttgttacaatccatgaacctacactatgaaatcacccaaagtttagggttcactcttggtgatgtacagcctataggcttgaatgaatgtatgacaagtatccaccattgtaacatcatggagtagtttcaccctgaaagtcttcagtgtctttaacttttttttttgtttggagatggagtctcgctctgtcacccaggctggagtgcagtagtgcaatcttggctcactgcaacctctgccttctgggttcaagcagttctcctgcctcagcctcccgaggagctgggactacaggagcatgccgccacatccggctaatttttttgtatttttagtagcgacagggtttcaccctgttgcccaggctagtcttgaactcctgagctcaggcaatctacccacctcggcctcccaaagtgctgggattataggcgtgagccaccgtgcctggtctgaccttttttttttttgaaacagggtcttgctttgtcacccagcagtagtgcagtggcgtgatcatggctcactgcggcctcaaactgccaggctcaagcgattctctcacctcagcctcctcagtagctgggactacaggcgtgtaccactatacccagctaatttttctactttttgtagagatggagtctcactttgttgcccaggttggtctcaaactcctggcctcaagcaatgctcccaccttggcctcccaaagtgtctttgacctttttatgattactatttcttgtctaatgtcaattttcctaactttgtcttaactaataactcagcagggacattaaggtctttaagccaaagttaattaattttctttccttttttccaggataatttcagagagataaggtgtttatattaataatagaaatgagaaatatgtttacacttttattaaccatttgtttttacacgatcactcctatacatttaattctactctctttgaaatagcttatttaccttttagggaagttttcataattttactgaataattaaaatttttcctcttatctggcaccttttccaagtagaaaaccattcatcctctgaatatggaaaattttaaaactgtgcagtgtgtgtgtaagggacagactggagcttatgagcgggtggctgtaggagtgtgcttttattttctcctatttcctcatcgatatgtatttattgagcatctactctgtccaagcattgtcccgagtctggaaaatttttcttaaagggttgtcacatcaaagcattgggagttttggcttgatcttaatttttttttccttagatgcctttggcatctcttagagtcacgtagcatcctgtggtcatttgaattcaaaacctagccttcactggatttgctagacttgatggctttgctcctttaattctctctggaggtcgaagaacccatctaagcttccgaaggaaacgtttcctttgtcatgcttggtgcggccacatcaaccctcgggaacaggtggccccgaggagacgctgttgcttcagcatcggacaagccaggtctctgttggggtttcagaatcttcttgagtccctcactcttttctctcagttctacatgggggaaaaaaggaaggcgagttctcaggaggaatgctcatcaagcaagctggagttcgtatggaaaatgcatccatccggaagagaacacacaagtgccttgcttccctgcaccgggtgtttccactattgtcctcctggtcctccccattagggaggaacagcccactgggtcacgtctgggctcttgcttcatcgaagctcctataccccagttcgggggaaaattcactctaaggccttcagctctcacagagtaaggaaacgcactcacctccaattagattacaaattggctgggtgcagtggctcatgcttgtaatgccaagactttgggaggtcaaggcaggtggattacctgaggtcaggagttcaaaatgagaccagcctggccaacatggtgaaaccccgtctctactaaaaatataaaaattagctgggcatggtggtggacacctgtaatcccagctgctcagcaggctgaggcaggaaaatcacttaaaaccagaaggcggaggttgcagtgagctgagattgcaccactgcactccagcctgggtgacagagcgagactccatctcaaaaaaaaaaaaaaaaaaaaagttacaaacagcctgcccagggagccctcaagctcagaaacacttcctccagggaactttggttcctctccgaaccagctgccaataactgctaacaactaacattattgtgctttatggctctgattctaatgacattggcaaaagacatgaaacaacaaaaaactccaaccccatactttttttttgagacaggatcttgctctttcacccaggctggaatgcagtggcatgatcatggctcactgcagcctcaacctcccaggctgaagcgatcctcccacctcagcttcccaagtagctgggactacagccacgtaccaccatgctcggctcattaaaaaaatttttttttcctagaacaaggtctcattctgttgccagggctgtctcaaactcctcgactcaagtgatcctctgacctcagcctccccaagtgctggaattacaggtgtaaagacactgtacctggcctcccaaccccatatatatatatatatattttttgagacagggtctcactatgtcacccaggctggagtgcagtggcgcgatctcagctcactgcaacctccacctcctggggtcaagcgatcctcctgcctcagcctcctgagtagctgggattacaggcacgtgccaccacgcctggctaagttttgtatttttagtagagattgggtttcactatgttgaccaggctggtctcgaactcctgacctcaagtgatccacccacctcagcctcccaaagtgctgtgattagaggcatgagccaccacacctgggctaatttttgtatttttagagactaggtttcactatgttgtctaggctggtcttgaactcctgagctcaagccatccgcctgcctcagcctcccaaagttctgggattacaggcgtgacccattgcgccctgcccaatcccatacttttgaaggtgtcgttccagcatggctcctcaggcacaggcccaccacagacagcagggcctatggaggcctgagcagagtttcctcatacttccctttttgctgcctcactctgggtccaccacagggtggcctttttcaggcttctcttcctggttcagttcatcgaccaaagacatggctccatttgctaactgagacccaaccaaaataaacattcatggagtggttgggccttttgttgtgaccccttaggtagaggaagggagagatatgcccaggttctgtttggtgtttctacctgtcaatagagataccacgttaatcattaacagccatgcctcccagttagtaagcaagacaactaactggaactagactttttacacaagttagagatgatcttcatcggatgcgtcaacaatgcctgaagcccagtgtcttagaaacaacacttgcccagggtcaggcgtggtggctcatgcctgtaatcccagctacttgggagattaaggcagagaatcacttgaacccgggagatggaagttgcagtgagccgagatcgcgccactgcactccagcctgggtgacagagcgagactccatctcaaaaaaaaaaaaaaaaaaaagacacttgcttggacagtttatgttggcctctctgaagttgtcagggagaatgtttctttcttctgatcttgctcagagctcttttgccaacagctaggatggcctggagttttcaaggctaagcgctgggattctgttggttaacagtgatgggagggaaaaaggaaaagaaatccaaaatttacaatatggacaggaaaaggcagaaagaatggaacacgggggcacacagcagtctggctctgtcgtcccacctcgtgggctgcgatcatgatacaagtgcttggcccctggaacataagaagcactcaataaatgctttgtcataatgattatgtgtgcccagtgcctggtacacagtaggtgctcaataaatcttaattcccgcaaagaccagtctaacctttgtctgggggtggctcttgggctgctggtggggtggtggttagtcataggaagtactggatgagacaggagagggccatggccagggccagatccccctccccacccaaccgcctctactccccacttttctcgtcatgttcgcaagagcctcatgaggcagaatagagcagtgttaaccatccccatttttcagaaggggaaactaaggccctgagagtcatcctcacttagggcccttcaacgagcttgcagtgggtccctggctgtcccacatctcctcctgttggaggtgggagcagaggggctggggtgctgggagtgggacagtccctcagaggagtggctgcatttgctcataggaagtccgaggcagcgggggccttccaggcccaggacgagggacggtcacagcagcccagccaaggccagagccaacttctccgaagacagtccagccctgcccccagcaggcaggtgagcactgccagctgtctggggccccgcaccccaaggggcggccactgcctcttccctcccgctagaagccaggcagggggcttggacaggaaggtcctctatgaaagggtcggagtccaatcatggggatccagctctcccctctccccaacggccagcagctcttggcaaaatgcacaagaccccacattaatcctttgaagatagcccctctcccacgctatccccttcctttactaagcactgctgtcttttttttttttttttttttttgagatggagtcttgcactgtctcccaggctggagtgcagtgggacaatattggctcactgcaacctctgcctcccaggttcaagtgattcttctacctcagcctcccaaatagctgggattacaggcgtgtgccaccacacccaactaattttcgtacttttagtagagacagggtttcaccatgttggccaggctggtcactcctgacgtcaagtgatccgcccaccttggcctcccaaggtgctgggattacaggcgtgaaccacggcacctggccaatactgctgtcttgagcagatttcagggaaagccttgaagcaagaatctggctctaagggccctctctttcagggtaatttgtatctttaaccaaacccagagggctaggcccgcctcagtggaatggggtattggtggtggaggttctggcacctgatagcccaagttggaatcagtatctttgagaggggtgagaagccaagaacgggggcaggtctttgcagatctttttctggaactgaggaaagcgggtgaaagggaggagctgaccccggaggggtggggcagagaccctgtgtactttttggcctgctttgattcaggctgctgtgtggacacagccttgactctctgggggcctaagaaaggcagagctggcagccaggtccccagagagagagcctcacctaccccctcacctcatccccaggtgaccatgctccctgccaaacaggcagaactgacccggcggagccaagcagagccccctcatccttggagtcctgagaagagacctgagggagatcggcagctccaggggtccccgctgccccccaggacatcagccaggacccctgagagggagctgcggacacagagacctctggagagtggccaagcaggcccaagacagcctctgggggtgtggcagagtcaggaggaaccgccagggtcccagggccctcatagacacctagaaaggagctggagcagccaggagggaggcctgggccctgggggctggtggggatgtggagagcccagcctgggggcagccaaagccccggagggagcatgggggggcacttccagggagtacaaggagagctgggggcagccagaggcctgggaggagaagcccactcatgagctccccagagaactaggaaagagaagcccactcacgagcccccctgagaactggggaggccccgcagagtcctcacaatcctggcactctgggacacccactgctgtgggctggggggcagagggagcgtgtccatacccgcgtggctctgagaggcgacccgagcttgactggagggatctgcttggccttctccgggcaccaggagagggggtctgggcccgtgtccccagcctggactgggagggcctcttggagctcctgcaggccaggctgccccgcaaggacccagctggacacagggatgacctggccagggctttagggccagagctgggtcccccaggcacaaacgatgtccctgagcaggagtcacacagccagccagaaggctgggccgaggccaccccagtcaatggacacagccccgcactgcagtcccagagcccggtccagctgcccagccctgcctgcacctccacccagtggccaaagatcaaagtgacaagaggaccagcgaccgcaactctggcaggcctggagcagacgggccccctggggagcaggagcactgcgaagggccccagcttgccagagctgcaggtaaggaggtttccaccctcccaagggtagccagaaagtcagccccactcagccaagtctccttggaaaagcctccccttggagtagcctaagctcctgcatccccctccaggctcagacctcagcctccctgctgaccacaacccatcccgatcaccaaactggcccaacaatgatgatgagcaacacagttttaagcgtttatgggccaagccctgatctgaatgtttgacgtgtgcttttcccatttagtctccttagcaaccaggtgagaaatacactatttacagataaggaaactgatgcgcagggtgaagccacttgctggtggggcatgggcaaaacccaggtctgctcagtgcagaccacactgaggcctcaagcaagatgctctggccagggcctattcccctcctggctccaccatacctggtttatgttgtgtctggtggcacacacctgaccccacctgggactgtagccagtgtgggcatgccccttcccctggtggtactcaggtacctgagtccaggacagcctcgcttaccctctctggcccctacagctcctctcagacacagagaagagggtgcatcaatgctcactgggttcagctagctgccaagacaggctgcttaaatgagggtcgtgtgcaaagtgggcccagcgccgggcacacagtaggtgctcgcccttcccctgcttcactggtgctttggtgctgccttgaagcccagaacattcttcatctgaagatggtgggcagggagggtcttggaggccagaatcctgcaccctggcaatagctcattgggaggacggcatgtggttttgaacaccagcctctctctctctctgtaagatggaccaaccacttctctgacgggcagcgctggggtgccgtgggggttcctgcttgtttctccaaagcctcctcatctcctagatgcaaagtccaacgccacctgccccaggatgagcagggcttccaggcatcagggtgcaccccgtgctgggcccagggccttgccatatgtgcctcaagtggataggaggcagctgccacttgacagatggggaaactgaggctcagactccttaggcatttgctgggggtcacacatgcataggtcgtgagaaatgagatcaaagcatccactccaaagtttgtgcttttatttttatttatttatttacttattgagacggagtttcgctcttgttgcccagactggagtgcaattgcacaatctcagctcactgcaacctccgccccccaggttcaagctattctcctgcctcagcctcccgagtagctgggattacaggcatgtgccaccatgcccggctaattttgtgtttttagtagagatggggtttctccatgttggtcaggctggtcttggactcctgacttcaggtgatgcatccaccttggcctcccaaagtgccgggattacaggtgcgagccaccatgcccggcctaagtctgtgcttttagccaccacgtcacaaagctcctgagcccatgggaggactggagaaccctctcccctgtatttccctgtggctttgatgagttgaccctccaatcaactcaatgcgtggacatcagagaagcagggataagtcagctcgtcctgccctcagattgctgtcaggcttgttaggaaggcacacagacagctcaaggaggacacggtgctgtgtcccggggcatgctgggtgccacaggccggccaggtcaagaaggaagttagaaagattcttcagtttcatggtgaagctcagggttctcaggaggctaggagatggtggctgggaagggatgggagcaccatgtactgaaaggaatttcacagatgacaaaacgagtaaccaccaggtcctgctggggctccagctgctcctctctatgaaaatccttggcttggcacagctgggtgcagtggctcacatctgtaatcccagcactttgggaggctgaggcaggcaaatcacgagctcaggagatcgacaccagcctggctaacacggtggaaccccgtctctactaaaaatacaaaaaattagccgggcgtggtggcgggtgcctgtagtcccagctacttgggaggctaagacaggagaatggtgtgaacccgggaggtggaagttgcagtgagccgagatcacgccactgcactccagcctgggtgacagagcgagactccatctcaaaaaaaaaaaaaaaaaaaatccttggcatggcactcaaggccggcttcccttccttccactccggatttgcctcattggtgctgagctggctgcagggcctgtgagcacatatccctgcctttgcacatgctcttccctgttcagccaccaaacgcctgttcattgtcgaagtcttaggtcaggctccctgtcctgagaagccttccctgaacagtcactcctagtaatggtccccttctgggcttggcagttttgcttccatttgtccatgcaacatccatctaatagggttgtcatttccccataagctccacacaggcaggatctctacctgctttatctctgtaactctagctctggcccagggcctgacataaaggaggggacagctcagtggatgcatgcaagatggaggacacaggggtcagtgggtgaacaatgaatgaatggagggtgaatgtgtgaatggatgatggatcaatgatgcatgttgaatgaataatagacatcttttggatggatgacagatgggtgatgatggatggatagctgggtgatgaatatatggtggtggtggatatatgatggatgttgcttaggtgatggatggatgaactttgggtggaatatgaatggatagatgtggcatgggtggatgaatgtcagatgatagatgttggagatatgggtagatggatgatggatggagagagggatatgtaggtattgggtaaatggatatgtgatggatcaatggagggtagatacatgaatgggtgatagacaatggatgatgggtacatgagagggtgagtcatgtgatagacactggatggttggatggatacatggatctactgatgctggacgttagatgggtgttgcatggacagatgatagaatggatggatgaggtggacagatgcatgcatcctggagaataagttgggctaagctgtgttctttttttaatctccagttccaaccagaggagcctgaggagtcagaaccaagcagaggccaagaccccctgactgaccagaagcaggcagactcggtagctgggtcatgggtgtgggtacatacggtggggaagggagggggaagcaggttggagatgggcttcattcctcagaagagccctagaatcaaccagaccaaagttggcattgccatggggtcatctatgtgcatggtggggccttaagaagaggggctctgcaggagccaccttctggcttggggacctgggtaggtgggcgatcctggggtcagaaccctaggccatgcttctcatttgctgggactgaaaaggtcaatgtctttccctgcgcaaatgatggtttggccccagtggtctctgtgggaagagatccttccggtttgaaagggccaggccaggctgaaagagcagggcttccacgagcaggagccagagagctgaggatgtacccagtcagccaggcctggagggtctccagggtcctggaggcgggagagatatgtgcgggggtgggacccacggatgctgctctgaggcctggctgcagctggtgagcacaactctgcccgcccctccccgtgacctaccaaacagactgttctcgtcaccctcagcctccagagaggtgagatcagagttgagggccgtggggcagtgggaggtgggggaggaggagacagactgtttggggctgtgttttccggtcctgctcttcctcccgttgcctcctgaagccaggggtggcagggagcgtccattgggcagcatagcgccccccaagtagggccctgccgtgagtcaaagctgggggaattctgcccaaaccctcactgtgcagatgaggaaatggaggcaggggagtcgtcccaggttatacagtcagtggctagctggactgggactagaacccagggcccaggaaccacccagcgctctctctgcacctccacctggcacccatgctgcccccgtccctgccccgatttcttgcgtggcttcgaacggcagtgctgtaacttcgagcagtccagtcttcccatctgtggaatgggcggggacaggggacactggtcgctaaaggcgctgccagccctcccagggactctgacaactttgctcttcctctttctgggttatttcttcatatcctggagccagagtagtgaacgaggcggaaacagcaatgccggggtgcccctctagtctccatgaaacgggcccggcccatcaacgtggaaaatatctcaacctacccccacccctaggcagccttgactggtcagaactgataaccacctcattcatgcattctttcacacacacttagtgagcaccttctgtatacccaggtgtgggtcacaggtgagtcggagcgccatcaaagagttcagtctagtgagatggttgcatgcctgtggtcaggactgtgatggggaatgtggtagcagggtcgggggcacccctacccccaaagccctcctggacctgtgctttgatgcttcaagttccacttccaaagagtctgcagattccagagcgaggaccctgggctctctcctaccttcccagtaacccatgtgtggctttggacaagtgcctctgcttcacaggggccttggtttccccaacgaggatgactccaaagagggagcatttgggggctctgctaggaatgtgtgtagaagtccacaactcattccctttgcttaagctggggtcacaaacctaacgccctgaaggccaggcaggtaacaatggtgagaaggtgggggggcaccgagggcacttgtgtgactcctcggttccagatagctgttgccatggggaagacgggcccagagtttccacatctttcgatatttcaagaaacactggagatatgtatttatatgtgaaatctctaacctaatgtgaaatactctgaaaacactatgtgggcagaaacatacctgtggtctgcaccccctccagctggcgcccgtggtttgactttagggtgatgacgtgcacaccttcaaaggtgctgagccctgggagccttgtcagtccaacacgatgtagtgtgaacaagttaaccagctcgtctcggcagttctgggaggagagaaagatgggaaccctggggctccatggtggggggcaccacagaatgggcaggggaggctgtagccaggggtgcccccatcctgccaaagggacctggggccaacactggaccctgtttgacaggcagacaagaggccagcagagggcaaggctgggagcccgctcaagggccgactggtgacctcatggcggatgcccggggaccggcccacgctgttcaatccgttcctgctgtctctgggggtcctcaggtggcgaagggtaggctggctccagtggggactggaggggtgagggtggatagagacggggatgggagggaggagggggctgttaagcaaaggagagagagtgggggctgaggaggaggcacctagggccgtcgcatgacaggagaggtgggagcagagctcttaagctcatcctggtctcagcaagcgagtgggtttcccacttccggggcaggcttgggggctgctttcagcttttggagtgaggggtgatggaataatctacacagctgaaagcttccaatcagcagcctctcgccagccctgggccaacggggagccaggtatgggggaagggaaggcgagcttataagtggctctgggattgcaaagtgtgtctcagacctgggcctgagccagtttcacaaacatctggcgttacgtaacccatcccctgcccagagaggcctggaaacactcaagcctctggctgggttttccacaagggcaggcagctgagacccgctccctcccacccgcttcacagcaggacagaaggggcctggccatctccagcagccacaggctggctcatggggtctcttctctctttgagaggctgactctcttactcaccgctgttggctctgagtccagcactaggctgggcacctcagagacagtgtgcccattttacagatgaagggactgaggcccagggaggtgagctgacttgcctgaggtcgcacagcttggggtataaaggagctgattttcctcattctcagatgagagaagggttgtagccaaacttactgagcctcggttgccacatctgtctattaggaaaaagtctgtggagactcagggctgcagagagggctcagggagatcaggatgcatggaggttgcggggctgttgtcgaaacactaactttcccatccacttcagaatttcctttttttaaaaaattaagacggagtctcgctctatcgcccaggctggagtgcagtggcaccatctctactcactgcaacctctgcctcccgggtccaagtgattctcctgcctcagcctccagagtagctggaattataggcgtgcgccactgcacccggctaattttttgtatttttagtacagacagggtttcaccatgttggccaggctggtcttgaactcccgacctcaggtaatccgcccaccttgacctccaaagtgctaggattattggtgtgagccaccacgccaggcgtttttttttttttttttttaaattaagatagagtctcgttctacccccagactggagtgcagtggcaccatctcggctcactgcaacctctgcctcccaggttcaagcgattctgccatctcagcctcccgagtatgtggtactacaggcgtgtgccaccacacctggctaatttttatatttttagtagagatggggtttcaccacgttggccaggctggtttccaactcctgacttcaagtgatccgcccgccctggcctcccaaagtgctgggattacaggcgtgagtcacccagctgagcccagaatttcctttcgctgctctttgtggttaaggcaccgagggtgagcaggcaagcatggttatctgagtagtgtggtacctttaagccatgggcaggaattaccttgtctaactaaaggtcaccaacacacagcacgtctggcaggagggggcaggtaagtccttggtagagcgaaggaggagcgaagcagggaaagcactctggggtaatgatgctggctaaccagcacttattgtatgcctactacatgcccagctctgtgttcactgcatggcgccacctaattgcatttgatccacactcccaggtgcagttagacgcctactgtccattttacagatgatgaagtgaagctcagagagggagggtcacttgctccaggtcacacagggagcaaggggcagaactgagattcagaccctgctctggctgacctcagagcccagtgcttccaacacgccccctacaccactgccttcacatcctgatctctctgagccctcctgcagctctgggagtccccacagattttccccattagaaagatgcggcaaccgaggcttggtgaggttggctacagtggttctctcatgtgggagtgagggaaatgaagagctagggatggaactgccagcagggcctcccagttacacagagcagatttaaacttctcttgggctgaagcagtgaaattagcccaaggccaagagccagaaagcctggagtcgagttctggcttggcacctaacttgtgtgcccttctctgagccttaccttattattctcagtagagtaacggtttgagactggataacctcgaagtttggtagctctggtctttgccagtttaataactcacccctgggtccctgaggctgtgctgtctctgacctgccaggatgagttgtggtttcttcattggtgcattcattcattcgagccgtgcttacggaggatgtgctgtgggcttaggccctaggctggtttccaagatgtagacaaaaaacattccagccctggccactggagcccagttaggtaaggacactgacatgtaactgatgagaacagtgtggtcaccactttagtggggaaaggtacagatgtagggagcactgggccagcagttcctaagtctgctggggacactttggcttcctttggtctgagacttcaaggaagaaattttccaggccaacaagcattgggagggggaaggggagaaagagagagagaatgtgtgtgtgtgtgtgtgtgtgtgtgtgtgtgtgtgtgtgtgtgctgggtgtgtgtgagtgtgtgctgggtgtgtgtgtgtgtgtgtgctggggtacagaagacaggaagagaagtgttccaggcacagcagagaaccatcagggggtagaaggacctgtcttatcctgggaattcctagtagtccagtgctgtgtatctttttttttttttttttttctgagatggagtctcgctctgttgcctaggctggagtggaatgcagtggtgtgatcttcactcaccgcaacctacgcctcccaggttccagcgattctcctgcctcagcctcccaagtagctgggatcacagccatgtgccaccacgcccggctaattttttgtatttttaccagagacggggtttcaccatgttggccagcctagtctcgaactcctgacctcaggtgatccacccgcctcggcctcctaaagtgctgagattacaggcataaaccaccgcgcccagcctccagtgctgtgcatctctttatttacttattgtattttgcaaaattgaccaaagtatgtgtctctccagcctgtcaaatgagaatctggaaggccaggatgacaggcaggagccaggttgtgatggttcctgactgcctagaagaggaatgtagcactgatctgtcagcattggtgatgtgtggaagaactttgagcagggaagtggtctggtcactgtgttgcgggtactaggaggagtcgcaggggccagaaaagcctggaggaggctggtgctgttaggtgcccagggcactggaccaggaccctggtggtaggtgaggtctcctgcgtgttcattcactctcccaaggactgactgcctgagtgaggtgcaagggtagggtgagaaaactcagcccggggtgccagaaggccagtttctagagttagatggacttaaccttggcctcattcctcatggtggagagactcctggcagcaaatgctgggaaagaacttcagctccctgggcctccatttctttatctgcaaaatgggaacagtaattataaaagcaataatttttttttttgagagggagtctcgctccgtctcccaaggtggagtgcagtggcacaatctctgctcactgtaacctctgcctcccgggttcaagcgattctcctgcctcagccttttacatagctggattacaggcgcctgacaccacgcccggctaatttttgtatttttagtagagacggggtttcaccatgttggccagtctgctcttgaactcctgatctcaatgatccacccacctcagcctcccaaagtgttgggattacagacctgaaccaccgcgcccggcaagggcaataatttttgaaccccaaatcaagatgacagaataattgaaatgccaattattccaagcttccctgcctccttgcctaaggatagctaatgagggataaagaggttgtcctaggtgccttacttgaattaacacttaatccttccagcaacctcatgaggtaacagcattaccccattttacagagagtgaaattgagcaccgagaggtgccttgcttaaggtaacactaggctggaatccccgtgccacacgaacttcctagtgcatttagcaaccaattccaccacggtccctactcacctgcaggaaaagagcatctaacaaacggcccagcgttctgggaacctgagcaacgggtgcacgcccacacctgaaaaaccccaaaccaaaaaagacccatttgtgaggagtgggcatttgggagagaccctgccatccaagaactcactttgtgtccagcttactcgctaggaattccgcctcttcctgtgtgacctcgggcaaatcggctcacccctctgagcctccgttttctcattagcaaaataagacctccctcccaagtctgtggtgaggacgaaaatcgactcttggcgagtgggacccgctgagtcgttagtactgggtgctttgccccggtccccgccaaatcacggcgccgagccctagcggacccatcgctccggggccgggtcgggaagcgcagcctgggcgagtcgtgcccacgcccggccgcccgcatcctccgcccccgcgccattgccggagtcacctgcaccctgggcccttccttcctcccagcgcgcccgcggcccgggcccgcccgccctccggccgccaccgccctcccttccctgcggccccatccgcccaccccgccgtcccgccgtcccgccgccccgccgccctagcgcgcccgtcccgttgcggcaggtcccgcccccggcccgtctcgcgcttccattggcccgccgcggcccccgccgctgtttgtctcggcttccccgccacccattggcccgctcgggtcctcccaggaagtttgaaaaaaaaaaaaaaaaagttttatgggcggatggaaggggccggggcagcgtcggggaaaggaagggccggaggcgcggcggcgggcggccgagaggggcggcggcggcggcggcggcggggttcccgcgccgcggagcccggcccgagagccgcgtccacgttcctgcctcctgctcccgccgccctggggcgccgccatgacggtgagtgccccagtcagccgcccgcgcccgaggccgggagaagggcgacgacccgaggcagagcccagcctctcccctccggggcagccccctcctcatttcccgaaggcgagaggagggctgggccggaagacggggccacctccgaagcgctttcggccagaccggcctcacccttcccgcaggctcctcctcgccttccctcgcccactcgcccccgggagcccaggcgaccctgaggggacggaacgacccgtctcgggcgccccctcctcacacttgcggcaccagtcacgggtggattcggggcgaccctttcccacctcccctccagccccctagacgaagacccgattccccaaggcggccaggggccccagggaggagcggaggtgggcctgggctggggaggggcgctcgtgggtgcggatgggtcgcgctgacccgggcctgggcaagccagccctccgtgtggccgctggcccgaggtcgggtgggcgagaagtggccggaccgccccacccacagcccgggaggcagtcccgggacgtctgaagcagcgggataccacgtcttcctgggcttgcactttgcagcggtcctggggccttgggacaagcctgcgagtctgagtagggggcatgatggcaggggtttgcctttctcatgggggtgagctgtacccaagccccatcaattacctgtgccatagttagcatattgagcctcacagctgggttcgctggactccccacttcacagccagataaactgaggcttggggaggggcgctggtgagttgcccgaggtcaccccaagtataagagaaggagtagctcctttccctgtccttctggcccactgaccgtgatgttcgggaagggaggggtggggctgcttttggtttctggctagtgcttcagggaggctctgacagcccagtggccctcctgggggaggatgagcagggtgtgtgtgtgcacaggcggcagtaggcctctttcaggggagtggagaccctgcggaggagtgggtgggctgctgggggcgggctgggctgctggggggcgtggcacgcctagcccctgccctgtgagtgtgatggcctggacttcctcggcgtcctcctggacatcctgccacctccctgctggcccttcctgtcgtcagcagcctccccttttctgtcaggagcagaagggatgtggggggaggagctgagtcagtgtcctggggccaggaggagagaagttgccttgcccaccgggtgcctgcccggccctcagccgggtgctttcacgttaccagatttgatccttgaaggttggtagtaacatcttaatcaaacagatgaggaaaccaaggtgtggcgaggtgaagtgtcatgccccaggtaactcagtgagtcccaggctaagccagaatttgtatccaggtccgttccagctttctttcacagttgcctgtcctgggggcagcacgtgctgagcaagggtaaggctgccggaagcagcgtgtggggtgcttggaagatggacagcacatccctgctggtggcagcagccttcctgagggaggtgtcctcctgtgattatagggccttgtcaggtggagatggactagcgaggagacagcagtgtggacagaaacgggtggtcatgtttgagaagtagcaagagcgtagggaaggggtctggggaggagggcctcactgctagggcttggacaggggcaatagagagccatgaaagcttttagagcagagaggaggctatgatcaccattaatagtgttcattgagttcatcctggctgccatgcagacctcagcctgctctcagctggtgctcctcctgtacccacctcacaccctcctcccctggcccccgtgccctgaatcagggatccatacagagcaagtggcacaggtgtgtgagtgtgtgaggctccggggcttcagggagttgggattctcttccaccccttttgcctttgcctgggtgcagctttgctcccggatcagccttccccctcgcctgctgggcatcaaattatatttggtcccttgtttactgtctctttcctacagtccaccagggcaggggccacagctcttggtcacagctaatttcctggcctagaacagtgcctgataactttaaaaaaaaatttttttttctgcaaacactccctgagcccctatctgtgctgggtcctggcaggtaaacagtgtatgtccctgactgtgagttgcatctaatctagcctgtgaaggataagtaaagggcctcaagatagtcacggatgcaacagaggcctctgagaggggccatgggagggcaggacgggggcggctggtggtgcggtgagtggcatgaactgtgaagggacctcagaggtggccattaagctgggtcttaaggcctgagtagccgcttgcctagtcatcggaggaggaggaagcatagtgtttcaggccaaggacatggcacatatgaagggcccggagtcctggtgtgttgtgatcggcaaggaatatgcagtggtataaacaggggcccctcagcaaggggaggccaggctggaagagtgtgatgaggcttccctgccatcctgaggcagctggactttgttttaaagccacctggagaccgggtgtagtggcttatgtgtgcctgtaatcccagcattttgggaggctgaggtggatggatcacttgaggtcaggagttcgagaccagcctggccagcatggtgaaatcccatctctactaaaaataaaaaaatttgctggacatggtggtgggtgcttgtaatctcaggtatttgggaggctgaggcaggagaaacgcttcaacccgggaggtggaggttgcagtaagccgagatggcgccattgcactccagcctgggcagcagagactctgtctcaaaaataaagcaagccacctggagccgtccctggaactgttaagcaagcctgggataccaagcctttttgagtgagtcccgccagcccgagggtgtgtagaggggttgtgtgcctggccaggtaggaggcggggctgtgagaacctgccagtactcccgaaaggcggaaggagaaactgagcttctagcaggtgaagaagaggtagctgggcctgaagagccctgtatgaaggggcatcgtgggagatttagatgatcggaccttttgaccctggggacaggtttccctgccagtttaaaaactcacattggttggccgggcacattggctcacacctataatcccagcatttttggaggccgaggtgagcggatcacttgagctcaggagtttgaaaccaacctgggaaacatagggagaccccatctctacaaaaaaaaaaaaaaaaaaaaaattagctgagcatggtggagtgcttatgtcgtcccggctacttggaagctgaggtggaaggatcgcttgagcccaggaggttgagtcagcagtaagctgtgatcacaccaccacactccagtctgggcagcagagcagggccctgtctcaacaaaacaaaactcaaattggtgaccttctatccccaaggtcactgtgtcatggcgtgcctgacatggtatgtgatgtgtctgtactgggctctggaggatcactaggtttctccttgtacagacacgttcagtcctgtcggaagctgcgggaggggaggaccgccccgtcatttgccacatcaggcagccaggactcagagaggggatgtgacttaggaaggtcacagtgactccacttcccaggcagccctagaggttccagcctgacagcttgtcattcctgccccaatctcccagccctggcccagggactttcgcctgggactgcccagtggtgccagctctgtgggcccaggaagcctggctcctccgggctaggtgggggtaggggagatggcccaaaaagcacagaaatttagaccagggggtagatatttcctcagcaagtttttcctgagccttgctgtggtcaagccccctgcaaggccctggggccacaggaggtcccagactgaggggaagtggagccaggtgtggtcaccaatcttcattcttagcttgggatcgccctgggcagcctccgtctcaggtggaagacggggtgggcagaatacagagcagcgggacaaacgcagccccaggggttctcggccgtgagcagagcctgtgtctctcccttagacaggtatacagggaggggctgggatgccaacctactgggtcccccgactgtggctgtggaaggttctggatcttcagctgtcccaagccccggttggtccacttcctatacctgagaaggggctccgtgggtggagagtgggtcgggagaggtggccaggcagggtggctgtggtttccagctgccactgtcaccgcccactccactgagccatgccacccgttctctgcaggcaaccagacaccttggcctggtgaggcctcgatgtaggggctgataggtaggctcagagccatggcaaccggtggccacctcctccctgccggcgccaggagcggagactgcagagggaccgggacttagatgagagaggtctccccagcaggaagggagggtctggtggttggcacccactagatgagcatggtcagaaaaatatcaggatgagcaacttctttatctaggcctgggtgggggtgcctggcacaggtctccatgggacatgctgcagctggtagcccccagaccccggggctgtgcccccctgggcggcacccagaaggtagggcttgccaggactgacccttcccaaagagatctaggcggggaccagagggtttctgaccccagcctgtgactggctccacctcccatagtctcctggagccgaggaaaggacaggactggcgggcccatgggagggtccgtggggcacttggtcctcgtcagagggaggaactggacagttcgcgcagtgctgctggtctggactgccctctgagctctcagggggtctctatgcaggcagagtcctcccagcccctctctcccattcttgggcgaggggtcggctggagagaggcccctgggacatctgggtgtgtgtgccagccacccagcccaacttcttggctctctgagtgccactatcaggaaaggggccagggctgcctcagtggctgggaggcctgcttggacttgggggttacctagggccttagccctcttggctggcttcccaggagctcggtcccacaggacttggggacagggtgggtgcagcacgctcccctcaccagcccccattggcttcctgctggacccaactcacctccctcctcatctccccacagcccgatctgctcaacttcaagaagggatggatgtcgatcttggacgagcctggagaggtaagaggactgaggccggaggggaggaagctggcttgtgctgctgctgggcccctgggcagcccaggagtgggggtggggctggggctggtgtgagaaccctgggggtggggctgggaggggtggaggctgcccattaggcttctgcctcctggagcagtctgcagtgtgtaaaagggatcacagcaaggggccgtctagcccctcacacccagtgccccatcccttgatctcatcaagagtctcttggccctgccacctcagtaggagcctgggtgggagtcaagggtcttgggtggaagggctcgtagaagctgtctggcccgagacacagattcctaaagcctggtctgaggggggtggggctcagggcgcaggtgctggggtttcacccacctggatccccactggttgagtcaaagcctcctctagtcctcagtggccacgtctgtgacatgggcataatggataatggtgattctttctagagtggataacaaggtcagagagatcaagcacgtacaggtgccacaaagctcctggcacttactgtgggctcagctaaagacccttcccttcctctggcatatgtgtccttggaaccagcagggacagtggctgtttcctcagctctgttctttcggctgccaggctggctccctgcccacactgcctgggcaggagcgtctccccacccctgccctgcatgcgcctgctgctctggtctgcgtgcagcctgcatgccggagagggctttgagccagaggggatttcattgtgtttccggcccacatgttttattccctccagcccacagccttccctacccgctgcctgcccgctgtccctggtggctgctctctaggctcacacaaagcccggcaccccgccagtgaccccttcctggcctccccacccagggtccccggagggcagagggattacaggccccacccagagctggccattagtcatcctctatcacagggttctggaatgtccgaactggaagggccctgggaattcagccagcccaaccccttggtgcacagacaggagacgggcccatgagggtgttggtctcttccaggcctaggagcacctggggcagacccaggctcagaactcagcgcacctgaggcccatggagctccacccagcttccatctcagacagtcataggctaggcctggaagagctaaagaaacctcttggcatagaacccctgtcctactttacagagaggcaattgaggtctgcagcagcaactccgtttacttagtgagaggaaaatgcttctaagaggcctggcctcccagaacaaacccagcaacctggttggtgtccatccctatgccaagggccatgacagccatccacacaagagaggatgggcgccgctcgcctcaccagaaggtctaggcacttctttttttgttttttatttttgtttttttttttctgaggcagagtttcactcttgttgcccaggctggagtgcagtggcgcaacctcggctcactgtgtcttccgcctcccgggttcaagcgattctcctgcctcagcctcccgagtagccgggattacaggcatgcgccaccatgcccatctaatttttttttgtatttttagtagagacagggtttctccatgttggtcaggctggtctcgaactcctgacctcagatgatccacccttctcagcctcccaaagtgctgggattataggcgcgagctaccgcgcccagctatagggacttcttagtagccctactttatggttcagaagactgaagctcagaaaagtggagacacttgcctaaaggcacacagagagaaagggaactcttggatacaaaactccttttctcagggaggcaatgtggaaagaagcagaaggtatcgtcgttgcatgccccttgagaacttaccatcttcttgaggagagaaaactaagtacttgaaacaaccaacagcacagacagggcttggtgatgtgagggaaccctgggagggctggggaccgggtgatatgcactgaccctggcagtgggcgggccgcgactggcattccagtggagtgaccagaagcccagaggtgggctgggcttggcatactatcaggctgttctggcgcccccacccctttcctacatgtcctgccaatctaaccccagctggagcagagacaggcactgcaggaaggcacccaatcacaaatcctaaacttacagcttagggcgctctcacctgctgcggatgtgggtagccagcctacagttcaagaagcagaccgtgcatctgggcgcggtggctcacgcctgtaatcccagcactttgggaggccaaggcaggtgaatcacctgaggccaggagtttgagaccagcctggctgacatgatgaaaccctatctctactaaaaatacaagaaattagctgagcatgatggcgggcgcctgtaatcccagctactcgggaggctaagacaggagaatcacttgaactcaggaggagggggaggttgcagtgagtggagattgcaccattgcactccagcctgggcaacaagagcaaaactcctccatctcaaaaaaaaaaaaaaaaaaaggcagcagattgtggctggcactcactcctactccagggctccatccagtcctacttcccaggggaccattgtccctgaccatggtgatgatctgggggaatatggaaaaagacgtaacgtcctggccccgctgagtccctgacttgcttacacaggtcatcacccctccctgtctgcactgggtccggggtgcctgaggagccttggcaatcttaaaaggagctccaagaaggaaagggagggtgtggttacggaggggaaaccaatccatttcacagatgctacccctgaggctcagagaggaaatggaggggccaggtctcaaattggcattttccgcctccccacccctcctgtgtgcagcatagtgagtttggcagccacacaggacacctgtacaatcacacacactggctctttcattccatcctccttgcagcctccctccccctcgctcaccaccacctctacttcgcagtggaagaaacattggtttgtgctgacagattcaagtctcaaatattacagagactccactgctgaggaggtgaggccatgggtgtactgatgaacccccggaagggcctggggtggcctggctgggttcactggggtgggtcacaccagggcccacacggaccatagtgggccctcttgctccaggcagatgagctggatggtgagatcgacctgcgttcctgcacggatgtcactgagtacgcggtgcagcgcaactatggcttccagatccacgtgaggctgtgtgcagcttgggggctggtggtgggcagcatggctggaggtccctgggggaggttttggtgttgaacatggctcaccatggagactggatcccttcactcatttacccagaggccctatcttcagagccagagctgtgatgccaacacttagcatatctgggggagacgctggagccagcagggctcttcccaggccaatggaagggaggttttgtaccccctgcccaccccagactcaagaccttagatgcatcctgggaaggaagggccaccctccctggggtccatagtggggagggagtcatgcggctggccatgtggcaacctacccatgcggtggccttgcagaccaaggatgctgtctataccttgtcggccatgacctcaggcatccggcggaactggatcgaggctctgagaaagaccgtacgtccaacttcagccccagatgtcaccaagtacgtactaagctggactggggccttgagggaggcacttacccttgcgtccccgagtgggtttctaggtactcacctgagggctgcacctttctgggccctcgtttctctgtcaacaacatgggaagagagtagtgagcattctcggtatcatccagaagtacactgagggtttgaggtttgatctgtcttctcaaatgtgatggggcctcttctctttggaggagatgcctgtgagtcaaaagcccctgccaggtggctgttctgtctctgtgtctgtgccgtgggggccgtgtctaagcctgtgttaggaaggggtggttaggtagttcagccttggcgcccacacctcccgggatggggagctcactccttctggaggctgccacgggcactggggcaggagggctgagttaccgagtggcagagccccccacagtttatacccagatgcccatggcgggctgggacttggagctgctgggcagcgggaacagagtgtggtattaaagggggctgggctgggtgtagtggctcacacctgtaatcccagcgatttgggaggctgagatgggaggatcacttgagctcaggagttcaagaccagcctgggcaatatagtgagacctcgtccctacaaaaaatttaaaaatcagctggccgtggtagggtgcgcctgtcagctgaggtgggaggatcacctgagcccggaggccgagtcccccagactggccacaccgcggctattcagccttaggccagaggctttcctgtctaggtttcagagtccccatctgtcacgttagcatgtcatgtctgtacatgtgccaggatgtgcccagagcactttgtgaactctgaagcactgtgcagttggactgttatttagcatctaggcccagctgctttaagaaagaaaccccgggcacagtaacttcatcgagatagatgttcatgtctcccttcagaacagccccgaggtatgcagtcctggcctggtggggctcgctctgccgtttcaggggagccacctgccacacccactcggcagcctatagtcacatggctacaagtagctgtgggaatactgcgagtgtagtttttggcagggtgaccacgtacccagctatgactgtggataaagagaattgccatagttgttcagagtctctgcaacttgtgttctgtgcaccccgaggtcccgccttcaccccatcagcagtgactgggcatcccccttgccactgtgagcctcgggaacctgggacattggtctcctacatcacctcattgatcaccatttgcaaaaagccccctgcctgctttccacgttcgcccaccctgtcctcacatccatcctgtgagaggcgtcgctgtcccacattacagatgaggtcactgaagctcaaagagggcaaagagaccagtgtggtggttcacgcctgtaatcccagagctttgggaggctgaggtgggaggagcacgtgagcccaggagttcgagaccaacctgggcaatatattgagaccccatctctatcaaaaatttaaaaaattagctgggcgtggtggtgcatgtctgtagtcccagctactccagaggccgaggcaggaggatcacttgagctaaggagtttaaggctgcagtgaactatgatcacaccactctacttcagcctgggcagcagagtgagaccctgtcccttgaaaaacaaaaacaagaacgggggcgagggaagccgggcatcctggtgggtccctgggctgtcaagaggtggagctgggatgttcctggggtctgttaaccaggaagctcaggtcgggctgcttccttccctggggtctgtctccagcccctggcacagggcctggcacacaggtgtcgctccaaaagtgctcattgtgggactgcaggggtgaggacccacctgacgtggctctgctggtgccctaggctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaaaaccggcttagtgaggagatcgagaagaagtggcaggagctggagaagctgcccctgcgggagaataagcgggtgcccctcactgccctgctcaaccaaagccgcggagagcgccgagggcccccaagtgacggccacgaggcactggagaaggaggtaggcaccacggctggctctctaggaggccccttgccccagcgcccctccagtccctgcattcatgccctggcatttgtcttgcactcctacagtgatggggagctcacccctgatctgctgtgagtgtgcaccccacactcctgcgaactagaatcttcttccttagaccttagtagtttggtttggttttgttttgttttttcctagttctgcccttagcagccatagagaagagaagtgggaagagaagggagagacctgccaggctcacacctgtaatcctaacattttgggaggccaaggtgggagggtcccttgaagccaagagtttgagaccagtctgtgcgacatggcaaaaccccatgtctacaaaaaaatacaaaatttagctgggcgtgctggtgcatacctggagccccagctacttgagaggctgaggtgggaggatggctggagcccgggaggcagaggatgcagtgagccaagatcaagccactgcactccagcagtctggcaatagagcccgactttgtctcagattaaaaaaaaaaaagaagaagaagaagggcgagaccgtttattgttcatcttctgcccgtggcctccctgcctgcactgactcgtggaatcctcacagcggcctctacccctagggtggacttcagcagttttactgacgggaaaactgaggctcaaagatgtttcctctgtcacctccatgatgtgtaaacatctgtgaccacagtttccttttcctatccctgtctagccttctctgggccaaggctctcccaggtcattgacctggccatccaggaaacagcccagcgtgtcccctggctacatctcactccagggctgcttgcccttctcaaaccctgaggcattcctaagccttccagggacgctgggcttgtatccgtgtggagctggaagcctgcgggctcctcactgccttccaccagccctgccccagcttccaggtcccactgaccacccttctccctcgtaggttcaggctcttcgggcccagctggaggcgtggcgtctccaaggggaggctcctcagagtgcactgagatcccaggaggatggccacatccccccgggctacatctcacaggtaaggccggggggctgtttttcagggggagggggcagatttctgcttgccgtgttatcaggaaacagctgagattttgggagcccttcctgtgtgtgctggaacctgtgtggggcatttgacatgcgtcatctcatttactctccccacagctggtgggcgtgatcactgtgcccgttttacagacaaggccactgagctctgagaggttatgtgacttgcccaaggtcaccccgcctgcaggtctcaaaggtgggatttgagcgagggtccggctgactgcagagcctgtgtgtgagtccccgtgtgacactctgcacttggacccttgccccggggaagtggggggctagtggccccgagagtcactccctgaacacagggaaatcctgccgaggcccactgggccaaggccccacacaaggaggtctgcaggacaggggagcctccagtagccctcagagaatgcaccgtccgcctaggacagcggttctcaacggggtccattttgtcccccttggggacatttggctgtgtctgggaatacttctggttgtcacaactaggacaaactaactctctagaaaaaacgtgtgtgtgtacacatatataagtttattataaattttaccaataaaaacaatgcttagtacacaatttacaaataaaaatatataattttattgtgaattccgtacagcaaatggatttttctcagaatgctttcagtgattttttccatactcttgtatccacaactgattaacaaagggggttgttctaacgtgtgctggttgacatttttgtttatggtaatgagtaagatgagaagacatttgtcgaaactttactggtccatgttgtcagctacttctttgctagatcggatagtagttttctattgagaatatttgagaatattctattaagaatatttttgcaattttttgttctatttacaatgtaatggttatagatgtgagatacttctaagtttaatctgcattattagcattttcttatcacttgcttaagtctagacaatcaacaaaacaataaatcaagccctgatgtgtaatgtttaccaattctgcagtgtaaatactcccgctgtggccaatgctgcattaccagcacaaagtccctggacagagagttgggaagagatgtcacactattcactaggatttccaccatgcggatacagtagatgtgattggccccaagagcacgcataatacaacacagtgaaatatttaggaagtaataaatttgagtatctattgccttgtctttaacatagttaatttaaagtatataaatttaattgttaatggctgtgcttaacaactacatcacagaattactaaaaatttgacaatcagctgtctgtagttatcacaccattatctaaagtagaaaagaaggggccaggcgcagtggctcacgcctgtaatcccagcactttggggaggccgaagtgggcagatcacgaggtcaggagaacgagactaacctggccaacatggtgaaactccgtctctaataaaatacaaaaaatagccgggcgtggtggtgcgcactgtagtcccagctacttgggaggctgaggcaggggacccactggaacccaggaggcgcaggttgcagtgagccgagattgcgccacggcactccagcctggcgacagagtaagactccatctcaaaaaaaaaaaaaaagaaagaaaagaaaagaaggctgagatctaggccctaggcaggaggagccttctaaaaatttccaaggggaggtcacgtcatgagggggctctcaggaaggcattggctggggcatgagaaggaaggctggttggtgcgtattgtggatgcctccagtgctgagctaatagttagaagctctggcctggtacggtggctaatgcctgtatctcagcactttgggaggtgaggtgggtggatcacttgaggtcaaatgttcgaggccagtgtggccagagtggtgaaaccctgtctctactaaaaaaaaaaaatacaaaacttagcagggcatggtggtgggcgcctataatcccagctactccagtggctgaggcaggagaatcgcttgaacccgggaggcagaggttgcagtgagctgagatcctgccactgcagcctgggtgacagtgagactctatctaaaaacagcaacaaaaaacaaaacaaacaaaaaaagagaagctcattccacagacttttggaggtttggggtcagacagtgacatcaggaaagtgatgttggagtggagggggcttgggagagggccaggtgtaaggcattaggaaatggctgaaggagggtgaatgtcaagggtctggagggaggagaatttgggactggatgaccagatctacggaaggcagaggggcctttgggggccctgaggctggggctgctgctccagggaagcccggagaccgtcctggggccaagtagtggatggagtttccactgatagaggagcaggcaggggaattggggtgggacgcagagggtgaggctgggggcttaccttgtcctggggaggggcaggggaggagccagtgttgtgccctgtagcctcccaccctgaggcagagaagggagctgggggcccaacaccccagctgaggcaggtgggagggcctccgaggcccccagccagggggcttctgcctgcgtgctctgctctaagaagctgcaggggctgctttctgggtgggtggggctgggacccattcgtacccacctataatcagagtggcttcatcttcctccattttattttattttaatttttttagagatgaggtcttttactgtcacccaggctacagtgcagtggcacagaggctcactgcagcctcgaactctagggctcaagcagtcttcccacctcagcctcctgagtaggaaccacaggctacaccaccatgcctggctaattaaaaaaatttttttgtagagacaaggtctcactatgttccctgggctggtcttgaactcctgggctcaagtgcttctctcatgttggcctcccaaagtgctgggggtacaagtgtgaccactgcactggcccacctttgtccgttttactcatagagccagctttagatttcctttagataaaggctctgccactacaatgacgtttaaaaggcactgctttggcttctcagcttactggtggcaaaactgaggcccacagaagggtgtgacctttgagctataggcagacctgtgtctggagttcaggcggtctggtccccaggtgccccattgggtgcaccaaagtctgtcagtgtttggtcccgttagggtgggatgggcacggggagcaggtgggaggggagaagggaataactggggagcagagctgaagaccaggcaggtggaggagtgaccccagatgcggaaggcagcagagaagaagagctgagtcatctgtatcgccctcaggcacgggaggaggcggatggaaattcggtggacctggaggagtgacagctgggagggattccccagctggtatctcgggctgagtgggtgcccttccttcaggggttgggggcttgctgctgcacgacagctgtcgggtggtctggggcttcacccactggacatctggtaaagagaacctttccccactattgcagtggggacagaggcatttctttatctactttgatgtccatgtcaaaggtggcagccaggatcaggacaccttgggccactcaggaaggtaggtgagagaggccctaggagcccctgttcgtcagctgagtcccacctcctgatgtcagcccctgcacccctgagctgctgggtctgcctgcctggtctggccctcttcagaagagcagtgcccacccccacattgctgggctccccactggtggatgctggcgtaccgtctccctctgtgcacagggttcccgtgcccagggagcctcgggggctggtcctgtgaggcctgctttacggatgccaagactgaagctcagagggggcgaggggtttgttcaggttcactccaaggcgcagccagggtgaagaccgcctctgaggtccaaagtcatgttctgttgtcctaagccaggagacacatagagggcaggaacagaagccaggggacagacacccctgtcgccacatgaagctcttggccctcgctcctccatcaaatcgtccccaggtgtggctgctggagaggcggggaggtggcctttgcgtgggggagacagtccctcatctggtcctctgtgccttagtttcttccctggctcttcttccccttccctttttaatgaccttaaacatttttttaattatataaaagaaatgtttacattttcaaaaataatttaaacaaattgaaaggctggaaatcaacaccctcacactccttctgctgccagctgccaccccagggtcctgtcggtggctgctgccgcctgcctatcagtttctggtggcagctgtaacctgtaaccacagctacctaaataatgcacatgtattacctcacgcttctgtaggcgagaagtctaacgcgagtcttgccgcgctgcagccaaggcgtgggcaggactgtgttcctctgcaggcacccgttgtatcccttgcctgctccagcttctggtggccgtccgcgtcccttggctctcggccccttccttcatcttcaaagcctgcagaggggaagtcgagtccttctcctgccacgtcactctgaccatcccttcctggtcacacctcccttgaactcttcgcttctgcccccttcgtccacttttaaggacccttgtgattacactgggcttgagggataatctgggataatctcccgattttaaggtcagctgattagcaaccttgattccctctgcagcctgaattcctctttgccatgtaacatgatgtagtcacagatcctgggagtaagatgtggacaactttgaggggctatcattctgccccctacaatatcctccctaccttttctgtgttttctgtgttttccattcactgggacggacaggtctgcacgtttgttcccgtgagtgagatcataccacgtgtatgtcagaagccaactttcaccacctcattttgggatctttttccacagcatccacacaaaaactctgtctagcagctgcctgtgtcccattgtcaagctcgatcccatcatttattcaagagttcccctgatagggatttagattgtttccagttttcatctgttaccaacctggctgtagggaatacccttgttccaaaagtctctgtacacatacgactttctgtgggatcatttctgggagtgaacctactaggtcaaccagtggggtcgcaaaatgtgatgatgccaccggaccacccccaacacacaccgttgtggcggacactcccagcagtgggtattattagtctgagatacttgcccatcttgtctactaagcattattttgtattacatcatcagtttcagctcatttactgagcacctgccacatgtcaggccctggcctagaccctggggactgcgccagtcagatgttctcagtcttcagggaatttatggtttggcagaggtagaaccttttgaggcaggggagaggctgcccagagacagagctaggagagacatttaaactgggctgcaggtcagtaaattacccagggaggtaaagttgccaaaaaaacattccaggccgggcacagtggctcatgcctgtaatcccagcattttgggaggccaaggccggcagatcacaaggtcagaagttcaagaccatcctggctaacacagtgaaaccccatctctactaaaaatacaaaaattagctgggcgtggtggtgggcacctgtagtcccagctactcacgaggctgaggcagaagaatcacttgaacccagaggtggaggttgcagtgagctgagattgctccactgcactccagcctgggtgacagaacaaaactctgtctcaaaaacaaaaacaaaaacaaaaaaaccacaaaattccaggcagtgggaatagctaaagctcagaggtgtgaacgtgctgcaaccgtaactgtgagattgcttggcagagaaaggccagggatgagaacgtaaaggtcagccatgggaacggggacttgactctgtaggacgaggaatccctggagggcttgaggcaggagcgacaaggtgaggtttgtgaatgaggagccgtggggtgggggtgggagcaggagcaggtgcagactggaggtgctgggacccaggaggaggtggtgtacctgcccctgagccttctcctctggaggctggggaagggccgctgtccagaggaacggggcagcctgtgacaccctggcgtccggcccacaggaggcatgtgagcgcagcctggcagagatggagtcctcgcaccagcaggtgatggaggagctgcagcggcaccacgagcgggagctgcagcgcctgcagcaggagaaggagtggctcctggctgaggagacggcagccacggcctcaggtatggaccctggggggggcacagtgggctgggctctgagcctctgtgctgaggttcctcctagccaaactggggaggattttatcaaataagatgtaggggtctcagtgccacatttggggtaaagggtcagcaggtgttagaagctccaagaactggcctgtagccctacttaaaaagggaaactgaggcagtaaaagataccctccccacccccaacaccaccactaccataggtggtgactcttcctgctcaggggcctgcagccaccatagagtctgcctaaaggcacatgctacccacgtgcgtgggggagaggctgatcagctgcatcccctgtcctcataggagtgcctcctccctgggcacatgggccagaccctggggagagcaggggaaggtgtgagcattgtccatgccagctgtgtgccaggcactgggccccacatgtttcccacaggagcacccttcatcctggacaattccctcccctcctgccaccgcacacctgctgtgtgcctggcacattcctaggcatcactaggggtttgcagaacaatagaaatgctggccaatgtcacatgatctgaagctcacaacctgccagtgctgtgccaagtgctcatgcactcgaacccagccttggggccagtgtgctctgcatttcaggaagatcgcctttgcagccgcgtgtgttagagaccccttccccctcagcagagtctggacttcgccctgtaatctggcactaaggtttctgctgtgaaatggataaaaatcacacttaagtggaataataaagaccataaatagcctcatgtccgttcagggtggggattgccaccaaaagatttaccagaggcccggtgcagtggctcatgcctgtaatcccagcactttgggaggctgaggcgggcagatcacctgaggtcaggagttcgagactagcctggccaacatggtgaaaccccatctctactaaaaatacaaaaattagctgggcgtgatggtgggcagctgcaatcccagctactcaggaggctaaggcaggagaatctcttgaacccaggagacagaggctgcagtgagctgagattgcaccactgcactccagcctggatgacagagtaagactccatcaaaaaaaaaaaaggccaggcactgtggctcatgcctgtaatcccagcactttgggaggccgaggcaggtgcatcacgaggtcaggagttcaagaccagcctggccaagatggtgaaaccctgtctctactatgaatacaaaaattagccatgcgcggtggcaggcgcgtgtaatcccagctactcaggaggctgaggcaggagaatcgcttgaaagtgggcggcaaaggttgtagtgaaccaagattgtgccactgcactccagcctgggtgacagagtgagactccgtctcctgggtgacagagtgagactccgtctcctgggtgacagagtgagactctgtctcaaaaaaaaaaagaaagaaaaaaaggagagaaactttcaatgttcagaagtttcggattttagaattgtgggtaaaaccatgggtggccctgagtgggaaaaaaaaagcctcggtctcagtccttaggagctcacaatctgagaataaagccagcaggagctaatgttggggcatttactctgagccatgctttgttctaaattcttcacacaccttccaataaccccatggaggaaaggtactgttgttatcgatccctgttttccagataagggatctgaggcacaaggggttaagtcacctgtgcaaagtcacatcggtttatgctgactgtggagcctgagctcttgaccacgaggctggtcaaagcagataggccttgtttgagagccctcagagtctgcagggggggtgtactaggtggggtcctacctggaaatcactagaacaggaggtaccaatggtcagaccctgagctgtctccccagtagggtccatccaacaggattatcttcccttaatagatgggctgagagaggttgagagcttaccccaagccactcagtttatgacacaacctgggctactctagactcctggttcggtgctctttgcatagcactccttggtccaagtccatagtacttgcatagtactatgtggagtccacatagtactccaccagtacatgtggcgtctcagagctggtggcacttggtgctgctgacccccctccagtctctcttgtgcctctctgccctgcttccagccattgaagccatgaagaaggcctaccaggaagagctgagccgagagctgagcaaaacacggagtctccagcagggcccggatggcctccggaagcagcaccagtaagatgatgccggggcccaactgcccaccctgatggttatgggttgaggaactttgctgaggccccttggcagcggacacatcagtttgcccctagctgagattcctgctccagtctcatggatgcaagaaacagaagcagaaggtcctcaggcagaccccatgccagtcctcacagacagtccttcaggcagcttcttgtcttggctggtcccagcctccacccacctcttcacccctttagtctcccctggagctgggctgcagtgtcactgttgaccactaggcctctccctgccccagagcacagttttggaatgttgaggtttcaggggctttaactttaaagatgggcccctccagccgggcacattggctcatgcctgtaatcccagcactttgggaggctgggatcaggagttcgagactagcctggccaacatggtgaaaccccatctctactaaaaatacaagctagctgaatgtggtggcgggagcctgcaattctagctacttgggaggctgaggcaggagaatcgcttgaacccaggaggcagaggttgcagtgagccaagattgtgccattgtattccagcctgggcaacaagagtgagagcaagactccatctaaaaaaaaaaaaaaagatgggctcctccaagccaccctcacttagggtaaacacctgtagcccagagaagctgtcactggttcacagccccacagcaggctaaaggcaaacctagagagggaaccccagagtcctgggatgctttaagtctacctgactggactccaggcttggcaggagcaagacaacctatgctctcctctgctcctcctctggggcaggtcagatgtggaggcactgaagcgagagctgcaggtgctatcggagcagtactcgcagaagtgcctggagattggggcactcatgcggcaggctgaggagcgcgagcacacgctgcgccgctgccagcaggagggccaggagctgctgcgccacaaccaggtgggcctggccccaggttggggggacacgggtgggtcccggcacccctcccctgaccaccgtgcctctcccaggagctgcatggccgcctgtcagaggagatagaccagctgcgcggcttcattgcctcgcagggcatgggcaatggctgcgggcgcagcaacgagcggagttcctgcgagctagaggtgagtgtcctcactagcaccaggcagcccagtggttctcggggcccggggctatggggcacccccgccataggctgggtatcacctgtggcaggaaagccaagtctcccagtggctgggccagcctgactaggctagaacacctactgtgcatccagtagccagcattctgccctcccacctgcattgtgtcacctacctgccgtgtaccatagcaaatcactccacttttctgagtcccagtagctcatctgtaaaatggcaccagcaccttccttactgggaaatattggggtaagaaaatatgtgtgtatgtgtgtgatgccagtatcactgtagtattttctttctttttctttctttctttttttgagacagagtctctctctgtcacccaggctggagtgtagtgacacgatctcagttcactgcaacctctgcctccctggttcaagcgattctcctgcctcagcctcccaagtagctaggattacaggcctgcaccaccacacccagctaattttttatatttttggtagagacaagtttcactatgttggccaggctggtctcgaactccggacctcaagtgatctgcctaccttggcctcacaaagtgctgggattacagcatgagccaccacacccggccttagtatttatttctttactttttttttttttttgagacagagttttgctgttgttgcccaggctacagtgcagtggcgcgatctcggctcaccacaacctccgcctcccaggttaaaacgattctcctggccgggcgcggtggctcacgcctgtaatcccagcactttgggaggccgaggcgggcagatcacgaggtaggagatcaagaccatcctggctaacacagtgaaaccccgtctctactaaaaatacaaaaaaattacccgggcgtggtggcgggcgcggtggcgggtgcctgtagtcccagccactccggaggctgaggcaggagaatggcatgaacctgggaggcggagcgtgcagtgagccgagatcgtgccactgcactccagcctgggtgacagagcgagactccgtctcaaaaaaaaaaaaaatattaaaaaaaaaaagcgattatcctgcctcagcctcccaagtagctaggattacaggcatgtgccacctcgcctggataattttgtatttttagtagagacagggtttttccatgttggtcaggctcttctcgaactcccaacctcaggtgatccgcccacttcggcctctcaaagtgttgggattacaggcgtgagccaccgtgcccagccgatattttatttctctttttttttttgagacggagtcactctgtcacccaggctggagtgcagtggcaccatctcggctcactgcaagctccgcctctcgggttcatgccattctcctgcctcagcctcccgagtagctgggactacaggcacccgccaccacacctggctaattttttgtatttttagtagagacggggtttcaccatgttagccgggatggtcccaatctcctgacctcgtgatccgcccgcctctgcctcccaaagtgctgggattacaggcgtgagccaccgctcctggccccaatattttatttcttcaacaaacacttaggtgaggctcactctgtacctagaaattctggaagccctttttgtctgttaactcatctaatcttcctgacagctccatacattagctactatgactgtccccatttacagatgaggaaactgaggcacaggaaggtcaagtaccttaccaaagcttttatagctggactgggatttgaaccaggcagtctggctccagtctgagcttttaagcctccccagtcctggctgaacttgtttcctccttggtcaagtcagcagcacctagccctcggggttggggaggggttaatgaggtgccttgtggagtggttcagcctgctcaggtttatgtagggcttcttttcatccatctcactcccgaggtgagagcctggtgctgcatgagggctgcagcagacttgaccgtgagatatccactcacacgggctggacaggggtgagagtaagggaaggcaaagcaggggaatcggagagggcttcctggaggagtccgcctccaggatgtagagggtttttgtgcagataggggctgcattctaggggcctgaggcagagagaacccgggctgcagggcactatgggccagggtagctctggcttctggccctgggtcagtccagcacctatatccccaggtgctgcttcgcgtaaaagaaaacgaactccagtacctaaagaaggaggtgcagtgcctccgggacgagctccagatgatgcagaaggtaggtccttccgctgggctgggggccgtcggggactctggagccatctggatgccatcctgtgagcacctgctctgtgccaagccctccactcgcttcatccttcctcaggctctcctgtgcttctcccatgtaggtgtcatcatccccattcactgacagggaaactgagactaagaaaggggaagtgacttccccaaggctgtacttggcttctgtttatttagcattatttaatttattgattattattgagcacctactatatcctgggcactgtgctaggtgctgggaagacagatgtgaacaaaataaccccaaatctctgctgtggggagcttgcactccagtgagaataaccacgttgctaggagttgggtgggtcagggttcagcccaggtctgagtctgcagcccgcctggcccacccttggctgctatgtcactgcctggtgcgctctgtcagtttggggcaggaagtggacatgttggtggctctgtaagtgcacgtgagccagaccgtgtttaccgcacttgaagaacaggtggcgtgaactcacaggaagggcccgagcacccagccaggctgacctggttctcatcccagccactcactgccctgcggtcttggtcaaaatcttctcccccgaaacaggatgaggatgacaatgacgcctgtgtccctgggtggtaccagggaggtgggaggggtaagcccagaacccacggccatcttggggagccacctggagggatgaagcgaggtatctgcggggaggtctggctgctggtgctgcccatgtgcccggttggcagggctggagggagagacttcatgccctcatacctgcctcctgccccccaggacaagcgcttcacctcgggaaagtaccaggacgtctatgtggagctgagccacatcaagacacggtctgagcgggagatcgagcagctgaaggagcacctgcgtcttgccatggccgccctccaggagaaggagtcgatgcgcaacagcctggctgagtagaggtggatgccgaggcgtgtgccctgcagggtgggcaggggctgaggctctcccacacccgggactccctggaccaccccagccaggccacttccttcttctggcctccaattcccgttctgtaaaaaggacaatgaaaccagcaacacggggttgttgcagagatcccatcagacccgggccacaggctgcttcatcagcttaagcctgttcctccagagctgggcggcacagtgcagagccacagcctactcagtgcaccccccttcttggggctggaggcaaatgcagcgtgcacatccctgacccccacagtgaatctccactgagcttcacacacacacatcgcacgctgaggccgggcttctatcccagttagtcttaacactccttcttgacttagcagggctcaaagtggttggttggttggttggttggttggttggttggttggttggttggttttggttgctttgagaaaggtcttactctgacacccaggctggagtgcagtggtgcaatcacggctcactgcagcctcaacctcctaggctcaagggatcctcccacctcagccttctgagtagctgggaccacaggccctcaccaccatgcccagataatttttgcactttttgtataggtggggtttcgccgtgatttcccaggctggtctcgaactcctgggctcaagcaatacacctgcctcagcctcccaaaattctgagattacaggtgtgagccgctgcacctggccaaagtgttcttatttttgctttttcaacgccacatctacctggagcatcctctttctgataagtcctcatggacttcctatggcatgcaggagaggccaccctatggctgagctgcttgggaaggagccaggaagagcggatctggctgtaccttaggggctgagaggtggtggaaggacccactcagcacccttgcttggccttggggtggcctcgcagcccctcagcccaggcctcagccctgccgcaccttgtctttcaggtcccgcccagctgcagaccctccaggctggaggaccagccgccctccttccctcctggatggaagtaaaaagccaagctttctccccaccctctgtgggccacacgtgcacttgcacccaccacacacacacacacacacacacacacacacacagacacacagacacatacgcacacacgtgcacacatgtacacacggatacacacacacacacacacactgcatatctgagcgcgcccctcgcactgggtctcaccttgcaccttcttcaggattttatatgtgaagagatttttatatagatttttttcctttttttccaaaacactttatactttaaaaaaaaaaaaaaaaagcaattcctggtggctgtgtgcctccaaccctggtccccctctgtctccagccaccctctgcttgggcttctgagctggtggccctggcccagaggtctggcggaggcccaggcagcagccatggcggggtgtctctacaggggagaggcgggagcctgccaccctcttcctgccctacctcctactaacacttcctgccccatttggacccgtaccatggggctcaggacagagggagctagcagctggcctccatggccccacagcctccttcgaggctgtgctgggtgcagaaccgccagagccacccaaaaggtgtttctcttctgctccctgaacctcttaacttaataaaacgttccagcagc

SEQ ID NO: 36260 - DNA, 58128 bp, Homo sapiens
agagcgcgagtgaggagcaggcgggcaggcggcgggcagccgggcagccgtggacagaggcccgggcacagccagttgctgtgccagagggtgtggtgtccggctacaggtgagggggcgaccacagggaaagagaacagggccttccaggggagagggggcctcggggtccctgggatggccagtggaggagtgggggtggaggtggcccttcttgcgggtgcctgtagggccagggccctggcagggcctggctgtctgggacggaaatgccagctctcctgttaactgaaaccacatgtgtctcccaggcagcggggcagagacgccgccaagcctggggcttggggctgggggagaaaagatgcagctggccccaccatgtgccccagggtgggtgaggggctgtgcaggagggctcggggtcatttgcatccgtacaagtgagagtgtgtcagagtgtgagtgaatgagttctgtgcgtgtgcttgttgtatgaatgagcgtgtgtgcacacgcgagagcctgtctgcaggtcggtggggtattcctgcttgcagggctgaagtggcctcctgtggcctaagtcctgggcacactcctacctgtcacccagagcttgggagcctgctggctgccccctgggagggtcctctggggtgagaggacactcacctgagtagggggtggtcctcactgtgcagagactcccttgtgaccaccatcctccttcattccttttctttcagcccagctcagtcttctggcacctgcacaacctctgcccatttccctgggggaaaagctgataagtagagcaaggaggtgataacaatctcggctcccacatctgttttcatctttttcagagcagtcacctccaggagctcggcatcaccactgtagccctggcaggtgagaaaacctagcctgagtgagggacagcttccttatggccatcggggagacagtggtgggccatccagactcatcgggggcacagaggacactgggatgtgggctcagccttggtgcgaggctggagtccacactttcaggttctgtggcaaatggggctcccagagggcctaggtgacctgagtcctggatcatctctccttaaggaatgagccttactgggcgccaggctctgggttctggtggtggccctgccactgccttgctacggatgttggacacgtctcctcctgtctccgggcctgtttccctatccccacaatggcagagttgggccaggatagtgttttccaaagtctggtgtgtgcacctctggcagcccatgagacggtgccatgtagactgccaattttcattgtaacaaggagtgtgtgttgtttttacctacattagggaaaggtgtctaaatagcatatcaagccagcgggtagttggaaataaaggaataatggacccaaatgaataaaagccggggatcaggagaagatccttgtgttctgtcccttttggcaatgggctgtcattacgcttccagcattttatttgtttatttatttttatttgtttattttatttttttagagacagagtctcgctctgtcacccaggctggagtctagtagcatgatcataactcttccagctgttttttcttttattttttgtagagacagggtctcactatgttgctcaggctggtctcaaacacctggccacaagcgatccttccctcatggcttcccagcgcgctgggattacagacatgagccaccacgtgtagccgctttcatcattttaaatgttcctaagagcgttggttttgactgtctagggcctgaaggtgtgatctgctatgtaggccatcttttggcccccacaaactagcaaccgccctgtaattctgtgattacagagtggaaagcccagttgccaccttagggtgtgtgtgtgtgtgtgtgtgtgtgtgtgtgtgtgtgtgtgtgtggtgtatgctgtgagtgctatgtgggaaggggcaggggatggaatgcgcagagctggggaaaagatcagccatcctgagtaaaagctggatgcccaaggtcacaggcaaggagtttgggaaagagattgtcccctgactgacattttcaagtgctttgtccggcctcagcctggctttgaatcaccaggatgggtgggtaggcgagaggccaccctggccttggcctttcctgccattcagctctggctcccaggccacttggctgcgttttatctgccagcccaggactagccagggagaggtgcactgggagggtgcaagggttctgggggggccccttggcaaagctccccagtcacttctccaggcaaagctggtcagagctggcatctttcaggacatactccctcaccctcctccctttctgctagatttgctgttgccgttagtgttacttgtgaccacagttgcttatatgtggatattcattggtgatttgtctcatcaccagctctttagggtagcctgaccctgctctgctgcaggaaatgcagctctcgggaccattctttcttgtcttgtcctgcaacaggcaaagggtaccaagctttggctccaggatgtggacagcatccttgggtagggacgaattcacagtcccttcttggtgaggcagagatgcagaggaaggagcacagggctgggtccacctgatccctgaccctgacatgcagtgtgaccctaggcaagctccttgccctctctggcccacctctcctctggccccaggaggcattgtccttgatgaggctaaagcgattctctagtgctgccctaggatgaaacaaaatgctatttccaggagactcttgttcttatggaagggtgcctttcctagggggaagaaccttgtgagttttggagttgggcttcctggagatgggcatatggagtcatccacagtccttgggcctggattcccttgaatcctgtttcaaaccctggggaagctgctggccatgatcaggggcatagcctctgcctgcagaacatgccacattctaactgaccttcagtggccttgtgggtcctgctgaaccactagcagctatacccaaggccaagggcaaacagagatctgcttcatgctgtcctggcatgggcacggttatagagagatctgcctgaccagggagcgggaggtggcactgctatgtggggaggatgagcgcttaaagagcaactgcgtcccaaagaaacattctcatttaaaagcaaaactgttcccataactgtggtctgcttaagtaagccaccctgttgggctaaggaatggggtgcagatggaggctgaagattctagaacttattcaccgacagtgatgccctgggttcttgacttccttagattttactttgatttctttttcctgggtttggtaggggcagtgtgtggaagtggcaacaatgcagtttatctatggagtcacatccatatctaccggtggcaatgttaactttaggcgaggaaaaactgaaggtagctgctgggtgaggcaaaaagaaaaagaagagaaactaggtgaccccgtgctctgctcctgtagtagccgtgggagctcaccaggcgactgcgtctcaactccaccttcctgacctgtaaaatggattgtcgtgaaaattcacgaggtggcggcacagaagccctggcacacactgcggctggcactgaacaaattgtagctcaaaggtatcaggcctgctgatagctctgctggcttaaggagggggtgtgattgtcattttacagaggggagaatgcggaagcaaatgatatgccctaagatgagagaagagcaccaactcttctgcaggcctgggttccagtcccatccccgctccccatggctccataacttcaagcagattacttaatcccaccacgtctgtgtttcctcatctgtaaagtgggcaggaatagcacctacctcacaaggcagttatgcggatgaaatgagccaaccctaagctcctggcacatagtaggtgctcaatgaacactcctctagctgaatggaaacccagaggcctttgctcctcaaattgctcccctctgatagtccctgcagttccaagttgggaccacggcctttgtgagtagtgaggttggacggtcagaggccctgagccccaggtggggctctccctgaggctggtctcaaatcttgccataaacactaccaaaagcacttcttggaatgttctccctgagtctcccaggttggcgggtggtcaggactagcactcttccttgtcactgatagcagggatggtatgatggttcatacctgaaggatatttaaagagatgaggaaactcagaaaattgaggctcagatagggaaggggcctctgtgggatcaatgtggcaacaaggcagggatggaggggtgggggcaagaaggtaggaaatcttatggggagaggggaaggggaggcccttggtacttacccggacagggcctccttcccagcttcactggagcaggaatgggttaaaggggaccggaaaggagaggaagaaagcaaacagagtcaggagaaaagcctggagctgcaagctcactggggttgtttggtctggctggaccacctcctgggccactcccagcagctctgcagacagactccaaccacccccaccacacacacacacatacacacacacacacacacacacacagatatgcacacactgatacacagagacacgtacagacacacacataaatataggcacaaacgcacgacagtcacacagacacacaaatacacacagacagatatacatagacacacacagatgcatacatacgtacccagagacacatatacatcacacttacacactgttacaaagatacacacaaagaaacacaattacacagattacacacagacacatatatacaaaatgccacatagaaacacgtacagacacacagatacacgcccagacacgtacatgtgcacacatacacacacgtggatatcatgcagatatcatgcagatatccacataaacacaagattcacatacaaacatacacaatgaatacatatacacacagacagacatagacacagacacgcacacagacacacagcagaagaagctccaagctggaggacagatgctgggatggcgtgtttctgtagctacttctggttcaacctgctcccctctgccccaacaacttacacagtctcaaccccctcactgcagtaatacctactgtatactgggcactgccactgtcaggctctgttctaagctcttatattgtttcatcctcacaaccacccagtgaggtgggcactgtgattattcttgatttgtacatggagaagaggggaagtcacttgcccaaggccacacagttcgtttttggcttctccaaggcaggctgcctgtgtgcagagccggctgccgaaccatgctgccacactgtcccagagcactgggctcttgctctgcgccgggcatggggaccagcactttcacctccaatattgccatgccctgtggagcagcaacatgattttgccttttctcaggtccagggagggaaagtgacctgcccacagtcacaagggttggaaggaacagggctgaacgtctgagtgtgtgctgagccaaggcttcagtgaggaggagaggcaggtgacaggggctggccaaccgagcaaatctacagttaggctgagcgcccctcagccgcctctttcagtgtcttcctttccttgacctgcccccaactcctgagcctgtacttctatcctccagcccttccctgtccagtatctgacgccctcacacttgttcttcatccagcctcaacaactgtgtcctgaatggatttaatagtagccttggataactgttgacaaaacatatttcccttccattattttatttcatcctacattggggggagggggagggggttattatcttttgatagacttgagtctgggctccagtccttactgagagtccttgtcagcatgatgccaaactaacttaaatacgtgtcaggtcctccattgggctcaaaatgccaactgcctaggtacaggatgtgggagatatggcataaaagtagcagttatttagtgacgtctttgtgggccataagcgtaataggaacatagctgtcgaaagaaaaaaaaagcaaatctgatgttaggctgcattaataaaggtagaatgtccagagtgaaggaggttatggtcttacaatgctctgtgctggtctgggtttcctgtaatattggggtcagtttatttctactgaggagtttctcattctctgcttgtttaccacaagtgacacggagctcagtacctattgaggcacgtaataacccaaggaatcacttagcccaatgccaaggggtgccaggatagctgatctttattgaagactttctttgccaagcacatttaaatgagaggtaggtactattattattctagttttacagatgaagaaactgaggaacagagggtgatataacttgacccaggtctcacagctggtacgtggcagaatgcagtgctggagtatggcagtggagaccagccctcctgactgcaatgccagcactgtcccctgaaacgtaatgcgagcacagatgtaatattacattatctagcaggtacactaaaaagttaaaaaaaaaaaggtggaaaaaagaagcccatgaaatcaattttaataatgcatttatttaaactccaaatagcgtcatgttaacatgtaataaatgtaagaaaaaaacttgttaatgagaaattttacattctttttttggtactaagtcttggaaatctggtgtctattctttatttacagcacatctcaatgtgggctagccacatttcaagtgctcagtagtgcatgtggctagtggccgccatgttggacggcacagtgctatactatatttcctttcgaggcactcgctgtggtatagcctagtgtgtaggaagaatccataaatgtcagccactagtataattatttttatcactggttgttgttggtggtggtccaggaagaagctggactgaggccccaagcccttggcataaactgtgcactgatgtcactcttcttaatccaagtccttcaacccaggagcttgatgtctcacaggcagagccaccttcatgaacctttggcccatggacccaaaagggccagcatgactttctaggagaggaagagaggccagccagaagcccctccatcttcctggctggccagctgggtaccacatgaagtgaagcttccttgggacctataagcctgtggcccatctgctctggagtgtgaggcagccgggcccacatctgcaaaggagagggtaagagcctctcctcccatggtttctttaggctggttaggcttttaaacagaaaaaacaaatgaataaaacccactatttttaatacattttttttttcctgaaaccccaggagttaaacaatggagcagtgatgtggggtctgcactttccccatccctgtatgatctctgggcatctacatagtgcttgcaaagagtgagggttcccaaacctacctgcgcataggaacaacctgcgaagcttcaaaatacgctgatcccaggtcctacccccagaagctgtgatttaatttgtctggggtgtggccagagctttggaatgtataaaagatcctcaggtgattctgatgaggtggacaagtttgggaattgccatgctaacccttaggggcaccagctccggtagccctcacagttgctatgatgcaggcgtggttagggttcccactccacagatgaaagattggaggctcacagaagtaaagtaaccggggcaagttcagacagtcaggaaatgggtatgatagggattcactagtcatggttttaaccagcggtgtgtggataaatgtctaacaacttgctctctggagaaaaaaaagctttgatttgtagcacctgccagtttctgtggtgtaactactcccaccgtggcccattttaagccattgacaatgtccctgaatgcagagctgggaaagggtgcattggctgttgagacagtgtggctggcttcagcacacagctgggccacttggcatggagaagaagggatcccatttggtaggcatggttaagcattttctatttttatttttaatttttttaattttttgagatggagtttcactcttgtcgcccaggctggagtgcaatggctctatctcggctcactgcaacctccacctgccgggttcaagcaattctcctgcctcagcctcccgagtagctgggattacaggcatgcaccaccacgcccagctaatttttgtatttttagtagaaatggggtttcaccatgttggccaggctggtctcgaactcctgacctcaggtgatctgcccacctcgccctcccaaaatgctgggattatcggcgtgagccatcatgcctggctggttaggcattttctgaatttttagtccttgaaccctttctgcaatgcaatatttgggagccccaatgtatgcaacagataaaaagcagtatgttatcagcataagtttactatagaaaccgaaatcatagtatccgtctcagtctcttgtttaaactgggggacagggtgagggggcactgtgaatgtggcgggggggggcagtgtggagcagtctcagagccagggccctgtgtgccagccctctccccatctgctgactgcgtagccttgggcaagtccctccccatctgagcccccattttctggtgtggccaagggagactggactttgtgcagagtggcctctgccctgccacacccctgcctgacctcagccagtctcagccccgtatttatagccatgacttcagtctccccagttcctctgaagctggttccctggcccatgtatttataaacccagcagggcagaaatagatgtgacgtactggggacttggctggttctgtgagcaggctggcttcagtgagtccacttggaacaggcttgagtgccccagcatcctgggtgctgagttccacaggcagtctaaagctggaagagcattttgagaccccaggcccaggcttgtcattgtgcagggaggtcaccaaagcccaagagtggaggcatgtggccacagtcacaggcacggcagagccagagccagaacaaaggactctgtgctgtgtgaaatggcctctccccagaccctcagaaaacctccagtgaccacgccaggccacagacaccggtcaggttccagcttggtcattttcctgctctgggatcatgggcacagactcaccctctgtgagcctctgcttcctcaatctgttaactgagggataacagtaggtgcctgcctcataatgttattgtgaggaagaaacaagaaacaagattgatacagtgcccagcacatgctcaatattcaatacgtggtagctcttgtaatgccctcagtcaccacttcacaaaaacaataattataataacaacagctgtttctattgagcatgtacacaggttaccttatttaatcctcacagcaatatgatatcattattattgtcctcaaactcattgcatatcatgtgttttacagtgaggagatgctctaccaataacgaacttggaaaagaatgttccaaaaaaagaatgctaacatatgaaatcttattttttatatacaagattacaaaaaatactcatttctaaatagtagacatattcagaatggaataggaaggttctaaaatggtgaacaattgaataatcagaatattagcctaagaaatatgtctcccaagggtttgtagggcttatgtttctaagtttgtcacctaatgttggtttgtgttttttttataattgcatatgaggatttaacataatagtgaacttgaaatgcatatgctatacaaaacacggaatggcatctgttaagatttgttatgttcatagcagtttctttatcttaatgacacgtagcactcccaggccgcctttctggcttatttttccatcgtatttaacaccatctgacatactttcttatttatttatctgtccaccccagctaacatgtgagcttcacgtgggcagagtttctttctcttttgttcactgtgtactgccagcacttaaaatagtgatggcacttagcaggcgttctgtgaatatgcattgagtgaacaaatgagtaaatgaatgactgagtctccattctaccaggagggcacctgaaattcagtaagatgcagggactcatctgaagttacccactattctgaggctgaactgaagccttatctctcctgagaccacccagtgtgcccagctggaagttcttcccaacctctcaccactacctcgtgccaagggctggtttcctatggctcctggggctccccccagctccacctcatgcccatccaacactggtcccttctgccccaggaggtgggcagaaatggagggaggactagggaggaaggagaaggggtcagagtaggctgggcggttgggatggttgatactgatggccgctgaggaagggaggaaggatgccaagattggtcagtctgtcctgaaggactagaagaagggatcgggaccgtgggatcatggtggacatccctctgggactgactaccccaactggaaaacactggaaatgggcaaggccaaggagaattcaggtgtagcagcaaccttgctgctaccgctcccactaaccactttgctcaaggcctttctcagctggagaaactgaggcctggtaaaagaaagtgattcttccaagaatgcagagcaaggtaatggaaaatgctggggtttctcatgcttactagctctggaggttggaagggcttggaattccccgcctttggagccatgaggaagaaacccccaaccttggatctcatcccctctttgggagagaaacactaaggcaggaacataggtcaggttcgcaaggacaacaaaagctttcttcctgttgtcagggagaacttagctctggatagaccagacagttcccctaccctagactggtgctgagggtgcttccagacaggaatctggtgggcaggtgcacctgagccatctgaacccgttcagagtcaccttttcctcaggatgcctccgttttgctcctaggttacacctacagtcaatctcctggccaccccacatgtattgtttcatttgatatatattacgcatctacaatatgccaggcaatgtaccagacatcagagagaagctccttcctccctcccatccttccatttcccattcctctctttcattcgttcatcttttcattctttcgctcagcaactacttataccattgagaaagtacagccttatggataagagtgacatttggagctagaccatcaggatgtgaaccttgactcaatcgctcactagctgtgtgagcttggcaagtcatcgcagctccatttccttatctgcacaatggggataataatagcaccttccttatagggtgtgatgaggatcaaatgagctgctgcaaatgaagtgtctgaatagcacctgacagagtaaacactccatatacatcagctattatcattgttactggttttgtgttttgttcttcttttcttttttcttttttctgagacagggtctcactctgtcacccaggctggagtgcagtggcacaatcatggctcactgcagccttgacctcctgggctcaagcactcctccagctcagcctttcaagtagctgggagtacaggtgtgtgccacaatgcctggctaatatttaatgttttgtagagacgggggtctcactatgttgctcaggctggtctcaaactcctgggctcaggtgatcatctcacctttgcctcccaaagtgctgagattacaggcatgagccactggtcctggcctgttgctttatgtgcctggacctgtgccagctgctgaagaaattgctccaaaattctcctcttgctgggacctctgcctgccagccagcccttttttcagtcccatgcctgctggtctggccatgttgcctccaacccaaacctacagagctgggccttgcagtcatttcccccaaccgtgtagggctgcccacccccctactttgtctctccagccagcaggagagagcctaggcaaccaaaggctgtcacaaactggccatcttctcagcccttccatacatgccctaacctcagcctatccaagcccgcctcgttcttcagagtcatccccagtggtcctgccttcttgccttcactgggccttgatggatgatctttaccccaggaaacctttcctcactcccctcagccaagaatcataagatttggctttgagcctgcatttgcagtgttgctttatctgtgagcaatgaggagccatggaatgctcttgagcaggtgagcaacacagtcagagccacactctaggacaatggatcagactttctataggatggaaacaggaagagacagcaggtggggaggtcaggtagagagccatgggcagtggggcctttggaggaatgagggtctagtcttcctgggctgcttctcccttctccgccctatagccttccacctataaaattagatcttgtgatttccccagcctgactcagtgaggcaatggaagagtcgaaacaaggaccccatgccctgacttctgcaatgcacctacttaagccctaatgctcagcacccctcactccctttcccttcttctacagcttacaagggaggctcttttgacccatggggaccctgcagatgatggggaatcagaaggaggctggactgtgccttataatcattgcagtctgtgcacaccaagcacttggggccccgaatgccaggctcaccaagcgtctgtagagcccagcaggtgagcagcacacagcaatgcttcctcattccccactgggtgaaggaataagcctatattttctctattaatccctacaaacaccctgggaagtggatcgtgttttaagccttgttttgcaggcagtaaaagtgaagctcagaaagataagagacatgtccagggtcaggcagccactgggtgagaattccaacccagacctgatgccaaagccagtgcccttcccccaccacacacacagcagcagaagggatgccagggccccaaggccattgcagaagccaacagttggagccctggggtgtcttggccggccctcagactgtggagcacctgacgctcagccggtcctctggtcctgggggcccctgcttggactcatgcagaggtgaaggggagggagaaggggaggctgacccctcagagggagcagggcttatgtgaggagctagagtctaagggtctgggtacctgcgttccagtgcagcgcctacctctggcttgccatacaactgcaggtaaatccttcccctctgggttcagagttctcctctctgagatgaggacagcgtgttctgtggactctatcagccatttctgccaaggctcaagtattttagagcttgtgtccagatgagggtcatgaatctgggggaaatggaattagaagttggtaggactccctcccatgtctgtggagtctgcagcaggtgctctcctacccacagaggagatccgccctcatggatgggttggccatctgagcgatggctgagtccagcaaccccaggagctgtgggggtccctggagtctgcagctgctgagagcagtgagtacaagcacagaccttggctgcctccattcacatcctgctttgccatttcccacccgtgtgactctgaacacagtacttacctctccgtgcctcagtttcctcctgtatagactgcactgacacagcaggagtgtcaggtaaagggctgggttcagcacctagcaggtgctcagttagtggcagctgctattattgtttcgggtcccgacccccacagctcctgcacagaggtgggtgctgtggggctcaggcttgcatagggcctgcccaagctccccgactgggttgggagtcctccttcctccttgggagggaaccttgaattggagtgctcctgccaactcctccctcctggcttggcagcgtgaagacaacgccggccaaaaatatttgtgtgggtggcggaaagttaacttttccgcctctctcttctttcctggaaaccgtggccaccgtcaaatacatcaaaacagaagcagggatagagtgaggcgaggcccctgcggggagtcagaggagccctgccccctccccacgcccactccttctgcctccggccatctggctctacggtggggggatgacggaggtgggtatccaagtgcttagaatcaggggatcctgcaatgccacagttggacggatcctccagcatcatctggctcagtctcaccatggtgtcctccgggaatctgactacagagtgcgaaaagcacctgccccagttcacagtcctgtctcttctgagtgctgctggcctttgtgagattctaagattctttgaaactcaaatggcagaaatctggcagcagctggtgagtgagaaagcacctggagatgaatgagggcctggagcctctcctccatgtctctgaatccaccatcatggtcaaggtgtcagagctaggttggaatcccagcctggccacttattagctgtgtgccttaggcaagaagtcacttcacctatctgagcctcaatttcctcacctctgaaatgggataataataaggtaattctctcatagggttgatgtgagaaattacggcaataacctaagtgaatgacccaagatagaagaggtgcttctgttcttccccggggggcagaaggtgggcttctttctcctgatttccctgccactgaggctgctataacaggtgcctggttatctttctgatccggatggttgtttgcctttcccctggttggctctgattttccctggggcttggtaatgcgcttatctctctgcctgcctgccagactctcctggcacagtcccagccagaaaccaagaccttgacccagcctgctgcagtgggaggtgcctgacccctgcttgggggcggaggcgtgaccacagcagctgaggtcagtccaggtcctcaggtcactcatgtccacagactctcacaattttcaggattctcactgctccccattttgcagtaggataagtgagagtaagagagttcacacttgcctgagttcacacagctaagtagcagcggaatccagtctttaagcaagatcccttgattctagggtttcctcccaagtgtaattggccatctgctctgtcttacgcactacctgcccatcctgggcatctcacccatctccaccctttgcctccacaaatgatttctagatatttgtccccagcctggaattctcccctgttctctagacccctatgtggaaccgcccactgctcatctcccctggaaatccaaaacctaactcatctccctgctccactaaacagctgctccttctcatttattcctgatctctattaacaaaatctctgtcaccagagctaggaacctgggctgcatcctaggctcctccctcttctccacacccactctccatctgcctccaagcccagccagttcttccacccaagtatctctcccatctaccccctcctcaccaccccttacagaaagcctccattccctcttgcttggattatcatcattcttaacatttatataaataatcatacaatgattattgttgttcctgctatcattcacagctctcctcaccacattttaaggcttctttatccctctgctatatccccagtactttttatgatgtctgaaaaataataggatcctaagaaatttttgtggaatgaaagaacagccaacatgtattaaggtatggcttagaaactgtgctgagtcctctgcgtgcattttttcatgtaatcctcaatgcaatgcgaagttagaaatattacaatacccattttacagacggggaagtggaggtttagagaggtcctgtggctggcttgttgatcgtcacacaaatggcagagctaggattctaactgcaagcctgggcacagaaactgaaagcacaccactgcaccatcttcttttgttttttttggctgagtttctgctctgttgcccaggctggagtgcaatggggcgatctcggttcactgcaacctccacctcctggattcaagcgattctcctgcctcagcctcccaagtagctgggattacaggtgcctaccactacgcccagctaatttttgtatttttagtagagacagcgtttcaccatgttggccaggctggtcttgaactcttgacctcaggtgatccacccgcctcggcctgccaaagtgctaggattacaggcatgagccaccacccccggactgcacagtgtttcttgttgcacaatctcctccaagggctcctatccccagtttgcatcttaggtcacaccactcctgtgattcctgtggtgtaggtacctttgctgggatatgagtgaattctttctaggtggtgtctagatacgtgttgttaaataactagatatttatttaatgtgcattgggggaaaaggactgagcacaatatacttgtggtttctctgcaaatattgcttaagataattctaaagtaatagaagtaagtgatttcaagttgattaatggaaaaatattagataaagtttcaggtagcatgaggatgtggtgaaaatccaggatgttaaatgactggagctttcgaaacacttccctatggaagtgtggaacctgcaccccaaatgccgaccagttctcagggtcacctgaagaggaacaggcttcagaaattcagcctggaaccccaagcgagctttctcatgtgctgtttctttcttccctatgccgatagattgccccaaagcggcctcacaccagagacgggttaagaagagggattggaggtccaccactccactagcccaggaaggacttatctttcgtctcagccagacctcaccccaattctgtgaatcagcggaggaaggcaaaagtgcagagagtcagaggaggctgtgtaaggagcagagaccagggctcacacagctggccccagcccaggccctggcccaggcccaggagcctgcttccctgcatcgctgaggaagaacagcaccatgctgggtcctcacctcccacctccgccccttgcacccagcgaagggaggcctaccccctgcgccttccagatccctgatggaagctacaggtgtctggctctggaagccgaggagagcagcggtgaggagggcctgcagggagaggtggggcctaccgacctggaagaggatgagggggtcagcaggagtggggacgactctgcctgcagagtcacccaggggacaccgcagctgcccaaagccctgggcatccaaccacccagctgctccagagaggaacaaggggcgtcccagcacgacgacagggccagccaggactgggatgtagtgaaggccgggcagatgatgacagccagccccagccctggccctgggcccagagtggcccagaaaccaggtaagcttgtgttccttttcccttggactaccagagtcactggagaccccccaggtccttagtacaagggctcctgaccatatttttccatgatccacagtaattcatcacagtcccatgggcatgcccagattaacagctgtggagagataggagcgacagcgagctacgtgcagttccagctgcaccacatctaaccccactcctttctctgccaaagagggcacgtgagaaggcagtgagagaaagccacattatcttgcttggctaaaaaaaaaaaaaatgcccatttcccactctcgtctgccttttaatcattagcggcaacaaatcactgcggtgtcccaagcaaccgatggggcagaaccctctcattaaatggattgagtgctggctacgtgggggtgctggggacgcggcactggaccaaacggatgtggttgctgacctcatggagcttgggaggtagagactgaagcctttgatagaatttgaccccccaattttacaggtggggaaactgagactcagagtgaggaaaaagacagctagaggtcactcagcgtgttagtagtggctgagctaggcccacgttcctcgcctaggccttggtttttcatttgttagaggtgacaagggcagatagaacaccacctaggctgcagtgagatcccatgacagcgtgtggggagagcacagtgtgcgcggcacggaaggaaggaagggcaggaatgatgataattttcctgcagcggctgctgtctgcagagcagggcgggacagggaagcccacgctgaatcacctccacagccagcccatggaaacgctgaagtgggtccagatggggaggacgtgagcagggccatgctcagctcaagcaggagccgcagccagtagatcccgggggtgcagggcatgcgggggacacagtcccgggagggcttgtgcgtcaggaaactgaaggaacacttcatttctctgcaggcgtcgttgacgcccggctggcatctcaccagccttcccgcccactcttctctctgaaataattctctccaggctctgatcaccccccatggccaccattgtctaccaggctggggtcacacagggggctgggcaggagcaagaaaggacctttaatccctctagggcaggaagaaggaggaccccagggaggcactgcagtcttgaacttggaggtgggccctcacaccagagtccgcccaaattcagtctcctacagtctgaagttcccaggacctgctcccatccctctcacgggcccaggctggggtcaggagacatagatgctttctagactggatgttgccgactagccaagccctagcaaatcccttccccttggtgagctctactttcctcctctgtgaaaataaaataaaaatatgagtcttatctacctcaaagagctgttaggaggttgcaatgatcttagttgtggcagtgttttggaaattttagagtaatctagataggtatgtaagaaacgtttatacctaattgaaatgaccatcatcagctcaacaataggactgctattatttgttagaagcctttatgtgctaagccctgtgccaagagctttacccttttcatttcatttaacctcgtagcaatccccatgagggacatacttttattattttcattatacagatgagaatatagaggctcaggaaatatatgtgacttatccaagatgcatgactagcaagctgctaagccatgatccagtcatggttttttgaacacgaggcttgtgctcttggccaccactgtcttctggaattataggagtaaagtgttgtctgcggacatcttggaatggaagagcccatggatggagaggacagaagaaggcactacctttaatgaactctgttggcaagtcacaccaagccagttcatttgatagcatctcactcttgttattgtactctcaaggcaggcaggtattattctccccattttacaggtgaggcaactgaggctcagagatttaagtcccctacccaaggtcacacagctagtgccagagctgagactatgattgtgttcttgcctggaacagtatggttcattcctttctttttctttttttctttttttctctttctttctttctttctttctttctttctttctttctttctttcttttcttttctttttttttttttttgagatggtattttgctctgtcgcccaggctggagtgcagtggcatgatctcggctcattgcgacctccgcctaccgggttcaagcaattctcctgcctcagcctcccaagtagctgggattacaggtgcccgccaccatgcccagctaatttttgtatttttagtagagatgggatttcaccatgttggccaggctggcctcgaactcctaacctcaggcggtctgcctgcctcggcctcccaaagtgctgggattataggcgtgagccaccgcaccaggcctcattcctttctttactgtccagccagtctgtcatccagttctgtcctagaatatttctagggacagagggggcagaaaagacttcagaaggatgaaatgggcagggaagacttcttggagatggaggcaggaaggaagctgggtcttgcaggagagtcaaaatccggtggtcttgggtcagagcccacacttgcctttctgctcccttgggaaagggagtggctagagttccttctcccttcctggagatcaggagggaagaaggctgtggggctgccaggttattagcggattagggcttcattttaaagcttcctgccattaccgccgaaggattatgagcatcttcaaacaattacatccatccttccgcaattgtacctgcctctctagagggctcacaggcaggtttaagtatgagccactatatcttctgctttgggcactgcagatacctttgtttggggtcagtgggtaccagtgccatttctccaaggcctgagtaccagctgagcagggcaacacagggccctgtgggcaggctagagggatagagggtacagagagatgccatcagctgctgccaatttgggaaaatagatctggggaggaaagggtagtgtagagctcatgatcaggcctcagccaacactagggcccccagctcaccaagacagccccatgctaagctgccctccccaaagtctcagctggtcataactggtagcgtttcttgagattgttgtgcagatggagactctgagtgccagagatggcaagtgacttgtccaaactcacacagtaagttggtggcaaagctagggctggaacccagggcttatgcctcccagttcagctgcccagcactgtgctaaatgcgccatatggagtatttaatcctataaacaatcctgtgaagttcatacttttcttatctctgttttacagatgaggaaactaaggcataaggaatttaagtgaattgtcaaagtctcacagcctgtgggtggaggagctgagatttgaaccccaggaggtctgggcccatgcttttaaccaccctctctactgcctgtctccatggtgatgaggcagcaggctgtgttcttccacccacctggggctgggaaaaggttgttcaggctctgggagttgttggaagattttgccaagccaaattccctcccactcggatgctctgggggaaacctgggtactcaccgctgatgcctccctgcctttgctggtggccacttgttattggaggctggaggtgtgtagcagatttagagccacttccaactctagtggacactgttctgagcctctggggtggggaggggtgtgggtctgtgttgtcagatgagtcctgccactggacatgtctgttttgttcaggcagagggacctgtgtgcgtgttaacagctgacagtggtcactgggcccagaacaaggctcctgctcctcaggctgtgacagagagggcagatggagcaggagcctgggcaggaagctgcctactccccctccactcccctgctccacagtgattgtaacaggagggtgatggtgaggagcactgctcacaggttcacatacacctcaccatgcactcacacatacatgctttcacatccatccgtaaacacacatgtatctacacatgatgtatagatgccatgttctcatgcaaaccatcacacatatgcactcacacaactgcacacacatggaggccctcagacacacatccatgcatggggtacacactggcacataccttcctgaaggccccctcacccatgcacagctgccacatgtgaacacgtctcagatttgcttacagagctgcagttgcatctgaaaacatataagcagacataggcacactttctcacacaaacacacatattccctctcatagatacaggtgaaaagcatgttcttttctccatttccttttgctacacacctacactttgaaatctttcacacattctctcctacagacctagccactcttgcacacccactgtcacacacctacgtacagaccgaatcactttctctcctttcttttccacatctctttctctttcataccacccacacagcaatcctagcctctctctctcttttcctctcacccacacacagcttcctggtttcccacaggctgggctgcagccacttccctagagcaggcactctcagggttagcgataccccaacctggtgggggtcccaggatcccacccccacccctcactctcccaacctgccctctaccctgggtacaagatgatgagagcagagcagccacacgatcagaggaattctctgaagcccatgaggccaggaggagaaatgggaactgccagggagggttcctgcattctgagtctccccagtgtgaacaggggacatcccaaacccaggccacctgcaggtctgtgtttcacaggcccttgtgtggggtgggcttacgctagcacattcctaacttcctttagcagaaatctaaacacacaactcttgatgcaaaagacagatgaaagtggaaccaccctggtcaagggggtggggaacccggggaaacttcggtgaaaacctagaccagcatttctccaaccgtggttctgtttcaaaattgctggggctgtggagggtacttgccatcagtcctgtgccaagcccaccagctcgtgccctcaatgggagtggtgctggaatgtgggtatctggacttttaacagcatcccacgtgactctgatgtacatggccactgccatggggcttcgcacgctcaatctgaatggcattttgctcagtgaaaggtggggagctgagccccagagctgccatacagcaccctgccttgttgctgacccactggtgaagtcaggggatggcagcaggtgggtggggacatggtcacccttctcagtgcccatttgcctaagttctaccaagagagacagttattctagttactggggctgagacatagcggggaagatgggcctgagcacccaggtctgaaaggagagccaggaagaggtagggtgggaggtggtaccagttatggggacagaatcacaaaggcagatttcaaagtgggtagtgggtgggttagagaaaagaaaaggggacacaaagaaactgtctccctcctagccgaaggagataggaggattttaggacagaccgaccgacctagcgatacagaaaatgataaggaaacggagagacagacaaccaggcagcagagagtgaggcacagcgagaggaaagagaggtgcccccgcctggagatgggaggctgagcgggtggaggagggagtcgcacccccagggctgggcggggcggggcgggaggggcggcgctagggccccggggagcaggcagcaggagcacggctcacccgcccgcccgcccgcccagcgctcccggctcccagcccggggtcccggagcagcccgctaggcggtggcggtggcggcggcgaggagggggcgtcgggcgcggagcctgggcctggcgcggggcgggggtggcggggacctcggggcggggcgcgctgacggacgcggccaggtgtgccgaggcggcggcgcccgggagctcggggaccgtgcgcagcggctggaggtgagtgaggggcgctggcctggcaggggtgcgggcaccgcgcgagcctcgccccttcccacctgcgctattcccggcgccgcccaggaggaggtggcacatctgggctccagtcctcgcacgcggggtgaccttggccaagtcgcttctacactttgggcctcagtttccccatctgtaggtggggggctggaggggtatcgaggctttcgagcagctgaggagcgggaggacgccctgacgccgggaagctaccctcctgggctgcgtgggggctccagcccttgcgcccctccccgcaagcggatcagggcgaggcagccccaggcttacaggtgggcaacagcccagagtctgtctccccaagcccgttctgggaaaagtcggaccgacttgacccaggataacccaggcgggttgggctctgcccagaattgaccaacatgggcgccgtgggggcagcgggaacggccagtgctgggcctcctcactcctccctgcgggcggggcgaccgggctctggggtctggctgtgccggtggggcacacaggatgccagagcagtcacaccctggggaccacccagcccaagccctacctggagaaatccaggcctttccccagcgcctacagggagaggggaaactgtcctgcgctgcccgcctcacaacatctttgcaattgccctccttgccaaggtgagagagaggccccagaggtgaagttagtggagggctcggctcctttctaaccgctgcgctgtggaatcaggggcactgtccagagccctggcaggacctctttgaggactcaggaaaaggtctcctttgctccccccattaccccaagttatgggcgtattccggaaggtgccagggaactccgtccatggggtccaggttgtctggaagggacaagagctgagtgggaagcagcatgtgccccatcccccatcccccaccctgtcctgaatggcaggtggcactggaataaaccaacttgttatgtgatcttggagcaagacccttgctctcttggcctccggtgagagggtttggcagggtagcccctgagggggaaattgcactgtggacagcagtgctggtggtagctgtagggctagtcagagggtgccctaccccctgtccattagaaagtggaagtgaaactggatgctgatgggggtctagggtacactggggcaaggggttggaagccttactggcgccagcctgccttgtcaccaagcccaggcctggcccattccatgttggggggcacagccacaaactggaactgatgtgctcccccactacttgccatattgtctcaggcaggcagatgagatccctcaggggagttgaaaaccccccggggagctgaaaaaccctgtttgctgggtggggcatccccttcctctgtctccttaggagatcttggtctggttcctccccttctctggtcctcagtttttccatcagtacgaaggggatggcctaggatcactctagcttgatattcaaacttcccccaggaatgttgtttaccactctggcttgcagcccccactttccaggcctgccccgtctttgcaagccatgggccggctcccctcaaccccacaactgacacctaaattaagctgtggttggaaccagcatttacatggctaaataaggcctttaactccttccctccctagtcagctgttgcccttatctactccccatcccttaaggtaggaaaaaaaccaaccaaatcaaacctgtggcattcaggcgcgtggttcctggtgcatccctaggttcttccgtggcattttatccagtatccgattttagaattggggagactggggccaaggaggggaagaggtttgcacagagtgattctgtgggaaggaggcaacagagctccctctccttgggaaagagcacatccttaataggtgaatggcgacatgagtgtccatggagcacctggagagagaggagaagcatgggaggaaccttcttccatcttctctccacccctagtcacagcccatttccagggctgacatgtgtcttcctgagcccacgtcacagctctgggaggtgggcagggcaggagtcagcacactccttccacctgccagggctgccctcccacaaggctgagcacacctccagggcccctgcctggcctgggaggcaccttttccttcaaggcagctcccaggcttctagacatgagctcatcggagctgctggtgccaggaagggagggactgaggggaagcaggcagggctgcccagatcagggcaccgtgggcccggggaagtacaggggggtgctactggtgaggccctgcaggctctggtccccattgtagtgaagagacagcagcaggatagatctgctgagggtcaactggggaagggtggagatgggccaagtgccctgggctgtagtgctaggccaacctctgctgcccactcacttactgtgtgaccttgggtaaatccctttctctctatgggcctcactgtccctggctagcaatgggttgggatgggtgcttagacactgaggttgcagtagtgaataagacagacaggcccctgccctcaaggcacttgcattttaattggggagatagaaaagaaaaaaggaagcaaataaatcatcaagataatttcagataggtaaaagtgccataaaaaaataagtcatgctgttaagatggagagcagttagggggctaccgggggttggtgattaggaaagtcctctctcagaggtgacttcagaacagagacctgaatcttatttgaagcaatgctcaaggctttctggggaaggtgtatctgcaactggagtctggaagaatggggaagctggggtgggggaggatttggttgggaggaaaggtttcccagaagatggtcatgctctggggctaggggctgggaccagtggcagggactggagggtgggggtgttggttgcatccccaggggcttcagactgcagatccaaaggagctccacctgagatctggtcagaggggcggctgggcctgcctgcaaagtggctctgctaagttagtcgtgtgtgtgtgtgtgtgtttctgtgtgtgtgtgtttctgtgtgtgtgtgtgtgtgtgtgtgtgtgtggtcagagtcttttgtgaactgtccctggatattggggctcaattgctacccagtgtggccagaggaggagtcaacatggaagcagcctgtaggccctgtaattccaaaggcttacacaagccctctgtttggaatgaaatctaccaactggctgctgctgcctgaaattccaccagcctagcttcagcttttccactcggtgaggcagggtcgtatagtactgtgcagaccctgccctaccctaccctgtccagcctcccagggttgctgcgggtggaacaaaattcagtctactcctaaattcttggaggcatgcctcatgtgtggctaatacacagattctgtggttggacctctgggttcccttcctggctggctgggagatcttaactatgttatgtaacctctctgggtttttgtttcctcatctataaaatagaaacaataatagaccctgttgtatactgttgttctgaaaattaaatgagatgatgataaatgctaaaaaaaaatgagctaccatttaggtattgtgaggttttgatctctgttaaaatagcggtcaggtgtggtggctcacgcctgtaatcccagcactttgggaggccaaggcagggggatcacctgaggtcaggggtttgagaccagcctggccaacatggtgaaaccccgtctctactaaaaatacaaaattaaccaggaatggtggtgcatgcctgtaatctcagctcctcagaaggctgaggcaggagactcgcctgaacccaggaggcagaggttgcagtgagccgagatcgcgccattgcactccagcctgggagacggagtgagactccagcaaaaaaatagaaatagcaagttcttaaggagatgggctctcgcttaagactaattgtatctcagtataagttactttttgatgtttggccaggaacaggtttttttgtttgtttggttgggttgtttgtttgagacagagtctgactcggccacccaggctggggtgcagtggcatgattatggctcactgccgcctcgacctcctgggctcaagtgatcctcccacctcctaagtagctggaactacagagatgtgccaccgtgcccggctaatttttgtatttttagtagagacagtgtctcgctatgttgcccagactggtcttgaactcctgggctcaagtgatccatctgcctcaggcttacaggcatgagtcaccatgcccggcctaggaacaggttttgatggtgggagaataggcacaagcacagcggaaaatgcctggactgagcttcaggaacggatgctcgaacctccgctcttagctgactggctggtggtcttgggcaaatcatttgcttcctctgggcctcaggcttcacttctgactgctgagatatgggctagtaaggatctgaggggatcatgggtgtgacaaagctccttactggcttgtcaccaagaacatggggctagcaggaggggctgacaccatggtgtcaagggtcaaggaaggggcaggctggatgagcccctgggacaggagagtgggctaacctgagacccttgcgtgtaatcctccagaataaaatctcttagagtctaagagtgcttgaaagataaaagccacagttcttgaaaaatgattgtttactgttatttactatgtaccatgggtgctttaagttctttacgcatcaacaactccatgaggtgagtactgttattagcattttgcagatgggaaactgaggcacagagaagttggttaagtgagcttccaaggtcgcacacctggtaagtggctagattcaaacacaggcagtctggccccaaaaactgtgtgcttaacttcttcgcaacatggtctctcccacactagatggagtgccaggggctcagaaaaagcaagccacctatcccagaacagacagcattcatctttgatcctcatcatccctgaagcttaggtcctggaaggaggagcctcactgggtctagggtccggggctctgagattggcccttgaaccagctcaacctttctattcccctggcagtaggtcagagaggatcaagggtgccctgcagtcactgtgggcatggaaggctctgccatggcctgatgagtgggcgttgttagtgccttggaacttgagtggctcctaagtgcttgagttgtaataaactcccacgcagtctggcacaccgccaccattgtacagttaggggaaactgaggtcagagtgtttagggagcagcccagggtcacacaggcagaggacacgcttcatccctgagcctcctgtcctgccttctgggccgcttagttcttgtgggctccataggaagatgagatgttggggaccctcccatggatccctaaggtggccctggcctcctcagccaggacattattcccaatatggggccctttgggagggcacatggagttgggggatggggagagtactgattaaaaaatagactgtcacgcgcacggagaacaagcatgccaccacccaacctgagccagttggctcccccatgcctggctgccaggccccactcaggtctcctgctgggggccccgcccaccataccctggctctgggcctgaggctgaatgctcccatccaccctctcctctccctcctccatccctgcccagcctccaggcagatggtgctcttactgagcttgggtgggcctgaagctcagctgtggactttaagctgtgccaggggtgtctggcatccccacacactggctgtgtggccttgaatgagccctttccctctctgggcctcaaacattgacagagtaatgctgtcaatcaaagttctttcccagatttcttctctcatttagacctgacagacactgcaggagaccccactcagagaggtgacctgcagtggccactcagctagggtgcagcagagcagaggccagtacccagataattgtgcaaatcccaatcctgtacaactccgggtgagtgaggtcacatgggagcatgaaggcaggaggctttgcagtcatgatgtgagcagtgtttcatgcatttgctcttttacttagtcaacaaatgtttattcaggcccagctatggccgaggcacaggggcatggacatagccaaggtccctgccctgcggggacaggcagactgacgtgaaaacaaatccttatggaattacaaagctgatgagcgtttagggaagaggcagagagtgttgtggcaggagaatgtgacctctgagggccttgggacctgtgaacagacctgaaggatgagaagtgtggtcagaaaggtgcagccaagggggcaagggaagaaagagctctaggaaaaggagcagccagtgcagaggccctgaggggagaaagtgctgggctggccgagcactagaaagagggtcagcatggctggagcctggcaggctgggaggtgaagcaccacgacgggagctgcagcgcaggggtcagggcagtggggctggtggtacagggcctggagcctgcgaaggggcttgaggcggatcataggaaagaggagcatgctggtgctgatctaggaggtgggtctttgctcctttcctttcctctttcccttggatgtccaccctgatagtgctatcgacagaccccattcatgcccccccagccacttcttgaggtggctaaatgcagagtctggggccctctctcccccatctcttcaaggagggttatggaggcccagcaggcctcagatgcaagctggtgagagtgcgttcctgggcaggaggctgcggtcactcaagctgagtgcccctgttcaggtgagttcttatttccttttattccctgtgggagtctgtggacaaaggagggtcagcttgtgtctgaatgaaggccgccccagacctacttccactgcctgtaacggctgcctgtcccctgttccattccaggcaccaacccccagccaaccctggagccaaaaccccgggatggcaggcaggaggcttgcatcctgagcccagctctgctgtacgctctagggcacacccctttttctccctgggcatcagtttccccatctctattatagataaatactctaatttttctacactcggtgtatggcccatggatgcagtatcagcatcacccagaaacttgttagaaatgcagaatcccaggcctcctcatcccagacttcctgaattacaatctgcattttgacaacattcctgagtaatttccatgtactttaaattatgagaagcgctattctaggtcagttatttttaaacttaagataaatgaaaatctatagcatatttttccttctctaaagctttacatataaacacataagagggcacccacccactgtatatttattcatcccatgaacaaggagggggaggagtgtggaggggtaagttagaggcacaggctttattaggatgggcgtcaggaggaggaaaagataaaacaggctggtggaggggcaggtgccatctgctcaccccctgagagcttctgacagttggcctctaagggccctttcggctctgccctccaggctcctctgctttatgggtttggagaaggagtgcttgatggtccatagcccagtgacgtctttccctgcttgtccctatcttgctgtcctgccctcttccccttggaatccctgaaagagtagccggtgctattcttagtgtgacagggtggtgaggagagaacatactagtgcattatttatgtttgtgagtcaacaggattacattcgggactcccagaacaccgccctcctagcgtggccttcatcacagccatggcaggtggtccactatgtgcagaggggagggcaatttcccaggacctagaaaccattccttctggccctgatcgtccctgctcagagtccctacccctcgacctgggaaatgactcatgaaataccatggtcagttaggactaggaaagagctgctttggccatatcatttccttgcatcatgcattcagcatatatttattgagcacatattacatgctgtaggtgtgggtgcatgggtgggggaaacagggttcctgccttccaggagctcacactttagccagagagctaatgtgcagtagtataggtttcaggcctttgcctgtgtgagagctgatctgagcaataacatagcagagtgggaattaagaatcttttagaggaaactgaggctccgcacatataaggcttgctaaaggtcaccatagctagtgatcaggttgaactcagattagttagaataaaacaactattttagagcagatggtagtgtgtagcgttagggctctgggaactccctgcactgccagtgagaggggtcttgtggctggaaggaaattaactggttgaggttgtcctgttctccagaggcatggagaagtcatgtgtgctcagagttttcataaacctggagtggtaggacagttacactgggggctgggagtcaaaatcacatgggatgagaggataaggccccgaggtggggcacctcatgaggctgtgccaatggctctggctaggagccaatgaaccatgtgcagtgagatcctgggcaggtcccttgccctttctctgcctcagttttctagtctgtaaaatggtgtaacaatccttgctctgtctctatctctgatggatgaaaagtgctaggaaaactataaaagtgttgtgcatattcaaggaatgctataaaattaccgtatataattatcataggctgtgtgcggtggctcattcctataatctcagcactttaggaggccaaggtaggaggattgcttgagctcaggagttcaagaccagcctgggaaacatagtgaaaacgcacctctattaaaataaaaattaaaaaaaagacaattatataaatatattttattaaatgtatttttattaacattatggagtcttactgtgtgaaagtctgtattccagacattttcttgtgttcactaacttacacacttagttataagatcatggactctaaagcccagtgggttcccaacctggctgtacacagaaccccttcgggagcctgttaaggtgtatattctgtggttcctccggtctaggataaagcccaggaatctgcatcttgaccacattccctgagggattctgaagcacctgcaagtttctgatctggaccagagaggggaaggaacttgccagaggcctcacattgaattgcagaccaggttgaggctaaaacccagatctccagctcctggcctggtcctttccctctactgttcagttgcctccaagtgccctagaggaatgaaggtggagatgactttggtgacacgtgaggatgctggtggtggtgctaaggtgtatggtgctatggtaggcatttcatatggcttatcccatttaatggcaataaggatagaaaaggggacatttgactgggcacagtggcttatgcttgtaatcccaacacttggagagaccaaggcaggaggattgcttgagcccaggagtttgagaccagcctgggcaacaaagtgagacctcgtctgtacaaaaatttttttaaaattagccgggtgtggtggtgcatgcctgtagtcccagctacttgggaggctgaggcaggagggtcacttgtccctggaaggtcactgccatgagctgtaattgcaccactgcactccagcctgccagcctgggtgacagagtgagaccctgtctaaaacacacacacacacacacacacacacacacacacaccacacacacacacacaaaggggacactctccacagccacatgatcccctgggtcatttgagcatcaagtggcagattttaatgtacccttggaaaagggagactatgactgagatgcagagatcctggagaagtgaatttgaaaccataccatcggtgcattgtccattctccaggagcatgtgccctcaaggcaagagttgtctgctaacccggttacctgaagacggggcaggctggcaggaaggaaacacatacgtcccacaaggtgtgtacctgatgcccatccatccatgccagccttccacgagtcccgtgtacctgcgggtgctcagtgtgcacatatttatgtgtacgtcctgccccctctgtgggtgtgcatgcgtgcctgggcacgctctgctgtgtgtagcacaggcttgaagcaagcagcacctctgtgtgtgggcatacgtgcagaggaggatgtgctgctgccggctggagcctctccagcattaagaggctactgagaatgcgtgtatgttgcaggtgtatgtgtgtgtgtatggaaatggttgcaatgcagagctcagaaggagaagggccattaaagaaaacatttttttgtttgtttggtttttttagacagagtcttgctctcttgcccaggctggagtgcagtgacgcaatctgggctcactgtgacctccacctcctgggttgaagtgattctcttgcctcagcccctcagatagctgggattacatgcatgcgctactatgcctggcaaatattttttgtagagacggggtttcaccatgttggccaggctggtcttgaactcctgacctcaagtgatctgcccgcctcggcctcccaaagtgctgggattataggtgtgagccaccgcacccagcccacacttttcttattcgtgtcctacctccacattatgtctatcattcttaaacctgccaggtatgagcctgcctcaggaccttagcacttgctgttccctctgcctgcactgttgccttagacaagcatatgcctcactctctcacctttttccgttctttgctcagatgtgccttctcagtgaggatggctttggttatcatatctacctttgcaaatcactcctcaccccttacagtccatatatctccagtccctgctttatttttttatagcatttaccatctgacttacttgtgtatttattatcttgttcccttacccgaatgcaagcagagattttaatctgtttcccttcatgcctgtgaacggtgcctggcccttagttggtgtgtaataaatacttgttgaatgaatgaatccatgcaccacctatacatattttctttaaattttgttagtgaaatgtccactttagcctctccttaagcagtaatatacctgagatcacaagtgtgttcattatacctcttttccaattcacatttgaaatgtatataactattaagattttaaatatcaaggtaccacctaaaatcctttttgcttccattagtggtgggggcaccacactctaggaaccaccagtccagtccaatccctcctttggacaaattggatgcactgaggccccaagagggtcagggatcagcccagtgtctcacccaaattgtgacaggacagaccctggaaccaaatctcctgacttctagtcttcttttcttttataatttgagggaaacatggagggcaggactgcatgattcagcctctccctggcaggagactcctcctgttggagtggggccagacctgcctggtaattggtgaatggcagcagaggagagggccatggcagggtcagcagcctccagcaccccagagccatggtgtcctcctctgagggggcctggggttcaaaactggttctggctagaagtgacatggggatcccctgtgcagagagaacgcggggtggggggtgttgggaagggggatggggttggactgtgtctgataatgagcagaagagtgagaccagacccagagaggggtggtgaagacagggagagagacagatacagccccagcctggtcgagttacgcagaggtgggtgtgtgcaaaagcctacagttaaccaccccccaatgtgtgcacagtgctttatactttagaaatcattgctgcatttcatttactcagcagctactctgcaaagcagatattattatccctgttttactgatgatgaagttgagactcagagaggtgaagtgatttactgaaggtagcccagcaatttgaataggatgccttgctgagccatagatgggggaagaactggctgcacctctgattggatttggtaaaggagggctgtctgtgggaggagcgggcaggctgaatggattcgggagtgaggggccggctggaaacccacaatccactcactggccaaataaccttgacaaatcacaaaacctttctttttgaggctcagtttcctcatctgtaaaatgggaataatggtactccctaactcacagcctgtgaggataaaataaaacaacatgatgaaaaatgataacactgaaaccgaatgcctcgcacattagaagtgctcagtaagcagcaacttgagtaatgaacatgattgcacccggcccctgaggagtttgcacacggtgaccacctgccacgactgagggattcccagcgccttctttggcagctgtgagcgcgcctgagaccccgtctggggaacccgcaggggttgggggcaggtttgtctgtcccagagccccaggctggtgatgacgcctcctggggataaacctcatctctctgttgtttaccccatgtgcggtgactttgtcattatcgttcctcctgcgttttttctttgagttatttatttttctgtgaggaaggaatgtggggaatttaccacagggcgctgtccttcactttcagctgggctgcacggcgtcctttcctataagaaggaagctgctgagacagatggcaggagaggtggaggcggagggtcccagctggctctgtggcccaaggagttgggggcagttatgtaacccacccggaggcccaggttctggtctccgggcatgagcctggtaatgtacatagctcctgtggaactgtgcctagccctccccattcacccctggcctctgggcaagcccagtgggtgtgttcctctatcaaagtttcctttctattcagctggtcttgatttggggtatgggggtaggtaggggagtggggtgggggttatcttgaacctcctagtctctgctgagctatcatcattgcttagaatgcttccttatctccatctttcaagagctaggacatatgtcacctcctccaggaagacttcctggattgcttcatcctaattcatctttctcttaggttgtatgttctcccctcacttcatgaaacattcttccccttaggtctaacacagtgatttgagatttcatctccttccctcacaaacgtgttgctctctccttccttctcctcccactcccaggaaccaccctctagatctttgatctagaatctagatgaatcttggatttagacaaatctaaaattcatctccagggatgaatggtgaagcaaaatgtgaagggggaggctttggattctggaagtgcttgtcctttagtagtttatttaatcaacacagtgatggtttcaacccctcctgggtgatggcttctgctgagtctggggacatttacagaggacagagaccagtcctggccctaggctggcacagggctaaggggaaggaccacatctttgtggcgggcccagagtgtgtcaggccctgggaagagtggaggggacccgcagatgacctaggccctgccctgaccctggcagaggcactgtttaggggaaaccacctctttccctgccctggcttgccacctttttgtcttttagattatgtgttttctctggaaaggcagggtatgatggttctttctgtactcccaaggcttccagggagctggggctggggagagtgaaacagcaggagggggcttcgtgagcacaggcttagctcaccagggttggactggagaggtggaagcctgggctgtgatcctgtgatcctctctgtgagccctcccttttcagtttgctgtatacctggggctcagcttgcctctctctgggttaccatctcaaagtttctaaaaattgactgattatagattaataattaccccagtagaatgggcaagagagaggctgtggctcctggcctttggcagggccctggtcagccaacagggagcagggcttgtggtctgcaaggatagaagatgggtcaggcttgcgctgactgtggagccctcatcttagcttccccttacccatccatctctgccctccctgatcccgacccactgccagcagagagaaaccagaagtttggccaggcccagcctccttcccctgggtttctgagttttctcaacctgccgtttcctctgagctctgttcctgctctggggcctctgggccaggttgaacaggggaggagcactgatctaggagtctgaatggattgatgagggcttcctacaagaagtggccgttgggctgggcctggatgggtgagtaaggaaggtgaatttgctttgtggggagctcttcagaaggaaggcgtccaggcttgagatcagtcagaccgcaggggccccttgctaagctgtgagacctggggtgagttagctgcttctgtgtgcctcatcttccttatctacaaaatggggataagggaacctcctctatgagttgctgtgaggattaaatgaaaaaaggcatgttaaacccttggcttggcagcatctggtgctcccaaaatgttggctcttgtcattctcatagatttcatgtttattctgcaagtgccaatggaagatgtggtggggacaagggaggaataccgaagtgaagcagtagaggcccctgccctcgaggccgttgcagtctctgggggaaaatagggcccagaccctcattgctacaaagcaaaacactgggagggggcagcatggcccacgtgactggccctgcactgggcattaggccaacctgggcttgaatttcagctcttcctctggctggctgtgtgaccttgagcaagttgctgcacccctctgagccagcgtcttctctaatatggagatgaggatagtgctggcctcatgggttgctgtggaagtaagtgaagtaaggccctgtcctgctacctggcatgtggtgagtataccctgaaagattacttttactagaataaataatacacaaggtggtggttattaagtgatgcagacagaacattggtgaaggctttttggagggggtggtggcattctaggtaggccggaaatctgaaggattagggcatgtagaaaggatgtgagacagaggagggttcccggtagagggggtctgtgcaaacgctgctttgcaggcaggaattcattgggcagctgtgggaactgcaagccactgaactccctccactgttgctgagggcacagagagaaggtgagtgagctcttgggcaggccccgatagcaggggtttgaatgccaggatgaggactctcctcttgatcctccatgtcctggggaggcagcagagggttttgagcaggagagaggcatgagtggagcccggagggaggaagatgaatctggcagcgtggggcgggtagattggcgggggagagactgggggtggagaggccatttaaaaggctgttgcaaaatcggttttcctgataaagagctgggctgagtcatctgtggaggagaaaagtcacatccagctccttcatgttgctgccgatgtgggattttcctggcttcgtcagccaagcaattggctgcctttgccggaggctttgagaaccaaggcttgaaggccggcaggagcatccagggggaagcttggcttcagggaggacctagcagagtgagtaagatgagcacccggaggtgcctttgtggcttggggtatatgacttagggcatgtggcatcccccctctgatcttagtctgtcctctgggcatcaagggagaggtatgtggtgatttctgccagcctgtgagtggtgaggcgggggctgggcctggggctccccaccccatttctgtgtcttctcccatgcccggcagtccttcccaccaaagtctagattgttctcctcccaagaggaggtctggcagtctgccgaccccagtcagattgcgctcgccatgactctggggatggagaattctccagggcatggagcctgtgtcatttcctcctttcagtgggaggaatggggaaggggctggcaaggtagccaggccattactcaggcctctccattttcctgcccccagctgagccagaggttgtgcagtggccagtcattggttccttcctgacctcaccaggggggcagtttacccagcctgtttacccttcctgtcgccaagacccctggactaccacaatgggctgccttgagccaatctctattcctacccctggctctctgtcccaccccgccccacctgaccctggctggacactcccattgacggcatcgtgtgaagaagcatttccttgaattctccctgtcctgaccttctgctctggcctcccttccccggccccacctccctcctgtggatcctccatccacacgggccccagtggtgggcagaacaagcagctgtccacagtgggtggtaggggtgggggaaagggtttgtccctttctacgccaaacaagaactggggtcttctgactcccaacatagtgatcttcccactctactcatctttcatgccttatcagtcctttctaccttagtaagaatgagtttatcaactcttctcctgaaaggaagaagtggaagaaagaaggagttgttctaggcagctgggttttcaggggagaagacattgctgaggggcattgatcacaagatgagggagcagagggctttgcagaccatcatccaagagcactggagcctctcttgtttctcctctttccagagtcctagtctggaaggagaatagttaagagattagactcagagccagacttttctgagtttggattccagctctgccactcataagttgtgtgaccctgggcaggtctctctgagccccagtttcatctgcagaatgagaagaatcacaggacttatgtctgggagctgttgtaagaactgaacaaggtggtgagcataaagtgcacagcactgagcctgggctgcagcaggggctcagtagtgacagcagtcgttgcaaagccccttctcatggctgtgctggggcttctcgcctactcccccacttcaggatttaccctgttggacccaggtctcctgaccccaggcagcttttcattgtgcccgccctccaccccttcctctcttgaaggcctatcttcagggctcctgatccagtgtccagggtgggtctttaaagggctagcaccccaacttggccctgcagaagtttaggtggggaggcggtggggacatcatgacttgcacaagtgcaggccacagccaggccgattgagggttcaatgaggtacctgtcccctgtagcctttggctacctccccacccccacctttgacaccaagagcatgatcttgagcagctgctgcctgggatattgccagagagggcagctccctagtctgaggaattttagatggagttgccccctggtgccctgctacgagggactctagggtgtccccccgcctccccagctttgtttgtgaagggtggcgaaaatcatctggatggctggctggatctggtccaaacctcctgctgaattccttttccatggagtcactgtgggctggagtgcgggctgcaggagcttgccttggagggcagggctctcttacctcctggccttttctgccattcctcttgttccagaacagtagcttgggagcagttctaagctcagagaggtggtggtgatgggatcttagcggcagcccaggttgtgcatggagcctcactgagagtcagctgacctggtcttgggctcacatcctcctctctgacctcttccttggctgggcctcccaggccagcttatttctaaaggcccttcatattctgacatttgaggattttctaaacccatggccttctagagccagtaaggagaaaagcagaaaaatgcaggggcattgagaggtctggagtaatcaaacactgaagtgctttctatgagccttgcaaggtgggaaccggccagccaggagcctggtgctctctgcagtaacgtagagccaggtgtgaacagagctctactccttctggctctgtgatcgtgggcagctcactttacctctctgagccgtagatttctcatcaataaagtgtgcataataatagtttgtgatttgtaggtttgttttggaaattaaataatatgagtaaagtctgtgtataggtgtacagtaagtgaccaatcaatattagctactattgctgcaactgtgtcataagaaacactggcaggactagagatgtttatcctgaccctgtcccaaggggatctgatgtatctgcaaatctctgcagggctgtcaggctggaatgaaagagaaaactttttgttgttgttgttgagatggaatgtcgctctgttgcccaggctgcagtgcagtggcgtgatctcggctcaccgcaacctctgcctccctagttcaagcgattcttttgcctcagcctcccaagtagctgggattacaggcgcccgccaccacgcttggctaatttttgtatttttagtagagatggggtttcaccatattggccaggctggtctcgaactcctgacctcgtgatccacctgccttggccccccaaaatgctaggattacaggcgcgagccaccgcgcccggctgagaagactttttctctgtgcagcctggggaggcagaaccacatcaagaaagcggatgatggctggacgtggtggctcacgcctgtaatcccagcactttgggaggctgaggtgggtggatcacttgagctcaggagttcaagatcagcctgggcaacatagtgaaatcctgtctctacaaaaaatacaaaaattagccaggcatagtggcatatgcctatagtcccagttactcaggaggctgaggtgggaggattacttgatcctggaaggttgaggctacagtgaaccatgatggtgccactgccctccagcgacagagcaagaccctgtctcagaaaaaaaaaaaaaaaaaagtgattggaagtgaatgtaaggaggaactttctagctgaggaatgttaattagtggaagacacctcccgggggagtgagctcgtcacctgagtatgtcagcagagacttgcacactcagcatgttgttttgaagatgcaagaattgtgtgggaattggacttggtgacagccacctctgagattccgaggttctgtgttttggggcagtaagctctgcctccgtgtagctctggaatctcctgctatttgaccttcagtcaatcccctgtgctagaagagtatctgaccttttccagggagtggaatggggtgaccaattgccagcttatgccaggatagcatgagccctctgtctgtccacctgggcttcatggcagtcaggccttggcattttcatgatctctttgtggcctcccaacactcatgtcaagttaaggagactgtggctctgagaggtacagtaacttgccaaggtcacacggctagcaaatggcagagcttggattcaggccaggaggcctggtttctaagcagagcaggggagacagacacagcatgagctgagcaacctctcagagccctccagtgtggctggcaccccatcccttaggctcctcccaggggagcagcctggctaatagatggctaatagacatctttaatagatagggtgatccaggcaggagaagagtcctactcggggggagtaatatcatgggtgggtgggataggctgtgtgctttcactgtttctaataggttaggggaaaaccaggttcgatggaggagggaagaaggaggttggggccagaaaacctgtggctgccccagtggagctgctgtgacgctgctggtcacagcttctttgctctgtgtgggcctccctgcgggtcccatgtggggtcacccggctctaccctgggctactctctggatctctgtttcccacctataaaacagggtggtgatgaaatacctcctctgtcagaattcttccagctctgagagtccatgaattcagagcctcgctggcaagatgcctggaaagactgtccctggagacagactcagcatgccatggccagtgctaatgagggcaagggaggggagggcagggtcagattcctcaagaactaattagcttcccacagtagggaggagaggggcaatggagggaggaattttcttagccactgatgttgctggtcacaggctgatccatccacctgtctgtcaatgcatttgttcatgcagcatttgttcatttattattcaacaattataaattgagcatcaactgtgtgccagctggccactggggatagaaagagaaatggttgcctatggtgatcttatagattaataggggactgaactcagcctgatctcaggacctcaaatcccagactgaaccccgacccatgatgaccttgttcctgccccttatgtcccaaagagaccttttgggatgagtagaccacttgagcatggactagagaccccagaaagaacagttctgactccagctttgtcacccttggctttgcaaccttggggcagttccttatatatctctgaacctccgtttcttcttctgtaaaacacaggcaagcaatgcttgtctcattgtggtcttgtgcagataaaataaaagaatgcaatgttctacagtagtcattggtgaaactagctcaatttgttacttttctagtgttaaaagatgtgaattttaaaatgagtatttaagtaaaactaggaagaaatcctgggaggagatagaagaaactgattgtgatacagagtaatcagggatggggtgacactttttactgtatacctttttatgttttaatttttagggccaggtatagtggctcatgcctataatctcagcattttaggaagccaaggccagagtatcacttgggcccaggagtttgagaccagcctgggcaacacagggagaccccttctctacaaaaaatacaaaaaaaaaaaaaaattggctaagtgtggtggcgcacaccgatagtccagatatttgggaggccgaggtgggaggatgacttgagcccaggaggttgaggctgcagtgagctatgatggtgccactgcatgccagcctgggcaacagagcaagaccctgtctcagaaaagtaaaaataaaataaaaatgaatgaataaataaatttttagactatgtgaatgtattacctaccctaaaaaggggaaatattagtggcgtctctttataaaatcaaagcacatgcctgtaatcccagcactttgagagactgaggtgggcggatcacttgcgcccacctgagtttgagaccagcctaagcaacatggtgaaaccctgtctctacaaaaaaaaatacaaaaattagctgagcatggtggcatacatctgtagtcccagctacttggggagctgaggcaggagaatcacttgatcccaggatgtcgaggctgcaatgagctgagatctcatcattgcactccagcctgggtgacagagtaaggtactgtctcaaaaaaataaataaatacaaattaaaaaaagcagacggtggtttattaaaacatttttgtttaaaaaaattagagcacattcctatgctataattctgaaagtataaagggccctaaggaaggcacacagaaaatattctgggggttcatttgtgcattcagcaatatctaccgagtgccactgtatgacaggtgctgttctaggggctgttgttagagtgataaacaagtcaggtggccgggcacggtggctcacgcctgtaatcccagcactttgggaggccgaggcgggtggatcacctgaggtcaggagttcgagaccagcctggcctacatggtgaaaccccatctctactaaaaatacaaaaattagccgggcatggtggcacatgcctgtagtcccagctactcgggaggctgaggcaggagaatcacttgaacctgggaggcggaggttgcagtgagccgagattgcgccgctgcgctctagcctgggcgacaagagcaaaaactccttctcaaaaaaaaaaaaaaaaagtcaggcaaggtcattgccccttggagctatgctgtaggtgaggagacagataatagacagggaaacataaagatcatttcaacttggtgaatgctatggagaaaacaaaacagatgggataggagaaggaaaggtgcctccagagaggggacattccagctgagacttgagtggcaagataggaaccagcatggactgctacctgggaaaagattattccaaggagagcgagcagcaagtccaaaggccctggggcaggaacatacttggcattttcaaggaagagaaagcaagccagtgtggcagagcctagtgagagaggagaaggcagtggggaggaactggggacacggtgggacttctagggtgaggtgttcgtactcagtttggtaaagtgccatatcagcaactgtcagggggattccaaatcagggaccagttaatcctgagaggataatcagggtggcgtagacgtggtggcatttgagttgggccatgaaaggtaggtcagggctgattacgaagtgagctaattctaagaaacagtgagtgacgattaaattccagaagagatcctgtgtaggaagggccgaggcgaccatctctgtctgcctgtttgtccgtgcacccctgtgtcactgcattcctgtttgctaactgggcttttgtccctccctgtagcgttgggccggagcactagcctcacggagaaggatctgaaagaagccaaggcgcggagccagcagattgcagcccagctgaccacccctcccagctccaattcccgtggcgtccagctcttcaacaggcgccggcagagggtgaacgagttcaccttggagagccacggccagaggggacagaagcccagccaggagtccctcagagtgctcccttcaagcctcccaggccatgcaccggggctcagcctgagttccacctcgctgccggagccaggccctccacggcaccccagtccccagagccccgacagaggggtccctggccacagcatggaggggtactcagaggaggctagcttgctgcggcacctggagaaggtggccagtgaggaggaagaggtaccactggtggtttatctaaaggagaatgcagcactgctgacagccaatgggctgcacctgtcccaaaaccgagaggcccagcagtcctcaccggccccacctccagctgaggtccacagcccagctgcagatgtcaaccaaaaccttgcctcgcccagtgccacgctcaccacaccaacttctaacagcagccacaatccgccagccaccgatgtcaatcagaacccaccggcaactgttgtcccacagagcctgccactttctagcatccaacagaattcctcagaggcccaactcccatctaatggcacagggcctgcttccaaacccagcaccctgtgtgctgatgggcaaccccaggcaccggctgaggaggtgagatgcagcacactcctaattgacaaggtatcaactccagctaccaccaccagcaccttctccagagaagctacgctcatccccagctccaggcccccagcctcagatttcatgtccagctccctgctcattgacatccagcccaacaccctagtggtgtcagcagatcaagagatgtctgggcgagcagctgccaccacgcccaccaaggtctacagtgaggtccacttcacactggccaagcccccatcagtggtcaacaggacggccaggccttttgggatccaggcgccagggggcaccagccagatggagaggagccccatgctagagagacgacattttggggagaaggccccggctccccagccccccagtttgccagacaggagcccccggccacagagacacataatgtcccgcagccccatggtggaaaggaggatgatggggcagcgaagcccggcctcagagagacgccccttggggaacttcactgcaccccccacctacactgagaccttgtccacagcccctctggcttcctgggtgaggtctcctccctcatattctgtcctgtatcccagctccgaccccaagtcttctcatctgaagggccaggcggttcctgccagcaagacgggcattctggaggagtcgatggcccgccggggcagccgcaaatccatgtttactttcgtggagaagcccaaggtgaccccgaatccagacttgctggatctggtacagacagcggatgagaagcggcggcagagggaccagggggaggtaggcgtggaggaggagcccttcgcactgggggccgaggcctccaacttccagcaggagccagcacctcgtgacagggccagccccgcggcggcggaggaggtggtaccagagtgggcctcctgcctcaagtcaccccgcatccaggccaagccgaagcccaaacccaaccagaacctctccgaggcctctgggaagggagctgagctctacgcccgccgccagtcacggatggagaaatatgtcatcgagtcttcaagccacacgccagagctggcccgctgcccatcacctaccatgtccctgccttcctcctggaaataccccactaacgcccccggggccttccgagtggcatcccgaagcccagcccggaccccgcctgcctccctctaccatggctacctgcctgagaacggggtcctgcgcccagagcccaccaagcagccgccataccagctgcgcccctcgctctttgtcctctcacctatcaaggagcctgccaaggtctcaccaagagctgcctcgcccgccaagcccagctccttggacctggtgcccaacctgcccaagggggctctccctccatctcctgccctgcctcggccctcgcgctcctcaccgggcctctacacctcccccggccaggacagcctgcagcccactgccgtgagccctccttacggcggtgacatctcccccgtgtctccctccagggcgtggtctccccgagccaagcaggcccccaggccctccttctctacccggaacgccgggatcgaggctcaggtgtggaagccttccttctgcttcaagtaacgaaccccacgggggtcccactgccggtcaagttcccctccttgagggccagatggagagcagatgtggcaggaaatggcacagagctgagtgaggagaatggggagtccatggttcaaggtcagatgcggccaccagctggctttgtgaccttgggcgagtcgcctcccctctctgagctgaagccgcccctcccctactacaacaggggtcggactccatgtctgagcggggaggagggtcatggagagagaactgtctggcagccctgatgcggtagaggggcatcctctggcctttgtgagctgtagggatgcagagtctgatgccagcgtcttgctgggggagtggcctagaaggggatcctaacagggacttctggagcagacagagcctgccagtgcctgtggagtcagccagccgagggtctgcctcctcagctgccccaggggggcctccctcctgaggctcaagctcctggcgtctttcttcctgttgctggattctcacctccatgggcctgtctcttctgcctctgccttctggacaccgtttcctctccgctgcttcagagagctttgcctcgcctccgcctgcgctcccctccagggtccttctgctggctgcggactcggcccaccactgctgtctgacgcttttcttcctgccccctctgaggcctggctctgttttagggagatcactgggcccaggcctcagccccagttctacctggcttgctgtcaccgctctaggggtgggggacgtcccaggggatccccaggagaaggagagccctgtagggggctgtgcagatgtgggtgtgccacagggagggtggcccctagccatgtatccattggctgttttggcttcagattcaaccaagatctgcctgactaaaagaagccacctcagcgcagtggaacggggcccagggggaggcaggagaggagggttccggtcccatgtcaccttctcatttgctgtgtgactttggcccactcacattctctttgggcctcagttttatcatttatacaaggagggcttttctagctgtaacaatctgtgaggattgagaggataggctggtgctttgaagaaaggccttgtaagtgacaagacagtcccctgggaagaaagagaaaggaaatgggctattgccaaaggacaggtggcgttagatggctgtgagggtgacctggtgagggaagggttggaatgagctgctgcaggaggccaagggatgcctgggctgggctgggctgggctggcttaggctcaggattgcctggggacagtaggagcatggcaggagctggggcaggtgcatagcagtgcagtgggaagggacagaggagatcttagaattttgaggaaaatctgggacttgagacctggattctaacagaccaactgcatgtgtgtctgtaggtctcagtttccacattcatacagtgagggtgttaagtcaggtagctggagacttcccatcgcctctgacacttttggaggtgatatgatacagcccccgaccaaaccaggctttgtggggggtgagagaatacagacacaagtggcaggattcagatggaagcttcgcaaggctgggggccgaggaccacccacttctctttcccagccctagttctgggttccccagtggggcaaggggtggtggaggcagtgcccatgctgggctgagcctgcagtttttgtgagctctgggcttgtctccatgggaacaggggtgccttcttagtgagctcatttcacacagatcgagggggtatgcgtgggggagttgtgagtgagctcagctccttcaggcctggcctctcccagaacagagtgaagcccctgccctggacccctgctcccttctacccttgagggccaccaatggaagagcccgcccttcattctgcagctcctgcggccaggctgagctctgcccccaactttgttttctctcatgttctcaatacactctgcctcaaatccgtcttgcttctttctttcttccgtgctgctaggggtcagggttcccttcctcctgcctgattctagcctgggaagtggagtgggcctgctcaattactgtgtgtgaaagtgtggctgtgtcctgcgtgctgcctgcacctgccgtgtgtctggttctgcactggtacagacgtgtgctgggttggaaatgagggcttcctctctacagcactcagggagccagaaccctgtgcaaatcgcaaccttttgttctttccttccctcagagtttggccaaaaatactttagaggatttttggggaaaatgcactacctcttctcgttgaggtttgtttgggttctttacaagtggaatagaaattcctctagccagcattcgctctccagttccctcaggtcccctccctgctccccattatctaaatttggccatttcccacatttgccattgttttcactgtctggatcctaaaagcatggagtttctgcccctggtggggaggaaagaactgccatcaagggtcaggagagctgggttctagccccaggtctgcatctgattcgtgtgtgacctcagacaacctcttccaatctctgggcctcagtttccccttctgtgcagtgaaaggattacagaaggaggtcagagaccatttggtctccgacagtccaggtttgactgtgttctacttatgtattcaccccacacatgtgccctgctttgggtctggggttgggttgagtggatgctactttttgaattttcacccaccgcattcccaaggagctctggtgtgcacggtgcattgagctctctgtcagaaagtgaacagttctgatttcctgcagccttttcgtactgtgcacacccccgactcaaaaacatacacacagagtcagtgcccaggcatggctgttagggtgaggtcaggctctggcccatctccagatgatggggatctgcttaccactgccctcaacattcaatcccgtttgagcccttctgttttgtagtcttggctgaattgttatttcttccacttgttggcctcagcattccccttgtggccaccaaaggcagaaacaatgctttagagatttttaggtagttatcatagctctcctgtgcagcctactctcctggctgaagaccccaggttccgctgccttgggtggttattgactggcttgggtcatgaactctaggccctacctccctgctcagggtggcactgtggtcaggtgttgggtcatgccagagcccaccctgatttggcatttggccctagccctcctcttctagccctggagctgggaccttcctcccagctcctctccctaaactgtggggtctgccttctgcggccagcctgactgggatgttccactggcacagagaagctcccagtgtctctggctcatgtatacacaattctgaccctgggaagaaaacagtgggatcccaggctgagccttaactttcagcttgatgactgggagcttggatgtccctagggagtctctaagggtcactccagcattagtatcccatgaaaaatgtcctgctcaggctgttgtataacattcttctttaggttaaagggctccagtttggagtctgggctcatctagcagctgctacattctgtttggataaaacatacaattggtgtctatttcctttggattgggaggaattagaagactctcagttggatgagaggatgactggcttggttatggctgatcactgattggatgaaagaataaatctttggatggttctagattttgatcgggtaggaagcatggaatggactggctagctctgaactctggtggatgactgctagtgaatttggattggattaaatggcaaggtggactggttattgctggaatctgattgggtgaacagttggaaagttcaggagatacatgttaggcagggattcccaagccctccactttcaaaccagttcaaaccgcttaaacatgtagcctttgagcagcacacacacacacacacacacacacacacacttcctggtggggcagaacacactagattgttatttacacctctgagcttcattttcatcatttgtaaaatgggtgtggtaatgctaattacctcactagtctgttgtgaaaacctaatgagataaaggatgagaatgaagtttgtagactgaaagtccttaagtacataggaaacaggtatggctctgcatcgctgaccagtgcttcatagcctccaagctgttcaccatcttggcctctccaaaaccacactcccctccccattgctgtgaaaaagctcagtgaggggcgtgtgctgcctagggaggaatggcccgacttccttttgtatctccatctgtcaggggcatcttcctccctgttcaggcatccaaggaaagatgatgaggtgaccatggcaacatggcaaatggtttggggctgagagggtctttccctaagtccaactttaataatagtcggccaggcgcggtggctcacgcctgtaatcccagcactttgggaggctgaggcgggcggatcacctgaggtcaggagttcgagaccagcctgaccaacatggagaaaccccgtctctactaaaaatacaaaattagccaggtgtagtggcaggcacctgtaatcccagctactcgggaggctgaggcaggagaatcacttgaacccaggaggcagaagttgcggtgagctgagattgtgccattgcactccagcctgagcaacaagagcgaaactccatcttaaaaaataataatggtcaatatttttacattttaattttgataatagataatacattcatatggttcagaaatctaaacttatataaaaagtaatatattaaaaagccttattcccatctccctgccccagcctactctcttggctgaagagccaggttcccctgcctcaatagttgctgactggcttgggtcatgagctctaggccccacctccctgctcagggtgacactgtggtcagatgagaggacacacagagcccaccctgacttggcatttggccctgagacactagtctcagcctctatctagttcttcccatgtggccctgggcccgggacctccctcccagctcctctccctaagtcatggggaaaccgaagcctccctcagctagcctgactgaaagcttcccgggatgtgccacagacagagcagctcccagtgcctcagactgtgtgccctgttcctgttctcaccccatttcctaacaggtgaccattttggttagtttcatgtatatccttctagtattttttttaaattgagacagagtctcgctgtgttgcccaggctggagtgcggtggcacgatgtcggctcactgcaacctccgcctctgaggttcaagcgatcctcctgcctcagcccccgcagtagctgggactacaggcacgcgccaccgtgccactaatttttgtatttttagtagagacagggtttctgcatgttggccaggctggtctcgaactcctgacctcaggtgatccacccgcctcggcctcccaaagtgctgggactacaggcgcgggccaccgcgccaagcccttctggtatttctttatggtaatcaacatctattgagcactttcttccaaggaatgtgccgatatatgtaatgttcttttccatcagttatctcatttaaccctcacaacaaccctataaggttaagtactgttatcacaccccattttacagaagcagaaactgaagcccagaggggtgaagtaacttgcccaagctcagttagtaagttaaggcggctctctccaaagcgagtcttcttaacacggaggcagacacaagacagcggggactcttcaggcgttccgggctgagagtttgggcgcctgcgttttattgcaggcactacctgacttggatcggtggcttcccttctcggtgtaatggacaaatcggactccgtcccttcctaaagcccggtgtggaagacctcagcactaatgcctgccccaccctctctgctctctccccaggaccgccgggagagcctgcccacctccccaccctggacgccgggcgcgtcccggccccccagcagcctagacggctgggtgagcccgggcccgtgggagccaggtcgcgggagcagcatgagcagccccccgccgctgccgccgccaccgcccatgtctccctcgtggagcgagcgctcggtgtccccgctgcgacctgagaccgaggcgcggccccccagccgccagctgcaggcgcttctggcgcgaaacatcatcaatgcggcccggcgcaagagcgcctccccgcggtcggcgggcgccgagaacccgcggcccttctccccgccgagggcgccaccgcccccgcccccgcccccgcccccgcccccgcgcatgcgctcgccacagcccgcccgccccggctcggctgctgtgccgggggcagccttcgcgcccatcccgcggagcccgttgcccgccggtccttcgtcctgcaccagtccccggagcccgctgcccgcgcctcccaggcccttcctctaccgccgctcgcccacggactccgacgtgtccctcgactccgaggactccggggctaagtctccaggcatcctgggctacaatatctgtccccgcgggtggaatggcagccttcggctcaagcgtggcagcctccccgccgaggcctcctgcaccacctagagccccacccccgaccccaccccgggagggcagagccagaagaaggctcattagacctgggggacccaaagggtctggcctctttgggcagccccagagatgaggggtcagcagaggagagctctggggttggggatgggttagggacgcaagcttgagttctagcccttgctctcattcagctgttgtgtgaccctgggtaagacccttccttgtttgaccctcagctttcccatctgtttaatggtggctttggccaaggcaatccacaaacgtcaaaattccccttcccatcagtacacacaccgatgcacacacactctctctttctctctctctctctctcacacacacacacacacacacacacacacacacacacacacacactagttagtgccttggatgaggcggggcagtgtgtatatggacccctggacttgctaccttcagggttccatactcgtccctcccctcctggctctgctgtctggagtctggcaagcggggtgtgttcagaaggtcctaggcctgtgtcgcatgtccaggcactggcctgaccatccggctccctggcaccaagtcccaggcaggagcagctgttttccatcccttcccagacaagctctatttttatcacaatgacctttagagaggtctcccaggccagctcaaggtgtcccactatcccctctggagggaagaggcaggaaaattctccccgggtccctgtcatgctactttctccatcccagttcagactgtccaggacatcttatctgcagccataagagaattataaggcagtgatttcccttaggcccaggacttgggcctccagctcatctgttccttctgggcccattcatggcaggttctgggctcaaagctgaactggggagagaagagatacagagctaccatgtgactttacctgattgccctcagtttggggttgcttattgggaaagagagagacaaagagttacttgttacgggaaatatgaaaagcatggccaggatgcatagaggagattctagcaggggacaggattggctcagatgacccctgagggctcttccagtcttgaaatgcattccatgatattaggaagtcgggggtgggtggtggtggtgggctagttgggcttgaatttaggggccgatgagcttgggtacgtgagcagggtgttaagttagggtctgcctgtatttctggtccccttggaaatgtccccttcttcagtgtcagacctcagtcccagtgtccatatcgtgcccagaaaagtagacattatcctgccccatcccttccccagtgcactctgacctagctagtgcctggtgcccagtgacctgggggagcctggctgcaggccctcactggttccctaaaccttggtggctgtgattcaggtccccaggggggactcagggaggaatatggctgagttctgtagtttccagagttggctggtagagccttctagaggttcagaatattagcttcaggatcagctgggggtatggaattggctgaggatcaaacgtatgtaggtgaaaggataccaggatgttgctaaaggtgagggacagtttgggtttgggacttaccggggtgatgttagatctggaacccccaagtgaggctggagggagttaaggtcagtatggaagatagggttgggacagggtgctttggaatgaaagagtgaccttagagggctccttgggcctcaggaatgctcctgctgctgtgaagatgagaaggtgctcttactcagttaatgatgagtgactatatttaccaaagcccctacctgctgctgggtcccttgtagcacaggagactggggctaagggcccctcccagggaagggacaccatcaggcctctggctgaggcagtagcatagaggatccatttctacctgcatttcccagaggactagcaggaggcagccttgagaaaccggcagttcccaagccagcgcctggctgttctctcattgtcactgccctctccccaacctctcctctaacccactagagattgcctgtgtcctgcctcttgcctcttgtagaatgcagctctggccctcaataaatgcttcctgcatt

SEQ ID NO: 36261 - DNA, 7453 bp, Homo sapiens
ccttaatggcgcccgcccagactcctggaagtgagcggcctagcgagcgagctcccaggcgcaaagcacgccggaagctgtagttccgccatcggacggaagccgaccggggcgtgcggagggatgtggcccggaatattggtagggggggcccgggtggcgtcatgcaggtaccccgcgctggggcctcgcctcgccgctcactttccagcgcagcggccgccgcagcggacactccagaacggcctggccctgcagcggtgcctgcacgcgacggcgacccgggctctcccgctcattcccatcgtggtggagcagacggtacggcggccgggcggggacacggttcgggggctccgggctgggtggggatcggctggctgccccggcccctcacctccatctttctacccccagggtcgcggcgagcgcgcctatgacatctactcgcggctgctgcgggagcgcatcgtgtgcgtcatgggcccggtgagcgccccgcgccgggaccctccccaggactctcccaagcgcctgccgacactccctgcgcccctccttccctggccccagactttccctcaggctccgctccccttctaacccccttccctccccttctgactcccctcctggctcccggtcccccaacccgctcctcaccccttctctgctcctcggctcttaatctccgacttccttcctgacacctggcaccgctcccctcattcctacgctcaagactctccccagccattctcaccccttcctttcctgtgtccctagccccctgactccccccttcctgtgctccaaaccccctgggtcctctccactactctctccccatccccttctggggcctaaattcttccccatcccttttactttgggctctggtcccccttcctggttccctgacccatccccagcctcccttaaaactctctccccaccccgaatctggggacacccctgccctctccacctgcagatcgatgacagcgttgccagccttgttatcgcacagctcctcttcctgcaatccgagagcaacaagaagcccatccacatgtacatcaacagccctggtgagcagggtctttcctgggtgccaggggcactcgtcagggcacacgggtgactcaggggaccagaatcccgggtcagggatgttctctctctgggaaagggtgcagagcgtcagagttccagaagtggctttaaaccaccaaaaggtgcctgttgctggcttttgagcctcggttcacaagtcaggatgtggcctctttgatcctgcacatactgttctgccaacctgacccggctgacatttaaaaattggtagattttaggccgggcacagtggctcacaccggtaatcccaacactttgggaggctgaggcgggcggattgctcgagctcaggagttcaagaccagcctgggtaacgtagtgagaccccatctctacaaaaaaagtacaaagattagccgggcaatgtggcgtgtgcctgtagtcccagcaactcggaaggctgagggagaaggatcacttgagcccaggaggtcgaggctgtagtgagcccatctcaaaaataatcataattggtagattttttccccctccccaaaaaaagtagtcaattttgattgagcacttatgatggaggcatttttttttttttttattgagatggagtctcgttctgtcacccaggctggagtgcagtgttgcaatctcagctcactgcaacctctgcctccttgggttcaagcgattctccagcttcagcctctcaagtagctggggattacaggcatgtgccaccatgcctgtctaattttttgtatttcgtagagatgatgtttcaccatgttaggctggtcttgaactcctgacctcaagtgatccacccgcctcagcctcccaaagtgctgggattacaggcatgagccaccacgcctggcctgatttctagtttctcttggaaatttagtagatctgatcccatggtccactggcacatctggcaagagtcagctgactgtaaagcaagcgctctgccttttgcctgcacctgggccgtgtcacttgtttttgtcacctcccaacccctggaagcatttgtgtttgtgaaccctgctttaaagagctgcttctagaccggacgcagtggcttacgcttgtcattccagcactttgggaggctgaagtgggctgatcacttgaggtcaggagtttgagagcagcctggccaacgtggtgaaatcccatctctactaaaaatacaaaaattagccgggcatggtggtgtacttgtaatccagctactcgggaggctgaggcaggagaattgcataaacccgggaggtggaggttgcagtgagctgagatcgcgctactgcactccagcctacgtgacagtgagactcagtctcaaaaaaaaaaaaatagctgcttctggctgggcatggtggctcacacgtgtaatcccaacactttgggaggattgcttgagcccaggagttcgagatcagcctgggcaacatagtgaaagcagtgaaacccagtcttaattttttttttttttttttgagatggagtctcgttctgtcgcccaggctggagtgcggtggcgctatctcggctcactgcaacctccgcctcccgggttcacgccattctgctgcctcagcctccggaatagctgggactacaggcacccgccaccacgcccggctaattttttgtatatttagtagagacggggtttcactgtgttagccaggatggtcttgatttcctgaccttgtgatccgcctgcctcagcctcccaaagtgctgggattgcaggcatgagccacagcgcccagtcatattaatttttaaaaaaggaggggggctgcatctgttccaccctccccaggtttaggagatggaatagggaaagggtcggggggagctggtccagcccctcacttgctcccccgcccacaggtggtgtggtgaccgcgggcctggccatctacgacacgatgcagtacatcctcaacccgatctgcacctggtgcgtgggccaggccgccagcatgggctccctgcttctcgccgccggcaccccaggcatgcgccactcgctccccaactcccgtatcatgatccaccagccctcaggaggcgcccgggtgagtgccagacacgcgagctgctgttgggaatcaggacagggtctagacagaaggactgactgggcggaagtcaagcgtgggaggggatgtttttttttttttttgagatggagtctcactttgtcgcccaggctggagtgcagtggtgcgatctcggctcactgcaagctccgcctcctgggttcacgccattcttctgcctgagcctcctgagtagctgggactacaggcgcccgccaccacgctcggctttttgtatttttagtggagacggggtttcaccatgttagccaggatggtctcgatctcctgacctcgtgatccgcccacattggcctcccaaagtgctggaattacaggcgtgagccaccgcgctgggccagccgggagtggatgtcttaaaatgtgcaggccaggctgggtgtggtggctcacgcctgtaatcctagcacttcgggagacagaggcgggaggatcacgtgagctcaggagttcgaggccagccaggggaacataatgagaccttgtctctattaaagaaaaaaaaaaaaaaggccaggcatggtggctcacgcctgtaaatcttgacactttgggaagctggagcaggtggatcatttgaggtcaggaattctaaaccagcctggccaacatgatgaaaccccgtctctactaaaaatacaaaaattagctgggcatggtggtgcgtgcccataatcccagctgttttgggaggctgagataggagaatcacttgaacccaggaggtggaagtgagctgagattgcgccactgcactcaagcctggatgacagagcaagactctgtctcaaaacaacaaagggaaaaaaagaaaatgcactgaggagttgtttgctgtctcttgagaattagcttcagctgggcacagtggctcacatctgtaatcccagcactttgggaggccaaggcaggaggatcacttgaggccaagagtttaagaccagcctgggcaatggtgagaccccatctctaccaaatatttaaaatgactcgggcatggttatgcttgcctctggtcccagctactcaggaggctgaggtgggaggattgcttgagcctgtgaggtgaaggctgcaatgagctgtcttgtaccactgcattccagccccagcaacagaggaagaccctgtctcaaaaaaaaaaaaaggcggccaggcatggtggctcatgcctgtaatcccagcactttgggaggccgagacaggaggatcacttgaggccgggagtttgagaccagtctgggcaacatagcaagaccccatctctaaaaaaaaaaaacaaaaaacaaacaaaaaaaaggcttagctaatgctgagacagagagacactgttcctcccagtctgcaaggcttcagatgcagaaaataacatatacttaatccagtcagaaagccttcctggtagtggcaagactgaagcaggatatcgggggatttacacaaccccagcccaccagcctcaaaccggaagcccaaagcccagggaagctcctgagtgccacctccagcctccctgtgaggggctgacgccgataccaacctttaccccctcactcccttggacgtccctcagggccaagccacagacattgccatccaggcagaggagatcatgaagctcaagaagcagctctataacatctacgccaagcacaccaaacagagcctgcaggtgatcggtaagcaccctcctttatttcatcctggtccgtgcacagacggaccaggcgttgctctaagccagggcttctccacctggcccctgcggactttcagggctggatcgttctctgggatggggggaccatcccagaggtcagcctggccaacatggtgaaatcccatctctactaaaaatactaaaaatggtgtacttgtaatccagttactcgggaggctgaggcaggagaatctgtggaatatgagagtttgaggttacagtgagctaatttttttgtttgtttgtttttttgagacaaggtctggctctgtcgctcaggctggaatgcagtggcatgatctcggctcattgcaacctctgcctcctgggctcaagcaattctcctgcctcagcctcctcagtagctgggactacagggatgcaccaccatgcctggctaattttttgtagagacgtggtttcaccatgttgcccaggctggtctcaaactcgtgagctcaagtgatccagctgcctcagcctcccaaagttctgggattacaagtgtgagccaccacgcccagccataattttattaaaatcaaaaagtgaggccaggtgtggtggctcacacctgtaatcccagcactttgggaggctgaagtgggaggatcacttgagttcaggagttcaagaccagcctgggcaatatagtgaaaccccatttcatagaaaagaaaaaaaaattttagctgggcaccatggctcacgcctgtagtaccagcactttgggaggccgaggtgggcggatcacgaggtcaggagttcaagaccagcctgaccaacatggtgaaaccccgtctctaccaaaaatacaaaaactagccaggtgtgttggcacacgcctgtaatcccagctactgaggaggctgaggcatgagaatcgcttgaacctgagaggcggaggttgtagtgagtcgagattgcaccactgcactccagcctgggtgacaaagtgagaccctgtctcaaaaaaaaaaaaaaaaaaaaagtgaatgttccacagcatcacagatgaattttgcaaatatgttgcatgaaagaagaataaacactctgtgattccatttatttaaactataaaaacaaggagagctaatttatgctgttagaggagtggttgctttggggtatggggagggggtggcaaggattagtgactgtcgtgggcccaagtggggtttcaggggtgctggcattattccatctcttggtctgggtgctggtcctgtagggtatgttcagtctgaaaatccatcccaccagacatttacgaatcatgccctttcctgggtgtatattatacatcaataacaatttttttttttttttgagatggagtcttgctttgttgcccaggctggagtgcagtggtgcagtctccacctcccagatttaagtgattctcatacctcagcctccctagtagctgggattacaggcgtgtgccaccacacctggctcatttttgtatttttagtagagacagggtttcaccatgttggccatggtgaaactttgaaggccaatggtgaaacatgaggccaaactcctggcctcaagtggtccacccacctctgcctcccaaagtgctgggattacaagtgtgagccaccgtgcctggcccaataacaattttttaaaaaacaaaattgaaattggtattttactgatacctaggggaaactgaggcactgcagaatgaggacatgtctcagtcagcttgagctgcttaacaaaacaccacagacctcaacagagatttatgtctcacagttctgggggctgggaagtccaaggtcagggtgccagctgattcggttcttggtgagtgctctcttcctggcttgcagacggccgccttctcgctgtgtcttcacatggtggagagagagcaagtgcactggtgtctcctcttataaggccactaatcccatcaaggggcccctgaccccatctctcctaatgacttcccaaggaccccatctccaaatcccatcccactaggggatggggcttcaacatatgaacttggggtggtgggcacaaacattcaggccaaaacaggacccagacctggccctgggtctctgctcttaccctaatgtgtctcacctcctgcttccccaccagagtccgccatggagagggaccgctacatgagccccatggaggcccaggagtttggcatcttagacaaggttctggtccaccctccccaggacggtgaggatgagcccacgctggtgcagaaggagcctgtagaagcagcgccggcagcagaacctgtcccagctagcacctgagagctgggcctcctctccagaatcatgtggaggggccagaggcctgccagacccccagctgggccctgctcaccccttgttgctgggcttggaggggcctcttgaggaacttttaatttgcaggggtgcccgctatggacggggcattccagctgagacactgtgattttaaattaaatctttgtggtctttgc

SEQ ID NO: 36262 - DNA, 169659 bp, Homo sapiens
gggctccctggaagccagggttgggcttggccagctggcatgggtgctagggtccctgcccactgggcaccctactcgtggtaacccacagagaagaactttgactggccggcagcctgcattgcgctggagcagcacctgtcccgctgggcagaggatgggcgctgggtcgaatacttctgcctggccgaaggccacgtggcttccgttgactcagtgctgctgctccaggtgagacggggtctgtggggggccaggcagggtgggccagggtggccctgacaacatcaccttgctccctttccagggtgggtcactctgtctgtcgggctcccgagatcgcaacgtcaacttgtgggacctgcggcagctggggacggagtccaaccaggttctgatcaagaccttaggcactaagcgaaatagtacccatgaggtgaggagtcaggtggggataggaggtatgaggcctgagtagggcatcttggttaaggccccaggttttggtacaggaccgcatagatttgaatctgacttttctaaccttggtgtgactttgagtgagatgtgtgacttctctgtgcctcagtttctacttctgtccagtgggtgattaggatgaggatgaaggagatgcattatgcattaatgtggacatgcattaagctcaggctttttttttttttttttttgagacggagtctcgttctgtcacccaggctggagtgtggcatgatctcagctcactgcaacctctgcttcccgggttcaagcggttctcctgcctcagcctcctgagtagctgggactacaggtgcatgccaccacacctgtctaattttttttttttttttttgagatggagtctcactctgttgctaggctggagtgtagtgatgcaatctcggctcactgcaacctctgcctcccaggtttaagcaattctcctgcctcagcctcctgagtagctaggaccaccatgcccagctaatttttttatttttggtagagacagggtttcaccatgttggtcaggatggtctcgatctccagacctcgtggtctgcccgcctcagcctcccaaagtgctgggattacaggcatgagtcacctggcctttatttatttatatttttattgagacagagtctccctctgtcacccaggctggaatgcaatggcatgatctcggcccactgcaacctctgcctccgggattcaagtgattctcctgtctcagcctcccaagtaactgggattacaggtgcctgccaccatgcccagctaattttttttttttaatggaatctcactctgttgctcaggctatagtgcagtggcacaatctcagctcactgcaaccttgcctcctgagtagctggaattataggcatgtgccaccatgcccagctaatttcttttgtgtgtgtgtgtgtgtgtgtgtgtgtgtgtgtgtgtgtgtgtgtgtatatatatatatatatatatatatatatatatttttttttttttttttttttttttttttcctttagtagagacgaggtttcgccatgttggccaggctggtctcaaactcctggcctcaagtgatctgcctgactcagccttccaaaatgctaggattacaggcatgagccacggtgcccagccaagctcaggctttgacacacagtaggtgctcaatagacgtcaggtacaccttgagaggcccagtgtaaagcagttatgagactacccttggagatcagccaactctgagcatgactgtcatctcgtgagaggtggctgtggaggagcatctccaccagtcgctaaggtggtcaggccggtagctgagagcttgggcttggggccaggatgctgggttcaaattctcactgtgctgcttcctggctgtgtgaccttgagtgagaaactcaacctctctggggcccagtttccccatttgtaaaatgagatacacaatattgccctcctcagcgggattggtgggcaaaaagtcagcattcagcaccctgtgcatattagctcctgaggcaagggatgttttctgcccaatttgctgatgaatgaactgagggaggtgatatggtttgccaggtcacaaagtagaggccacactcttaatcacttgtcatgtggcttcaaaccaccactggtgctgagttcttgcagaacttgacttagaaatgttattgggccagggtgcagttagttgctcaggcctgtaatcctaacactttgggaggccgaggcaggaggattgcttgaacccaggagttcgagaccagcctgggcaacatgggagaccctgactctacaaaaaataccaaataattagccaggcgtggtgcgtgggcacctgtagtcccagcgactcgggaggccgaggcaggagaatggcatgaacccgggaggcggagcttgcagtgagccgagatcatgccactgcactccagcctgggcgacagagcgatactatgtctcaaaaaaaaaaaaaagaccggatgcagtggctcacgcctgtaatcccagcactttgggaggctaaggcaggcggatcatctgaggtcaggagttcgagaccagcctgaccaacatggagaaaccccggctctactaaaaatacaaaattagctggcgcggtggcacatgcctgtaatcccagctactagggaggctgaggcaggagaattgcttgaactcgggaggcggaggttgtggtgagccgagatcgtatcattgcactccagcctgggcaacaggagcaaaactccatctcaaaaaaaaaaaaaaaaaattagcagagtgtagtggcatgcacctgtagtcccagctctttgggaagctgtggtacaaggattgcttgagcctgggatgtggaggctgcaataagccatgatcgcaccactgcattcatgcctggatgacacagcaagaccttgtctcaaaaaaaaaaaaagagttcctgggccaggcacagtggcacatgcctgtaatcccagcactttgggaggctgaagcgggcggatcacctaaggtcaggagtttgagaccagcgtggccaacatggtgaaaccccgtctctactaataatacaaaaattagccgggcgtggtggcacaagcgtgtaatcccagctactagagaggctgaggcaggagaatcacttgaacacgggaggcagaggttgcagtgagccaagatcaagccactgcactccagcctggatgacaaaagtgaaactccgtctccaaaaaaaaaaagtttctgggtggggtgtgcctttcctggactctgaagtcaggctgacccatggacacaaactttaatctgtactcaacttgaacttgctctggtttcatctatgcaatgggggtgatcacctggagccagagttgggtgttgtacttgctgcagcatctatcaccatgggcactggggaggaagagctatgtggctttgggtgagtctcttgacctctctgagccttacctgcaaaaacagaacgatcccagtctgggacccccatgggctgtggcaggtgtgtgactgctgctcctgtcctgcagggctgggtgtggtcactggcagcgcaggaccaccgcgtgtgctccggctcctgggacagcacagtgaagctctgggacatggcagcggatgggcagcagttcggcgagataaagtgtgtgggggcctgggcagggggcctgcggggataggaccctgtctggccacagccaaagccctgtggtctgtgtgtccctagggccagctcagccgtgctgtgcctctcctacctgcctgacatcctggtgactggcacctatgacaagaaggtgaccatctacgaccccagaggtgggccaagggtcctggggcccaggttgggagatgtcatgttagggaaggagacactggggcttcacagcctggctggggtcatagtcacttaaccaaatactcaccactcagagtggccatgctgtgctggtacaatacaggcaacttgggcagcgggtgaaggtgaagcttgggcagccctgggggcgggttagagttctggctgtcccactgcctagctgtgtgacctccagacaagcttgaacctcggtttccccatctttgaaatccagataataataccacagcagccccatggggttaatgggggaagatgataataggaacagtggtggattaactacgtttttttatgctggatgtggtggcgcctacctgtagtcccagctactccagaggctgaggcagtagagacaaggtttcaccatgttggccaggctggtcatgaactcctgacctcaggtgatccacccacctcagcttcccaaagtgcagggattacagatgtgagccaccgcgcccggccatttttcttttttttaaatggagaacggggtcttgccacgttgcccaaggtgatcttgaactcctgggctcggatgatctgcccatatcagcctcccaaaattctgagattacaggtgtgagccactgtgcctggcctatttattcattctacttttgttaattgaagggccagtgtaccttgtccaggcagagctggagcggggctgcgggataggcatgtttcaggccaacctgagggtggatgcaagactgagaccaccttggtcagctctgtgctaagaacagtagatgggatcggaggagggatatgggatgtggacggggatgggcagaggcctggggctcctgtggaagcctggatttacctgaggcgggagaggagagatgggtcactctgtggggtgggggaatgagcagatcgagggttttgccagacaggatggagacccgggatgctctcatgggctggggggggccttcgaggggctctgatatccctcctcaccggcccatcacccatgaagccggcccagccctgttgaagcaccagcaactacactccagacccgtgctgaccctgctggcggatgaccggcacatcatctcaggcagcgaggaccacaccctggtggtggtggaccgccgagccaacagcgtcctgcagcgtctgcaggtgggccctccccaggggcctggagggatggggactgttgcaggcccagcccggcctgagctgtcccgtcccttgtccctctcgtagctggactcctacctgctctgcatgtcctaccaggaaccccagctctgggctggtgacaaccagggcctgctgcacgtcttcgccaaccgcaacggctgcttccagcttatccgggtctgctggagctcctgcccctgactgtccctccccccgggcttccttcctacccgagcccctggtggtgtgggggagggcgggccttgggagagcctcgactgagtgttgcctgatcctcctcctgcagtcctttgatgtgggccacagctttcccatcactgggatccagtactccgtgggagccttgtacaccacatccactgacaagaccatccgggtgaggctcctgcccagcccccaccccaggacagtccctgcctctcccctacctccatcagccaggggcacacctcttgacctcgcccattgcccctcactaggtgcacgtgcccacagacccaccaaggaccatttgcacccgaaggcatgacaatgggctcaatagggtaaggtcctgccccatgtgccctgcccagctggccagagcgccatcgtccctgactcctcatgttcctcccccttcccaggtctgtgctgagggcaacctggtggtggccggctctggagacctgtcgctagaggtctggaggctgcaggcctgagcaggtgggcgtggatgtggatactgcctgccggaggctgggcttcctcctctgttcttgggggaccatccccaatgttggtgctgcctccgccccgtgggcctagggcacaaggagtcccagccacattcgggtgagcgtcctggcctgggccctatgcccgggggaagggtgaaattggggttcaggcccacccagggggccgcttcccactcttgggccctggttttgttatgatttggatgccccgctctcagttgagagcgaaggagaaataaacctgacatgttggtgcttgggcctggagtgtgagtgtggtttgcctgctggggttctgcctgtgcctgcttggggctgtggggctgcgggcctgcatgggagtgactgggagagatagcaagtctgggctgggggtgcatgtcagctgttgctgtgcatttgaagagggagagtcctgaggatcgtgggcatctgtgtctatgatgtcacgtgtgtgtgtgatgtgtgacgcgtgtggtgtatagattatgactcaaatcctggccatttgtctgcacggtgggaaagggtacctgctcaggctatcccatgggtgctggcgagggcaagagggatggcgtgctctccgtctggggctccagggtgtgtgtgtgctgctgtggctgtgaccccgggggcaggcagggagggaggctgggccaggtacgcacctggcccctgcaagcccaaagtccctctggtctcccatctcagcccagctcagccatgccctgagaagtattcacttcatgtttattgaggccccctggtttgcccaggccacagggtggcattgccctgggttcataggatggcatagggcttcttctccttgaaggagttggtggcggccgggatgcccacaaggaaggggtcattcttggcctgctccgtgcagaacttcagcagatcggcggccatctttggacacctgcagaccaactggttcagccagaccagacccaggcatgcacctgtcccctggcccatgtgttcccacctcttcccgcctcctgcactggccccgaccctcaccttcacttggtcgatgcctgcctccatctggagctgctccactgcccagagggcctgcccaatgtcactgttgatggccaccttgctggacatctgggtaaagtgggcaggccgtgggcagcaggcccaacctcagtcccctagggggagcctagggctgcccgagggttcccacacctccttctatgttccttgggggctgcaggatgagggtggctgctcctggacccatcaggcccacacacctcggctaagggctccggcccaagtcacctctggctgcctggtcctctggtggccaccctgctgtggctccctccccaacccagcctgtcctcttcaacccccttttctccctcggctacccctgcaaagactttgaagccagggctctcatggagtgaaatgtcaccagctgcagcagcagctgctgcctcggctgagggggtccctgccccaggaggccctgtggctcctctggtgtcatgtgtcacctgggtccctgtgggctaggtgccttggctgggggagtgaggaggccctggcctccccctggcctgctggatctcctgctaactgttcccaacacatctgctttgtcagcctctgccatctccaacatgcagccttgcctctcctcctgttgtcgccactgctcaggctcaaatctccaatgccttcgttcttttttttttttttttttttttttttgagagagagtcttgctctatcacccatgttggagtgcagtggtgcgatctcagctcactttcaacctccacctcccgggctcaagtgattctcctgcctcagcctcctgagtagctgggattacaggcgtatgctaccacacccggctaattttttttttttttttttttttgagatggtatttcgctcttgttgcccaggctagagtgcaatagcgtgatttcggctcactgcaacctccgccttctgggttcaagcgattcttctgcctcagcctctcgagtagctgggattacaggcatgtgccaccatgctcggctaattttttgtatttttagtagagatgaggtttcaccatgttggtcaggctggtcttgaactcctgatctcaggtgatccacttgcctcagcctcccaaagtgctgggattacaggcatgagccactgcgcccggccacacctggctaatttttgtatttttagtagagaaggggtttcaccatgttggccaggctggtctcgaactcctgacctcaagtgatccacctgcttcggcctcccaaagtgctgggattacaggtgtgagccatcgtgcctggccttcttttctttttttaagcccaggttctcgctctgtcgtccaggctggagtgcagtggtacaatcatagctcactgtaacttcaaactcctgggctcaagtgatcctctcaactcagcctcctgattagctagaattataggcgtgagccaccgtgccctgctaatttatgtttttaactttttgtagagatggttcttactatgttgcccaggctggtcttgaactcctggcctcaaacgatcctcttgccttggccttccaaaggaattataggcataagccactgagccctgccccgagattctaatatgtgcccagcactgtgcaaaaacccaaattagcaatgaaacaagacaaaaccttgccctcatggagctgcctttctagttaggcagggatggacaacagaaaatgtactcagtgaaagagtatacatgtgaaagggcatatgaaagaagaataaaatcaaagtaaaggggagaggagtggtcagggcaggcctctcagaggaggtgacatttgaacttaggcccaaaggaggagaaggaactgagaaatggggtgttctaggcagaaggagcggcaagtacctgactccttggacaaaaaagagcttggtgggttccaggaatagcaaagaggtctgtgtagctggagaggagagagggagggagggccagcatggtgggagatggcagcagggaggttgagaggtgccctttaaggccactgtgaaaagcttggattttactcccagggggaagctaccattaggaggttttaacagtgacatgtttgatttatggttaaagagctgtggcatgcacctgtagtcccagctactggggaggctgaagtgggaggatcacttgaggccaggaggtcgaagctgcagtgaggtgtgattgtcccactgcactccagccctggtgacagagtgagaccctgcatcaaaaaaaaaagctcagcggctgggcacggtggctcatgcctgtaatcccagcactttgggaggctgaggtgggcggatcacgaggtcaggagatcaagaccatcctggctaacatggtgaaaccccgtctctactaaaaatacaaaaaattagctgggcgtgtggcgggcgcctgtagtcccagctacttgggaggctgaggcaggagactggcgtgaacccgggaggtggagcttgtagtgagccgaaatcacaccactacactccagcctgggcgacagagcaagactccgtctcaaaaaaaaaaaaaaaaaaaaaaaagctctctgattttagctgttaggtgggagatgggttggaggataccaaagccagcttgcaggctatggggataaagaaaacacctggatttcggacctactttataggtagaggttggcagacatgctgagaaggatggatgtggggtgtgagaaaaggggagacagcaagctgcgctcctcatttttaatttttatttatctatttttgagacggagtttcgctctgttgcccaggctggagtgcagtggcaccatctcagctcactgcaacctccacctcccgggttcaagtgattctcctgcctcagcctcctgagtagctgggattatgggtgtgcgccaccacacccggctaatttttgtattttttagtagagacggggtttcgccatgttgtccaggctggtctctaactcctaacctcaggtgatctgccctccttggcatcccaaagtgctgggattacaggtgtgagccaccgcgcccagccccaatccctatttttcagtctagtggatgagtggagggtggggccgtttgctgagatgcagaaagatcagggataggtggagagggagctgagggggcaactttgaggtccaagcgaggatgtcaaggaggatgtctgtctcctccaacaaggtaggctcattccagcctcacggcttttgctgttctgtcttcccatgtgcaggaaatggcctctctgcatcttcacatacggggattttctcagccttctggctttggctcaaatctcacctccttggcgtccttcacccatccctccaactaaaatcccgaactcctccacctaaagactcaaattatcctgtttaaatcctgattgcgctgggcgcggtggctcacacctgtaatcccagcactttgggaggccgaggcaggcagatcacctgaggtcaggagttcgagactagcctgaccaacatagtgaaaccccatctctactaaaaatacaagaattagccgggcgtgatggctcatgcctgtaatcccagctactcgggaggctgaggcaggagaattgcttgaaactgggaggcagaggttgcgatgagtggagatcgcgccattgcactccagcctgggcaacaagagcgaaactctgtctccaaaaaaaacaaaaaacaaaaaaggcctgatagcactcaccactattgttaactttctatcttcccaatcagattgtgggctccagtagggcagggtccacatcttggtcttgttcaccactaaatccttagtgcctagcacggagcccaccatagagaatagactacatgaattgtagagtgagtgaataatcctgttggccgtatgcactgttaggagggtgtgtttgagatacagatgacacccagggtctcacattcttgcaggagggaaagagacgtcagccctgggtcccagaagaggccactgacccagtgggagttcagggaaggcttcccagaggaggtggaggtgacagctgcagctataagggaaggaagaacagagcgttatgcagcatgtgaaggctttggagacttgtgagggcacgaaccgggctcactatcccattagacaaaagtggctgaggaaggatgaaactgtgtctaactctgcctggtgaccgaaatcttgtccatgggtgacgcttaagaagtgaccctcggccgggcgcagtggctcacgcctgtaatcctggcactttgggaggccaaggcgggcgggtcacgagttcaggagatcgagaccatcctggctaacacggtgaaaccccatctctactaaaaacagaaaaaattagccgggtgtggtggcgggcacctgtagtcccagttactcgggaggctgaggcaggagaatggcatgaacctgggaggcagagcttgcagtgagccgagattgcgccactgcactccagcctgggcgacagagcgagactctgtctcaaaaaaaaaaaaaaaaaaaaaagtgaccctcataaaaaaattagctgggcacgatggtgcacactagtcggaatgctggggtgggaggatgacctgagtccgggagtcagaggttgcagtgggccgagatcgcgtcacagcactccagcctggcgacagagtgagaccctatcaaaaaatagcagcaggccaggcgcggtggctcatgcctgtaatcccagcactttgggaggctgaggcgggcggatcacgaggtcaggagatcgagactaccctggctaacacggtgaaaccccgtctctactaaaaatacaaaatattagccgggcgtggtggccggcgcctgtagtcccagttactggggaggctgaggcagaagaatggcgtgaacctgggaggcggaggttgcagtgagccgagatcgtgccactgcactccagcctgggagacagcgcaagactctagctcaaacaaacaaacaaacaaaacagcaacaacaacaacaaaaccatcctcccctcccgaggggacagaacagaaacgaatgggcgagtgccgggccaagcagtgggtctccagcaggtggcattaaaataggaattttggctggggacggtggctcacacctgtaatctcagcactttggaaagcccaggcgggcggtcacctgagggcagaaccagcctcgccaacatggtgaaatgccatctctactaaaaataaaaaattagccaggcctggtggtgggtgtctgtaatcccagcaactcgggaggctgaggcaggagaatcgcttgaaccaggggggcagaggttgcaatgagtcaagattgcaccaccgcactccagcctgcgtaacaagagcgtgtaactcttgtctcaaaaataaattaaataaataaataataaaaataaaaaagaatcttcattcatgggaagtcgagaacacatgaaaacaagtaaaggccgaagcgcagtggctcacgcctgtaatcccagcactttgggaggctgaggcgggcggataacctgaggtcggaagttcgagaccagcctgaccaacagggagaaaccccgcctctactaaaaatacaaaattagccgggcatggcggtgcatgccagtagtcccagctactcgggaggctgaggcaggagaatcgcttgaacccggaatgtggaggttgtggtgagctgagatcgggcaattgcactccagcctgggcaacaagagcgaaaccctgtatcaaaaaaaaaaaaaagaaaaaaaaaggaagaaaaggcctaaaggcgccgggcgcggtgggtcacgcctgtaatcccagcactttgggaggccgaggcgggcgaatcacgaggtcaggagatcgagaccaggtgaaaccccgtctctactaaaaatacaaaaaaattagccgggcgtggtggtgggcgcctgtagtcccagctactcgggaggctgaggcaggagaacagcgtgaacccggaaagcggagctggcagtgagctgagatcgcgccactgcactccagcctgggtgacagagcgagactccgtctcaaaaaaaaaaaaaaaaaaaaaaagaaagaaagggcctaaaggctcctcgcggcttccgtattacggaacacacgcacaaaaatggcggcgacctggtttacaggggctaaaaatggtcacgtgataaaccaacttccggtctttcgcccaaagcacgttccctacttcctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatggtgaggaccgggcggaatttctagggacgcggaggggcgtggcttgtagaaccaacgcggtactagacgggggcagcgtttccagtggaggggatatgtcttttatttgagttgcccaatagttggaggaaggcgggacctattctgggcgggagtttctgtcctgggaaggggattttgcactctggtagttacatgctggtacggtaacctgaggaggcgaggactgattcttggtgtgggggcgggttctaggtacatttaaagctttctggaatgggcggagcctggggcaagacaaattaagggaggatatgggaggaggagcctaagtctgggcggttcttgaatttagatttgcttttcccagcggggaagggaccggatctgaaaggagatgctctctgattcctaaaagggtgggggctggctgggcgcggtggcgcatgcctataatcccagcattttgggaagccgaggcgggtggatcaagagaagaggagttcgagacaagcctggccaacatggtgaaaccctgtctctactaaaatgcaaaaaattagccgggcatggtgttgcgcgcctgtagtcccagctactcgggaggctgaggcaggagaatcgcttgaacccgcgaggtggaggttgcagtgagctgagattgcgccactgcactccagcctggtgacagagcgatactctgtctcaaaaaaaaaaaaaaaaaaaggccgggcacggtggctcatgcctgtaatctcagcattttgggaggccgaggcgggcggatcacctgaggtcgggagttcgagaccagcctgaccaacatggagaaaccccgtctctactaaaatgcaaaaaattagccgggcatggtggtgcgcgcctgtagtcccagctactcgggaggctgaggcaggagaatcgcttgaacccgggaggtggagcttgcagtgagccgagatcgcgccattgcactctagcctgggtaacaagagtgaaactccgtccaaaaaaaaaaaaaaaagggtgggggcaaatcctgaacgtgtgtcttgagatctggtctgggaaggggcagagtttacacaggagatgttccttggtcccctgtagaactggtcctgtatccctgaatgtgcagggcctggggtgaaatctgtttctggagcccacctggagtcctgagtctgggatttaaggccagtgcttaacttgacttggcccttactcacagatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggggacctggtgaggccgtggccttggcctctgggtcaatgggcaatgcagttattgatcgtttaagtgagatgggcagataggggtctgttataagcagaggaatagaatcaagttttgttttgtagcagagctccctcataagagtcactggacaaggatgaggttagaagttctgcccagaatgagggcaggggcttccttcttgggccaaattcactgccttgtggctgcaggtggacgtattggtgaccacagctggcggcgtggaggaagacctcatcaagtgcctggcgcccacatacttgggcgagtttagcctcagggggaaggagctccgggagaacgggatcaataggtgagaaccctgagtggtgttgggcaggggagctggaccaagggtcctggggcctgatgcctacatgcctcctgttctcaggatcggaaacctgctggtgcccaatgagaattactgcaagtttgaggactggctgatgcccattctggaccagatggtgatggagcagaacacagaggtggggctggggcaacctggaggggccagttcagtgggagtcaggggaggcatggcctgaaggtcacatcctctcctagggtgtaaagtggacgccttctaagatgatcgcccggctgggcaaggagatcaacaacccagagtccgtgtattactgggcccagaaggtgaggacctaagcgggagcaaagtagccagactttggcatgtgttaacttatttcatctttccagcctcctggggattcagtactgttattctcagcatcctcactcttagatgaggagactcaaacacagataggcgtggtaattttttttttttttgagacaggatcttgctctgtcacctaggctggagtgcagtggtgtgatcacagctcattgcagcctcaacctcctggggccaagcagtcctcccacctcagcctctcgagtagctgggaccacaggcacatgccatcatgcccagctaattttaaaaattttttgtagagatgggggtctccctgtgtttcccaggctggtcttgaactcctggcgtcaggcagtcctcccaccttggcctcccaaagtgctgggattacaggcgtgagccactgtgcccagccaggctaggtaattttgtctgaagtcacacagataactagtggggcctcagcatccttatgctcctcccagactatctctggaacagtagaggcaacacttagcaactctcctggggcctggctcagggtcccacactcccagatgctataaaataagagctacccactccctttaattagagaatcagaacctgaaaaaaaaaaaaaaaaagctacatagtctttttttttttttttttttttttgagacagagtcttgctctgtcgcccaggctggagtgtaatggtgtgatttcagctcactgcaccctccacctcccaggttcaagtgattctcccgcctcaccctcctgagtagctgggactataggcacccaccatcatgcccggccaatttttgtatttttctacagatggggtttcaccatgttggccaggctggtcttgaactcctgacctcaagtgatccacccgccttggcctcccaaagtgctgggattacaggggtgagccaccacacccagcctacttactctttcttttttacgagacagggtctcattctgtttcccaggctggagtgcaatggcacaataatggctcactgctgtcttgagcttctgggctcagtcgattctcctgcctcagcctgctgagtagctgggactacaggtgcgtgccaccatgcctggctaattgtttttgtagagatgggaactcaccatgttgcacaagctggctctttttttttttttgagacggagttttgctcttgttacccaggccagagtccaatggcgcaatcttggctcacagcaacctctacctcctgggttcaagcaattctcctgcctcagcatcaagttcccaagtagctgggattataggcatgtgccaccacccctggctaattttgtatttttagtagaggcagggtttctccatgttggtcaggctggtgtcgagctcctgacctcaggtgatccacccgcctcggcctcccaaagtgctgggattacaagcgtgagccaccgcgcccggccacaagctggctctttaaaaaagaattagacggccgggcacggtggctcatgcttgtaatcccagtactttgggggctgaggcgggtggatcacctgaagtcaggagttcaagaccagcctggccaacatggtggaaccctgtctctactaaaaaaacaaaatgcaaaattagctgggcatagtggcatgcgcctgtaatcctagctactcgggaggctgaagcaggagaatcactggaacccaggaggcagaggttgcagtgagctgagatagtgccattgcactccagcctgggcaacgagtgaaactccgtctcagggaataaaaaaaaagagagagaaacagctcagcaagctaagaataggctggttctttatgtgccaggcactatactaagtgttttctgtgggttttctcatataggcctcatctgtgagaggtgtttctgttatgcttataattgaggaaacagtcctagagaaattaggcaccccatccacagtcagatagtcatatagccagcatggagacgaggctctgagctccagccactgtcctgtcatgttctctgcagaaccacatccctgtgtttagtcccgcacttacagacggctcgctgggcgacatgatcttcttccattcctacaagaacccgggcctggtcctggacatcgttgagggtgaggcgctagggccacagaggagaggggaaggagggctggctgagtccaaggcctgacttcggcgctcttcccccagacctgaggctcatcaacacacaggccatctttgccaagtgcactgggatgatcattctgggcgggggcgtggtcaagcaccacattgccaatgccaacctcatggtgagtgggggtggcgcttcggcccactctgcagacatgctgtgtggtgggcctatgccatgtgctgggtagacagcatgaactagacaggccaggatccctgctccccgggactgatgttctagtaggggagatagcaaacaagtgacatccacgtcagggggcagtcattgctacggggaatactaaatgatggcatgagaagagaaaggggtgctgtccaacaagaggttttggaaggaggcttctggaagtgtgagctgggagcaggggtttggggaggcatctcccaggagctatgtggttgtctcccgtgccaggagtttgtgctgctgtactagcattgagcttctggattgcaaagttcccaggagagggaacagccattgcaaaggctctggggcgcctgaagtaatccaggaacagctgggtacctggtgaggggaaggtggagtggtgagggccaggaggtgatgcagggaggtgccacagggagcctgctgggccctgtgggctgaggcggggctttggcttttgcactgagagaagtgggagaggacttgactcgggttcccatgctccccctggtggccatgtggtgaacagatggtggcaggtgagtgagaactccagtccaggacagtggtgaccatgcagggatcaggaggcaggcggtggttggatttggagggcttctgaagatagagttgctggcagctcctgccttgcagatggggcagggttgttgacacctggctgttgggtctggggaaacacagccatcgttgcccagcagctctagtgaccccagacattgacatgggccctgtctgggagcgaatgtctgtgaagggcttccttcatctgggacacacctctcagcctgtttggctacggtgtcctccctctgtgtctgtctcctgtgactggctgactgggcccaccgtgcccccgcctccccacagcggaacggggccgactacgctgtttacatcaacacagcccaggagtttgatggctctgactcaggtgcccgaccagacgaggctgtctcctggggcaagatccgggtggatgcacagcccgtcaaggtaagcgctggctgggtggggcatagggtctctgggacgatgagtgtgggtcccatggcttacccaggttcccccctacccaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttccatgtctgtgtctcggtccttggtcctgttggtgggtcccctggcttcagcctgctccatcctctgcctcataggcctcctctcgccagcactggacgctgcctcccatggcggtcagcaggcagggctctgttgggtggtaggccagcgactgcaccacaccggaacccacaggcagggccagagccagcgcaccctgtggagcgaggggtagggagtggttatctgtggctgggctgtaccctggtttctgaggtccctgggcaccccccatctcagtcctgcctgaagccctcagtcacctctccccgaccttcagccacctgcctctaattgcctcctagacactgcaaaattaatctacctcagactgagcccctcagtagctctgtcctaccaggtgttcaggccgcaagtcttgggagcctcttattgattttttattttttaaaatagcagagatggggtcttaccatgttgcccaggctggtctcgaactcctggcctcaagtgatcctcctgccttggcctcccaaagtgctaggactacaggtgtgagccaccatgcctggctttgggagtctttttctttttctgtttttttttgagatggagtcttgctctgtcgccaggctggagtgcagtggcgccatctgggctcactgcaacctccgactccctagttcaagcgattctcctgcctcagcctcccgagtaggtgggattacaggcacgcgctaccatgcccagctaatttttgtatttttagtacagatggggtttcaccatgttggccaggatgatctctatctcctgacctcgtgatccacccccctcggcctcccaaagtgctgggattacaggtgtgaaccaccatgcctggccgggagtctttttcttgtaccacatgttcctctatcagttattcctcttggctctgcttctagaccatgtccagagactgctgattttctgccactaccatgtttggagcatgccttgctcacagcttgcctgttccctgccaccagctgggctccatcctgtccatttggcagccccaatgatccccacttcccctggtcccaacacaatgtaaacagttcctcaagcaagccatgcttcctctttccaccttgaaaatgtcccttgatgtgcctgccctccaaggcaacttctgttctactgggcccataagaaataggtggaacattcttgctaccttagttcctaaagcaagagcttgtccgccaagtcttcagggcccccccggttccctccatcctcttatgggccttagttcccctggccaagcccagcgctgatgtctcctttgccgagattcccccggctctgaccccactacaccaggatggtctgtttctggcctgactccccaccaggctgggacatgtcaaggacagggctcagggcttgaaaccatgcacagggatgctaagatgtagctccagtttcttgaatgactgcagccctatctcacccaaggttagacatggccgtcggctcccccttgcccaggggtcagtgccagttgctcggcctggcatctgcagcccagcctgaccccggatcttgccgcacctgccgccaccctgaagcctttgtttcctgactgatgcatgcgcaggctacacctcttaacatatgctgttccctttgcctggaatgcccttcctgcctcatcttctctctagcccaagctgggcacggtgtctcaggcctgtaatcccagcactttgggaggccgaggcgggtgaatcacttgaggtcaggagtttgagaccagcctggccaacatggtgaaaccctgtctctactaaaaatacaaaaattagccaggtatggtggtaggggcctgtaatcccagctactcaggaggctgagacatgagaatcacctgaaccctggggggaagaggttgcagtgagctgagatggcgccactgcatttgcctgggcaatagtctcaaaaaaagaaaaaagggccgggtgtggtggcttacgcctgtaatcctagcacttgggaaggctgaggtgggtggatcatgaggtcaggagtttaagaccagcctgaccaacatagtgaaaccctgtctctactaaaaatacaaaaattagctgggtgtggtggcacgcacctataatcccaactactcaggagactgaggcaggagaatcgcttgaacttgggaggcggagtttacagtgagccaagattgcgccactgcactctagcctgggcgacagagcaagacttgtctcaaaaaaaaaaaaaaaaaaaaaaaaaagatcctagccttcaggccctggagtgactgaggtaaggacagggctgagatggggcaggcatctaggtatgaagtagggctgggggcacctcacctccaccaggtcccagaagaacaccttcccgtcctcagaacagctgaccacatgtgtgtcacgctcgctcaggcagcagtccagcttgtattcctggttcttatggcccttgtacctaagggtggacaggatcggggggcttggtcctctccaggggtgggagaggagggaaggggatccccacgaccacaaggactcactcgcccagcagctcccctgtgtctttgtccaggagccgcaatgtggagtccaggctggacaccagggtgcactgcccatcccggctgaagcaggtgcaggtgatggggccttgggggaagggtgggtaggtgagtgagggtggggtgcccctggttggccccccatcttccctgcctgtcccacatccccagccacactcactgcccacgtagtctgagaagagctgccccatccttaggtcatagcgtctcacgcggccatccacggagctgcaggagagggtagatccagcgggaaccttgactacactcacatggctccaggcagccctgtgccttcccagcccagtgggcctgctcttccagtgcacaggagtggaattctgaagctctggccttgagactcaggcccagggccaattacgtcctactccatcatttccaagacccacaccccctttccaagcccttggagtccttctgattcccccttttcttccttttgtttgagacagagttttgctcttgttgctcaggctggagtgcaatggcatgatcttggctcaccggaacctctgcctcccgggttcaagagattctccttcctcagcctcccgagtagatgggaatacaggcatgcaccaccacgccctgctaattttgtatttttagtagagacggggtttctccatgttggtcaggctggtctcgaactcccaacctcaggtgatccgcccacctcagcctcccaaagtgctgggattacaggtgtgagccaccccacctggcccaattcccccttttcctgcattctccagctcctcctcctcagtactcagtcccaccactttccccactacccagcaccagcatctagactgttctggtctccctgcaccccccacagccaccagagggagcacttttcaaagtacagttgacccatgaacaacacggtttgaactgaacgcgtccacttatatgtggattttcttctgcctctatcagctgtgagacaccaagatcaatccctcctcttcctcctcctctgctttctcaacacgaagatctttatgacgatctcttcacttccacttaatgaatagaaaatatattttttccaccaggcgcggtggctcacgcctgtgattccagctctttgggaggccagggcaggtggatcacgaggtcaagagatggagaccctcctggccaacatggcgaaaccccgtctctactaaaaatacaaaaattagctgggcgtggtggcacgcgactgtagtcccagctactagggaggctgaggcaggagaatcgcctgaacctagaagttagaggttgcagtgagccgagatcacgtcactgcactccagcctggcaacagagcgagactgcgtctcaaaaaaaacaaaaattcttccttatgattatttttatgtatttatttatttaatttatttacttattttgagacggagtcttgctctatcgcccaggagtgtagtggtgcgatgtcggctcacagcaagctctgcctcctgggttcactccattctcctgcctcagcctcctgagtagctgggactacaggcgcctgccactatgcccggctaattttttgtatttttagtagagacggggtttcaccgtgttagccagaatgatctcgatctcctgacctcatgatccgcctgcctctgcctcccaaagtgctgggattacaggcatgagccacagcgcccggcctatttttatttatttttagaaatcattttatctttttttttttgagatggagtctcactttgtcgcccaggctggagtgcagtggcacaatctcggctcactgcaacctccaactcccgggttcaggcgattctcctgcctccgcctcccgagtggctgggattacaggctcccgtcaccacacctggctaatttttgcatttttagtagagacggggtttcaccatgttggccaggctgatctcaacctcctgacctcaagtgatctgcccaccttggcctcccaaagtgctgggattacaggtgtgagccaccgtgcccggccagattattattattttgtagacagtctgtctttcacccagcatggagtgcaatggtgcctcgaactcttggactcaagtgatccttccacttcagcctcccaagtagctgggattacagctgtgtgccactgtgcccagctgagagtaggttttaatctgagcatgggggcagctatgattccccgtagcacctggggtgagaccaggtcctggctccactcaccctgccaggatctcgtggtctgacaccttcacactggacacgccatctctggcctcatccagcgtctgcactggctcaggcctccgtgagcggcaatcccaacagcggatactggaatcaatagagcctgtgaggccagcatgatggtgaggtcaggtttggagggggagggcagcaccctgggcccccgtgcttaggccccagactcaccggacaggataactgtggcctcttcattaaactgcaccgtgttcaccttctgagaaagttattgccactcagaggaggctggactttggaggactgggataaaggcagggttcccagtgtcggttaaagcaagggcgaaggggaggtgaaaggttttgggggaacagcaaggacaggggttggtgactgcctagcctggcatgcggagtgggggatcgtcatctggggaagggatccttacggtgtaatgggggtggccgtgtcaccacctatgcgctaatacgggtcccctccactcaaatgagggtctccaggctttcactcacccctgcgtggccccggaatttgcgcacgacctgccctgatgccacatcccacagaaccaccgccttgtccccgccgccggagcagagactactgttgtcaaaggagctggagtaaaggaggaggaggatcagcatcgacctcggatcccagcctcagcgctcccatcccagcctggtccccggctcacccggccgcatccagcacctcgtagccgtggccgctgtacgtccgcagcagcgtcccccgaagcgggttccacagcttcagcgtcttgtcactgccgcacgtcaggcagtaattgccatccactggggaacaccaggcgggggttactgggccgtcgatctcaggaggcgggaggaggacccggaatgaagacgaaggcgctcaccattaaatcgtacggctcgcactgccccctgcccgcagtccagcgtcttcaaccgtttctgcggcagctctggaggccgcggctttggctcagggaaagccatgctcccaggactccttccttgcagccttaaatcggtctgtacggaaaattccgcgccttagaaacccacgcttgggtgtaaccttattattgttcttcctgacctacttcctgtttatcacttccgggttcatcattttggcatttcggtgatcgggttggaactattgaagcccgctttcaggttcttttccccattttccctttgaaaggaagacttctggcttctcctaaatctccgttctctgggtaaggggagtccaagcctctgtcatgaggaacggaaatgcgagggcctcgggtgttactctaaaatccgccctcagcttgcacgccggaagctgcgattcctgcagcggaagaggcgtgatctggccttcgactcgctatgtccactaacaatatgtcggacccacggaggccgaacaaagtgctgaggtgaggaccccagcgtcgtgggcacgggttcgggttgtgggtgtggatcggggccctgggaagcgcctgtctatcccgggggcaggacctgagcgcccctgaccctcgagcctgtcgcaggtacaagcccccgccgagcgaatgtaacccggccttggacgacccgacgccggactacatgaacctgctgggcatgatcttcagcatgtgcggcctcatgcttaaggtgggcggggttgagcttctatgggtgtagttggacctgagaacgaggcccgggggcgggtttggaatgaagcggggtgtcttgtcattgctgatggggcgggacctgagatcggccgggagtggggctgcgatgacgctgggccgagaaagccccagtctttggtgaagtcaaggattcgagtcaggttggggatgtggcagattggtctgcgagtggggccaggctttgaagcaacttggagaggagttgtggaaaaagggcagggtcttaagcatgtgggatgtcagagtctctcttggtcctgagagacgcaggccagacagtaggactagaaaccacgtatctagagtatgccatgagcaggtgggactgaggaattccgggtggggcaaggtcccagctgcatcagatggaatcagtgggcatgatctggtgtctggaaaggtggcttcggggactcattgttgtgcctttcactaacctgcccacccacttacctttccctagctgaagtggtgtgcttgggtcgctgtctactgctccttcatcagctttgccaactctcggagctcggaggacacgaagcaaatgatgagtagcttcatgtgagacttgccctacagaacaagtgactcttgagtaaggggtggggggaccccagcctggccatcctagactgacacctctctcctgtctcaggctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggacttccctgaatgaggccgtctcggtgcccccagctggatagagggaacctggccctttcctagggaacaccctaggcttacccctcctgcctcccttcccctgcctgctgctgggggagatgctgtccatgtttctaggggtattcatttgctttctcgttgaaacctgttgttaataaagtttttcactctggctgtcagcctcttctgttcagtggggtgttcctcctacctggcgggaagggctctagccccataggcctggtgtggggccccagtctggaggcttctggctgttcatttgcttacttcataaaccttgtgtcttaagtcaggtgctagggacaagacagtgacttctgccctctggcaactcaccagatggccctgctgacctagataatctaggctttggtttccttttttttttttcctttttaagaaagaaaatggtcttgatctgtcatgcaggctgagtgcagtggcacaatctatgttcactgcagcctcaaactcctgggctcaagcaatcctcccacctcagcctgccacgtaactgggaccacaaatgcgtgctaccatgcccagttaattcttgttttttttgagacagagttttgctcttgttgcccaggctggagggcaatggcatgatcttgatctcggctcactgcaacctccgcctcccaggttcaagtgattctcctgcctcagtctcccaagtagctgggattacaggcatgtgccaccatgcccagctaatttttgtatttttacattttgtgtaaaattacaaattttgtgttttcaaacccgtctctacaaaacaacccatgttgcccaggctggtctcaaactcccaggcccaagtgattcaccagcctggccctcccaaagtgctgggattgcaggcttgagccactgcgcctgccctgggctttgttttcttatcagagaatgaactggtaggaattgggaaaggcatgaaagactcggggtccttccccacttgtcagaccctcttttctctccggaacacccagggatccttctcaaccaggctggatcccatccctggtactccaggggtatttacccaacgtcccaatccccacagtataggactcttcatcagatcctcctcttaggcaagctaggtccttccaggaccctagcgctgaaggtccatgggacggacaccctggattcccatggacacactacaccggctaggaaaacccggcccccttaggaaaagcacttctgctcctaccggcattaagaggcattccgtcttggaattccggcattaagaggcattccgtcttcatagcccgtgagacgccagtgtcacctttagcccaaccagtgccctgagggtggcattttcctaccttcctgtaacgacccccgggattgcccagggctacagcctctctcccgtgagcctccagaccgcgccctggccccgccccccaccccgattggcccggccgggtctgggggcggggcgtttgcccggcctttccagggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgaggtgagtggggcctccgagctgaaacgtacaggaggcagagtgaaacccagaatacagtctagaggtgtgggtgggtctgtcctgtgggtgtctagtgaatggctgatgatatgacagtgtggtctgagtgcgtgctttgtgtcattgcgaggtctggctgtgcgcatctgagtataggactgtgtctgattgtacctgcctccgtgtctccgggatgcttgcctagactttgtctgcacttaactgtgggattggaggggcaggaggtggcagggggtgagcagtgtatgtgtggggggaggtgctggctgagagctgggactctggagtctgcctgaaattccagcctagctcttacacttcctgagtgtgtgacgttgggcaagtcacctatcctctctaagcctcagtgccttcatctggaaactggggataacatcaccccacctcccacggtggccgtctgctgtcggcaaatgctgaacaaacatcagctacttctattattattttcccggagtgtgaatgagagctgccctgtggggttgtgcaaagtggagttgtatctatgagcacaactatgtatgtgtgtgtcctgcctgggagggcctggcctcctctgcacataggcgagatcaggcctctctgagtcactcacctctagatcaagacttactctgcagcccccgacctcgggggttattgacaaggtatgtgtgtttggggtccctgtgcagacatgccccacagtgcagccgaacatgctgaacgtgcacctgctgcctcacacacatgatgacgtgggctggctcaaaaccgtggaccagtacttttatggaagtgagtagaggatggggactggtccctgggatccccatggtccctgtaatccctctgggtcctggacattagggtggggccagtgctaccctaatatccagggtttgggctcctctgtctaggaataacccccttggctctgctgttccctgagagccttatccctgttatccacagtcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccagggtgagcctaccccaaggaagtgaaaagaggaagcccagcccagcttctgcttctgcatctctggtttctgagatttgtcatgccacgtgcaagctgtataacatgcgtgtcgctccgcctgcctggactctccatttggagacctcctatacatcccacaaagccccacctgctgtgcatcctctgggaagcctgccatgcagggggcctctttcccatatctgggaactatggcctgggagcgacccctcttgtccttccgccagaaatgtgtacacaggcaggctttcacattcccagtatcacccaccctactcccactcctggctctgaccgctgaccctgaccttgcctgtcctggcacagggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcaggtgcgacccgggacctctcttgggcccacttcttcactcactctggctcctccctcgcccagtcaaaccccgccctctccctgcaatctcacaaggaccaggcccaggcctaggcctgttgaagccctgccccttgagtgagccgtaaagccagtggcttttgagctctggcctcagccggctatgcccagcccaggctgacccagctccggctggctccgccctctcccctaataggcccctcttggtgttctggccccacccactagctcgggtcctggctcctccctaaaccgggtggcaagtggatgcctaggctgccttaaaaacaggttcattacctgtgctcagaccccatccatcctcaggctgtggaagggggaacctcattcctggagtcaggcctgctctgcgctttgacagtgctggggaggtgaacctgggttctgatgttggacccgccctctccctgctagcccaaggtggtgagttctgaaacttccccaagcttggaaataagctggaggcctctctgtttcagccctacgtgtttttgtttttgttttttgagacagggtcttgctgtcatccaggctggagtgcagtggtgcaatcctaactcactatagcctcaatctcccggattcaagcgattctcctgtctcagcccccctagtagatgagactacaagagcgcaccactacgcctggctaatttttaaattttttgtagacagtctgcccgtgttgtgcaggctggtctcaaaaactcctgggtttaagtgatcctcctgttttggcctcccagaaggctgggatcataggcaagagccaccacatcgacctagcactgctttttaacctgtgctctgacctgcccctcccaagcagaggggagtttggtggtgagagggctgggcactaattcacactgccttttcctccctcatccccagatgggcttcgacggcttcttctttgggcgccttgattatcaagataagtgggtacggatgcagaagctggagatggagcaggtgtggcgggccagcaccagcctgaagcccccgaccgcggacctcttcactggtagggggcttggtgagggcagggccagccatggtgccacacactcagaagggccctgggcttgatatctgctctgttgtcactgtcctggaattcctatagtctgggaacaaaggccctgcatttccttttgcattgggacacaaattctgaagcccatcctgggtgggacatggccggctttgaaaccagggaaggtctgggtgatgggccaccccttgaacttggtgtgacctgcaggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccaggtaaccctggtgtccagaaccttcgagtccggtatatacaatacaatgagctctttccatggtacaggcatcccctaacacgttctccttatttttaatttttttgagacagtcttactctgtcacccaggctggagtgcagtggtgcgatctcggctcactgcaacctctgcctcctgggttcaaacaagcacatccagctaatttttgtatttttgcactggggtctcatcatgttgtccaggctggtctcaaactcctgagctcaagtgatctgcttgcctcggcctcccaaagtgccgggattacaggcatgagccaccgcacctggcctctatttttaacatttttatttatttattattatttttttttttttgagacagagtcttgctctgtcacccaggctggagtgcagtggcatgatctcagctcactgcaacctccgcctcccgggttcaagcgattctcctgcctcagcctcctaagaagctgggattagaggcacctgccaccacacccagctaatttttgtatttttagtagacagggtttcgtcatgttgaccaggctggtcttgacctcaggtgatctgcccgcctcaacctcccaaagtgctgggattacaggtgtgggccactgtgcctagtctatttttaacatttttattgagaattccttttttattttttttagactcactctgtcgcccaggctggagtgcagtggcacgatctcggctcactgcaacctccacctactgggtccaagcgattcttctgcctcagcctcccgagtagctgggattacaggtgcccaccaccatgctcggctaagttttatgtctttttagtagaaagggggtttcaccatattggccaggctggtctcgaactcctaaccttttgacccacagccttggcctctcaaagtgctgggattacaggcgtgagccaccgcgtccagcctttaacatttttataattaaaaaacattattttttcacagagataaggtctcaccatgtggcccaggctggtctcaaactcctgaactcaagtgatcctcctgccttggcctcccaaagtgctaggatataggtgtgagccaccatgcctggcataacacgttctccttaaaaaaatttttttttcctttctttaaaaattgatggctgggcatggtggctcacgcctataatcccagcattttgagaggccgagatgggcagatcatctgaagtcaggagttcaagaccagcatagccaaaatgacgaaaccctgtctctactaaaaatacaaaaattagtcgggtgtggtggcgcacgcctgtaatcccagctacttgggaggctaaggcaagagagtcgcttgaacctggcaggtggaggttgcagtgagccgagatcacgtcacttcactctagcttgggcagcagagtgaaactctgtctcaaaaaaaaaattgttttagattaattttttttttttttcttgagacagggtcttgctgtgtggcccaggttggtcttaaactcctagactcaagcgatcctcctgcctcagtctcctgagtagctgggattacaggtgtgagcccctgtaatcatgttctcatgccccctggaggaagatgctattctattcaccatcacaatgtccccctcctggatttatgtgcattcctcattagaagagatagcataggctgggcaagagatagcatggcatggtgactggatgccctcttctaggtagtgggtccaagagaactgctcaacaactggtggctacttttatctgtgtccccacgctcccaagtgccatacccccacccatgcctgtgcacccaacatccttgaccccatatacatcaaaacacagctatacacagggatggcccaggatcctctggcttcaggactcccctcttgcctgcagggccggtattaccgcaccaaccacactgtgatgaccatgggctcggacttccaatatgagaatgccaacatgtggttcaagaaccttgacaagctcatccggctggtaaatgcgcaggtcagtgcgcctaccctgtggtacccttgtgcacatgtgcgcttgcatccgggggccttgggttatgtgcatagctctcagtgctgtctttgttttctattgttctattgtggtcattctataacaaatgaccacacacttagcagctcaaaacaacagaaatacattgtcttacagttctgtaggtaagaagtccagcatgaggccgggcgcaatggctcatgcctgtaatcccagcatgttgggaggctgagccgggcagatcacgaggtcaggaattcgagaccagcctgaccaacatggtgaaacgctgtctctactaaaaatacagaaattagctgggtgtgatggtgcgtgcctgtaatcccagctactcgggagcctgaggcaggggaatctcttgaatccgggaggcggaggttgcagtgagcggagattgtaccactgcactccagcctgggccacagagaaagactctgtctcaaaaaaaaaaaaaaaaaaaaaaaatccagcctgagtctcaccaggctataatcaaggtgttggcaaggctgtgttccttctgcagtctctaggagagaatataatttccttgctttttccaacatctagaagttacccacattcaaaatctattcttggctccatcttcaaagccagccacatagcatctttctgaccctgtttctgtaatcacatccctttctctcattctcacctcttctgcctctctcttccacattttatttatttacttagagacggagtctcgctctgtcgcccaggctggagtgcagtggcgtgctctcggctcactgcaacctccgcctcctgggttcaagtgattcttctgtctcagcctcccaagtagctgggactacagtcgcgtgccaccacgcccagctaatttttgtatttttagtagacagggtttcaccatgttggccaggatggtctcgatttcttgacctcgtgatccaccccgctcggcctcccaaggtgctgggattacagatgtgagccactgtgtggcctaatttccctactttaagtttggctgatgaacaacctcaattccatctgcaaccttaattccccttttgccatgtaatctaatgtggtaataggttctggggatcaggacatggacacttttgggcagttatcattttacccaacacagatgtgttagtgttttgcactaagtggcctgtggctgtggctgtgtgcacagtcagtcactctcatcagcacagaaacttgtctcccctctcccatctcagacaccccttcccatcaatcttgtcctcactacggtgcaatctccattcccaccttccactcgctcccagcactgctatttcaccaaaacagctcttttatgtcatttatttttatttattttttctttttaaaattttatttatttatttatttattgagacaagagtcttgctttgtcacccaggctggagtgcagtggcatgatcttgcctcatggcaacctctgcctcctgggttctagtgattctcctgcctcagcctcccaagtagctgggactacaggcatgtgccaccaaccctggctaatttttgtatttttagtagaggcagggtttcactatgttggccaggctggtctcaaaactcctgacctcaggtgatccgtccgccttggcctcccaaagtgttgggattgtaatctgaggtgggcggatcacttgaagacaggagttggagaccagcctggccaacatggtgaaaccttgtctctactaaaaatactacaaattaggtgggcgtgatggcactcatctgtaagaccagctactcggcaggctgaggcaggagaatcgctggaacctgggaggcggagtttgcagccagctgagatcgtgccactgcactccagcttgggcgacagagtcagactcagtctcaaaaaaaaaaaaaaaaaaaaaagtttattgagcacctactgtgtacattgggggacacagctcgtgcaaaacaaacatccttttcctcacataggtcactttcttgttcctccaccttgctcaggtgaaagtgcacctccattcattataaaaattgtgtctaggccgggcacggtggctcatgcctgtaatcccagcactttgggaggctgaggcgggcggatcatgaggtcaggagatcgagaccatcctggctaacacggtgaaactccgtctctactaaaaaatgcaaaaaattagccgggtgtggtggcgggcacctgtagtcccaggtactcatgaggctgaggctggagaatggcgtgaacccaagaggtggagcttgcagtgagctgagattgagccactgcactacagcctgggcaacaaagtaagactccgtcccaaaaaaaaaaagttgtgttttttggtaacaatctgacagtcctgcaaaacgattattcctgccctataatgtcacacttagtttttccacaaaagtttttaataataaagttggaattattgtaaaagtttagtaaaatttcaggtttattcttgcatctctgaaatccttttaaaaaaggctagtggtcatgtttgacttcagccaaaattcattttcacacccaaccattggcttgcacgccaaatatgtatttagagaaactgaacctatgggatgcatgaatgtgcacacatgtgtggaagtgtgggcccccaggaaggtgcggactcccgagggctcactccgtcgcctcccccagcagcaggcaaaaggaagcagtgtccatgttctctactccacccccgcttgttacctctgggagctgaacaaggccaacctcacctggtatttggggaaactggggagcttgggggggttggcatgccccgtgggtcatgaccctgccctcaatgcccctgccgctgtaggtcagtgaaacatgacgacttcttcccttacgcggatggcccccaccagttctggaccggttacttttccagtcggccggccctcaaacgctacgagcgcctcagctacaacttcctgcaggtgggtaggagccgggctagagggggcatgcagccccgaggcccgacaggctgggcgccccaacatacccctctgcctccaggtgtgcaaccagctggaggcgctggtgggcctggcggccaacgtgggaccctatggctccggagacagtgcacccctcagtaagtgtcgggcccaagaggggaagaggtttgcggctgaagttggaaaccacccctaggccgcccccctcgagtttcttctttttttttttttttttttttttttttgagacggagtctcgatttgtctcccaggctggagtgcagtggtgcgatctcggctcactgcaagctccacctcccgtgttcacgccattctcctgactcagcctcccgagtagctgggactacaggcgcccaccaccacgcccggctaattttttgtatttttagtagagacggggtttcaccatgttagccaggatggtctcgatctgacctcgtgatccgcccgcctcggtctctcaaagtgctgggattacaggcgtgagccaccgcccccagccgtcctcgagttccttcttaaagcctctaagaatcctgcccgccagcaccggacctttcgcttccccttggggtctcagctgagtcccacagaacctcaccggactcattgtctatgagcagatgaggcgatggctgtgctccagcatcacgacgccgtcagcggcacctcccgccagcacgtggccaacgactacgcgcgccagcttgcggcaggctgggggccttgcgaggtgcgcggggcgagacttgggagacacgggggtggagacaggaaggggcggggccagggcctgggaaaggggacagagacaggtgtgaggcgtagccgagagccctgtggcggggctacaagggctcgtgggggcggggcttgtaggaggcggggaaagatacaggaacggggcggggctttggaggggggaaggaggcggggcgtgggcaagaggaggcggagacagctatggggtatagtcaagggcagcagggtggggctagaaggggttttggggcgactcttgagggaggcgggacagagaccggaacggggcggggcctgaggagaggggaggagtcaggcctggcgtcctgaacccaccggtccctttgcgctcttccgcaggttcttctgagcaacgcgctggcgcggctcagaggcttcaaagatcacttcaccttttgccaacagctaaacatcagcatctgcccgctcagccagacggcggcgcgcgtgagccgggacgggaggggtggatctagggcagatgggctttagagggggtagttggaaaatgtttttggaggactatacaggagtgaaattacgtgggctgcgaagctgggtcagcagagagaacaacgcatctcgagggggcttggccttaagtgccgtgaccacactaggaccagccaggggtgtttctgtgcaaagtgggtgggtttggagaaggcctgctgtgacccatgccctctctgacccccgcctccccagttccaggtcatcgtttataatcccctggggcggaaggtgaattggatggtacggctgccggtcagcgaaggcgttttcgttgtgaaggaccccaatggcaggacagtgcccagcgatgtgagcccaaacaacgaatattcccccgctgggactcctcccccagtgggcatttcctcatcgcccccatggatatcgcctgcttccatgaatacctcccactcatgcatatctcttcccccctcttgtatcttctccctctgccccttaatatcagtctccccttgggaacatatgcctcctgtgagtggtcctcccttttttttttttttttgagacggagtctcgctctgtcacccaggctggagtgcagtggcgcgatcttggctcacttcaaactccgcctgctggattataggcatgagccaccgtgcctggctggtcctccattttaataccccgcttccccaggaaaatttattgctgtttatggacatctccttcattccagaaaacgtcctcccccaaacctcttcctcccccgagaacctgcctcaagggtttcttcccctacttcctccttcactcccccgactccatggtctctccaccctcccggtgggtttttttttccacctggtgaatcttctctgcaatcatttccttggaatctgactgtccccccaccacacacacctccatttcctttccccatctcaggactcttttccttccttgagttttttgtctccatgcatgtatagctttccatgggtactcttgactcagtttccctcctcctttatccgaggtggtaatatttcccagctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgaggtgagaccccatttcaatcccctttcctgctcctgtgacaaatttgaagtgtcatggtgagctgtgtggactctgggtcagcaggtccctaggcttatgacctcctgtcacaactcccctcattgtgtgtccttgagcaagtgacctttgtctgagcctcagtgtcctttcctgggactgttatgaggacccagtgtgatcatgggtgacacttgacagacatgtcagagttggtggcaggtggtggttcgcaattttggcagggacgtttcagggaaggtgttcccgataaaggtgacatttaagatatgacctgagggagggagccgtgtggctatttgaaggaagagagatccaggtggggagagaataacaggcataaaagccttcgagcaggagagtgtgcagaattccaggagccacaaggagctcagtgtggctgaagcagggtgaacgggtgacaggtcagaccttgagggccttgaggaccaacaggaagactttggcttttgccagtcattgttgctcatgtgtctactcctagctctttgggaggctgaagcgggaggatcacttgagcccaggagttgtcccagctaattgggaggcccagatgggaggtttgtttgagctggggagttcgaggttgcagtgagtaatgattgtcccactgtactccatcctggcaacagagtgaaaccctgtctgaaaagaataataataaaataggccaggcatcgtggattatacctgtaattctagcaccacgggaggctgaggtgggtggatctactgagctcaggagtttgagaccagcttgggcaacatggtgaaacccagtctctacaaaaaattagctgggggtggtggtacacgtctgtaatcccagctacttgggggctgaggaaggaggattgcttgagcccaggtggcagaggttgcagtgagccgagatcatgccactgcactccagcctgggtgacaaagtgagaccctgtctcaataaaataaaataaaagaagttctgcagtaggactgttcatgttaggaagaaaacatctttttcatatttttattaaaataaaataaaagaagttaaaacgttcccacaggcccctaaaagtcttgtgagttctggcattgtggttcacacatcagatgcccaagttggccctggtccgcagcagaggagggctttgatgggacttagggtatcacaggtgtgctctggctgttgtggggaacagactgtaggcagccagtgtggaagtgcagggacctggaaggggttgactgcactggccctggaaggccctggtaagaggtggtgaggttgaaaataaggttgggggggccgggcgcggtggctcacacctgtaatcccagcactttgggaggccgaggcaggcagatcacgaggtcaggagatggagaccatcctggctaacacggtgaaaccctgactctacaaaaatacaaaaaatttagccaggcgtggtggcgagcatctgtagtcccagttactcgggaggctgaggcaggagaatggcgtgaacccggaaggcggagcttgcagtgacctgagatggcgccactgcattccagcctgggcaacagagtgagactccgtctcaaaaaaaaaaaaaagaaaaaaaaagaaaaaaagaaaaggctggggtgggcacgttggctcatgcctgtaatcccaggactttgggaggctgaggctggcaggtcacctgaggtcaggagtttgagaccagcctggccaacacagtgaaacctcgtctgtaccaaaaatacaaaaattaactgggcgtggtggtacacacttgtagtcctagctactcgggagggagaggcaggagaatcacttgaacccaggaggtggaggttgcagtgagccgagatcatgccactgcactccagcctgggggacagagcaagactctgtctcaaaagcaaacaaaaaaaaaatcaggttgaatggctgggtgtggtggactgcttgagcccaggagttggacactagccccaggcaacatagtgggacccccatctctagaaaacaaatttaaatttttttttttttaatttagtagagatggagtttcactatgttggccaggctggtatcaaactcctcacctcaggttatccacccaacttggtctcccaaagttctgggattacaggtgtgagccaccacgctcggccctaaaaaaattttaaattgagaaaaaaaggggccaggcgtgttggctcatgcctgtaatcccagcactttgggaggctgaggggggggtggatcatgaggtcaggagttcgagaccagcatggccaatattgtgaaaccctgtctctaataaaaatacaaaaattagccaggtgtggtggcatgtgcctgtagtcccagctattcaggaggctgagtcaggagaattgcttgaacccgggaggcggaggttgcagtgagccaagatcacgccactttctgcactccagcctgggcgatagagcgagactcagtctcaaaaaaaaaaaaaaaacaaaaaacccaggccaggtgcagtggctcacgcctgtaatcccagccctttgggaggccaaggcgggtggattacctgaggtcaggagttggagaccagcctgaccaacatggcgaaaccccgtctctactaaaaatacaaaaattagccaggcatggtggcatgtgcctgtaatcccagctacccaggaggctgaggcaggagaattgctggaacccaggggcagaggctgtagtgagcagagattgcgcccctgcactccagcctgggcgacacagcaagtttctgtctcaaaaaaaaaaaataaaaatccggctgggcacagtggcttatgtctgtaatcctagtactttgggaggccaaggtgagcagatcacttgagttcaggggtttgagaccagcctggccaacatggtgaaaccctgtctctactaaaaatatgaaaattagccaggcggggtggtgggcacctgtaatcccagctacttggatagctgaggcacgagaatcacttgaacccgggaggtggggggtgcagtgagccaagattgcaccactgtactctagcctgggctacagagtgagactcagtctcaaaaaaaaaaaaagaaaaaagaaaaattaaaaaaagaaaacacacacacatacacacacaaacccatctgtggacccttttctgcccagcacatccgggcaacgtttgatcctgacacagggctgttgatggagattatgaacatgaatcagcaactcctgctgcctgttcgccagaccttcttctggtaagggaagatcaccaggcctgagggtggggtggtggtgctcggcatggagctagggccccttacctgactctcacctgccccaactccaggtacaacgccagtataggtgacaacgaaagtgaccaggcctcaggtgcctacatcttcagacccaaccaacagaaaccgctgcctgtgagccgctgggctcagatccacctggtgaaggtcagggactaggaatgatgagtgggcagttgggaatggggaagttatggagcccaagagggtggtgggccatgtgtagagtgagggtaggggaggatttacttttccttcagatcagtgggctaagacccacagatcagcgggggaaatatttgagggtccttccatagaattgatattcatagctggtcgtatgagagtctccccataggacacatcatacaaagccattcacatctgctgtggacgtttacatacttagttttggaaattgggggtggggcattcccacttggcccatgaatcaggagagccaaatatcactgcttgaagaattcaccaaagtctgtagtaagaggagcttctatctggagtgaatatttgagagtccacccttggattgattgggtttgggtgagtctcagggtgaatgcctatgggtgcatctggctaggaacagtggtttcccagggcctctcattgatgtttgactttcatagatgacaaaactcacatttgtccacattcaagagcctcgcgtttcatgtgagtccctttgagatgaatgtctgcatatctgtatatagttttgcctgttctaacagagttacccaaattaactgtgactagaataagatagaagattattttcttctaacaaaaagtctggctgttagtccagagaaagtggggtggttccataatcacccaggacctcctcttctatcttgttgctctgccttccccaatattcagtttccacctcatggtccaagatagctgctgaagctccagccgccacatttgtgtttgagtcagtagcagagggacaggggcaaggaacattgttgacaccacttggatcactttctatggggcaaactggtcactcagctactgatagcctcagggaagactggacaatatagtctttatcccaggtagccatgtgccaagctagaatcctattctatggggcaatggtgaacaggaggcgtttatgccacgctcaagagtgatgtggtaagccagatgcagtggctcatgcctgtaatcacagcactttgggagactgaagcaggaggatcgctgagcataggagttcaagaccaggtgggagcatttgctgattaggtgcctacatagtgatgccctgtctcaaaaaaaaaaaaaaaaaaagaggccgggtgcagtggctcacgcctgtaatcccagcactttgcgaggcagaggcaggcagatcatctgaggtcaggagttcaagacaagtctggccaacatggatagaaaccccgtctctactaaaaatacaaaaattagccaggggtggtggcaggtacctgcaatccctctactcgggaggctgaggcaggagaattgcttgaacccaggaggcggaggttgcagtgaggcaagattgtgccactgcactccatcctgggcaacaagagcaaaactctgtctcaaaaaaaaaaaaagaaaaaagaattatgtgggccaggcgcggtggctcacgcctgtaatcccagcactttgggaggccgaggcgggctgatcacgaggtcaggagatcgagaccatccttgctaacacggtgaaaccccatctctactaaaaatacaaaaaattagccgggtgtggtggcgggtgcctgtagtcccagctactcgggaggctgaggcaggagaatggtgtgaacccgggaggcggagcttgcagtgagccgagatcgcgccactgcactcccgcctgggcaaaagagcgagactccgtctcaaaaaaaaaaaaaaaaaaagaattatgtggcggtgactgaaggttgaccttgatgtaggccttaatggggtttatggccagggttgggggacatttgtaggactcacctctgctcaggtacagactgacatccacctcacccgtgtgcccgcagacacccttggtgcaggaggtgcaccagaacttctcagcttggtgttcccaggtggttcgcctgtacccaggacagcggcacctggagctagagtggtcggtggggccgatacctgtggggtgagtggcacaggctgggagaggggtgtggaagcaagggcagaggggtttatccaaggctcacaaccttgccatcccattgggtacagcgacacctgggggaaggaggtcatcagccgttttgacacaccgctggagacaaagggacgcttctacacagacagcaatggccgggagatcctggagaggaggtggggggtgactgagagcactgagggggtggtctgtggtgtgttggggcccaggggtggtgagggaaatttgctgattacatgagtgtgggagacagaggacgaagggagagtgaagggcgggggagccaggcagggtgcagtggctcacgcctgtaatcccagcactttgggaagccgaggcgggcagatcacaaggtcaggagatcgagactatcctggctaacatggtgaaaccccgtctctactaaaaatacaaaaaaatcagccgggtgtggtggcgggcacctgtagtcccagctactcgggaggctgaggcaggagaatggcgtgaagccgggaggcggagcttgcagtgagccgagatcgcgccactgcactccagcctgggtgacagagcgagactccatctcaaaaaaaaaaaaaaaaaaaaaagagttggggagccagatcccaagcctgatcagctcacccccaaccccaggcgggattatcgacccacctggaaactgaaccagacggagcccgtggcaggaaactactatccagtcaacacccggatttacatcacggtagctctcccccatcctgcacctccccacctcgatagaaagggaatcaccccttatctgcagcatctcaaagctgcctggggttggggttgactgccctctactttcacccttcaactcccaggatggaaacatgcagctgactgtgctgactgaccgctcccaggggggcagcagcctgagagatggctcgctggagctcatggtgagtgggtcagagccccatccgagccagggtcctcccaacctggacccctgctggaccttgaaggctgtttctggcccagttctctgctttcaggccccactaagctgaggactccgtttctttcttttcttctctttgagacggagttttgctcttgttgtccaagctggagtgcaatagtactatctcagctcactgcaacctctgcctcctgggttcaagtgattgtcctgcctcagccttccgagtagctgggcttacaggcacacaccatcacgcccggctaattttggtatttttagtagagatggggtttcaccatgttggccaggctggtctcgaactccttacctcaggtgatccactcacctcggcctcccaaagtgctgggattacaggcgtgaaccaccgctcccggccaaggactccatttctgtgtgtggcttttcctctccgtttttctccatctcctgcccaggctccctccacgctctggcgtgccatatccaggcccccctgttaggcatttacctccttccggcctggttcccatgcctacttggatcctgcctctgctggggttgccctaccagaccctcaccttcatcctcatccgttcctcccaccctttaatttcttttgacattcccacacgcccttacccagtttctggcccaaggacacccacaaacccacgactctcaccccctcctggccactctccccccaggtgcaccgaaggctgctgaaggacgatggacgcggagtatcggagccactaatggagaacgggtcgggggcgtgggtgcgagggcgccacctggtgctgctggacacagcccaggctgcagccgccggacaccggctcctggcggagcaggaggtcctggcccctcaggtggtgctggccccgggtggcggcgccgcctacaatctcggggctcctccgcgcacgcaggtgaggggcagcggggtaggcagagaggaccggattgaagtctaccagggagccgggtttgggtgcggagtttcctaggctcagcggggatccatttggccataattagccccaaaccctcgggccaaccccatcccctgggcagtccccgcccagtgccagcccagtcccaacccccctggactgtgtagaggcacagccctagctcatgcccctaaaccaccaactcacctccggccccgcccatttcactttagccccgccctctcaccgcccccaggctctgtcctgcctcacccagccccgcggcttcagccccgccgtaactcccaaagtctcaggtcacatcagttctgctccatcgggactcgaaccctaagcttgggaccgacccatctccccattggctcagtcctccctgtcacggccctggccgctcctctcggctgagccttgcccctctccggcgaaaccccgcccctacaacctagccctgcctcctgacctggctcggccccgcccttctccatccaggccccgcccctctccaactcagccccgccctctctcccgcagttctcagggctgcgcagggacctgccgccctcggtgcacctgctcacgctggccagctggggccccgaaatggtgctgctgcgcttggagcaccagtttgccgtaggagaggattccggacgtaacctgagcgcccccgttaccttgaacttgagggtgagaagggcaaaattgagaaggagatcggagagaggcaagagagagggagagaagagaaacctggctttgccccaactcatctgggcccatccccttccccgcaggacctgttctccaccttcaccatcacccgcctgcaggagaccacgctggtggccaaccagctccgcgaggcagcctccaggctcaagtggacaacaaacacaggtggggccctggtcaggggtagggaaggggtggagtcttacctggggccggcaggtgggggcaatgtgtgaggcatgggatgttggccaggacccaaaaaggtcatgagggtatggggcagagtccagacccaggttaggggcttaaaggatctgaaatgggtgcggcaaaccaggaatgggtcttgaggtttgtgggtgctgtttagtcccaagaacaagatttgaaaatccccatccatgtctagttctgggagggtgttcatcacccctggggtcagattgagggtacgaggacagtggccagattgagggtatgaggacattggacctgggggtggtattcggggccggggaagcaggttaagagtctgggattgaggccctggagacagattcggggatatgcagctgtgtctagacccaggggaggaagcatcgtggggtgagtcagaggaagtctgcacctcctcactcctccttccccctgcacctctccaggccccacaccccaccaaactccgtaccagctggacccggccaacatcacgctggaacccatggaaatccgcactttcctggcctcagttcaatggaaggaggtggatggttaggtctgctgggatgggccctccaagcccaagcctcctgctccgggggcagaccagactctgactctcctcttggggctgctgccattaaaacgctactactaagactcaggtcgctctgtgactgagtgtgggttttttttgtctgttatttgcttgttagagggggacagaatttatgacccagagccgggtgtggtggcttgctcctgtaatcctaacaactctggaggctgaggagagagaatcacttgagcccaggagatctagactagcctgggccacaaaatgaggccctgtatgtacaaaaaatttaaaaaattagctgggtgaagtgtctgtattcccaactacttgggagaattgcttgagcacaggaggtcaaggctgcagtaagtgataatcacaccactgcactccagcctgggcaagagagccagatcctatctcttcgtgtgtgtgtgtgtgtgtgtgagggacagagtctccctctgtcgcctaggctggagtgcagtggcgcaatcttggctcactgcaacctccgccttccgggttctagcgattctcttgcctcagccttccgagtagctgggactacaggcgccccccaccatgcctggctcatttttgtatttttagtagagatggggtttcaccatgttggccaggctggcctcaaactcctgacctcaagtgatccacctgccttggcctcccaaagtgctgggattacaggcatgagccactgcaaccagtctggatcctatctcttgaaaaaaaaattaaaaattagaaaattatccagataggatggcgtgcatttataatccccagctactacttgggaggctgaggtgggaggattgcttgagcccaaaagtttgaggctgcagtgaaccatgatggctccactgtactccagcctgggtgacagagtgagaccctgtctctagaaaaaaaaaaaaaaagtaggcagtgcgtggtggctcacacctgtaatcccagcactttgggaggctgagtcacatggatcacaaggtcaagggattgagaccatcctggccaacatggtgaaaccccttctctactaaaaatacaaaaattagctgggcatggtggcacacacctgtagtcccagctactcaggaggctgaggcaggagaatcacttgaacccaggaggcggaggttgcagtgaggcgagattgtgtcactgcactccagcctggtgacagagtgagactccatctcaaaaaaataaataaatacaaataaaaagtttttaagtgttctggggtcagtttgcaagcaccaacagcatatgtttcttaggccccctctgatgacaaggactggcccagggtggacagggaagcccagggagggtggtatcatgttggtcctctaatgtttcctctgagaacccctccaatgggccagttagcatgggccacctagggatgccagggtggggtgccaggggacactctgctgtggtcccacttggggcatggtcaccagatgtgctctttttcttttttttttttttgagatggagtctcgctctgtcgcccaggctggaatgcagtggtgcgatctcggctcactgcaagctctgcctcccaggttcacgccattctcctgcctcagcctcccgagtagctgggactacaggcgcctgctaccatgcccggctagttttttgtatttttagtagagatggggtttcaccgtgtaaggcggaatggtcttgatctcctgaccccgtgatctgcctgtctcagccttccaaagtgctgggattacaggcgtgagccaccgcgcccagcccagatgtgttctttttcaagtttccttcttgacggagggctgggccagcttgtgaggcctgaaaagggctccctgcacctgtctgccgtattggacctgttactggaggtatcacccccaccaaaaatatttctaagtccctctcctatggtagtgactggcctgggctgagtaaggaggactgtggagtactcttcaggctcagccctggtcccacatgcgtccctgttttaacatgtgactcctccgcagaaaacttttataagtccctctccaggaagagagattggacctggccaaccagagaggcctggagagggtgacctgagtttgcccacagccccatgtgggctccttcataggaggctctgagtgcaaagtttcctgtgtcccagccagtggtagggactggtcgcagccaaagaaggaggccagcagaaggaccacaggtgggctgtcatcctgcagaggcctctgattgtgggatgtgcctccaggaaatatttgtaagtccttggggatggggtggggataaggaaacagcttaggtcagctaggaaccatagggcagagcaacccaggcttagttttggtcacacatggggcctggttcctggatgtgctccttgaaaatttgtctaagtcaccctctaaagacaaggattattacaggtgagccagagaggcccgagaagggcaccccagcatagttgtcctgctgcatagaatctggccacaggatgaaccccctgaaaaccttaaaaagtctccggattgagaccatcctggccaacatggtgaaaccccatctccactaaaaatacaaaaaatttctctttcccttcagtgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctctgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgtcgtcctgtgctggggctgacaggctccaaacaggaatgcgaggtgcctttggaaagccccagggcactgtggccagggttcacattggccaagttatcatgtccatccgcaccaagctgcagaacaaggagcgtgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtatatccccaatcgtggccctctggacaagtggtgggccctgcactcatgagggcttccaatgtgctgcccccctcttaatactcaccaataaattctacttcctgtccacctaaaaaatacaaaaaaaaaaaaaacaacaacaaaaaattagctggtcatggtggcgggtgcctgtagtcccagctactcgggaggccgaggcaggagactggcatgaacccgggaagggagactgggactccctctatcacccatgttggagtgtgctggcctgatcaaaacacactgcaacctcagaatcctgggctcaagcaatccccccgtctcagcctcccaaagtgttgggatgacttgcttgagctgccatgcccagcctctccctaatttttctaagccagcctgtagaggctgggaatcagccctggccattcagggaatccgtggagggtggcccgggcccagcaggctaccctctgactgctttgggccgagacacaagttggagtgagaccctgaccaggtggcatctggtccggtaggggaaggtccaggtccggcgcagtcccaccggtggtcgggcgccactttgtgatcactctgatatcgtccccggagctcggttgtcgcgtgtgtgggacaagatccggccggagagcccaggacagtgttccaggagaccgaaggagatggcaaggtcttctcggccggccacacgcggtgctgcataatggactctcctgagatagttactgcgggatccgggggagcctgagatcattactgcgggatgggaatctttgagaatcgcggaagaagagtggcgtatgaaggtccctctgcccttggagaccgactggtgccgtcgcaggtgaatggggtagggcgccctgggctcagccgctttcccatctggtgccgggttgttcacagcatcactggatacattttcgttcttttttttttttgagatggagtctcggtctgtcacccaggctggagtgcagtggtgctcactgcaaactccgcctcccgagtagctgggactacaggcgcggctttttgtatttttagtagagacggggtttcaccgtgttagccagggtgttctcgatctcctgacctcgtgatccgcccacctcggcctcccaaagcgctgggattacataggcgtgagccaccgcgccgggcctctttttttctttttcttttcttttttttttgaagacagagtcccgctctgttgcccaggctggagtgcagtggcgcgatctcggctcactgcaacctctgcctcctgggttcaagcgattctcctgccttagcctcccgagtagctaggattacaggcacgtgccaccacgcacggataatttttgtatttttagtagagacggggtttcaccatgttggccaggctgggctcaaactcctgacctcaagtgatctgcctgcctcggcctcccaaactgctaggattacagtcatgagcccatgcccagcctactggaaaagttttctaggtccccttcctggggccaggatcgcagccagggaccccagagggcacacagctcctgcccaccgactcacataaggtaccgtcgcagaaagtgcgtcctgaaatttttcccaaggccccttttaagaagggacactcgcccaggcatacagggaggatgaaggagggcacccagaccccagctgcagtttccatggcgaccattcatcggacaccttcagaaaacgtctggagggatgactggggccaaacagggagggctaagggtgggcgacttggacttggtcacagtcctatgcagacgcgtctgaagcacctgctgaaaacgttgccaattctgagtgataggagataggaataggggcatgaagagagggacggggagggtaaaaggagggggatcactgggagccgcagaagcagtggcggggaaagcagggggaaggggaggtagagggatggttttgatgggagaaggaggttctgagtaggatattgttgtggcttcattcccctgtgggccttcccaaatgttccttttttttcttttctctttctttttctttccctccctcactccctccctcctttctttctttcccttccctcccttccttccatcttgaatgttcttcttcattttctttccttttttttgagacagactttcactcttgtgggttattttttatttatttttttttttggtgttttgttttgagacagagttttactcttgttgcccaggctggagtgcaatggcgggatcttggctcactgcaacctgctcttcccgggttcaaacgattctcctacctgagcctccctagtagctgggattacaggcatgcgccaccacacccagctaatttttgtatttttagtagagaagggttttctccatgttggtcaggctggtctcgaactcccaatttcaggtgagctgcccgcctcggcctcccaaagtgctgggattacaggcgtgagccgccgcgcccggcctctttttccttttctctttctttttccctccttccctccctccctctctcccttccttcctccctccttccaccctccctctccctctctctttcattttttttggtttgtttttgttttttgttttatttttcccgcgaccgagtctcgctgtcacccaggctgctgtgcaatgatgcgatcatagcgcactgcatcatctccagggcacatctctcctcccgcctcggcctcccaaagtgttgaggtggtaggcatgaggcatccagcagggcttcattcacattttctgtctgcctatggaggctgggatcagccctggccattcagggagttccgtggagggtgccccgggcccaccaggccatcctctgaccgctttgggccgagtgtattacaggttcatgtgggacccgaaccaggcggtgtagactggggaaagtgcctgtctggtgaggtccggcgggtgttcgagcgccacctagggtcagtctgatgccatcccctgagcttggctgccgcgtgtatgggaagtgatctggctgcaaaccgcaagagagagttccaggaggtcgccggcgatgacagagtcttctcggctacgacacgcgccgccccatcatgggctctcctgagatcgttactgcgtgttgcgggcgagcagtctctgagaatctcgcgggctgaatgtcgcatgaggtcccctccgcccgtggggactggctgctgccgtcgcaggtgagcggagtagggtgccctgagcttggccgctttcccacctggtgcctgcttgcccacagcttcattggcgttttctaggtccccctgctggggccaggatcacagtcaggaaggtcctcggactgctgtgggaagggccccaggttctgcccaccgccagattgggcctggtagttagatgagtcctgaagacacttctaagcccccctacacagctggggccaggctggccctggaggctggagggattaagtattcctgtgattctttgtgggcccagttatatttatccgttgaacaagtttccaagacctcctgcaggctggctagggatacctgaagaaggcttcctggcttggctgtggtcacatgcgaggggcctttttgatgaatacacttgaacaaaagtttgcttttattagaaatggtagccagttgcggtggctcactcctgtaatcccaacactttgggaggccgaggtgggtggatctcttgaggtcacgagttccagaccagcctggccaacatggtgaaacctgtctctactaaaaataaaaaaaaaaaggctgggcccggtggctcacgcctgtaatcccagcactttgggaggctgaagcgggcggatcacgaggtcaggatatcgagaccatcctgtctaacatggtgaaaccccgtctctactataaatacaaaaaaacagccgggtgtggtggcgggtgcctgtagtcccagctactcgggaggctgaggcaggagaatggcatgaaccccggaaggggagcttgcagtgagccgagattgcgccacggcactccagcctgggcgacagagcaagactccgtctcaaaagcaaaaaacaaaaaacaaaaaacaaattagccgagcgtggtggcgggcaactgtaattccagctacttaggaggttgaggcaggagaatcgctcaaacctgggaggtagaggttgcagtaagctgagattgcaccactgcactcccgcctggacgacagagcaagactcagtctcaaaaaaggatggggtcttgctatattgcccaggctgatcttgaactcctgggttcaagccatataacgcctcggactcccaaaatgttgggatgacttcccttacccaccgttccctgccttctccacgtttgctgagttggcctattgaggccagggccagccttggccattcagggagttctgtggaaagtgccccgggtccaccaaggcagcctctgatatcttggggccgcggtacaggttagagtgagacccggacaaggtggcctctgctgagggtcggggtccaatccggcggggtcttgccggtgattgggaattacctgtttgttggcgtttatattttcttttcttttttttttttttttttgagacggagtctggctctgtcgcccaggctggagtgcagtggcgccatcttggctccctgcaagctccgcctcccgggttcacgtcattcttctgcctcagcctcccgagtagctgggactacaggcgcccgccaccacgcctgaataattttttgtatttttaatagagatggggtttcactgtgttagccaggaaggtctcgatctcctgacctcgtgatacgcctgcctcggcctctcaaagtgctaggattacaggcgtgagccaccacgcccggcctgacgtttatattttctccctggagctagcctgctgcataggtgggataagattctgccatgatgctcagaatccagttcagttcctggaagccaggggcaatggcaggatcttctctacaggcgccagtctgtagacaggctctcctgagattgtcactgcaggacgggggtgagtgatttctaagaattctgaaggcctactggcccgcggaggtcccctccgcttctgaggaccgccttgagcggtcgcacgtgactggggtcgccctcctgaggacaggatcgcagccagggaggcccaggaaggcaccttgctcctggcctccaactcacgtggggcaccgtcgctgagagtgagtcctgaaatcttttccaagtcgcccaccccgttttttttttttgttttttttttttgagagagtctcgctctgttgcccaggctggagtgcggtggtgtaatctcggctcactgcaacctctgcctcctgggttcaagcgattctcctgcctcagcctcccaagtagctgggattacaggcgcccgccaccacgcccggctaatttttgtatttttagtacggacggggtttcatcatgttggccagctgctctggaactcctgacctcatgatccacccgcctcggtctctcaaagtgctgggattacaggcgtgagccaccgcacccagccccaactctccctcttaagaggacacgggctcaggctgacaaagaggcttttaggatgccacctaaagctcagctgcagttcccactgtgcgtattcatcagacacttacagaaaaccttggtgatatggtttggctgtgtgtccccaaccaaatctcatgttcaattttaatttctaataccaggagagggacctgctgggaggtgattagatcatgggggcggctttccccttgctgttctcgtgatagttctcaggagatctgatggtttaaagatgtgcggcacttcccacttcgtgctctctcctgatccctcctgcttcaagtgaagactgactcgatccccagtagccttccgccttgataagtttcctgaggcctcccagccttgcttcctgtacagcctgcagaactgtgagtcaattaaacctcttttattcgtgaattacccagcctcaggtagtttttttcttttttcttttttttgagacggagtttcactcttgttgcccaggctggagtgcaatgacgtgatccccgctcactgcaacctctgcctcccgggttcaagggattctcctgcttgagcctcctgagtagctggaattacagacgtgagccatgacgcccggctaatttttttattattagtagtagagatggggtttcaccatgttagtcaggctggtctcaaactcctgacctcaggtgatccacccgcctcagcctcccaaagtgctgtgattacaggcgtgagccatcgcgcccagctcaggtagttctttatagcagcgcgagaatggagcaacacacttgggaaggatcattcaggctaaacagggaggtcaggggagggcgacttgcacctggtcacagtcctgcacaggcgcatctgaatcacctgctggaaacgtttccagttcggcggggccgcacaggggcaagaggtgataaagtggggaagaggagacaaagtggggaaagaggggaaaaagggggatgaaggctggagggggccaggatggggcggggcagggtaggtcttggggaggggagggcaaagggtagggatggccttgatgggacaaggagtttatgattaaaatgccctggtggctttattcccctgtgcgccttccaaaaatatttcttcttatctctcattttgtttttacttttaagagacaaggttggccgggcgcggtggctcacgtctgtaatcccagcactttgggaggctgaggcaggtggatcacctgaggtcaggaatttgagaccagcctggccaacatggtgaaatcccgtctctactaaaaatataaaaattagccgggcgcggtggcgggcgcctgtaatcccagccactcgggaggctgaggcaggagaatcgcttgaacccggggggcggaggttgcagtgagccggtatcgcaccactgcacttcagcctgggcgacagagtgagactccgtctcaaaaaaaaaaaaaaaaaaaaaaaaaggaaagaaagaaagaaaatacattacagggttccaccaggcagcacacccagagaggagctaactgcaaggagacaaaggcttggtggggattttagagaatggtgctttggccgggtgcagtggctcacgcctgtaatctcagcactttgggaggccgaggcgggcggatcacgaggtcaggagatcgggaccatcctgactaacacggtgaaaccccatctctactaaaaatataaaaacaaaattagccaggcatggtggcgggtgcctatagtcccagctactcaggaggctgaggtgggagaatggcgtgaacccaggaggcggagcttgcagtgagccaatatcgcgccactgcactccagcctgggtggcagagcaagactccttctcaaaaaaaaaaaaaaaaaaaaaaaggactcataagttctgccctagatcaaagcaaccttaatgtggtacaaattataggctatgacacacatagcattcttgcctgttttggaaggtggctgacatgaactgtgtcacccaggtctgagtgcagtggcatgatcatggctcactgcaggctcgaactcttgggctcaagccatcctcccacctcagcctctggagtagctggaatcacaggtgtgccccaccacacccagctaattttttacttttgtagagatggggtctcagttctttttttttttccttttttctccttcccttccttccttccttctctcatatctctgcttttctttcttttgctttctttctctttcctttctttttctttctttctctctttttcttttctttctctctctgtcttttcttttttcaacacgactgagcctcactgtcgcccaggttgctgtgcagtggtgtaatcacagctcactgccacgtggaactcctgggcacaaaccatcctcccacctcagcctcctaaagtgttgagatgacaggcatgaggcacccagtacggcctcattcaaattttctaagtccgcttatggaagcatgcacctgcagtcccaactacttgggaggctgaggcaggaggatcactccccagaagtcaaggtgacagtgaactatgatcgcaccgctgcaatctagcctgggtgatagagcaagacctcatctcaaaaaaaaaaaaaaagtttgacaggtggtggaacacactagaacttcaaaactttgagactctataattctgatttacatgagtttgggaaagaccctgtgctctctctgcctctgttttttcatgtgtaagatgggaggaatcccagcactttgggaggctgaggtgggtggatcacctgaggctaggagttccagaccagcctgaccaacatggtgaaaccctatctctaccaaaaatacaaaaattagctgggcatgttggcacatgcctgtaatcccagctactcgggaggctgaggcaggagaattgcttgagcctcggaggcagaggtttcagtgagctgagatcgcgccattgcactccagcctaggcgacagagtgagactctgtctcaaataaataaataaataaataagtctatgaaacatttatttctggaattttccactaagtatttttggactgtgtttgaccatgagtgactaaaaccacagaaagcaaaactttggatcagaattgactactgtattaccataattaattctgaatacaggtgtgaccgtggtgattgctggcaatagggcactgaaaataccactgttttgaagagaattttgttttatgacaaaatgtaagtataagaataaaaaacatctaagggaaaaataccagaacatttatgcacatgctaatattgagtcagaatgtatcttgacaaaatgacaaagttgatctgaatattcataactgtaatgggatattttaatatagcctttcaggaaacggggaagacaattatttgtttttgaactaatagagatggggtcttactatgttgcccaggctggtctccaacttcaggcctcaagcaatcctgcctcagcctcccaaattgttgggattacagccatgagccactgcacccagatgatgataatatttgatagtatacatgttgtttggaaacagttaacaaaatatttctaagaaacatctaagaagcttttgcttcaaataaataaaaaatgcattattttagttgcatacaaccaaacataaatgaaaataaaccgatggagaatattcaggaatagttggaaacacccacaatttgtctgatatgaggaaggtgattattctcaaatggaaggatgggggagagtagtcactgtataatgcagtaagagaacaaactcccatatagttgtttttttttttttttactgttttactgtagctgtcatggtggaatcaggaatacatagtccctagtggcattaacagaacaagaaccatacaaattaaagctcatagaaacacaaagggaagacagaacctcagagaacaatgccaaccatgacagtctgaaatagatgcttgggccacacatgaaggctagaaggaaaatccaaactgtacgtggatctttgatgcggagcttgtggagacaactgtggaaaccaacacatctctttgagaatggaagtcaagcagctcagggtgttttcaggatacttttgattggcagagaaaataaccaggaaaatgagcaggaagcaggctgtctccctgtatggtggggttccaatacctgactaatgtcttcttcacttctgcctggcaaatctcatgcaagtgaggctataagtgaatttcaacatggatctataaagggaacagattctaggaaatttacctgtgtcgacaggtagcaggagggccacgtccagctctagattttattgtcctatcacaggtgtccttcctgaattcaaactctactattcaaatcccagacagaattataaaaaaaaggcgaaaataataattcgcataagaatatatgataaacttcacatacttaccaacttatgccagatgtttaataaaaaggaaaatggaataaggctcttctagctgaaattcattttatttatttatttatttgagatggagtctcgttctgctgcccaggctggattgcagtggcacgatctcggctcactgcaagctccgcctcccgggttcacaccattctcctgcctcagactcctgagtagctgggactacagacgcccgccaccatgcccagctaattttttgtatttatagtagagacggggtttcactgtattagccaggatggtctcaatctcctgacttcgtgatccgcccacctcggcctcccaaagtgctgggattacaggtgtgagccactgcgcccggcaagaaatttattatattttaatttaatttttttgatatggagtctcgttctgttgtccaggctggagtgcagtggtgtgatcttggctcactgcaacctctgacttccaggttcaagcatttctcctgcctcagcctcccaagtagctgagattacaggtgccctccaacatgcccagctaatttttgtatttttagtagagatgggatttcaccatgttggccaggttggtctcgaactcctgacctcaagtgatctgcttgccttggtttcccaaagtgctggaattacaaaggagtgagccaccgtgtctggccaagaaatttaaaaagcagtttttcggaaaaggtgaaataaatatataatgggtaatatatgcaccaccttccacatgaggccagtaggaaaaatcctagttacagtgtgtcagtattcaacaatctctttattcagagaacaactgaaaaactatacacaaattaaaactaattgtatattaaaaatacacttctactaacactggtctttaaaagaaaaaaaaaatacacttcaggccgggtgcggtggctcaagcttgtaatcccagcactttgggaggctgaggcggtcgaatcacgaggtcaggagattgagaccatcctggcttaacacggtgaaaccccatctctactaaaaatacaaaaaaaattagctgggcatggtggcgggcgcctgcagtcccagctactggggaggctgaggcaggagaatggcgtggacccgggaggcggagcttgcagtgagccgagatcacaccgctgaactccagcctgggcaacagagcaagactccgtctcgaaaaaaaaaaaatacacttcagtttactcatgaatcaagacatcaagagaaagagaaaagttttactaactgatttaatgagaaaacacaaccttttaaacttttgaccactgcttaaagagtacttacagaattatctcacttccaagacttcttggaaaagtagttaagttacaattcatagtccagagatgtacttgaagaatgagccagtgataaaaaatttttaacttttttttggtgtgtgggatggagtcttgctctgttgcccaggctggagtgtagtggcacaatctcagctcactgcagcctccacctcccaggttcaaatgattctcctgcttcagcctcccaagtagctggaattacaggtgcatgccaccacgctcaggtaatttttgtatttttagtagagatggggtttcaccgtcttggccaggctggtctcgaactcctgacctcaggtgatctgcctgccttggcctcccaaagtgctgggattacaggcatgagccaccatgccttgccttaacttttatatcgtgtgtgatgaatttatatcatggtgtgaattttctggagcattttacaggcagagattgcttaatcatgggtatatgttctgagaaacgtgttgtaggtgatttcctcatggtacaaacatcacaaagtgaacttacacaaatctagatggtatagctacaacacatctagactatatggtacagtctattgctactaggctataaaccatacaacatgttgttgtactgaacactgtaggaaattgtaacaaaatgttaagtatttatgagtctaaacacagaaaatacacagagtaaacatgcagtataaaagataaaaaaggatgcacctgcataggacactccatgaacatagcttgcaggactagaagttgctctgggtgagtcagttgagtggtgagtgaatgcgaaggcccaggatgttactgtacactaatggagaatttataaacactgtacacttggactacactacattcataaaaacattttttcctcaataatgaataaaccttaacttactgtacattattttctttataaacttatttttaaaaactttgtaataatttagcttaaaacacattgtacagctgtacaaaaatattttatgtccatattctataagctttttctattaaatttttttaaactatttttgttaaagactaactaagacacaaacacacattagtgtaggactacacggggtgaggatcatcaatatcattgtcttctgcctccatgttttgtcccgccagaatacgttcaggggcagtcctgcacatggagccgtcatcgcctatcataacaaagtttttccgggaatatctccttaaggacctgcctgagactgtcttactgttaaaaaaacacaggaatacattctaaaacaggattgtaaatatataaaccagtaacttagccatttattatcaagtatatattgcacatctgtgctgtaattttttttttttcgagacggagtctcgctctgtcacccaggctggagtgtagtggtagatctcagctcactgcaatctccacctcccgggttcaagcgattctcctgctttggcctcccaagtagctgggactacaggcacaccagaacgcccagctaattttcgtatttctaatggagacagggtttcatcatgttgaccaggctggtcttgaactcctgacctcaactgattctcccacctcagcctcccaaagtgctgggattacaggtatgagccactgtgcccagccaattttttttttttttttttgatacagtctcactgtcacccatgctggactgccatcacgtgatcttggttcactgtagccttgaactcctgggctcaggcaatcctcctgcctcagcctcccatgtagatgggactacagggtgtgctaccacacttagaaaatgtttttattttttgtagagacagggtctcactaggttgaccagagtagtcctggcatcaagcaatcctactgccttagtctcccagtgttgggatcacaggtgtgaccatgcccagctgtgttgtactttttttttttttttttttttgagacagagtctcgctctgttggccggatctcagctcactgtcagctcggcctcctgggtttatgccattctcctgcctcagcctcccaagtagctgggactacaggcgcccaccaccacgcccggctaattgtttgtatttttagtagagatggggttttaccgtgttagccaggatggtcttgatctcctggcctcgtgatccgcccgccttggcctcccaaagtgctgggattacaggcgtgagccaccgtccccggccgctgtcttgtacttttatacaactgaaagtgcagcacgtttacaccagcaccataaacacttaaataatgtgctgcactatggtgttactactgctactaaattgcggttgatagaaatgttttaggtgttatataatcttatggggctaccaacctatatggtccattgctgactgaaacatgattatgtggtacctgactatacatgaatcatcttgtatctcgctttctatattacttacattgacaggatttctctcttcagtgggaattttcacaactttgaaagcatctgttagaattgaaaactttctcctatttctcacatttatagagtttctatcgattgtgcattctcatatgtttttttaaggatgtggacacactgaaggcttttccacattgcttacattcaagaggtttctcataattgtgaattcttgtatgtctttgaaaggaactgtgaagactaaaggccttcccacattctttacatttatagggtttctctccagtatgcattctcatgtgtccttgaaagcttgtgggataaataaaggccttcccgcattccttacattcataaggtttctccccagtgtgagttcttttatgtatccgaatgtaactagaacaactaaaggcttttccacattgtttacattcatagggtttctctccagtgtgagttctttcatgtgttcgtaacgcactaggaaaaatgaacaccttcccacagtccctacatttataaggtccgtctccagtgtgggtgatcatgtgtcttcgaaagttctcaagagaaatgaaggtttttgcacattccttacactcatagggtttttctccagtgtgatttctcttgtggattttcaaatctagaggataattgaaagttttcccacattttttacattcgtagggtttctctccagtgtgagtcctttcatgtattcgaaagtaactgattctactaaaggctttcccacattctttacacttatagggtttctctccagtatgcactctcacgtgtactcgaaaggctgggcgtgcactgaaagatttcccacattctttacatttatagggcttctctccagtatgaattctttcatgaatttgaatggaggtggaacatctgaaggctttaccacattgtttacatttatagggtttctctccagtgtgaattctttcatgtactcgtaaaaaactgggaaaaatgaatgcctttccacattctttgcatttataaggtctatctccgttgtgtgttatcatgtgtgttagaacacttgtgtgggaaatgaaggctttcccacattccttacatgcatagggtttctctccagtgtgagttctttcgtgtactcgaatagaactggaacaactgaaggctttcccacattgtttacattcatagggcttttctccagtgtgaatcctttcatgaactcgaagcgaactggaacaactaagagcttttccacattgcttacattcatagggtttttctccaatgtgagtccgctcatgtctttgaaagggctggtgatatatgaaggtttttccacattgtttacatttatagggtttttctccagtgtgactcctttcatgtctttgaaaggatttgagataactaaaggctttctcacactccttacatttatatggcttctcaaatagctcgtatccagtgtgagacctcatgtgtctagtaagggatgagagacgcatgaaggcttttccacagatagtacactcatatggttttactccggcagtcttcttcgtcacactgagattgggactgaagttttctgcacattgactaccttctttaccttcacagagtctctctcccgtatggcttctgtaaaaaattagaagcacggtaatactggttgtgtattaatgattttatatgtattatcgggtagtagaactaaagttcttttttcttttttgagacggagtcttgttcttgttccccaggctggagtgcaatggtgcgatctcagctcactgcaacctccacctcccagcttcaagcaattctcctacctcggcctcccaagtagctgggattacaggcatgcgccaccacgcccagctaattttgtatttttagtaaagccgtggtttcaccatgctggtcaggctggtcttgaactcctgacctcaagtgatctgcccgccttggcctcccaaagtgctgggattacaggcgtgagccaccgcacccggcagcagaactaaatttttatcattttcagggaaatagttttctgccccgtctgacttgtttaaaaacgaatatactcaatgttctgcaagagggcttgtgtcactgatagctattatcaaaacagtaatattgaggtatgggtttttttttttttggtttcattttgagacagagtctcactctgtcacccgcactggagtacagtgatgcaatcatggctcactgcagccttgacctcccgggctcaatcaatcctcccacctcagcctcccatgtagctgggactacaggcatgcaccaccacaactgactgaattttctgtttcttgtagagacagggtctcgtcttgttgcccaggctggtttcgaactcctgagctcaaatgatctgctcaccttggcttccggaaattatatgtgaggctttaaagtactgtttctgggcgggcacagtggctcacgcctgtaatcccagcactttgggaggccgagacgggcagatcatgaggtcaggagatcaagaccaccctggctaacagggtgaaaccccgtctctactaaaaatacaaaaaaattagccgggcgtggtggtgggcgcctgtagtcccagctactcgggaggctgaggcaggagaatggcgtgaacctgggaggcggagcttgcagtgagctgagatggcaccactgcactccagcctgggtgacagagcaagacttcgtctcaaaaataaaaataaaaataaaataaaatactgtttccacaccttggcatggtggctcatgcctgtagtcctagcactttgggaggccgaggtgggtggatcaattggggtcaggagtttgagaccagcctggccaacatggtgaaaccccatctctactaaaaaatacaaaattggctgggcatggtggctcacccctgtaatcccagcactttgggaggccgaggcgggcagatcacgaggtcaggagatcgagaccatccaggccaacatagtgaaaccccatctctactaaaaaatacaaaaattggctgggcatggtggctcacgcctgtaatcccagcactttgggaggccgaggtgggcagatcacgaggtcaggagatcgtgaccatcctggccaacatagtgaaaccctatctctactaaaaacacaaaaattagccgggcatggtgatgcatgcctgtaatcccagctacctgggaggcggaggcagaagaatcccttgaaccagggagtgggaggttgcagtgagccgagattgcgccacagcactctagcctggtgacagagcgagactccgtctcaaaaaaaacaaaacaaaacaaaaattaacccagtatagtagtgcgcgcttataatcccagctacttgggaggctgaggcagaagaattgcttgaacccaggggttagaggttgcagtgagccaagatcataccactccactccagcctgggtgacagagcgagactctgtttcacaaaacaaacaaacaaacaaaactgttcccaagtacaatatttttctttcttcttcttcttctttttttttttttttgagatggagtctcactctgtcgcccaggctggagtgtagtggtgcgatctgggctcactgcaacctctgcctcccaggttcaagtgattctcctgcctcagcctcctgagtagctgggatgacaggtgtgtgccaccacacccggctaatttttgtatttttagtagagacaggttttcactgtgttggccagactggtcttgatctcctgacctctggtgatccgcccacctcaccttcccaaagtgctgggattataagcgtgaggcacagtgcccggcccaagtataatatttttcagccagtggacatctgtgtcacttgagaaaacatttttggtaaacattttctgataataaataaatttggggcccagtggctcgtgcctgtaatcccagcactttggaaggctgaggcgggcagatcacctgaggtcaggagtttgagaccagccttgccaacatggagaaaccctgtctctactaaaaatacaaaaattagccaggtgtggtggcacgtccctgtaatcccagctacttgggaggctgaggcaggaaaatcacttgatcccgggaggtggaggttgcagtgagcaaagaccatgccactgcactccagcctgagtgacagagcaaaacctcatctcaagaaaaaataaataaaacaaataaataaataaatttggagctaagcttgcttcttgttttaaaagtgtcacaacttctttttttttttgagacagagtctcgctctgttgcccaggctggagtgcagtggcgcgatctcggctcgctgcaacctctgcctcctggattcaagtaattctctgcctcagcctccagagtagctgggattacaggcgcccaccaccacaactggctaactttttttgtatttttagtagagacggggtttcatcatgttggccaggctggtcttgaactcctgacctcatgatccacccacctcagcctctcaaagtgctgagattacaggtgtgagccaccgtgcccggccataacatttttaagattctttcaaggaacactgttacttcttgtgagtgcaactcaccttagatttcgtccttggtttttgtgttgatcttcaacattcgggtcttcccatttttcccctaaaatgtagatcaagaataatcatgataaattattaaaaattatacaaatattattagattataggttcacaatgagctgtaaccatgcctggtttatttacagaagtgtttccttttcagattccaaatctcggaacagtgattatgagcaagaaatggcagttctctaactgacgatatgaaaaaatgatgtcactggggtgcggtggctcatgcctgtaatccccacactttgggaggctgaggcgggtggatcacctgaggtcaggagttcgagaccagcctggccaacatgataaaaccccgtctctactaaaaatacaaaaattagccgggcatggtggtgggcacctgtaatcccagctactcgggaggctgaggcaggagaattgcttgaacccaggaggcggaggttacagtgagccaagatcccgccactgcactccaccctggggaacaggacgagactcaaaaaaaaaaaaaaaaaagaaggccaggcacagtggctcatgcctgtaatcccagcactttgggaggctgaagcgggcagattacctgtggtcaggagttcaagaccagcctgaccaacatggtgaaatcccgtctctactaaaaagaaaaaaattagccaggcatggtggcacgtgcctgtaatcccagctactcgggaggctgaggtaggagaattgcttgaacctgggaggctgaggttgtggtgagctgagattgtgccattgctctccagcctggacaatagtgaaactctgtccccccccaaaaaaaaaaaaaaagaaaaaagaaaaaatgatgtcatccttacctatagatgccaggttcttgaatgtttcctgcatcacatctctgtagagtttcttctgtgaaggagccagcagagcccactcctcctggctgaagctcacagacacatcctcaaaagccactgagtcctgaaacatccaatataagtagagaataggtgagattgacaaggatgagaggtatcctcaattcataagaaattcacacacgattttgtggtctccaaacatttagtgcatgactcaattgttagaaatgtaacagcacattgaacacataaacttatagctacatcttcactgtggtcactgtaagtcctattgctctctaatggtagtatctagttcaacttagaaaaatgaaagaaatcctacacaaatgagacaaattttaggatcaatttttttttcttcctttttgagacatagatggtctcgctctgctacctaggctggagtgcagtggtacaatcacagttcattggagcctagtcctcccggctcaagcaatcctccaacctcagcctcctgagtagctgggactacaggaacacaccactacacctaggtaagtattttgtgtatattttttgtagagatggggttttgccatgttgcccaggctggtctcaaactcctcagctcaagcgattcactagccttggcctctcaaattgctgagattacaggcaagatcttcaattctttatgagataaattcttatttcttgtttgtttgtttgttgttttctaagagacagggtcttgctctgtcacctaggctcaagtgcagcaatcctaactcactgtagcctcaaatccctgggcccccaagacatcctcctgcctcagcttcacgagtagttaggactacagatgtgcaacaccactcccagataaatgggttttttttctttctttttttttttttttttgagacggagtctcactctgtaacccaggcaggagtgcagtggtgcgatctcggctcactgcaacctccgcccctccaggtttaagcaattctctgcctcagcctccgaagtagctgggattataggcgcgtgccaccacgcccagctaattttttgtatttttagtagagatggggtttcaccatcttggctaggctggtcttgaactcccgacctcgtgatccaccctcctcggccacccaaagtgctgggattacaggcgtgagccactgcctccggctggggttttgttatattgtccaggttgacctttaactctcggccccaagtgatcctcctgccccggcctcccaaagtgttgtgataacaggtatgaataaccatacccagcccacagcctaatttcttattacccaaatcattcagcattccttaagatatgggattaaatgaggtggaggtttttttttttttttttttttgtttgagacagtcttttttttattattttttttatttattattttttttaatttatttttttattgataattcttgggtgtttctcacagagggggatttgacagggtcatgggacaatagtggagggaaggtcagcagataaacaagtgaacaaaggtctctggttttcctaggcagaggaccctgcggccttccgcagtgtttgtgtccctgattacttgagattagggagtggtgatgactcttaacgagcatgctgccttcaagcatctgtttaacaaagcacatcttgcaccgcccttaatccatttaactctgagtggacacagcacatgtttcagagagcacagggttgggggtaaggtcacagatcaacaggatcccaaggcagaggaatttttcttagtgcagaacaaaatgaaaagtctcccatgtctactttctacacagacacggcaaccatccgatttctcaatcttttccccacttttcccgcctttctattccacaaagccgccattgtcatcctggcccgttctcaatgagctgttaggcacacctcccagacggggtggtggccgggcagaggcgcccctcacctcccggacggggcggctggccgggcgggggggctgaccccccccacctccctcccggacggggcggctggccgggcaggggggctgaccccccaccgaggtggaggttttaataagtaaatacacattgagaatcttctatccccttttgttatacatgagaggccaggaggcttgtggaaatccaacttttaagaaggtctagctgcctatatcgtcctgaagtatttgaggccatcagaagcactcagattctgctgactgaatggaaatactcttttagagacgtattaatttcaacttgtttccgatatatatatatccctatgtgttggcattacaggcatgagcgaccacgcccggctgtgtgtgtaatatctatcatagacccagtttttccttttactttctgtcccatttcgtgagactaggaagttactgggaagacagctcaggcacaaggaaggggccctcacaacttagactttcacaaaatcgttatacccatgagcctcagaactgcttccaaccaatttttagcacaaatacatatacacattgagataaaatgtcagaagagcactttctggaagatccataatcatgtcatctgggctttgctgaccttgaagaatagattgacagtatcaattttcaggggacttcactgatgtccacaatggtctgatggtgaatttgcccatgattataaaattaacaggtaatttcatacctccaaaagaacataaaatctgggtcaggatggctcatgcctgtaatcccagcactgtgggaggccgaggcaggtggatcacctcaggtcaggagttcgagaccaccctggccaacatggagaaaccctgcctctactaaaaatacaaaaattagttgggcatggtggtgcatgcatgtaatctcagctactcgggaggcagaggcaggagaatcgcttgaacccgggaggcagaggttgcagtgagccaagatcgcaccactgcagtccagcctgggcaacagagcgagactctatctcaaaaaaaaaaaaaaaaaaaaaaaagaacataaatcccctttctccagtttcaggaggaagtgatcccagacagacactctaggggctgttgtcccaggttctctcatttccatgcactcatgtgcaccatacgttaaaagatccacacagttagaaggggttttcttaagtaattaggactatggtctgagcaggaagaaatttggctccagggagctctccctcgtgacaagtccatctgcatgcctgggtgctctctgtaaggtttatttacatttacatttaatagaaaataaacattttggccaggcgtgatggctcatgcctataatcccagcactttgggaggctgaggtgggcagatcgtttgagcccaggagttcgagaccagcctgggcaacatggtgaaaccctgtctctataaaatatacaaaacttggccaggcgtggtggtgcacgcctgtggtctcagctacttgggaggctgaggtgggaggattgcttgagcctgcaaagtcaaggctgcagtgagccataactataccactgcactccagccaaaaataaataaagacaggccaggtgcggtggctcacacctgtaatcccagcactttgggaggccaaggcaggtggatcacgaggtcagaagatcgagaccatcctggctctactaaaaatacaaaaaattagctgggtgccgtggcgggcgcctgtagtcccagctactcgggaggctgaggcaggagaatggcgggaacccgggaggcggagcttgcagtgagccgagatcgcgccactgcactccaacctgggcgacagagcgagactccgtctcaaaaaaataaataaataaaataaaaataaataaataaataaagatttcatatatagccttttactaaataataaaaagaaaaaaaaacagaaaaaaaaggttcatctccttgctaatgaggatataaatgtcaaatagttcccacttcaaactgagtaggaagacaaaactagtcgattaagataacattagtggccgggcgcggtggctcacgcctgtaatcccagcacttggggaggccgaggcaggtagatcatgaggtcaggagatcgagagcatcctggctaacacagtgaaaccccgtctctactaaaaatacaaaaaattagccaggagaagtggcgggcgcctgtagtcccagctagtcgagaggctgaggcaggagaatggcgtgaacacgggaggcggagcttgcagtgagcccagatcgcgccactgcactccagcctgggagacaaatcgagactccgtctcaaaaaaaaaaaaaaaaaaaaaaagataacattagtgttgatgactacagagaacaatcatgtacaaacggaggatcaactgatacactccaccactttttttaagtttgtaaatttaaacttgaccaagatccagtaatttttttccaactaccagagaatttattgtgcgtttgcacttgcagactgaaacaaaaatagtaggagcattattttccacaaagcaaacaaaaacaaaaccgtgaaaaagtctaaacaccacaaccattggaacggatagcctgcagcttcagatactagcatatgagaaatatactgagaggtggccaggcgtggtggctcacgcctgtaatccctagcactttgggaggcctaggtgggtggatcacgaggtcgagactgagaccatcctgaccaacatggtgaaactccgtcgctactaaaaatacaaaaattagctgggcatggtggctcatgcctgtagtcccagctactcgggaggctgaagcaggagaatcgcttgaacccaggaggcggaggttgcagtgagctgagatcacaccactgcactccagcctggcaacagagtgagactccatctcaaaaaaataaataaatacacacacacacacacacacacacacacacacacacacacactgagaggtaaacaaatcaccacaaaattatttatttatttattttgaggtggagttttgctcttgttccccagggtggagtgcagtggcatgatctcggctcactgcagcctccgcctcccgggttcaagcaattctcctgtctcagcctcctgagtagctgggattacaggcacgcaccaccatacccagctaattttttgtattttagtagagacagggtttcaccatgttggccaggctggtcttgaactcctagcctcaggcgcgagccaccacactcggcctttattttatttttgagacggggtctcattgttgcccaggctagagtacagtggtgcagtcacggctcacagcagcctcgacttcccgggctcaagcaatcttcccgcctcagactcctgagtagctgggactacaggtgtgcatcaccatgcctggctaattttttcattttttgtaaagatgggtctcactatgttgcctaggctccaaaaaaccctttaagtgtaattccattaatactcattaaatgttcaaaggaggcaaaaatttaaaaatacaatacttgtgaaaaagaatagatggttggtggacgtggtggctcacgcctgtaatcccagcaccttgcaaagccaaggtgggtggatcacctgatgtcaggagttggagaccagcctagccaacatggtgaaactccatctctactaaaaatacaaaaattagccgggcatgatggtgtgcacctgtaatcccagctacctgtgaagctgaggcaggagaatcgcttgaacccagtggatggaggttgcagtgagctgagttcttgcctctgcactccagcctgggcgacaaggacgaaactctgtctcaaaaaaaaaaaaaaaaaaaaagcaaaatttagccctgtatgtggcacgcacctgtagttccagctactcagaaggctgaggtggtggttgtagtaggctgagatcatgccactgcattccagcctggtgacagggtaataccctgtctccaaaaaaaaaaaaaaaaaaaaaaaagagttccagcaggtagaaaatcagaaaggacaaagtttagttgaaaggcaacaactgggtttaattaaaatccatgaatgcttcatccaacagaacaacacacattcttctcaagttcatgtggaacattcaccaagataaaccatgttgtggacaaaaacacaccttaacaattttcaaagaatatacattatataaaatatgctctcagaccaccatggtattaatctagaaatcagtaacagaagaatagttagaaaaccatcaaatatttggaaataaaacccaacacagttctaaacatgaatcaaaaaaatctcaagaaaaattaaatttgggccgggcgcagtgactcatgcctgtaatcccagcactctggggggccaaggtgggcggatcacgaggtcaggagttcgagaccagcctggccaacatggtgaaaccccatctctactaaaaataaaaaaattagacaggcatggtggcacgtgcctgtaatcccagctacttgagaggttgaggcaggagaatcgcttgaacccgggaggcggaggatgcagtgagccaagactgcaccactgcactccagcctgagtgacacagcaagactccgtctcaaaaaaaaaaaaaaaagaagaaaaaagaaaaattaaatgtgaattaaatgaaaatagaacttatcaaaatttgtggaatgcaacaaaaatagtacctaagtgaaatttatactattaaactctcatacacccacaaaaaatttatacatggatcttacacctttcacaaaaattaagcccaaatcgatcatagatgtaaatgtaacatgcaaaactatccacttggctttggtgatgaatttttagataaaccactaaaagcacaatctatgaaaggaaaaaataagtttcacttcattaaaatgaaaaactcctactctgtgaaagaaagtgttaaaagaataaaaataaaaggcacagacagatttttgcaaatcttcacaaaagcacttatctgattaaggactagtatctaaaatatccaaagaattctttttgtttttctttttttttgagacagtcttgctctgttgcccagggtggagtgcagtggtgcaatctcggctcactgcaacctctgcctcctaggctcaagcgattctcatgcctcagcctcccaaatagctgggactacaggggtgtgccacccacattgggctaattttttttctccgatcccttggcagctccagccccagcaccacttctcagctctgctccccagcagcctgggtggccccacatgagctaccatgcctagcgtcctttttgtttttttgagataggatccattatgttgcccatgctgggcttataatcctgggtgcaggcaatcctcccactttagcctctggagtagctgggatgacaagcgtgtaccaccatgcctgcctccaattcgaactcttaaatctcaacaaaaataagacaaatgaaccagtgaaaaatgagcaaaagacctgaacacacccctcaccaatgaaagatatacagatggcaaatacacatatgaagagatgctcaattatatgtcactaaggagctgcaaataaaactgaagagatatcactttacacttattagaacgtacaaagttcaaaatgctgagaacagcaatggatagcaaagatgtagacaacaagaattctcattccttgccaatggaaatggaaaatggtatgtctactttggaagataggcagtttctaacaaaacaaaacgtcctcttaccagtggaccatgcaatcacattccttgctatttactcacatgagttgaaaaatactgttcatacaaaaacctgcccatgaatatttacaggaggtttcttcataactgccaaatttaagacttaaccaagacatcatgcaacaggtttatggataaacaatctgtggtacaatcttttttttttttttttttttgagacggagtcttgctcttgttgcccaggctggagtgcaatggcactatctcggctcactgcaacctccaccttccaggttcaagcaattctcctgcctcagcctcccaggtagctgagattacaggtgtgcgccaccacacccagctaatttttgtatttttagtagagacggggttttgtcatgttggccaggctggtctcaaactcctgaccttgtgatccgcccgcctcggcctcccaaagagctgggattacaggcatgagccatcgtgcccggccggtacaatcttatgatgaaatattgttcaacgataagagaaatcaggtatcaagccatgaagacacagaaggaccttaaaagtacattgctcagtgaaggaagccaatctgtgaaggctatatcctgaataactccacgtgtattacattctggaaaatataaaaccttaagacagcaaaagtatctttggatgtcaagaaattgtgggaggccatgcgctgtgggaggccagggcgggagaagtgctcgagcccaggagttccagaccagcctgggcaatatggcgaaaccccatctctacagaaaatacgaaaattagatgggcattgtggtgcatgcatgcagtcccagctactcagaggaggcaggaggatcacttgagcccaggaggtggaggctgcagtgagcaatgatcacatcactgcactccagcctgggcgacggagtgggaccctgtctcaaaaaaaaaaaaaaaaaaaaaaaaagttgaacataggagactaaggtgggaggacggcctgaggccaggagttccagaccagcttgggcaacagagtgagacgctgtatcaaaaaaaaaaaaaaaaaaaaaaaaaaaaaaaaaaaggccggacgcagtggctcacacctgtaatcccagccctctgggaggccaaggtgggcagatcacctaggtggggagctcaagaccagactgacaaacatggagaaaccccatctctactaaaaatacaaaattagctgggcatggtggcgcacgcctgtaatcccagctacctgggaggctgaggcagaagaatcgcttgaacctgggaagcggaggttgcggtgagccgagattgtgccattgcactccagcctgggcaacaagagcaaaactccgtttccaaaaaaaaaaaaaaaaagttaaacatattccccagcttggacccagactctcccagcttgaaaaacgtaaccccggcctggcgtggtggctcacacctgtaatctcagcactttgtgaggccaaggcaggcagatcacctgaggtcaggaatttgagaccagcctggtcaacacggtgaaaccccgtctctactaaaaatacaaaataaattggccgggcctggtggcacacacctgtaatcctagctactctggaggctgaggcaggagaatggcttgaacccaggaggcggaggttgcagtgagccgagatcgtgccactgcactccagcctgggcaacagagtgagactcggtctcaaaaaaaataaaaataaagaaaaatgtaacccctagagtgggtcagtacctggtaatggaggatagaagcacctgatcagcaaggaactatgggagctccacacctccttctctcctatggcagcaaagaaacattagcttccctaggtttccgttttcccaagtgaggaaactctcaaccagattgagattgaggttctgatgcaaatgagctccccaattcattaaccctgtctctaggaaacataagtcctgaccttcacagacactgtcaatatgcaccaattacacccagtacacctatattacggaagtgaaactcaaaacgtaatgtctaaaaacacacccaaggaaaccacaattaaaacctcagacatcctcccctcttcccctaacagcatctgcctgtgcatcctcagcttccaagtgctctgcagtttctttcagtacaagaggatccttccatggtgggcatatgagtagctggcagacctgtaggggaggctccccaggaagaaccaattgggccttcaatgatctttctttgcaggctcaaaggtggacttagcttggaatcacttatctcaggcctctgctccccagtcacaaggctctggaacactactagtaattttaaatgagacaatttaattaaattttttttttgttttgagatggagtctcaccctgtcacccacgctggagtgcagtggcgcgatctcggctcactgcaagctccgcctcccaggtccacgccattctcctgcctcagcctccagagtagctgggactacaggcgcccgcctccacgcccagctaattttttgtatttttagtagagacggggtttcacaatgttagccaggatggtctcgagctcctgacctcgtgatccgccctccttggcctcccaaagtgctgggattacaggcatgagccaccgtgccgggcccttaaattcttaaggattgttccttaaacatccagcagaaggcctggcacgatggctcacacctataatcccagcactttgggaggctgaggcgggtggatcacctgcggtccggagttcgagaccggactggccaacatggtgaaaccccgcctctactcaaaatacaaaaaaattagccgggcatagtggtgtgtgcctgtaatcccaggtacttgggaggctaaggcaggagaatggctgtcaatatgcaccaattacactcagtgtacctaccttacagatgtgaaactcaaatgtaatgtctaaaaacacacccaaggaaaccacaattaaaacctcagacatcctcccctcttcccctaacagcatctgcctgtggctcctcagcttccaagtgcggaggttgcagtaagccaaaattgtgccactgcactccagcctgggcaaaagagcaagacttggtctttaaaaaaaaaaaaaaaaaaaaaaatccagcagaattacttaaacacagtgtttacgtataaaggaagcaaaaggcctggcgtggtggctcatgcctgtaatcccagcattttgggaggccaaggcgggaggatcatgaggtcaggagatcaggagattgagaccatcctgggaaacatagtgaaacactctctactaaaaaaaaaaaaaaaaaatacaaaaattagctgggcgtggtagcttgtgcctgtaatcccagctacttgggaggttgaggcaggagaatcgcttgaacccgagaggcagaggttgcagtgagctgagatcgtgtcactgcactccagcctggcgagaaagctagactccgtctcaaaaaaaaaagtaaataaataataaataaataaataaataaataaataaaggaaggaagcaagaaaattttaagccatttaacaagaaaacccactattgctttcagaaaatgagaatgttgggccggtaatagtagctcatgcctggaatcctagcactttgggatgctgagggtggaggatcgcttgagcccaggagttcaagatcagcctgagcaacacagccagaccccatctgttaaaaaaaaaaaaaagaaaataataatgtcagttaattatttccatggcaataaatagtttacaaaagtattacttctatctgaatgcttctagatgttgcaagtttaagtcctggaataccatctgaaacatcaaactaaaagaacagacctgagaaacatattccatgtgctcagggaaagaacaaagaatttttaacaaatgtaatattgggatgttttttgttttctgagattcatttcttttttgccctttggaaatattttgtactgtctctcaagttcttctgataacatatattttatatttattggaaaaatgacattcgagtgaataaatcttttcaaggtcataaacccaaggcgggacagtgccaatctgaaactgtgctgaaaagatagattacccaggaaagtttacaaaaaggaacctcaacgcaaaggagttcccataggatgtctgtgccctggaaaggtaccaggatgagggccacagcattttatgcagattagttccaagtgaataatttttctgatttttctctgatgtaaaatatccacaaacaagaaataaatcgtttaaaagaggcatctattggaaaaaagattattaaaatactgcgtgtgtttgaaatgcaccacacaggacaaagagttggtgacgatgttttccactggcgagcggaagtaggcgtttgggaattcggggagggatccggaaatctagggattaatggcccgccgtgggaggagctaggctggggggacagggtagtggatttgagactctgcttccaacatctttggaagactcagggggaaacagcctttgggaagaaagaagggactgggaaccccagactgtagctcctcccacacaaaccaaacacacaaggcgggattctccccaggaccctcccgtggtccctgcacgatctgggaaagacgcggggctgcgggcgcggagttgtccagagagggctccggggctgggaccgcagtcgccgcgcagggacgggacaggacgcttggagttccagctgccagcccagccccacactgcggccggaggtgaccgtggggaggcccgggtcccgcgatcacggccggttccaactagtccggccctgcacactcaccattttccggcctcgcgggtgtcccggtgttgtccctaaggttcacggagccagcgcagggtacagcgcatccgatgcaggggtacagcaacctgacgcgtcaaggggccaggagaccccaagctaagcacaacccgatcgcacagtgacgtagcacgcatttgcgcagcgtagccgtaccctcctttccggcgccgcccctgattggacaattatacagccccgcccctttttgtccgaatgacagctaggcagcaggtctagtagctaggcagatctcgcttccgccggtgggacggaactggtgccctccgtggacaattgtgttgaagcagaaattgttccggatctcgggtcggacacggaagtcttcctgcagtgtttctggatgcggggacagggatgcgcaggaattccagtctcagtttccagatggagcgacccctcgaggagcaagtccagagcaagtggtcgtctagtcaaggccgcacaggaacaggagggtctgatgtcctccaggtaccaggggcttggcataatgttgtaaggcctctcgtggaatagtgacccttgtttataaacagacggttaccccatcatgtgtaataaaaagtgtggttgcattttaatctttgaccataacagcgttgaggcgtccacctttcttttccccacctccacacatttggcactttagaaaaggaaccccaaggcagggcttggtggcgcacacccgtagtcccagctactgcgtggtgggggcggtgggggaggtcggggggtgggtgggctgaggcgggtggatcgcttgactccaggagtttgagttcagtctgggcaacatggccagaacccatcccaagaaaaaaaaaaaaaggaaagaaagaaaaaacaatccgtaggacacccgagcacttggctcgggtggtaaattgcaaccctaacctgggcacagggactcttcagaccaatcacgatctatgagacgtgctcagtaaactgcgttttactctggaaggaaatggtttgttttcgttgtttttttgtttgtttgtttttagtttaagcatgtttttattgcttttcatttttatttttatttttgtagatttatggttacaaatgcacttgtgttacgtggatatatttcatagtggcgaagtctggcttttagtgcacccatcacccaaagagtgtatattgtacccaataggtaatatttcatccctcatcccccctctctgtccaacctattggcatctccagtgtctattattccattctgtatgtccatgtttacccattgtttagctcccacttatatgtaagaagatgcagtttttgactttctgtttttgcatcatcgcacttaggataatggcctccagttccatccgtgttgctgtaaagtggaaggaaatttatctcaaataagttttctaaagtgtccctacagaacttggaaagaccaagagcccaaaaccagcctgggcaacatagcgagaccccatttctcaaaaaatttttaaaaattagctgggtatggtgttcacctgtagtcctagctccttcggaggctgaggcagaaggatctcaaggctaagagtttgaggttacagtgagccaagattgtgccactgcattccagcctgggagagagagagactgtctctaaattttttttttaaagtagaaacatatttcatttttcccattatagaggagacagtgtaatcttgaaaactcccatgatccacccttctggtagctctgtgtgtacaggtagatgcagggggaacaatgcttccaaggctgtcaaaggtcatgtttagttctaaattgctgaaactcacaaaatgcatcctcttgtttctaattagatgcagaacagtgaacaccatggacaaagcatcaagactcaaactgtaagtgagatcgctacctgtcagcgtggctaccttccttgtttataatgaccatttgggtctgtccttctatgacctctttgtgggggggtctttcgggtctttgtgaaggcactcccatagtcaaggccaataaccaggctctcaggtatgtcctgttcattgccctcaccctgtacttccattgtcccttaccttcattggccatcccaacacagccacctgcatcctttggaatatcacatttgggctgggtgcagtggctcatgcctgtaatcctggcactttgggagactgaggtaggaggattgcttgagttcaggagtttgagaccagtgtgggcaatgtagtgagactctgtctctacaaaaaataaaaaaaatggctgggtgtagtagctcatgcctgtaatctcagcactttgggaggcaaggtgggtggatcacttgaggccaggagttggtttccaacctggccaacatgctgaaacctcatctctattaaaaatattttttaagttagctgggcatggtgggaggcacacctgtaatctcagctacttgggtggctgaggcatgagaatcacttgaatctgggaggaggaggttgcagtgagctgagatcgcgccactgtactccagcctgggcaacagagtgaaactctgtctcaaaaataaataaataaataaataaataaatacataaataaataaagataaaaaattagctgggcatggtggcatagtcccaggtcctcgggaggctgagacgggaggatggcttcaacctgaggctgcggtgacctgtgatggtgccactgcactctagcctgggcaacagagcgagaccctgtctcaaaaaaacacaaaaaccacaaatttggagtcatgtttacttgtttgcatagtttggacaaaacgatcactgcagttctgaccttcaaggtaaacatgcaagagacggataaggcacgggttagtgtcgggggtacctaattttgtcattgctatcagttccctgatctaagtgactctgtaatcccaacactttgggatgctgaagtgggaggaatttcatggggaatgactacagccttcatgcatgtggatacataatctgagcctgaatatgtcatcttcacataaaaccacgatttggttattgactgttctgtgaatcctgggttccttggctcatgggagcttcaatgtggcttttctggccaggaacttgcctgacattttcaataagccaatccttaagttcagcatgctggtatttttcagtgtctgggtcaccgtccttcctgtctaccaaaacccgaaatggggaagctatcaatcctggcctccactgatttgctgctgcttctctgtctgcagatgctatgctgttcttgtttgttccttttttttttttttgagacagggatcttgctgtgttgcccaggctggtctcaagctcctggcttcaagcaattctcctgcctcaacctcccaaagtgcagggattacaggtgtgagtcactatgcctggcctgagttttcagtttttgacagtgctcagtatatgtggtggcacacatttggactttaatactgagaagttccattattattactgttattatattgtattactattactattatgttctgtcacccaggctggagtgcagtggcaagatcacagctcactgtagactcaacttcacaggctccctagtagctgggactagtagctggaactaggactaggtgtgcgccaccacgcttggctaattttaaaaaaattctttttttagccaggtgtggttgtgcacatctgtaatcccagctatttgggaggctgaggcaggagaattgcttgaacccagaaggtggaggttgcagtgagccgagatcatgccactgcactctagcctgggtgacagagtgagactccacctcaaaaaaaaaaaaaaatttaaattttttaaattttagagacagggtcctgctatgttgcccaggctgatcttgaactcctggactcaagtgatcctcccacatcagcctcccagtgttgggatggtaggcgtgagctaccacacctggccaatttcattattacttatgagccatatgagtttagacaagactttgtgctctccatacttaacttttttcatttgcaagatgggaggtatgattgggtggggctaatcaaatgaaatactaatgattatgaaatcacattagtcaccacagtgatgtgcaaacataaattattgaaatattgaataaaaatgggattttatttgttctttagtaaaacacaaagctgttcattttttttctttcctaacatgtgctggaaatctaccatatggaaatgatacttgtgaatggtcatggacttttaggcctttgctgatcattaaaataaaaatcttccagtgattccttttataaaaggacatcaaagcctgggcaacagagtgaaatcctgtctctataaaaataaaaaaaattggccaggtgcagtggctcacacctgtaatcctagcactttgggaggctgaggtgggtaaatcacttgaggtcaggagttcaagaccagcctggccaacatggcgaaaccgcatctctactaaaatacaaaaaattagcggggcatggtggtgcacacctgtagtcccagctactcagcaggctgaggcagaagaattgcttgaactcaggaggcagaggttgcagtgagctgagatcatgccactgcactctagcctgggcaacagatagagaccctgtctcaaaaaaaaaaaaaaaaaaagaattacccagggtggtggcatgtgcctgtagtcccatagcagagatcccttgagtccaagagttggaggctacaatgacctatgattgtgccactgcactccagcttgggcaatagagtgagtctctgtctctaaaatgaaaaaaaaaaaaaatcctattttaggccaggcgcggtggctcatgcctgtaatccctgcactttgggaggccgaggtgggtggatcacctgaggtcgggagtttgagaccagcctgaccaacatggagaaaccctgtttctactaaaaatacaaaattagcgggacgtggtggcacatgcctgtaatcccagctacttgggaggctgaggcaggataattgcttgaacccgggaggtggaggttgcggtgagccaagatcattgcacgccagcctgggcaacaagagcaaaactctgtctcaaaaaaaaaaattaaattaaaaaaaaatcctattcgagggtctcaaatacacttttcttaaagggataggaaaaccattaacaaaatatttaacagaatacttcacttctggtccaccaataaccacttctcaagcagacaccagctgggtgtgctatataattcaatttaattgtgacagtatctacctggagacggagtccaataccaaaagctaacggctcacaagaatgcccctcactgcaaatgtcagttgtaagtcccaggatgtgacctatgcttctgaccaacaagctgtaaatcagggttttcatgacccactctttgggtttgattaatttgctgtagcagcctacagaactcacagaaacactttacttacattcacccatttattacaaagtgttttttttttttttaatagagcagggtttcactctgtctcccaggctggagtgcagtggcaggatcatagctcattgcagccttcaactcttgggatcaagcgatcctccctcatcagccccgcaagtagctaggaatataggcatgtgccaccacactcaactaattatttattttttgtaaagttagggtctcgctctgttgtccaggctagtctcaacctccaggtctcaagagatcctcccacctcgctcctctcaaagcactgagattataggagtgagtcactgtgcctagtcttacaaaggatattttattatttatttatttgtttactctttattttgagacagggtctcactctgttgccaggctggagtgtagcagcacgatcttggctcactgcaacctccatctccagggttcaaatgattctcgtgtttcagcctcccgagtagctggaatgacaggcatcctccaccacgcccagctatttttgtatttttagtagagaaggggtttcaccatgttggccaggctggtctcgaactcctgacctcaagtgatccatctgccttggcctcccaaagtgctggcattacaggtgtgaaccactgcacccagcctacaaaggatattttattttatttattattattattattttttttttgagacggagttttgctcttgtcgcccaggctggagtgcaatggcgcgatctcagctcactgcaacctctgcctcccaggttcaagcaattctcctgcctcagcttcccaagtagctgggattacaggcgcccaccaccacgcctggctaatttttttttttttgagatagagtctcactcttttgcccaggctggagtgcagtggcacaatcttggctcactgcagcctctgcctaccagggtcaagtgattctcctacctcagtctctcaagtagctggattacaggcccatgccaccatgcccagctaattttttttctgtgtgtctatgtttttagtagaggcagggtttcaccatgctggccaggctggtctcgaactcctgacctcatgatccgcccaccttgtcctcccaaagtgctgggattataggtgtgagccactgcacctggcctaatttttgtattttaagtagagatggggtttcatcatgttggtcaagctggtcttgaactcctgacctcaagtgatccacctgcctcagcctcccaaagtgctgggattacaggcgtgagccaccacacctggccctacaaaggatattttaaatgatacgaatgaacagccagatgaagagatacctccaggcatatggttatgttcttatttaccaaccagaaggctctctgagccgtgtttttgggtttttatggtggctttattatggtgacatgattaatcacatcattcactatgggtgatcaactcaaccttcagttttctcttccctccctggaggtggggacagagctgaaagtttcaaagctccagtcacatggttggttccctggcaactagcctcacatcctgtggtttgtaggagctttccaaaaatcaccccattaacataaacttagctgtggtggaaaggggatggttatgaataactaaagacatttcttccacctgtcactctggaactcttctagagctattttaagaactgaatacaaaaggccatttttttttttttttgagatagggtctccttcactctgtcacccagtgacagtggcacaatcttggctcaatgcagcctccacccccgggttcaagcaatgatcccaccacagcctcctgagtagctgggactacaggtgcacgccaccacatctggctatttttttctatttttagtagagatgggttttcgccatgttgcccagactggtctcaaacacctgagctcaagcatccacctaccttggcctcccaaagtactgggattacagatgtgagccccagcgcccagccttttttttgttgtttgttttttgagacagagtcttactctgtcacctaggctggagtgcagtggtgtcatcacagctcactgcagccttgacttccctgagctcaggtgaccctcccacctcaacctctcaagtagctgagactataggcacacacccctatgcctggccaatttttgtattttttgtagagataggatctcactgtgttgcccaggctggtcttgaactcctgggctcaagcatcctgcctgcctcagcctcccaacatggtgggattacaggcagcccaaatattttaacaaaagatactccaattgctctagtcgcttaggaaattacaaggtttttagcaactgtgagccaggaaccctggacaaaacccaaattatatatttcacaatatcacaactttcttttccaccaaactggggggtggtactcaaaatgataccctctctctgcagtttgattcaattataacttggatattctctaagaatccatagttcttgtctgtgtgtcaactgggaaatcactgtggatttgaataagtactctgcacataagaaaaacccatgatggggccaggtgtggtggctcacacctgtaatcccagcactctgggaggctgaggcaggtggattgcatgagcccaggagtttgagaccagcctggccaacatggcgaaaccttgtttctactaaaaatacaaaaaactagcccggcgtggtggtgcgcacctgtaggcccagcttctcgggaggctgaggtgagagaatcatctgagcctgggaggtcaaggctgcagtaagccgagatcacaccactgtactctagcctgcataaccatagtgaaaccttgtctcgacaaaaaaaaaaaaaaagaaatatacatgatgggctgcactgtgtagatgaccattaccctctaggaagacctcagtggttttctttttttgagacagagtcttgctctattgcccaggttggagtccagtggcatcatctcggctcgctgcaacctttgtctcctgggtttaagtgattctcctgcctcagcttcctacatagttgggactacaggtgcctgccaccatgcccaactaattatttttatttttttggtagagatggggtttcaccctgttggccaggctggtctcaagttcctgacctcaggtaatcctcctgcctcggcctcccgcagtgctgggattacaggcgggagctaccgcgccagccaaaggttttctgatatacaatttaatttatgtcacccagtctccagtagcagcaaaattttcatatcaaatacatgaggcaattcagacatagagatcaatggcatgaaattgaaattccagaaataggcccatatatgtgtgtgtgtgtgtgtgtgtgtgtgtgtgtgtgtgtgtgtgtgtgtgtatatagtgaactgagtttcaaaaacggtgccaggaatcgggaaataatattattttctttttttacttttttcttttttttttgttgagtcagagtcttgctctctcgcccaggctggagtgcagtggtgcgatctcggctcactgcaagctccgcctcccgggttcacgccattctcctgcctcagcctcctgagtagctgggactacaggagcctgccaccaagcccggctaattttttttgtatttttagtagagacagggtttcaccatgttagccaggatggtctcgatctcctgacctcgtgatccgcccgccttggcctcccaaagtgctgggattacaggcctatgccaccgcacctggcctagaatattattttcataaattggtgttgtgacagttggatagacatacaaaaaataataaaattgggccgagcacagtggcatgatcatctgagtcctggagttcaagaccagcctgggcaatatagtgcaacctcatatcttataaaaaaaaattagccaggtttgtggcatacacctgtagtcccagctgcttgatggctgagggaggaggattgctggagcctgggagttttggctgcagtgagctatgattgtaccactctagtctagcctgggtgacagagtgagaccccaattctttgtttttgttttttttttttcagacggagtcttgctctgtcacccaggctagagtgcaatggcgcaatatcggctcattgcaaccttcgcctcccgggttcacaccattctcctgcctcagcctcccgagtagctgggactacaggtgcccgccaccacgcctggctaattttttgtatttttagtagagacggagtttcaccgtgttagccaggatggtctcgatctcctgacctcgtgatctacccgccttggcctccgaaagtgctgggattacaggcgtaagccaacgcacctggccttttttttttcttttttttttgagacagggtcttaccctgtctccctgactggaaagctgtgagcctcagctcactgcagtctctgccttccaggctcaaaggatcctcccacctcagcctcccaagtagctggggctacaggcgtgcaccaccacacctggctaatttttgtattttttggagagacaggttgtgtcatgttggccaggctggtctggaactcctgggcttaagtgatccacccaccttggcttcccaaagtgctaggacaagagtcctgaacattttttctctattctgatgtcacaatctccaaagttatctaaaacttgcattcaagagcacctgttagagctttatagctgattataaaaccaccttctaaagaggaccaagacaagacaacaattatttatggatgacaaagttttagggtagccatagctaaagacacaattgacaaggaaatctgttactctgtggcacacaataatttaacataataattataattattactgataacatacactgatatatcagaattacaagagttttccatcattttggaacacataccaataacatatatatacagatatagtccaaagaaagccatactccattttatatttgactttgcttcctctatgatttttgtaccaaataagccaaatttcacatttacattagtatactattactgttaaacccaattcttttcttttctttttttttttgagacagagtctcgctctttcgctcaggctggagtgcagtggcacatctcggctcactgcaacttccacctcctgggttcacaccattctcctgcctcagcctcccgagtagctgggactacaggtgcccgccaccatgcctggctaattttttgtgttttttttttagtagagacggggtttcaccatgttagccaggatggtctcgatctcctaacctcgtgatctgcccgcctcggcctcccaaagtgctgggattacaggcgtgagccacggcgcctggcctaaacccaattcttaataaaaccttatagacatatttacccaattttatagacatatttacgccaatgtttggcaatttttatagattttttattaccctttacaatttttgttaaagagcaggttagtgttctaaaagaaagccgttgtgcttttattttaatattcaatttacagaaaaactggataataccccctttaactttagccaatatgtttacacacagaatttcttttacaatcaaccttccacaacttgcttaaactttcagctttattttatctaatttaatccattaaccttttatttaggcaaaaaaaatccacattcccatgccttcttataatctttttaccaaaagtatactctactttccttacacaccttgcatgtaaaactgttttttccagtagtctcaattacatgttacaatattgattcttagcaacttttacttttggtgaaaaacctggtaagtgattttaattatggaccaggtggggagcctaggacctagacagaagtgcagataaggtctgactcattctagcatctaacttcttgtgtcccaggccttccctagctgtaaagcaggcagttgtacagttaagagtcataatggcattttatgaagcattcaggaggcctaaacacctttaaattctacaacatttcttccataagttccctttcataaattctttcatgacttacactctatgatatgccttgactttctgacttgtcctaaacatccctctttttaaacaaccagtcatttttctttaggacaagaatctatcatacaagatccttttttatataaaatatcttttctttatgctttttttaaccaaaaatacttatttatttttataactttctttatgtctctttttttttcttttctttctttctttttttttttttttttttttttgagacagagtcttgctctgttgcccaggctggagtgcagtggcgtgatcttgggtcactgcccaggttcaagcgattctcctgcctcagcctccagaatagctgggatcacaggcaccccgccaccacacccagctaatttttttttttttttgagatggagtctcgctctgttgcccaggctggagtgcagtgatgcagtctcggctcaccgcaacctctgcctcccaggttcaagctattttcctgcctcagcctccctagtagctgggactacaggtgcgcgccaccatgcctagctaatttttgtatttttagtagagatggggtttcactgtgttggccaggctggtctcgaactcctgacctcatgatccgcctgcctcagcctcccaaagtgctgggattacaggcatgagccaccgcgcccggcagaatcctgggttttaaaaagggagaattattgacgggcatggtggttcaggcctgtaatcccagcactttgggaggccgaggcgggcagatcccaacctaaggttgggagttcgagaccagcctgaccaacatggagaaaccccgtgtctactaaaaatacaaaattagccgggcgtggtggctcatgcctgtaattccagctactcgggaggctgaggcgggagaatcgcttgaacccgggaggcggaggttgcggtgagcggagatcacgccactgcactccagcctgggcaacaagagagaaactctgcctccaaaaaaaaaggggagaattattatgaggctagatcatgtgatgcttttacagtgcacttaacaattttttttcccaaagacatttctaagtgtctaaaccacactttttcttaaaatcctgagtagcttctgttgcaatagctattttttttaattgttgttttttttgagacagagtctcgctctgccaccaggctggagtgcagtggcgcgatcttggctcactgcaacctccgcctcccaggttcaagtgattctcctgcctcagcctcctgagtagctgggattacaggcgcgtgccaccacgcccagctaatttttgtatttttagtagagacagggtttgaccatgttggccaggatggtctcgatcacttgacctcgtgatccgcccgcctcggcctcccaaagtgctgggattacaagcgagagcctccgcacccggccggaatctatatttcttaatttttaatttttaattttgtagaggcgggttcttacagtgttacccaggctggtgtgaaaatcctggcctcaagggatcctcccgaagtgctgagattacaggcttgagccaacgtgcctggcctttaaatgtcttaaaaggaagtaaattctgacacatgctacaacatcaggaagattgaggacattatgctaagtgaaataagtcagtcggaaaaggacaaatacagaataattccacctatatgaggtacccacagtgaaattcacacaatcaaaaagtcgaatagtaggtgtcaggggctgagggtgagcggtaaatgggatgttattcaatcaataaagagtttcaaatttgcaagattaaatcagttctagagattggtttcacaatgtaactacacttaacactactgaataggccacttaaaaatggacctcgggcaaagaacaaattcctcttacatgcaaatatccccgccgggaaaacccactctgggaagctagctcggctcaaccacgtgccctcctgcatggctgtcactcaggggtcagggggcgggggcacacaaactgtccagtcagcatcggtgttgaaaaggcgcttgcaccctagctctgaatgcgcgtgtgaacatccttattctagcggttcgctaggattgcgtcccagcctcggactgtctgtggctctgcgtatgctttgtctcactgggacctgcaggtagtgagggatccgtagggaggactcctggagcctccgtaagccgagaaatggtgagtgtgcggggccgggagtcccgagacctgaggaggggacttgtcggaaccggctatgggaagacccgagtccccctggcgcagctgacccgagggtctcccagcagcgtggggctgggccggcagctgggacctcaggcgttctgtcccgtccctgcgattgcggccccggccccggagccctttccgggcagctgggcgcccccagccccgcgtctccgaagattgtgcaggggccacgggaaagtcatgacggattctcgtgtgtttgagaatccatttgggtcagaacattaaggtgaatccacctgtgagaattgaagcctggaggagggaacattttttttgcagctaggggagaggagggcgtgtggagctcccagagttcgttcctgtggctgctcagatgcccctgctgtcatcaccaggcactgacccactgtctgggctaccgctctcaagtttgggaatttgtttgtttttgacacggtctcgcagtgtcgcccaggctgaagtgcggtggcgccatcaaacctcactgcatctcaagcgatcctcccgcctcagcctcctgagtagctgggactaaaggcatctgccactactggctaatttcaaatttttattttgtagatacagggtcttgctgtgttgctcatgctagtcttgaacgcctggctttaagggatcctcttgccttggcctcccaaaatgttggtattataggcgtgaccatgcctggcccttgtgaatgtatttacctttcgattgtgagttttccattttaacggtggagaagcaattccttatctaaacagattaaaacatttgcgtttctttcccttggattccttgatcaaatcacttttttttttttttttgagacggagtctttctctgtcgcccagactggagtgcagtgacaccatctcagttcactgcaacccctgcctcccaggttgaagcaactcttatgcctcagcctcctgagtagctggtattacaggcgtgtgccaccacacccggcccatttttgtatttttagtagagatgggattgcatcttattgaccaggctgttctcgaactcctggcctcaagtgatctgcctgcctcagccttctgaagtgctgggattacaggtgtgagctgctgcgctggcccaaatcacctttttttctttttctttttttcttttgacagagtcttgctcttttgctcaggctggagtgcagtggcatgatcttggctcactgcaacctctgcctcccaggttcaagcaattctccctgcctcagcctcctgcgtaactgggattacagtcacctgccaacacactcggctgatttttgtatttttagtagagatggggtttcgccaggttggccaggctggtctcaaactcctgacctcaggtgatccacctgcctcagcctcccaaagtgctgggattgcaggtgtgagtcgccacacccagccctgaaaccttttaatgccaccagttccatgggtgaggcccataacctacaatttgaggttttctggaggaaaaaaatatattaataaatattaaggtaggaagataaccggaagcatatcaagtgaccacagaaacaaaacagagaaagattaaagaaggaagggcacaaaagaaaaaaaaatgaagcatttttctaggttttgacctaattgcaactccaaaatatagtaaaagaattatgcaactaaaaaaaaggctggacatggtggcccacacctgttatccaaacactttgggaggctaagacaggcgggtcgggagctgaccaacatggagaaacccccttctctactaaaaatacaaaattaactgggcatggtggtgcatggctgtaatcccagctactagggagcaggagaatttcttgaacccgggaggcggaggttgtggtgagccgagatcacacccttgcactccagcagggacaacaagagcgaaactcggtctcaaaaaaaaaaagagagagaaaaggacactgcatgtgcttggctttcaggcctctccgacattagttctgaattttattattttttaaatcatatatatatatttctggtttcaaactcctgggctctagcaatcctcctgccttggcctcccaaggtgctgggattacaggaataagccaccaggcccagcctagttctgaattaattttaacatctctgtaatgcactaactgacaatcattcatgggattaatcaatcctaggaatcagctatatctggagatcccactaaatgtaagcaaggtacactgattgattgatggatggattgatggagtcttcttcctctgttgcccaggtgggagtgctgagacagactctcactctgtcgcccaggcagaagtgcagtggtgtgatctcagctcactgcaacctctgcctactgctgttgttcctgttggcacccacaacatcatttgggcttttttgatgttcaggaggtaacacagtcctttataaagtttacttaagcccatttatgctgtgacttgcaaattggtcatcattgcccggatatcgctaccacagaggctctagacactgtttaagttgccatatggcaggcactcctgttagtgcctccagagcactatagatgctctttttttcttttcttttctttttttttttttgagatggagtcttgctctgtctcccaggttggagtgcagtagcaaaatctcggctcactgcaacctctgcctccctggttcaagcaattctcctacctcagcctccagagtagctgggattacaggtgtgcaccaccacacccagttaatttttgtatttttagtagagacggggttttaccgtattggccaggctggtctcaaactcctgacctccagtgatctgcctgccatggcctcccaaagtgctgggattacaggcatgagccaccattcctggccactatagtggctttagaaacctcctctcatgcctcttgtaattatccatgatgaccataagttgtccatagggctctgatgcaagaaacagcccttggccccacactatatgccattagagctgcaatgatcaccttgtactaggttatcctgaacattgaggctctcctgggccctgggcatgtgactctactcaactgctcattttgccatgggtcctagaaacagcaacctacacagacctcctttcaaaattacagagtcaaatgttagccttcagcatatcctctctgcaggagttggggtgggagggtgacttcttttctttcttccttgccagatgtcatggtgctggaggaggtctaccttctcctagatcctttgctactgagtgaacagcagtggcgagtgtgtagacttgatggctgacatggccacatttgtacatgttggagctgctgctttttatcccttaattgaaatggacctaataaaggactagattcaaggggcagttcatcagttagtcatcttagcagtggccaacaataaatcccatctgcacatgtttacacactcttgagtgattgtctaagagttgcacctttgtagtaaaagaactctgggaatattaggctgggtgtggtggctcacgcctgtaattgcagcattttgggaggctgaggcgggtggatcacttgaggtcaggagttcgagaccagcctggccaacatggagaaaccccgtctctactaaaaatacaaaaaaattagccaggtgtggtggctcgtgcctgtaatcccagctactcaggaggctgaggcaggagaatcgcttgaacctgggaggcggaggttgcagtgagccgagattgcgcctctgcatttcagcctgggcaacagagcgagacttcatctcaaagggaaaaaaaaaaaaacccacaaaactctgggaatctttttttacctcacggctagccatataagtcaagataatacacacctctacagagggtaatcccacaatccaaggctccgcctggacactcatattcgtgcaagagttccggacactactgatactaatcaaagctcttatttcacttctcaaaatagagagtgatgggcttttgaacaaggcatcctgtggaactttcattgcctttaccagtctctggctcacgaagcaccataaaggcttactaaaataaaattcatgaattgagtgaaaggttgtatgtttcattcatcaaccagtcatggtgtgaattgtcattagcctgtcctcatcgtttttctttttctagtagactttatttttgtagagctatttcagagttacagaaaaattgatgagaaagtgtagtgttcccacttgatccctctgcctccacatagtttatcctttttatattttctattactttaatacatctgttataagtgatgtaccaatattgatgcctcagagtccacagtttacattagggctgactctgttatacaatctgtgggttttggcaaatgtataataactgctattcatcatagctgcatcatgtaggatgctttccctcacctaaatatcccctgtgcttctcctattcattagtccctccctcttcccaaattcttgacagtcaaaagcctttttactctgtcataattttgccttttcctgaatgtcatctttgaaactacacagtatataaccatttagattggcttctttcacttaataatatatgttcaagtcaaggtttctccacgtcttttttttttttttaaattgagatggggtctcatcataacacccatgctggtcttgaactcccagactcaagtgatcctcctgcctcagtgccctgagtagctggtactacaggtgagagccaccatacctagcctccatgtcttttcatggcttgatacctgattctcctgcctcagcctcccgagtagctgagatgataggcaagcgccaccacactcagctaatttttgtatttttagtagagacaggatttcaccatgttggccaggatagtctcgatctcctgacctcatggtctgccctccttggcctcccaaagtgctgggattacaggcgtgagccaccgcgcccagctgatacctgatttctttttatcattctgtaggtgaaccagatggtttatccatttgtctattgagaggtatcttggttcactctaaggtttgcaaggttttgaataaaactataagcattcatgtgcaggttttggcatgaacataaattttcaactctttttagtaaatacctaggagcatgatggctagattacaatttaagagtgtgttttttttttttttgtaactgtctgcctttcaaagtgggagtatcattttccattgccagcagcaaataatgatgatacttattgttctccatcttcaccatcatttggtgtttttagtgttttaaaatttagccatttagtgagtgtggtaatatcttactcagttttatttatcttagtttttttttattccctaatgctgtgtgacgttgagcatgttttgatgtgctgctttaccatctctaaatcttctctggtgatgtgtatgttcatatcttttgcccatttttaattggattgtcttcctgttactgagttttaatagttcttttagtagttggaatatcagtcctttgtcagataggtgttttgcaaagaatttctccctgtctgtagcttgtcttttcattttcttaacatggtctttcccagagcaggactcttttttgggggggcggcggggatggagtctctgtcagtcaggctggagtgcagtggcgtaatctcggctcactgcaacatcagcttctcaggttcaagcgatttattctacctcagcctgccaagtagctgggactacaggcatgcaccaccacacctggctaatttttgtatttttagtagagacagggtttcaccatgtcggctagactggtctcaaattcctgacctcaagtcatccgcccacctcggcctcccaaagagttgggattacaggcatgagccaccgtgcccggccccagagcaggacttttttattttaatgaagtcaaacttataatttatgttataattcatcatcaaacccaaggtcatctagattttatatattatcctctaggagtcttattgtattttacagttacatctttgatctattttcatttaatttttcttttatttaaaaaaaatttttttttttttaaagaaatagagatggagtgttgttatgttgcccacattggtcttgaactcctgggctgaagtgatccaccccatcttagcctcccaaagtgctgggattacaggcgtgagccaccacacccagctgcctttggttcttcatcaaagatcagttgactatatttgtgtggctgtgtaggaaaggagttggccttatatgttgagcttgtgtccttcaaccttgctcttattggttccaggaattttctttgttgtagatttttgaaattctctacatacgcagtcatgtcatatgcagatagacagctttagttcttccttcccagttggtatatcttttatttctttttctttttcttagtttcactgttgtacaatattgaatagaaatggtgagaggggccaggcacggtggctcatgcctgtaatccagcactttaggaggccgaggcaggggttggggggatcattgaggtcaagagttcaggaccagcctggccaacatggtgaaaccccatctctactaaaaatatacaaattagctggacatggttgggtgcacctgtaatcccagctactcaggaggctgaggcaggaaaatctcttgaacccgggaggtggaggtggttacagtgagctgagatggcaccagtgcactccagcctgggcaacagagcgaaactccatctcaaagaaaaaaaaaaaaaggccaggcatggtggctcatgcctgtaatcccagcactttgggaggctgagacgggcgtatcacaaggtcaggagttccagaccagcctggtcaatatggtgaaaccccgtctctactaaaaatacaaaaaaattagcggggcgtggtggcacatgcctgtaatcccagctactccggaggctgaggcaggagaattgcttgaacccaggaggcggagattgcagtgagccgagatcgtgccagtgcactccagcctgggtgacagagtgagactctctcactaaataaataaataaataaatacatacatacatacatacatacatacatacatacatacatgaatggtgagagtgtgagaagggtctttcttaccttgttcctcatattactgggaaaacatctagtttttcacattaagcgtgatgttaactgcaggtttcttgtatgtactttctcaagaagttcctcttgcccgatgcagtggcatgcacctatagtctttgctgcttgcggggccaaggcaagaagattgctggagcccaccagtttgaggctatagcactatgacggcgcctctgaatagccaatatactccagcctgggcaatttagtgagacctgtctcaaaaaaaaaaaaaaaaaagaagaagaagaaattcccttctattcctagtttgctatcataaatagatgttcaattttgtcaagtgcttcttcattttccccctttcgtcatattaacaatctttgtctttttgttgttagctagcttgaggagacatttttcagttaattattgatattttcacaagaccaccttttggttttgttggtttttctctatctattttttttgagacagagtctcgctctgtcacccaggctgcagtgtgatggcgcgatctgggctcactgcaacctctgcctcctgggttcaagtgattctcctgcctcagcctcccaagtagctgggattataggcctgtgccaccatgcctggctaatttttgtattttagagtacatgagagagtatttttgtaattttgtatttgtagagatggggtttcaccatgttggccaggctggtctcgaagtcctgacctcaggtgatctgcctgactcagcctcccaaagcgctgggattacaggcgtgagccaccatacctggcctgttattagttttttaagttagacactgagattattgattacagatcattctttggtggtatatgtgttcaatcgtctacatttcagccaggcactccttttgctgcattctacgtgttttgataagttctatttttatttaattcaaaataatttttaatatcttgagacttttctcatccatgcattatttagaagttcaggatttaatatccaaatatttgtgggttttcaagctatctttctgttatcaattctggatctgagaacatgttttgtattctctagtcttttaaatttgctaggaagtattttatttaccagaatgtgagatatcttggtgaatattccatgtgaacttgagaagaatgtatattctgctgttactgaatgaattattctggatttcaattaagtccagttgttttgatggtgctgttcaatttaattatgtccttcctgatttctgcctgctggatctctaaattaatgctgggggttattgaaatatacagctgtaccagtgaattcatgtatttcttcctgcagttgtattagttttcccctcatatattttgccactctgtggttatgtacatacacagtaaggattgccttgtcttcttggtgaattaacccctttgtcagtatgtaatgcccttctatcactgataatttcatgctatgaagtcagctttttctgaaattaataaggctgtgccagcttttaaaaaattagtgttggccgggcatggtggttcatgcttgtaatcccagcacttagggaggccaaggcgggcacatcacgaggtcgggagtttgccaccagcctaaccaacgtggtgaaaccctatctctactaaaaatataaaaattgaccaggcatggtgtctcacgcttgtaatctcagcactttgggaggcaggcggatcgcctgaggtcaggagtttgagaccagcctggccaacatggtgaaaccctgtctctactaaaaatacaaaaattagccaggcgtggtggcaggtgcctgcaattccagctactcaggaggctgaggcagaagaatcgcttgaacctgggaggcggaggttgtagcgagccgagattgcgccatcgcactccagcctgggcaacaagagcgaaacttcgactcaaacaaacaaacaaacaaaaaatattagctgggtgtggtagtgtgcgcctgtaatcccagctactcaggagactgaggcaggagaatcgcttgaacccgggaggtggaggttgcagtgagccaagattgcgccactgcactccagcctgggtggcagagtgagactttgtctcaaaataataataataataattagtgttagcatagtatatctttctctattcctttatttttaatatatctttgtgatatatttatttattattactttttattattatactttaagttctagggtacatgtgcacaacgtgcaggtttgttacatatgtgtacatgtgccatgttggtgtgctgtacccattaactggtcatttacattaggtatatctcctaatgctatccctcccccctccccccaatctttgtgatatatttaaagtggatttgttggcctaggtatggtggctcgcacctgtaatcccagcattttgggaggctgaggcaggatgattgcttgaggccaggagtttgagacaagcctgggcaacatagtgagaccccatctctataaaaagaaacaaaattatcaagggatggtagtgcacacctgtagttccagctactcagaggctgaggtgagagtcctttgagcccaggagtttgaggttatagtcatctgtcatcccacaactgcactccagcctgggtgacagagcatggccctgtctctaaaaaacaaagtaaaaaaaaaaaaaaaagcgaatttcttgcagacaacatatattaggtattcttttttctttttctttttttttttttgagatggagttttattcctgttgcccaggctggagagccatggcgcgatctcgcctcactgcaacctctgcctcccaagttcaagtgattctcctgcctcgtgagtagctgggattacaggcatgtgccgctgcacctgactaattttgtatttttagtagagacagggtttctccatgttggtcaggctggtcttgaactcctgacctcaagaggtcctcctgcctcggcctcccaaagttctgggattacaggcgtgagccacgcctggccaggtgttcttttttatccactatgacagtatcagtgagctgagattgtgtcactgcaatccagcctaggcaacagagtaagactctgtctcaaaaaaaaaagaaaagaaataaatttctggtctgataattccagcatctcttttatatctcagtctggttctgatgcctgcactctctcttcaaaccgtctaagtcttttaatatatcttgtaatttttgttgagatctgggcatggtgttgaaaaggaactgaggtaaacaggctttaaatgtgagggtttaggtttatcctgttgattttaggctgtgtttactattttcagtaactgtaggtgtcagataaaattgcctttggtgtccctggttttctgtgttctgtcatttttggggttctctagagatttcttcaattgtgaaacatgcagaaagaaatagaatattgtttcattgtattctactgttttattttattttattttattttattttttgaggtggagtttcgctctgtcgcccaggctggagtgcaggggcacgatcttggctcactgcaacctctgcctcccaggtttaagcgattctcttccctcagcctcccaagtagccgggattacaggtgcccaccacacccggcaaatttttgtatttttagtagagatggggttttgctatgttggccaggctggtctcaaactcctgatgtcaagtgatctgcccgccccccgcctcccaaagtgctgggattacagtcgtgagccaccacacctggcctgttctactgttttaaaacaaaaacccaggccaggagtggtgactcattcctgtaatcctagcattttgggaggccaaggcaggcaaattacttgaggtaggagttcgacaccatcctggccaacatgaagaaacaccctgtctctactaaaaatacaaaaattagctgggtgtggttgtgtatgcctgtaatcccagctactctgttggctgaggcaggagaactgcttgaatgctggaggcaggggttgtagtgagccaagattgcaccactgcactccagcctgggtgacagagcgagactgggtctcaaaataaaaacaaaactctaatgtcacactgttaccagtggctggagtggaaacatgatataatcctatgaatcatctgtcttctggtgagcctgtgccccgagccatgatgttctttgctatgataagaaagacatttgtttggtctttgtgtgtggttcctagtacagagttcctaaatctcttggaatttcatgagtgataagggtaatggaccctctcttgttgtaaataaatgactactggaaagaatgcctacctaacttcagggtggggattgatgtcccgaaagacacccagtcttgatcttcctctagccctagcccccaaagtcgggggagagaaaaagggctggaggtttagtgcttggactcctgacctcaaatgatctgcccacctctgcctcccaaagtgctgggattataggcgtgagccaccccgcctggcttttgactgctcacagctttaaaacctcattcctcagtttccactgtgtaccccacatatggacgtggtaggaagaaagcctgggtcaccctcatttggtgctggcgacagagccaattcgcatcagcctccacctgtatgcttgaactcacactagcccactccctaatgtcagtaaaaatccccagccaggctccttttcttgctctccgaagccacttcacaagtgcttgagagttacacagctttgcctgagagctcaagcatgcgagtaataaaccttcatgagtacaggggtttatagaggtccaagttgctgtgctttctttccaataacctcctagacccatgaaatgagacagaaaggaaaaactgaacctatgataaatattacacaaacacgttgaaattaatactaatgcagaagaatattttcattcagccacctggatttgcatggttctaatggcccgagatccttcagggcaacatggccagtgacttctggcttttcacagacttcctgatctctcatgttgtttatgaaaaagaaaaatacacagtttttcatcctcaatgggagatgtgcagcttatagtctaaagggtgtattcatttattaaaatctcatccagatttgaccccaagtttcatgaaatgctgagtggtacagtatgtaataaggtagaaaatgaaagagtttttctcacgaggaattgatgatcttacaatttgtttcatttgtacagcatttctctcatatatccaagatggtcttgggtctgtatttaaagagcaataaggtggccgggcgcggtggctcacgcctgtaatcccagcactttgggaggccgaggggggcgattcacgaggtcaggagatcaagaccatcctggctaacatggtgaaaccccgtctctactaaaaatacaaaaaattagctgggcgtggtggcacgcgcctgtagtcccagctacttgggaggttggggcaggataatcactggaacctgggaggaggaggttgcagtgagccaagatcgcaccattgcactccagcctgagcaacagagcaagactccatctcaaaaaaaataaaaagaaaaagaacaataaggcttcaagtgatcacagttaaaatatagaaataatggcagggtgcggtggctcacgcctgtaatcccagcactctgggaggccgaggcgggcggatcacgaggtcaggagatggaaaccatcttggctaacacggtgaaactctgtctctactaaaaatacaaaaaattagctgggtgtggtggtgggcgcctgtagtcccagctactcgggaggctgagacaggagaatggtgtgaacccaggaggcggagctttcagtgagccgacattgtgccactgcactccagcctgggcgacagagcaagaatgtttcaaaaaaaaaaaaaaaaaaatatatatatatatatatatagagagagagagagagagagagagagagagagagagcgcaataatttttgtatgttcacgatagtgttaaatttatgaggaagtgagtatggaaagagtcaagagttctgacaaccaagttataccactaaaccgagactacaggattatatggaatttctcaggaattctgagaatggatcctcactactgcgaatctctctcctcctcctaaacacacatgggggatgttttaggactccatctcccttgaggatgtggctgtgaacttcaccctggaggagtgggctttgctggatcctggccagaggaatatctacagagatgtgatgcgggcaaccttcaagaacctggcctgtataggtaagggtgacataatttctctacttaattaaggagggaacaggtgtttcttgcacaacaactgagttccaaggtttaaaatgggggaaggggccaggcacggtggctcgcgcctgtaatcccagtgctttgggaggctgaggcgggcggattaagaggtcaggagtctgagaccagcctgaccaacatggtgaaaccctgtctctactaaaaataaaaaattagccaggcctggtggcaggtgcctgtaattctggctactcaggaggctgaggcaggagaattgcttgaacccgggaggccgaggttgcagtgagctgagaccgcgccattgcactccagcctgggcaacagcgagactctgtctcaaaaaaaaaaaaaaaatgtgggaagagaatactttagtaagtagatcagacagtgtcatagctaatcaatagctaatcatggatcttagagtgttataattttctataatttctaataatttattgtgagttctctgggcttgtattttaggggaaaaatggaaagaccaggatattgaagatgaacacaaaaaccagggaagaaatctaaggtgagttgcattcacaaataattatatagcccctgagagaatcttagtatttcataaatttcaaaagccaagcaagcaaaacaataagcagagtttcaggtttattcattcttagaaaatttttactgaaggtgtttcattgaaactgtcatgggcagccaggcgtggtggctcatgtctgtaatcccagcactttgggaggctgaggccagtggatcatgagatcaggagatcgagaccatcctggccaacatgatgaaaccctgtctctactaaaaatacaaaaaattagccgggcgtggtggcgtgcacctatagtcccagctactcgggaggctgaggcaggagaatcgcttgaacctgggaggtggaggttgcagtgagctgagatcgatccactgcactgcagcctggtgacagagcgagactccgtctaaaaaaacaacagaaactgtcattggctgggtaaggtagcgaatacctctaatcccagcctttggtaggtgaaggctggagaattgcttgaggccaggagttcaacaccagcctggtcaacatagtgaaaacctgtctctacaggaaaaaaaaaaaagcaatagatgttcagggtgtgagaagaaatcactatgaaacagcatttaaaaatcctggctgggcgcagtggctcacgcctgtaatcccagcactttgggaggctgaggcgagcggatcacctgaggtcaggagtttgagaccccgtctctactaaaaaagatataaaattagcggggcgtggtggtgcatgtctgcaatcccagctacttgggaggctgaggcaggagaatcacttgaacccaggaggcggaggttgcagtgagctgagatcacgccactgcactccagcctgggcaacagagagactccgtctcaaaaataataataataatttttttttaactattttgataatagctatggtcacggcctgttctagactattgagtatattagctttcaaaacaatttagacagggcagataacatacagtttctgtgaaaatatttaaaatgtaattctggtacttgctaataaatataagatcattaatacaaaactattaataatacggtactcattctttacagaagtcctatggttgaagcactctgtgaaaataaagaagattgtccatgtggaaaaagcactagccagattcctgatcttaatacgaacctggaaactcctactggattaaaaccatgtgactgcagtgtgtgtggggaagtcttcatgcatcaggtctcccttaataggcacatgagatctcacactgaacagaaaccaaatgagtgtcacgaatatggagagaagccacataaatgcaaagaatgtgggaaaaccttcactcgcagctccagtattcgaacccatgaaagaattcacactggagagaaaccctatgaatgtaaggaatgtggcaaagccttcgcatttctcttttcctttcgaaaccatataagaattcatactggagagacaccctatgaatgtaaggaatgtgggaaggcattcagatatctcactgctcttcggcgccatgaaaaaaatcacactggagagaaaccctacaaatgtaaacagtgtggaaaagcctttatatattaccagccttttctaacccacgaaaggactcacactggagagaaaccttatgaatgtaagcaatgtgggaaagccttcagttgtcccacgtacttacggagtcatgagaaaactcatactggagagaaaccttttgtatgtagggaatgtgggagagccttcttttctcactcaagccttcgaaaacacgtgaaaacccacaccggagttcaaccttatacatgtaagaaatgtggggaagccttcaagtcatctagttcctgtgaagtgcacgaaagaactcattttggagaaaaaccctatgaatgtaaacaatgtggtaaagccttcaattcttcaagttaccttcagttgcacgaaagagttcacactggcgagaaaacttacgaatgtaaagaatgtggtaaagcctttctttattccactcactttcgaatccatgaaagaacccatactagagagaaaccctatgaatgcaaacagtgtggtcgggtcttcatttacttcagtcaccttcgaaggcacgaaagaagtcacactggagtgaaaccatgtgagtgtaagcagtgtggcaaagctttcacttgtttaaattccctgaaagtacacaaaagaattcatactggagaaagaccctttcagtgtagacaatgtggtaaagccttcagttactcaaagtctttgcacgtgcacgaaaggactcatagtagacagaagccctaagaaagtaaagtgtggtaatgctgtcagttgtattagttccttttggatgtatgagagtacttacgctggagagaaattcaaggaatgtaaacggtgtgattaagccttcagttgtcctaattccctttgaagacgtgactcatgcggcaatgaaatatttaacaaatgggggaggaacttgcactctcctgcgggattgcagatatgtgaatggactccatggacagaaaagctacgaatgtatggagtgtaggaaagccttcacttcacgtaatcttttaaagacacctgagaatatatactggagagaaactataaagaaaattctatatccatcccatcttttgtggggtttgttttttgtttttgtttttgttgagatgtaattttgctcttgttgcccaggctggagtgcagtggtgcgatcgcggctcaccgcaacctccgcctcccggattcaagcaattctcctgccgcagcctcccaagaagctgggattacaggcatgcgccaccacgcctggctaattttgtaattttagtagagatggggtttctccatgttggtcaggctggtctcaaactcctgacctcaggtgatctgcctgcctcggcctcccaaagtgctgggattacaggtgtgagccacagcacccaacctttttttccccgccgcaccccaagatggtgtctcactctgttgccccaggctggagtgcagtggtgtgatcctggctcactgtaacctctgggttcaagcaattcttctgcctcagccttccaagtagctgggattacaagtgcccaccaccatgcccagctaatttttatatttttagtagagacagtgtttcaccatgttgaccaggctgatcttaaactcttgacctcaaatgatccacccaccttggcctcccaaattgttcgttttacttttttttttttttttttttgagctggagtcttactctgttgcctaggctggagtgaaagtggcgcaacctctgcctcccaggtcaaagcaatcctgcctcaggccccctagtagctggcattacaggcacatgccaccacgcccaactaatttttatatttttagtagagacggggtttcaccatgttggccaggctggtcttgaactcctgacctcaggtaatccacctgccttggcctcccaaagtgctgggattacaggcgtgagccaccacacccggcccccagttctttttttttttttttgagacggagtccttgcccaggctggagtgcagtggcgcgatctcagctcactgcaagctccgcctcctgggttcacgccattctcctgcctcagcctcccgagtagctgggactacaggcgcccgccaccacgcccggctcattttttgtatttttagtggagacggggtttcaccgtgttagccaggatagtcttgatctcctgacctcgtgatccgccctcctcggcctcccaaagtgctgggattataggcgtgagccaccgcgcccggcctccagttcattttaaaaccatgaaaccacccacactggagagccaccttcttaaatgtaagcaatatgggaacatcttcaatgacatctgcaaccattgtcgagattcttcgtaggaagaattaaaggaatggggaagaaggacttgggccccagcaggccttttgtggcatccagtcagaagttaggaaacaccctctagggcagtgcctgccctcagctctcacacatgactggagagaagtgagaagactcccagaatctgccttttaagtttccatcagtgtcctcgggtcagactgtgggaatgctgtacttctaagacaaaggttcgcatcttacagtttttccccaagtgggatctgcctatgcacatcctaattcacagacattgtcagcattgcattattccagggctgttttgaggtcatctccagctccatttcccatctcaaacctacactttggacacttgtttaaacattcacatctgaatttctctgtggcaaccgcaggtggctctgaggtgagagactgaagaagcagagcctgtatcatgggacacacaccccttgaccacacagcatccactctcctgcggttaccagccctgcaccaaccaccacagtcagaataatctcaaaactgctagtggagtcacagacacactctgccatgtcttagctgtaggacactcagaattcttacctcccctaacttgctttccctgttttctggcacattctaccctgagatattcagcggcatatgcactgatgatgctccggccttctcacgtcagtgcatgtcacatgcatcctgctccaggactggtttcctagcctcccgctaagactagcacttagctcttcttggaaaaggacccaccctgcagcgctccagctctgttgtgtatgggaggtgctggtgtcagggttcacaagccatggaactaccttgcttcacatcacaaggcaaggtgaactcaactcccaataaactgcttgctggagcctccgaattctccgttttctgaattgcataggcacgataggggtcgggtctgtcctttgttggagtcagtccccccttttcttagcaagtcagtgtgttttagaagggaggtggcagcattgagggaaaccaggtcaccatccaccctcgtaacaacagtctccctgggtgggtcccagaagtgatctttgtgtcgctcgggtcggaactctttaggcctctggcctccaccctcccccaacagcagggatgggtcaggtggcagcatccaaaaccacggtgaagatactagggtccagaggccgactggagcaaggtttgctggcagatgaggcctcagtggaagtgacggctactgtggagatgcagtggaggacctggtggctgagccaggagatgcacaccttcgcttctctcaccaggaacattcgcttctctcaccaggaacatttatggtagtatgaggggttggaacattattactcaacccatttcaggtcctttcacattcttgagctgccatgttgtgcttttgtagagagatgattattgtactgtgggaggtcaggaagttcgagattccttcactgtcagaatgggctcaaggagccatcttttgtgataggtattggggaactaaggggtatctctgctacaggaatgggagtgagaacattcactttttgaaggacaagtatatgtgggtctatgatgatgtttttgtaaaacccttttgtgtatgtgtctgtgtgagtcctaatattcagtaagtattttcctctgtgtaactccctctaataggtgtagtcaacaaagctgtgctaatatctctgtccccttgatcctggcattctggaagacacgaaagcaagcaaggatatataaggcactgtggtggttattcccgaggagccagagaaacctggagaagagatcagaacacctggggtccttctatttgggagaatcttttagtatctgggctgttacacctgtgggtttgtgaatttgtgtctgtccacctgtatgtacagtgataacgtgtgtgatttttgtatatttgtctagagggctgtgtgtatatatatttatatatatttttaaatatggaatgcttttaggtttttttttttttttttttttttgagatggattctcactgttgccaggctggagtgcagtggcacaatcttggctcactgcaacctccacttctcaggttcaagcaattctcctgcctcagcctcctgagtagctgggactataggcgcgtgccaccacaaccagctaaatttttttgtatttttagtagagatggggtttcaccatgttgaccaggatggtctcaatctcctgaccttgtgatccacccacctcggtctccccaaagtgctgggattacaggcgtgagccactctgcctggctggttattttgtttgtttgttgtttttttgagacacagtctcgctctgtcaccaagctggactgcagtggcatgatctcggctcactgcaatctctgcctcccaggttcaagcaattctcctgtttcagcctcctgagtagctgggattacaggcgcgtgccaccataccgagctagtttttttatttttagtagagacggggtttcaccatgttggccaggatggtctcgccctcctgaccttgtgatctgcctgcctcggcctctcaaagtgctgggattagaggcttgagccaccaggcccggctggaatgcttgcattttcttgcctgatttccctgggagcaccccccttaacactgaatggagctggtgagagcaaatatccttgtttctgatattagatattaaaaatatggtttttcaccatcaaagattttattgagtttttcatatatgccttgtagcaatttgagtaaattatattccttgtttgttgcagatttttaatcataaatgggtgttgaattatgtcatgcttttttgcatcaattgagactgtcatttttccgtcatttcctaatgtggtgtattccactgatcaatttccatatggtgaaccatccttacattccagggacaaatctcacttggttatattgcataatgctttgaatatattgctttatatgctttgctggcatttatttcaagatttttgcatcagtactcataagggacaggaatgccatcttccttgctctcacgccatgtcacacttgcttgagagccctgcattgttctctctgatacctcatttttgtaataagccttttcatactctcggtgtgtgtgtgcaccacatagctctcggtgtcaacctctgaagcacaccttttcaggcaaccgtaacagttggcactgtcagcaggatgtctagatgttggtcaccatgcaatgggtcagctttccctttctctcaggtgctaacctgctctgctacctggtggccagcatgctctttgagctgctgctgcttgctgctctgtgttccattgctgaggccgaacaaacttgtgttccagatttagccaaccgaagatggcagtttctataagtctttggcatttaggagcaggagtatcggatttgggccctccttaaaatggtctgggctaggagttttcactttgcctttctatgtagaatgaagctgggactgatgctaggtgttggccttgtcctgtaggtctggtggtgggggctggtggtgagattttatcttgtgcatgttggggccccattagtggtcattcctgaaagagcagtcatttgaaaatgagaaagagcctggcgcagtggtggtggctcacgcttgtaatcccaccactttgggaggccaaggcagacagatcacctgaggtcagaagtttgagaccagcctggccattatggtgaaaccccatctctactaaaaatacaaaaattagctgggcatagtggtggacgcctgtaatgccagctactcgggaggctgaggcagtagaatctcttgaacctgggaggcagaggttgcagtgagccgagatcgcaccactgcactccagcctgggcgacagagtaagactccgtctcaaaaaaaaaaaaaaaaaagtgagaaagaaggctaggcgtggtggtttacacctgtaatcacagctactcaggagactgaggcaggagtatcacttgaacctgggaggtggaggttgcggtgagctaagattgccctactgcacataaacctgggcagcagagcgagactccatctcaaaaaaaagaaaaaagaaaaaatgcgaaagaagagaaggtggggaagctaccattagatggtgtcctgaagttcacactcagctggacctttaagtacctctgctgctgccgctgcccatgcctctatctcaacagagaccctgatcctctgggttataagggacaacccctgtggcattcctgtagctcaacaaacgtattcaaacctgaataaatcccagtatccttaaattatgtaaagcatctgttgtcatccaggaaattcctgctagggtttcaatgtcttctccatagttattgaaatatggtccagtgtagtggttttaggcctagtgggaggtgtttaagtcatagggtagatgcctcatgaaagacttcatgctcttctcattagtaaaatcttgttcaggctgcatctggagagggtttcacctgcctacatttgcggcagaaagcagaaggggaaccagcgtgtgcagagatcacgtggtgagacaggaagtaagaggacatcaaggaagacagaccctttaataacctactctcgtgggaaccattcctgtgaaagcaataacagaagggcgttaatctattgtgatggagttgcctttttgacccaaacacctgccacctggccgcacctctcaaaacagctgctttggagatcagatgtcaacgtgaggccaggcatagtagctcacacctgtaatgccagtgctttaggacacaaggtgggagcattacttgatcccaggaagttgagaccagcctggtcagcatagctaggccccatttaattaatttatttatttatttatagatggagtctccctgttgcccaggctggaggcgcgatctcggctcactgcaatctccgcctcccgggttaaaatttttaattttaacatctctgtaatgcactaactgacaatccttcatgggattaatcaatcccaggaatcagttatatctaggagtcccactaaatgtaagaaggtacactctataatttatttatttatttattttgagacagagtcttgctctatggcccaggcaggagtgctgagacagactctcactctgtcgcccaggctggagtgcagtggcgcgatctcagctcactgcaacctccacctccggagttcaagctattctcctgcctcagcctcccgagtaactgggactacaggcacgtgccaccacacctggctaattttttgtatttttagtagagatggggttccaccatgttggtcaggctggtctcgatctcctgaccttgtgatccaccagcctcggcctcccaaagtgctgggattacaggagtgagccacctcacctggcctgacttgagctcccaatagcttgcaggtaagagtttttgggttttttgttttgttttgttttgtttttctgagacggaatcttgctctgtcacccaggctggagtgcaatggtgcaatctcggctcactgcaacctctgcctcctgggtttaagcaattctcctgcctcagtctcccccgtccccgcccccgagtagctgggattacaggcacctgccaccacgcccagctaattttttgtatttttagtagagatggggtttcaccatgttggccaggctggtcttggactcctgacctcgggtgatctgcccacattggcctcccaaagtgctgggattataggggtaagccaccgcacctggccgcaggtaagagtttttaaaggcaggagtattgtaaagacagcaggggaaacacacacacagacacacacggaaaaggcaggggtaaatttcaggaaagcagaggctacaggcaagaatcataaatcagtacatggaggttacacagtggtataagcttaaaagaatggaatatcttgaagtggggctcataagtcacaggtagattcaaagatcacatttgcaattggttaaggaagaaagaagtaagctgggcgcggtggctcacgcctgtaatcccagcactttgggaggccgaggccggcggatcacctgaggtcaggagttcgagaccaacctgatcaacatgacgaaaactggtctctactaaaaatacaaaaattagccgggcgtggtggtgggtgcctgtaatcccagcttctcgggaggctgaaacatgagaatagcttgaacccgggaggcggaggttgcagtgagccaagattgcgccattgcactctagcctgggcaacagagcgagactccatctcaaaaacaaacaaaaaaaaaaggaagagagaagttttgtttaaaaatttaagctaggctgggcaaatggctcacacctgtaatcccagctacttgggagactgaggcaggcgaatcgcttgaactcgggaggtagaggttgcagtgagttgagatcacgccattgcactccagcctgggcaacaagagtgaatctccgtttcaaaaaaaaaaaaaaaactttaagttaggtgcggtggctcatgcctgtaatgccagcactttgcgaggcctaggcaagaggatcatttgaggccaggatttcaagaccagcctaggcaacataacaagacttcatctctgagaaaaatgaggtcataagattaaaaaaaagaaaaatcgggttgtcacgcgtgtccgtgtgaagagaccaccaaacaggctttgtgtgagcagtaaagctgtttatttcacctgggtgcaggcaggctgagtccagaaagagtcagtgaagggagataggggtggggctgttttataggatttgggtaggtagtggaaaattacagtcaaagggggttgttttctcgcgggcaggagtgggggtcataaggtgctcagtggaggagcttctgagccaagaaaaggaatttcacaaggtaatgtcagttaaggcaggaaccagctattttcacttcttttgtgattcttcacttgcttcaggccatctggatgtattcgtgcaggcttgggctcagaggcctgacaggggtcagtagaaaaataactggttacagggagtgactttctctaatcccccaaggaagaaacagaacaaaggtcaagtttagtcttcacttcttccttatctaggagtctgtgccagtgaatggatctgttcagcgggggtcctcagtggggttccaagcctctgaaagacaactccgggatgtatgttaagatgttatcctgccgggcgtggtggctcacgcctgtaatcccagcactttgggaggctgaggcgggcagatcacgaggtcaggagatcgagaccatcctggcgaacacggtgaaaccccgtctctactaaaaatacaaaaaattagccaggcgcggtggcgggcgcctgtagtcccagctactcaggaggctgaggcaggagaatggcgtgaacccaggaggcagagcttgcagtgagccgagatagcgccactgcactctggcctgggtgaaagagcaagactccctttcaaaaaaaaaaaagatcttacccttagtttatatggggaaagcaaacatatctgggcctctaacttcctgagctattgttttagatctattaccttcttgtttaacaagttacttatttgcttctcatggcttcactaggtgcctagaatttcctttaaactcaggatttttctttatttccatgcttggggtccacaggccgctaataaaaggtgtccctactgtcttcataccatagcaatcttcttcccgtttcttgtcatataacccctaaaattttttgagtcttaaaagtgataagtgacattttgtatgctaatgagttgactgatggcttgggcctgctggatagcctcaggatgggggggcaggtagcaaaggaaataaccatgtgattataggattggaactttcagctccattcctttggacctccagagtggggagatggactgaaggttaagttgataaacaatgggcaataatgtaatcagtcatgactacataatgatgactccattcaacttgaaaggcctgggtccgggagcttctggggagctgaacgtgtggaggttcctgaaaggtgtcacacctagagtcatacatctcttccatctggctgttcacctgtatcttttgtaatattctttgtaataagtgggtaaacaaaattgggcacagtggcatgagcctgtagtcccagctacttgagaggctgaggtgggaggatcgcttgagcccaggagttcaagaccagtctgggcaacaaggcaagaccccgtctcagaaaaaaaaaaggggggtaaattaaactaatatgtttctctgagttttctgagctgttctagcaaatcgtactagtcagggttctctagagggaaagactagtaggatatctgtatatatgaaagggagtttattagaattgactcacagaatcacaaggtaaagtcccacgatagtctgtaagttgaggagcaaggaagccagtggtggatcagtctaaatcccaaaacctcaaaagttagggaagccgacagtgtagccttcggtctgtggccaaaggcccgagagaccctggcaaatcactggtgtacgtccaagaatcccaaagctgaagaatttgaagtctgatgtttgagggcaggaagcatccagcacaggagaaagatgaagacgggaagactcaacaagtcagctccttgcattttcttctgcctgctttattctagccacgctggcagctgattagatggtgcccacccaaactgagggtgggtctgcctcccccagtccactgactcaaatgttaatctcctttggcaacaccctcacagacacacccagggacagtattttgcatccttcaatcacgttgacactcaatattaaatatcacactaattaaactcaaggaaggggttttcggaaccccagtgtttaagttggtccagaagttctagaggccctggcttgtgactggcatctaagatgagggacagtcttgtggaacattgtccttgatctttgggatgtgatgctatctccagatagatagtattggaattgaatagaatttgaggatatctagctggtgaatcctctgcagaattgcttgctgggtgtgtatggaaaagcctaacactcagagaaattgtgttgatttgtttttctctatattctcacaacatccccagttcatagattagactacttaatattgtgaaattatccaattgtaaatcactactcaaactgatgcacagattcaatgcaattcataacaaattcaatggcatttttttgcaaaaatagaaaaaagaatctgaaaatgtatatgaaacttccaagaatctgaaatatccaaaacaatcttgaaaaacaagaacaaagctagaggcctcacaattcctatgttcaaaacatagtaccagccggtcacagtgtctcacgcctgtaatcctagcccctcgggaggccgtggtgggtggatcacttgaagccaggatttagagaccagcctggccaagatagagaacccccatctctaccaaaaatacaaaaattagccgggcatggtgctgtacgcctgtaatcccaggtacctgggaagctgaggcagtacaatcgcttgaacctgggaggcagaggttgcagtgagccgagatcgggccactgcactccagcctgggtgacagagtgagactgtctcaaaaaaaccaagccaaaacaaaaaacatagtactaagtgtgaccttctggaaggtcaaagaataaaaacctctgcttattatgagtgttttgagaaagtcagccaaagctttggcagaaaaatatccaggaaagttccaccagagagtccttcaccaccatgacagtgctcctgcacattccttttgttgaacaagaacaattttgtgagagttttattgtaaaatcattaggcatccactgtaccatcctgatgtggctcctcctccccgctccaattttttttttttgagacggtgtcttgcttggtcgcccaggctggagtgcagtggcgtgatctcggctcactgcaagctccgcctcccgggttcacgccattctcctgcctcagcctcctgagtagctgggactacaggagcccgccaccaccctcggctaattttttttgtatttttagaagagatgtggtttcaccatgttagccaggatggtctcgatcttctgacctcatgatccacccgcctgggcctcccaaagtgctgggattacaggcgtgagccaccgcacccagcctccccgctccaactttttttgggaggcaggatctcactttgttgcccaggctggagtgcagtggtaggatcagggctcactgcagcctcaacctccccaggctcaggtgatcctcccacctcagcctccccagtagctgagattacaggtatgtgccacctcacctcgataattttttgtatttttttgtgaagacaggatttcagcatgttggctgggctagtttcaaattcctggatttaagcaatcagcctcccaaagtgctgggattacatgcttgagccaccaagcccagctatttcctaatcttaaaaaaatctttaaaaggaactcatttttgtttggttaataatgtaaaaaagactattgacatgattaaatttccatgactcagttctttaaggatagactaaatggctggtctcatcacttggaaaagtgtcttgatattggccggcacagtagctcatgcctataatcccagcattttgggatcgacgcaggagggtctcttgagtccaggagttcgaggctgcagtcagctgtgattgcactactgcactccagggtgagagagtgagaccctgtctttaaaaaatgcaaaaaaaaaaaaaaaaaaaaaaagcctccataggaatagacgttcaacattacaagtcataagagaaatgaagatcaaaagcacaaagagataattcttcacgttcgtcaaaatcacagaaaataacaagtgctggtgaggatccatagaatttggaatgcttttcattgttagtgggaatgtaaaatggtgtagctattatggataacaggatttaggttctcttaaacacccacatacccctagataacgcaattaatatttgaatatatttgtgtgtgttttttttttctttttttgagatggagtttcactcttgttgcccaggctggagtgcaatggcatgatctcggttcaccgcaacctctgcctcccaggttcaagggattctcctgcttcagcctcctgagtagctgggattacgggcatgcgccactacacccagctaattttatatttttagtagagagaggttttctccatggtggtcaggctggtctcgaactcccgacctcaggtgatccgccctcctcggcctcccaaagtgctgggattacaggcgtgagccaccgtgcccagcttgttttaatctctttgtagatatcgcttcatccatctcgatttttacgcatgttaatataaattacacaaggctgtacacttccctcctaattctccattgctcacatcatcaacaacagttcaatactttttttttttttttgagacggagtctcgctctgtcgtccaggctggagtgcagtggtgcaatctcggctcactgccagctctgcctcccgggttcacgccattctcctgcctcagcctcctgagtagctgggactttaggcgcccacgaccacgcccggctaattttttgtatttttttttttaatggtacatagttcttttctatttttatttatttatttattttattttattttattattattatgctttaagttttagggtacatgtgcacaatgtgcagggtagttacatatgtatacatgtgccatgctggtgtgctgcacccattaactcgtcatttagcattaagtatatctcctaatgctatccctcccccctccccctactccacaacagtccccagagtgtgatgttccccttcctgtgtccatgtgttctcgttattcaattcccacttatgagtgagaatatgcagtgtttggttttttgttcttgcgatagtttactgagaatgatgatttccaatttcatccatgtccgtacaaaggacatgaactcatcattttttatggctgcatagtattccatggtgtatatgtgccacattttcttaatctagtctatcattgttggacatttgggttggttccaagtctttgctattgtgaatagtgccgcaataaacatacgtgtgcatgtgtctttatagcagcatgatttatagtcaattttttgtatttttagtagagacagggtttcactgtgttagccaggatggtctcgatctcctgacctcgtgatccgccagcctctatctcccaaagtggtgggattacaggcgtgagccaccgcacccggctttttttttttttttttttttttttagacagaatctcactctgttgcctaggctggagtgccctggcagaatctcagctcactgcaacctccacctcccaagttcaggtgattctcctgccccagcctcctgggcagccatgattacaggcgcccgccaccacgcctggttaatttttgtatttttaatagagacagggtttcaccatgttgcccaagctgctcttgaactcctgagctcaggcaatctgcctacctcagcctcccaaggtgccaggattacaggcatgagccaccgcgcccggcctttttttttttttttttttttgagagggagtcttgctctatcacccaggctggagtgcattgacatgatctcagctcactgcaacctccaccttctgggttcaagtgactctcctgcctcagcctctcaaatagttgggattacaggcatgcaccacaacgcccggctaattttcgtgtttttagtagagatggggtttcaccacattggccaggctggtcttgaactcctgacttcaagtgatccacacgcttcggcctcccagagtgctgggattataggcgggagacactgcgcctcaccaggactggtatttttttttttttaaagacagagtttcgctgggcacggtggctcacgcctgtaatcccagcactttgggagtctgaggcaggtggatcacaaggtcaagagatcgagaccatcctggccaacatggtgaaaccccatctctactaagaatacaaaaaagtagctaggcgtggtggcacacacctgtagtcccagctactcaggaggctgaggcaggagaatcgcttgaacccaggaggcggaggttgcagagagctgagatcacgccactgcactccagcctggcaacagagcgaggttcctttaaaaaaaaaaaaaaaaaagacagagttttgctttgttgcccaggctggagtgtaatggcttgatctcggctcaccgcaacctctgcctcccaggctcaagcgattctcctgcctcaccctcccaagtaactgagattacaggcaccggccaccacacctggctaacttttttgtatttttagtagagatggggtttcatcatgttggccaggctggtcttgaactcctgacctcagttgatccacccgccttggcctcccaaagtactgggattacaggcgtgagccaccacgtccggccaagactggtaattttaaatggaaaagtatatcacaatttggttgagtgtagaagtagtgtcagaatgtttgagagaacatacattaccacttatttgtatatttatattttagatttgtaacaactggtaaggacttctgaagagttttattgatggagagattttaaaggattaaagaataaaatatcgcatttgtaaatgccatgtaaaatgtttaagttatttcagcactcccactgggttaagtgggagccacaaatggttctgagcaggctgggcgcgatggctcatgcctgtaatcccggcactttgggaggccgaggcgggtggatcacttgaggtcaggagttcgagaccagcccgaccaacgtggtgaaaccccgtctctattaaaaatacaaaaactagctgggcgtggtggctcacatctgtaatcccagctattcgggaggctgaggcaggagagttacatgaacctgggaggtggaggttgtagtaagccgagattgcaccattgcactccagtctgggcgacagagcaagactccgtccctcaaaaaaaaaaaatgttctgagcaaaggaaagactgatctgatttaggttttgcgtaaatatcctccagctatgggctgcggggcgtgtgtcgctgggtgggtgggttaggtggacaaaactggatcctagtgcctatgcgcccctttaaaacgaataaaaagacgtagttctcaaccagggacgtccttggtgatgctctgctggtcctgcagcctgagggctttttccagacgctttgacctgtgcacttctgcccccacgcggccaatgcctgaactgcagcaacgtcctgcagacccagtttccttttttggtaccaggcatatgcagggcgtggacagatcctacaatggaaccagccagagactgccctagagaaactcatatgccgggatttggatgtttgtaggataacatcatgagcagcagctttgcaggaccacacatgttccagggagattctcagaggagggatctttgggcagtgtctccaaagaccagtaagaatatttcaggaagacacaacaagaaaaaatattctaggcaaagtgaaaactgacattgataccccgaccccaacccctcttaactgctacttccgacctgggtcgtggagctaccattcaagccctatacccaatactcatcttgaactacttaactacttatttatgtatttatttatttattattattattattattttgagacggagtctcactctgtcacccaggctggagtgcagtagcgcgatctcggctcactgcaaccttcacctcccgggttcatgtgattctcctgcctcagcctccctggcagctgtgattacaggtacctgccaccatgcctggataattttttttttctttttctgagacagagtttcactcttgttgcccaggctggagtgcagtagcatgatctcggctcactgcaacctccacttcccgggttgaaacaattctcctgcctcagcctcccgagtagctgggattacagacacgcaccaccacgcctggctaatttttgtatttttagtagagacaagagtttcaccatgtcggtcagcccagtcttgaactcctgaccttgtgatctgcccgcctcggcctcccaaagtgctgggattacaggcgtgagccactgcacctggccccacctgggtaatttttgtatttttagtagagacagggtttcaccatgttggccaggctggtcttgaattcctgaccgcaggttatccacccaccttggcctcccaaagtgctgggattacaggcatgagccaccaagcctgacctacttatttcttctcactcccatcatcccaattgccaccacccaggtctagacactcacctgggtacctgtcaaagtgtcctccttggtctcccaaacttcaattcctagtcattcacctcggcaccaaagggacatttttctctctcttccctgctcacacacctcccatggctccctagtgctctcaagtgcaagtccaagctcctcagcctggcacctgaagtcttgaagacccagttctgcctgtcccactatatcattagcatgaccaactagaaagacattaataaaaagaatagcactacctctatttattgagtgcctacctggtgctaagacatgtgtcttgcagtttcaaggtgcactcacaacaactttattatcttcgttttacagaaggggctattgaggtttagagaactcaagggacttgttcaaggtccccgcctaagtatgaactcaattctttccaactccaaagctcaggcctaaacccaacgctctgtcccctccatgacaaacctctagtgggatgggtttaactttcttgccatttctgtcttttactctacttgagccactataacaaaatacaatacgattacaaaataacaaaatacaataacaaaatacgattcttgacaccatgaagtccaaggtcaaaatgacagtagattctgttcttggtgagggctttcttcctggctcaaagatggctactttctggttgtgtcctcaagttgggaagagggcataggggtgacagagagaaagacagagagaaagagaggtctctggtgttttttcattattattattatttattagtagtagtattatttgagacagagtctcactctgtcgtccaggatgaagtgcagtggtgcgatcttggctcactgcaacctctgcctcctgaggtcaagtgattctcctgtctcagcctccgaagtagctgggattacaggtgcccaccaccatgcccggctaatttttgtatctttagtagagatggggtttcaccattttggccagactgtctcgaactcctgttctcaggtgatccgcccacctaggcctcccaaaatgctgggattacaggtgtgaaccactacactcagcctattattattattattgagacagggtctcgctttgtcacgcaggctggagtgctgtggcacaatcatagctcactgcaacctcaaactcttgggctcaaaggatcctcctgcctcagcttcccaaagtgctgggattacaggtgtgagccaccacgcccagcctggtgtctcttctttttttttttttgagacagagtcttactctgtggcccaggctggagtgcagtggcgcgatctcggcttactgcaagctccgcctcctgggttcacgccactctcctgcctcagcctcccaagtagctgggactacaggtgcccgccaccatgcccggctaattttttgtagttttagtagagatggggtttcacagtgttagccacaatggtctcgatctcctgacctcatgatccacccacctcggcctcccaaagtgctgggattacaggcgggagccaccgcgcccggccctggtgtctcttcttataaggtaactcattccatcatgcgtgccccaccctcaagacctcaccaattatctcccagaggccccatctgcaaataccagcacactggagagtagggatttattatattaatttattggaggtgggagacagaaacgtttagtccctttaaatggagtttaattctcttccctttgaatgtggagtgccagtttgttgttgttgttgttgttgtttcgagacagggtgtcactcccaggtagtgcagtggcaagattatggctcattgcagcctcaacctcccaggatcaagcgatcctctcacctcactttttgaatttttgcagtagagatgagctgagattctgtgtaaccatttaagggttcccggcactgcatctcttggccactagctgaatcttgacatggaaagttttagctaatgccaagtggagatgcagaaaatgctaagttgacttaggggctgtgcacaggaactaaaaggcaggaaagtactaaatattgccaagagtatcaaccccaggatggactttaccttctaggagctctaaaccggcaccacccccagtgctcacctggctgactttatcctccatgttccattctacacagcaagtggcagtgtctccaccacctcatccatgagggctttggttccccgggcaaaagcttcccattcaaaaacccctacagaaggccgggcgcggtggctcatgcctgtaatcccagcactttgggaggccgaggtgggcagatcatgaggtcagtagttcgagaccagcctggtcaacatggtgaaacaccggtctctactaaaaatacaaaaattagccgggcgtggtggcacgcaccagtagtcccagctactggggaggctgaggcaggagaatcacttgaatcagggaggtggaggttgcagtgagccaagaccgcgccattgcactccagcctgggtgacagagtgagactccatctcaaaaaacaaacaaacaaaaaaccccaaaaaaccccacaggaccattccacacaatctgcttagcctgagtgacagccccagcatacttcttgctgctttcagggccacagtccaagcccagccagccagcaggtatgccagaagccacagtggcttggccagtcttggtattctcatcaaacttgccagcagtgacaaagtcaacaggcaagataatcttcacaccattcttctcagctttggacattaggtctttgacagtcttggctccctcttcatcaaacagagaagtgccaatctccatgttgctgagcaccttaaggaaggtacaagccattccactaccaataatcatctcattgactttgcccagcatgttcttgatcagctggatcttgtctgcaactttagttctgcccaggatggccaggaagggtcgctctgggctctccaaggcctcggcaaagtagttcagctccttcttcatcaaaaaaccaccagccttctgtggcagattgacttctgccatggagctgtgggctctgtgagcagtgccaaaagcatcattgacatagacttcccctagcttgggaagtgaagcttggaaagcttctaatttggctggatcagcattagccttgttcccagaagcatcttttcccttccctcttcctccacatgaaagcggaggttctcccgcaggatgacagacccagcagctgggttggtacaggctttctccacttctgggcctacacagtccttcaagaacagaacatccttgcccagcagagatttgagttctacagcaactggctctgaggagtacttgtcaggcatagggacaccatcaggccaacctaggtggcttataaggactactgacttggatccattgtccaagcagaatttgatgcttgggacagcagccttaatcctccagttgtttgttacctggttgttcttcataggaaaattgaagtcgactctcataacgaccggcttccctttcacgtccagcttgtccagcatcagcttgttagaaagcgacattttggaaatacagctggggagacagcttggtaattcagacagccagggagccggctaccgacgtgtgctcgggaggtttgcagaatccagtggtatactttttttttttggagatggagtctcgctctcttgcccaggctggagtgcagtggtgcgatctccgctcactgcaagctctgcctcctgggttcacgccagtctcctgcctcagcctcccgagtagctggaactacaggctcccgccaccacacccggcaaattttttgtatttttagtagagacggggtttcaccatgttagccaggatggtctccatctcctgacctcctgatccacccacctcggcctcccaaagtgctgggattacaggcgtgagccaccgcacctggccagtggtgtactttttaacaaaaatttattttgaggtcattgcatattcacatgtaggaaattatacagccattttctctcaatggtaacatgttgcatagctgtagtacaatgtcctaatcaggaaatttcatctcacccacctccgtcaacccaatgaacaagtacagagagtacactgttcacagaggtggttcaacaattctacttccaaagagtatttcccaccagttttttttctttttttattttttgagacagagtctcactctgtcacctaggttggagtgcagtggcacgatctcagctcactgcagtctctgcctcctgggttcaagcggttctcgtgcctcagcctcctgagtagctgagggattacaggcactcaccaccaagcctagctactttttgtgttttcagtagagacagggtttcgccatgttggccaggctgttctggaactcctgacctcaaatgattcaccagcctcagccacccaaagtgttgggattacaggcgtgagccactgtgccccatcagttgtttttttttttttgtttttttttttgagacacagtctcgctctgtcacccaggctggagtgcagtggcgcagtctcagctcactgcaagctccgtctcccaggttcacgccattctcctgcctcagcctcccaagtagctgggactacaggcacccaccaccacgcctggctaattttttgtatttttagtagagacagggtttcaccatgttagccaggatggtctcgatctcctgacctcgtgatccacctgccttggactcccaaagtgctgggattacaggcgtgagccaccgtgcctggccccagccccatcagtttttaaaagttatttacaaaaagtattatttgccgggcgcagtggctcatgcctgtaatccaagcactttgggaggcctaggtgggtggatcatctgaggtcaggagttcaagaccagcctagccaacatggtgaaaccctgtctctactaaaaacacaaaaggtagctgggcatggtggtgcacccctgtaatcccagctactcaggaggctgaggcaggagaattgcttgagcccaggaggcggaggttgcaatgagccgatatcgtgccactgcactccagcctgggtgacagagtgagactccgtctcaacaaaaacaaaaacaaaaaacagtgttatgctactactacttttaaatacatgaagcacttccaaatatctagaaatactagatatttcatctaacttgtccaccatgtacacgcactgttaaataaaattccacacatgtaaccgtggttataatctgaggtatctcctaaatatgaccattttggccttgaaccattccctcctcacttccttctctctgctttcaatccagtggacaagtacacgcatgtgtaatgcttagagatggttgaacaaactcctatccaaaagtcatccacagaagacaagtttcctatgaatttcaacacaaagtatacaaaatatgctaaatttactaagtactttatcacacactggcaacctctttaacatccagcaattagatgttgcaaaatcaggatgcatttgcccattgtatatgctatatacagagcaaaacaaaatgcacaaaacatacagaaaaatagtgtctgaaaatgtccaattatgaacacactggcctattaccttttgcaatttcttccctcccacctcctctaaactatcgaacaactatacacagtactacactgctcacaaaggtggttaaacaattcaatttccaaaaggcagtgtttcctataaattttaacaaaaagatatttacagtgatatttcactacctctatatttaatatacgtgggacacttccaaacatctaggtagactagacatttgaagtaaggagttaatttttccactatgtaacagcagtcttgaataaactgcaaacatgtgacaacagttataatttgaaagtcttccaaatatgaacattctggcctagaaccctttctgtctccatcaacccagtgggcaaaaatgctcaaattttcagaagacaatatttcataggaattttattttttatttttatttatttatttatttatttttgagacggagtttcgttcttgttgcccaggctggagtgcaatgacaaatgtagagttcgtaaatgaatatattttgcatattttgttttaaaattcctaggaaaggccaggcgccttggcttgcacctgtaatcccagcagtttgggaggctgaggccagcagatcacctgaggtcaggagtttgagaccagcctggcaaatgtggtgaaacccaatttctacaaaaatacaaaaaaattagtggggcgtggtggtgggtgcctgtaatcccagctgcctgggaggctgaggcagaagaatcacttgaacccgcgacgtggaggttgcagtgagctgacatcctgccattgcactccagcctgagcgacagagtgagactctgtctcaaaacaaacaaacaaacaaaacaaacaaacccgggagcggttgctcacgcctgtaatcccagcactttgggaggctgaggcgggcggatcacgaggtcagggggtcgagagtagcctgaccaacatagtgaaaccccgtctactaaaaatataaaaattagccgggcgtggtggtgtggcctgtagtaccagctacttgggaggctgaggcaggagaatcacttgaacccgggaggcggaggttgcagtgagctaagattgcgctactgcactccagcctgggcaacagagaaagactctgtctcaaacaaataaaattaaataaataaaaaaaattttaggttgagggagaagttgagcagctttttcctattatagacacaggccttcttcttcttttttttttgagctggagtttcactcttgttgcccaggctagagtgcaatggtgcgagctcggctcactgcaagtgattctcctgcctcagcctcccgagaagctgggattacaggcgtccgccaccacgcccgactaatttttgtatttttagtagagaccgggtttcaccatgttggtcaggctggtcttgaactcccgacctcaggtgatccatccgccttggcctcccaaagtgctgtgattacaggcgtgagccaccaccgtgcctggcctacacaggccttctatagacggtcagtaaatcttcccaaagggtgctggggatttcccaggaccacatgtgccaggccattttaccatttctctcttccacatgaaggtctggtagaacgaaggcgaacagccgcatggccgctaatcgttccactcgtagtcaggggactcgttcaccttccaggccggttaaggctattctccgctatcgtcagggctaggtaggtctcgccccactgggacagagaggtcccccaggtcccggatctgcgcggcttcctggtctaaagcaaggcggccgagcctgtgtccctagaccgcctccagggccctctgcaccctgacgccccatcgcgaccgccccgcttcccgcccgccgctcccgcagccacctggaggcgctgcgtctcggctggggcttcgtctgtgcccggcacagcgagggccccggtgtctgcggggcaggggccgcggcctgtcccgggacatccccgccctccagctcacctgcctgcttgggactcggcaagccggccgcactctgcgtctcaccgcgctctctgtaccattttacatttccaccaccaaagtaggagtaggagtaggagtagaatccagtttctcttatgtcctccccagcactggtataatccttccttccttccttccttcctttctttctttcttccttccttcttctttctctttctctctctttccttccctcccttctttctttctctctctctttttttttttttttttgagatggagtctcactctgtcacccaggctggagtgcagtggcacgatcttgactcactgcaacctccacctcccaggttcaagtgattctcgtgcctcagcctcccgagtagctgggagtacaggcgcccgccaccacgcccagctaattttttgtatttttagtagagacgggatttcgccatgttggccaggctggtctcgaactcccgagctcaggcaatccacccaccccggcctcccaaagtgctgggattacaggcgtgagccaccgcactgcacccggccctccctctttctctctttcttttctctcctctcctctctctttctttctttttctttctctctctctccccctccctccctccctctctttctttctttctttcgacagggtcttgctctgtcacccaggctgaagtgcagtggcaagatctcggctcactgcaacctctgcctggtgggttcaatgattctcctgcctcagcctcctgagtagctgggattacaggcatgtaccaccacaccatgtgctgccacgccatgtgacgccacacctaaaacagttttaaagaaaggagacaaaaaattattaggctgggcacagtggctcttgcctgtaatcccatcactttgggaggcggaggcgggtggatctcttgatgtcaggagctcaggaccagtctggccaatatggtgaaaccccatctctactaaaaatacaaaaattagccaggcttagtggcacacacttgtaatcccagctactcaggaggctggggcaggagaatcgcttgaaccctaggagtcggaagttgcagtgagcaacttgagatctcgccactgcactccagcctggcgacagagcaagactccgtctcaaaataataataataatacataaaaagaaaaatatttttttctgagacggagtctcactctgtcggccaggctgcagtgcagtagtgatctcggctcactgcaacctctgcctcctgggttcaagtgattctcctggctcagcctcccaagtagctgggactacaagtagctgggactacaggcacgcgccaccacgcccagctaatttttgtatttttagtagagacgggggtttcaccatgttggccaggagggtctcgatctcttgacctcatgatccgcccacctcagcctcctgaagtgctgggattataggcatgagccaccgcgtccggcctttttatttatttttcatagagatggggtctcgacatctttcccaggctggtcttgaattcctgggctcgagcaatcctccctccgcagcctcccaaagtgctgggattacaggcgtgaaccactgcatccaacccctgtccagataatttttggcttctgtgtagcattcctttccccagcgtacaggacaggacactctttggagtgagagtcttatgacccacgatcacattagagttctgcagtggacaggtgaatggggggcaggagaaggtcagagagagagagtttctgtttactgtaacaaggactatgggagttatgagtcaggaagcatggatggaaaccaatgtataaatcataatagcatagctgatatctttgttttctcaaaggaatcattacttgccagttttaaaatccatataaagtattttagaattttttgtcttccagcttatacataaccacagaaggaaagcaggaactctgctagtttcttaaaaacaaacaaacagcaaaggggattgaaggtcttttttcttacctaagtggatcagtgttggtgagaagcaagtgaataaactgcagtgggcaggagagcctgagaccagtctggagcctgcaaagagagggaaagggtgcttcttgggcagcctgcccgcccttgcaggtggcctccagctgctcaggagtgcagattctttttttaattttaattttattttttacttttattatttttttgaggcagagtctcactgttttggcacccaggctggagtgcagtggcgcagtctgggcttactgcaacctctgcctcccgggttcaagcggttctcctgcctcagcctcccgagtggctgggattacaggcacgcgccaccacgcccggctaatttttgtatttttactatagacgaggtttcaccatttggccaggctggtctcgaactcctgacctcaggtgatccgcccgcctgggcctctcaaagtgctggcgtgagccaccgcgcctggccaggaatgtggattctgagaagctgcagagctgtgaaaagcaggagacccatgtgcagatgtggttgggttgggggtggagggttctgtcttttctgaggttgtacctttggcgcctggggccatttcctggacagtgttttggttttagcattcatggggtcgctgagtcaggctgtaatttgtatacatgaagaaaatctgtgagggtcagactcagtgaaaaacttgtttgcattgtcccctggagaaaaggtttgggaacatgacaatttatttaggtcacgactttacattgactccgggtgagagtttcctgctggtacaaatgaaggttttgaaggaaagagtgtttccacactgtgaggagaggactggagggcaccttgagctcccaaagttgaattcttaagtgtccctgtctcatcaccaggttctgatccacactggggttccatttcagcagttagagtctgggtcccaagcttgggattattttattttatatttcatttcttcatttcattatttcatttcatttcatatttcattttttagtctcgctctgtcgcccaggctggagtgcaatggcgctatctcggctcactgcaacttccccctcccaggttcaagcgattctcgtacctcagcttcccgagttgctgggattacaggcacctgccaccacgcctggctaatttttgtatttttagtagagatggggtttcaccatgttggttaggctggtcttgaactcctgaccttaagcaattttctcaccttggccttccaaagttctgggattacaggcgtgagccaccgcgcccggcgcttgggaatatttttaacgttatgattgtgggttttccttgtgaactgcgggtgaagcaggctgcttgtctgagctagttcaaatgtttgcttacttctcttggtttctttatagatgatcgctgtcataaaaactccagtttttcctatacatttaatacttttatttctttgtccgttttaattttcttgcctgaaagaagcaagccctcctccctcctgttacactgtggtctggcctggcctgggcgcgcctcctactccgaggccaggggatggctccactggacgccgagtctgtcattccctgtgcacacttgtgactctgtgtccgggaggaaaaggcaggaagggcaccctgagtgcagaaacacgccagtgtcacctctgcagagcctgaaacactttctgcttaaatgcaaatatcctccccggcacagaaggttacagaaggaggaagcccggcccgcgaagggcagtggccaagaccctgtcaatctgtctttactcagccacataccgcattgcttctcctgtcactcagtaccaagggggcaggacttgaatcatcacccaatcaggggcactggggcgggaacctgcaaaccatccaatcaggaactctgcaagggggacaggggcaatgttcaacaactccgcggggtcttcctgtttcgtgtccgctgcgtttgggttccggtctccgcttctccagtggccccggtggctccaccgcagcgtctggcgcgctgggacctgcacaggccggagagagccgtaggcaggaccccgggacaccctggaagccaggaaatggtgcgtgtgcggggccgggcgcctggagactgggggaggggcttgtgggaaccggccggaaccggctgtggaagcaccctggcctccctgcagcgactccagggtctgggacccgagttccctggcgcagctcggccctctgtcccctcggccgcagggtgggttgggccgtagccagtaccccaggcgtcctgtcccgtccctgcgcggcgactgcggcctcggcctcggagccctgtctgggcagctccgcgcccgcagccccgcctctctccagattgtttgtactgggacacgggagggtcataaggcggaatcccgtctcgggtgtgcggttcgtgcatgggaagagctgtgggctgtggccttcccagtacatcgtctttttttccgggggactggtcttcctccgagtcttccaaacgtactggaaaaagaatctcaaacctacgactcccgttttttttagcctagctttttctggggctggaaataaatgcctaaatttccggttccttccccgcattcccaaaggtgacctcccctcgccaaatcaacattatcagctgttttttgtttgacatttaagacacagtattttagttgtttatagtttctttcaccatactcttttgaaaggatttgttttctgtttgttgttttttttttcttttcagacagagtttcgctctgtcgcccaggctggagtgcagtgggaagatctcagctcactgcaaccttcgccttccgggttcaagcaattctcctgcctcagcctcctgagtaactgggattacaggcatgcgccgccacgaccggctactttttgtatttttggtagaaactgggtttctccatgttggccaggttggtctcaaactccagacctcaggtgatccgctcacctccgcctcccaaaatgctggtattacagacgtgagccaccgcgcccggcctcttgtttgtgtacttgtaacctgagagggaaacggagaataagaacctgacactctacggtaaaatttttttttttttttgagacagagtttcgctcttattgcccaggctggagtgcaatggcgcgatctcagctcactgcaacctccacctcctgggttcaagcgattctcctgcctcagcctcccgtgtaactgggattacaggcatgcgccaccatgcccggctaattttgtatttttagtagagacagggtttctccatgttggccaggctggtctcgaactcccgacctcaggtgatccgcctgcctcggcctcccaaagtgctgggattacaggcgtgagccaccgcgcccggccgtggtaaaaaaatttttgtgcttcccctccttttatctttcctaagccccgacgcctaatcagaatgtctttgggtggagtttcccctttggaaactttacaaggtgatgtggccctctatcttttcctggtcctgattttcagaactgcctgggcctgacccaggatacccacagctgccacttctcttggaggatctagtgattatcaacccctgggtcactcctcccagaggacagcttaaggtgtaggggtggggcctctcacgggagcagctgtatgccctgaggtgggaggagtctcccggtatccccttcctctgaaaagtttaccctttgggacgctcagcttttcttcctcaaccccagtttccgttccttagggacacattgatggttacccaatcttaggctgttactgagaggaaaagacacaaatgattcctgacctctggattgtttttagtctagtgaagggaggaaaactatctcaaaggagaaggaaaacctgccccattgaaatggtgcgagaacctgaaagttaaaatgcgcttggggcagagtgagcagggcacaattcactgtcttcagggaggttggtcactgagcactcagtgagccagggtggggctgggagatgtcctaggggatagggtgacctcacctgacattggaatcagataaatgtctgtattccaggtcagcattgcctctccctgggtttgtaaacccttgaaaaggtttatttgcttatttgatcctgtttttcattaaatgtagaatgtattttatcagtagtgcttgaaagacaagataaagtgtttgcaaagggagggtcacaaaggggagaaagaggcagaaagtagatttgagggaaaacaattatctagtcttacattcaatttgttaaaaaatcttatttgtgtagtttcctctccgcaacatgtatggtaggtttctcaggtctattttcttcttttgggtgatttcagatcaatcccagaacttagccttgagaatgctactgcggataagaatctcagataagtagggaaattcagtcttccattatggctacagagaaacgaatacatttccacattaattggtgaaatacagagattctctaaaatatcttctcctttgcagggtagagattttgtcgtaatggataactgttctgtatcctttcatctggactttggtgattaatgctaaatcctatcagatgggactttgaaatattaaatattagtgaattaaatattagtaaagaagttgtcatggaagtaacaataatgtgaggtctctattgtctgaaagggatagataaatgtgcttttcatgtttaagctatagaatacaaatgtcttgccagccgcgatggctgacgcctgttatcccagcaccaaggcaggtggatcacgaggtcaggagatcgcgaccatcctggctaacatggtgaaaccccgtctctactaaaaaatacaaaaaattggccgggcacggtggctcacgcctttaatcccagcactttgggaggccaaggtgtgcggatcacaaggtcaggagatggaaaccatcctggctaacacagtgaaacccggtctctactaaaaatacaaaaattagccgggtgtggcggtgtgtgcctgtagtcccagctgctgggtggctgaggcaggagaatgacgtgaacccgggaggcggaggttgcagtgagccgggatcgtgccactggactccagcctgggcgacagagctagactccgtctcaaaaaaaaaaaaaaaaagaatacaaatgtcttacagtttcctttcctcctatatacataaatggtaagtttgagtgattttgctggattcttcaaacacaggatattttcttacttaaaaataagtgaaactgggcgtggtggctcatgcctgtaatcccagccctttgggaggctgaggtgggtggatcacctgaggtgagtttgagaccagcctgaccaacatggagaaaccctgtttctactaaaaatacaaaattagccgggcatggtggcgcatgcctgtaatcccagctactcgggaggctgaggcaggagaattgcttgaacccagcaggcggaagttgcggtgagccgagatcgtgccactgcactccagcctgagcaacaagagtgaaactcagtctcaaaaaaaaaaaaaaaaagtaagtgaatatagtcttgtctaaggaagcagaggtctgaggccaagtgtgcctcagagtgactcccaactaagagcctgcaaagggaggtcattgaagtcccagttggttcttcctgggtagaacttggcaggcatcccagccttatcactccaaccaggggaggggtcctttatactgagagaagctacagaccactgggaagctggggatgcacacataggcatagttgggagggtgataccctgtctgaggttgtaatagttaattgttcagataataacagtaaaccatgggctcccatgatttgagagagttgtttctagacatcctcaaatacaagaaatccggagttaggtaagaagtgactttatgtgaaaggagtataacgaaaaggtgaaagcagtagatacaagatctgcaagcatcccagaggttaggcagaaaaaggcttttctggtggaagtggcggcttacatctataatcccagcactttgggaggccgaaacaggaggattgcttgaggtcaggagtttgagactaacctgtacacatagtaagaccatctctctacaaaattaaaaaaaattgtggtggtgcacacctatagtcccagccgaggctgaggtgggaggatcccttgagcccagaagatcaaggctccagtgagcaatgattctggcattgtactctagcctggacaacagagcaagaccctgtctcccctcctcttcccctaaaaaagtttttcattcatggggaggaacaaataagattaggaataggtgggaggagagggcagagtggaaagtgcaaaatcggatcctaggtcagagaatatttttcctgaggttagtctgtttttaggatggtttataaaggagggattgggtgggtgcttccttaggctgtggaggatgggtcaaagttcagggctgaaaggaggagagaaacttaaccattaaggttggatttagagatattttgttttgactgatcagtgaagacaaaactgtccagccaattgtttatgaagtaaacaatgggaatttggagagtctgttttgttttttcttttttgagacagagtcttgctctgtcacccaggctggagtgcagtggcgcgatcttggctcactgcaagctccacctcctgggttcacgccattctcctgcctcagcctcccgagtagcctggactacaggtgcccaccaccattcctggctaattttttttttgtatttttagtagagacggggtttcaccgtgttagccaggatgatcttgattcttgacctcgtgatccgtccacctcggcctcccagagtgctgggattacaggcgtgagccactgcacccagccgcctgtctggctttcttataggtaaaataaaggacgtctaaattagtaatagggttttttcccccgcagtatgctgcttctctggaacaccaagggtggtggtggtggtggagagtgttttaatcatagctattctgtaggattatagagcttgggtaaaattcaacattgtcagcaatttggttttgtatccacagagttggtttagtcagagtgtaatttctgcaaatgtctgtgagggtcagacttagagaaagacacctttggcttctttctgctggagaaaaggtttatgaatttacgagtgtatttgcttctgtggtgtaataaatatatttggtgtttgtctgcagttcctgggacagggatcctaaaacccttggaattccctaagtgataggtggagtgtgttttgttattcacaacaatcccctttcagaccatacttgagttttaagctaatgaggtgattctgtggaacccctggatactttcagagtggagactggtgaccagaaagaccaaacccatgactagagggttgttgctttaagctccattccctaccccaggaaagagtggaggctggagattgagttgtgtaaaaatttttgagcaaagacattcagagagtacttccaggttgatgaggacattgatgtgctgggagggtggtgcaccccaagatgaggagcgttgcctatatccacccccctttccctgccatttttcagctcttatttgcctgttcctgagttatacttaagtaacatgttttgctaagttctttgaatagttttagcaaattattgaacccgaggaggagattatgggagctcacgatttgtacacagttgttcagaagtgtgggtggccctgcggcttgtgactggcatgtgaactggcatgttgtgagactgagccctgaacttgtaggtctgtcctaattctgagtggtgtcagaactgaactgttagacacctgctgttagaactggtcggtgtttacacttcgggtgtcacagaaaggacaccagaggtcagaaccttaaactgactccaggtaaacatctggtcactggtgagaatcgagaccgtgaatcacatcatgaggagaggagagtagggtgcgtggagctcccaggatgtttccctcactcatttcttttttttttttttttttttgagacggaattttgctcttgttgcccaggctggagtgcaatggtgcgatcttggctcaccacaacctccgcctcctgggttcaagtgattctcctacctcagcctcctgagtagctgggattataggcatgcgccaccacgcccagctaattttttgtatttttagtagagacggggggtttctccgtgttggccaggctggtctcaaactcctgacctcaggtgatccacccgccttggcctcccaaagtgctgggattacaagcatgagccaccacacccggctccctcactcatctcttaggagtgggccacatcttcacatgaatggtcctcaggcttgtttaaccttctgaatgtgggtttccttgtgactgtgggtgaaacaggctgctaggtaatagatcccagagagaaaggatagttctccttgtaggccaacaggaagagggtggctgtttcagacctgatatacacacctaaccagggagcaagacagaggaatctgggcagatgcctttattggagactctgtgggagttctagttggtgagtttagagcaaccagatgggaatttcgtggagtcacatggtgactgagaggtggtccctgcagcctctctgtgcattccttgtgtagggtcagttggatgatttccagcagtttgtatctagccgtctcatgcggaggtggtcacagggaggcggctgtgtaaggcagataactggattgaccacatggaggaaatgggaggaggcgtagaactggaaactgtattaagggtgactaagccctgcttctggtatgagaaagttaaagccatattcaaagtggcttctgaggtagcatacaattttaagaattcactgcaatagacagctctacactgaattcacaacattatgtggagatgatggcagaagatgggttatcactgctgctggggtttaactgtccgtcgtttctgtccctgactgaccatacctgctctgtcataggttcacataccctacatagatgccctggtttcagaatttcccatatttctttggtttatctttctgctactgccatagtgtcctaattatttcataaccctgatgtatggttgagaaagtgctgtactgtcttagtcacctggggatgctgtaatacattgccataggctgggtggcttgaacagcacacatgtagttttcacagttctggaggctgggaagtccaagttcaagtgctggcagatgtagtgtctggtaagggcctgctttgtggttttcagatcatcatctctcattatatcctcacaaggcagaggagagaggaagcaagctgtctcctgtcatttcttctaaaggtgctaatcccatttatgagggcaccaccctcatggtctctaaccccgattacctcccaaagatgccacctcctaatgcaacgacattaggagttagaatttcagtatatgaattttgggagggacacacagattcaggctgtaacattttctaacagtgtactgtacgaagtctttgctgtttttagatatttgagtcctatttcagttgtttttttttttttttttttttttgagacgaagtctcgctttgttgccccgtctggagtgcagtgacgtgatcttggctcaccacaacctccacctcccgggttcaagtgattctcctgcctcagcctcccgagtagctgggactacaggtgtgccaccatgcctggctaattttttgtatttttagtagagacagggtttcactatgttgaccaggctggtctcgagctcctgacctcaggatccacccaccttggcctcccaaagtgctgggattacaggcatgagccactgcacccggctatttcagtttttagaagtggtcccttccctttccccttccccttccccttccccttcccctcccctccccttctctcttttttttttttttctgagacgaagtttcactcagtcacctaggctggagtgcagtggtgtgatatcagctcactgcaacctccacctcctgggttcaagccattctcctgcctcagcctcctgagtagctgggattacaggtgcaccccaccacgcctgactaatttttttgtatttttacaaagacaaggtttcactgttttggccaggctggtcttgaactcctgaccttgggtgatctgcccgccttggcctcccaaaatgctgggattacaggcgtgagccaccgcgcccggccccttcttttcttttttgtggtggagtttctctcttattgcccaggccagagtgcaacggcatgatcttggctcactgcaaactctgcctccgggattcaattgattctcctgcctcagcctcccaagtagctgggactacaggatgtgccaccatgccctgctaattttgtatttttagtagtgacagagtttcactatgttggtcaggctggtgtagaactcctgacctcaggtgatccacccacctcggcctcccaaagtgctgggattacaggcatgagctatggtgcccggcccttttttcttttccttcctttctttcctttttttcctttccttccttcctttccttttttcttttctttcttcctttccctttctttccttcctttcttccttgagatggtccccctatgtcaccaggcatgatctgcactggcgtgatcatagctcactgcagcctacaactcttgggttcaagcgatcctcctgcctcaacctcctgagtagctgggactacagacacgtgctatcatgcccagctaatttttaattttggttgaggtttcattatgttgcctaggctgatcttgaactcctggcttcaagtgatcctcctaccttggcctcccagaatgctgggattccatgtgtgtgcctggcctagaagtagtgtttcttaaacctttttttttttttttttttttttgagacagagtctcactctgttacccaggctggagtgtagtgccgtgatctttactcactgcaacctctgcctacccggttcaagcaattcttgtgcctcagcctcccgagtagctgggactacaggcgcccaccaccatacccggctaatttttgtatttttagtagagtcggggtttcactgtgttggccaggctggtcttgaacaccttagcctcccaaagtgctgggattacaggcgtgagccaccatgccctgccaagaaatagcatttcttttttttttttttttttttggacagagtctcgctctgtcacccaggctggagtgcagtggcacaatcttggctcactgcaacctcttctctcccgggttcaagcgattcctcggcctcagcctcctgagtatctgggattacaggtgcctgccactacgcccagctaattttttgtatttttagtagagacggggtttcaccgtattagccaggacggtcttgatctcctgaccatgtgatccgcctgcctcggcctcccaaagtgctgggattacaggcgtgagccaccatgcctggcagaaatagcatttcttaagtttaataacataccaagcaaatctggttgtgaattttatggaattaaataaagcactgtatttgggacagcttaagcatatatcatggtaatattcagcctcttttctaaggatctatgccatttctccatgtagtgcttcctaatttgattttttttttcttttttttttgagacagagtctccatccccaggctggagtctagtggcgcgattttggctcactgtaacttccgcctcttgggttcaagcaattctcctgcctcagcctcccaagtagttgggattacaggtgcgttctaccacgccgagctaatttttttgtatttttagtggagatgggcatttgccttgttggccaggctggtctcgaactcctgacctcaggtgatccgcccatctcagcctcccaaagtgatgggattacaggcgtgagccaccctgcctagctatttttgttttttgaggcagggtcttaaccccatcacccagggtggagtgcagtagtgcagtcaatggctcactgcagcctagacttcctgggctcaggtgatcctcctccctcgagcctcttgagtagctggaactgcaggtgcgtgccaccacacccagctaatttttgtgtttcttttttttttttttttttttttgtagagacagggttttgccacattcctgaggctggggctatgctgtctttttttttttttgagacagagtctctgttgcccaggctggagtgcagtggtatgatctcagctcaccgcaacctccactcttgggttcaagcaattctcctacctcagcctctcgagtagctgggactacaggtgcctgccaccagacctggctgatttttttttgagacggagtcttgctgtgtcacccaggctggagtgcagtggtgccatctcggctcactgcaagctctgcctcccgagttcacaccattcttctgcctcagcctcccgagtagctgggactacaggcgcccgccaccacgcccggctaattttttgtgtttttagtagagacggggtttcatcatgttagccaggatggtggcgatctcctgactttgtgatctgcccgccttggcctcccaaagtgctgggattacaggcatgagctaccacacccagccggtttttgtatttttaatagagatggagtttcaccatgttggccagactggtctcgaactcctgacctcaactgatctgtccgcctcagcctcccaaagtgttgggatcacagatgtgagccaccacactggccctatgctctcttttaaatgttgacttcaatggcttgatgctcaaaattcggagtacactgagacttatttgtgtattgagttttcattgtggaaacttactaaacatattgcatatgaggaaactacataaaacagttgcacagtcaactgaaacattgtaaagggaatgtcagtctcatgacagccaggccacgactttgaagacttctcaccacatgccccacttgaaatgattcctagaagccaaatcatccattctctttccagatggggccagtgttatagattataagataatttccttgcttttcttaacctgtgtactcaaccctatgtcaatatattttattttaagccagtcagttacatatttcatttttgaatgaatcttacgcaagtggcattatactgtgtgtactatggaatgtcaggtttcttttttcttttttttttttttgagacggagtctcgttctgttacccaggctggagtgcagtggcgcgatctcggctcactgcaagctccgcctcccagattcacgccaatctcctgcctcagcctcccgagtagctgggactacaggcgcccaccaccacacctggctaatttttcttttttgtagttttagtagagatggggtttcaccgagttagccaggatggtctttatctcctgaccttgtgatccgcccacctcagcctcccaaagtgcttggattacaggcgtgagccactgcgcctggcctttttctttttcttttttgtctttttgagaggaattgtcgctctgtcgcccaggctggagtgcagtggcacgatctcggctcactgctacctctgcctcctgggttcaagcgattctcctgcctcagcctcccaagtaactgggactacaggtacgtgccaccttgccctactcttttttttttttttttgtatttttattagagatggggtttcaccatgttagccaggatggtctcgaactcctgaccttgtgatccacccgcctcggcctcccaaagtgctggaattacaggcgtgagccactgtgcccagccagctttctttttttacactagaattttccatgaaaggttagtttatttgcttttttaattcatagtttacagaaaaatttgggagctattacagagccccttttccctacctcccctatttttttttttttttttttgagatggagtctcgttctgtcaccgaggctggagtgtggtgacaggaggcacgatctcagcttactgcaatgtctgcctcctagattcaagcgattcttctgcctcagcctccggagtagctgggattacaggcgcccaccaccatgtccagctaatttttttttgaatttttttagtagagactggattgcgccacattagccaggctggtcttgaactcctgacctcaggtgatccacctgcctcgacctcccaaagtgctaggattacagacgtgagccaccacgcctggcctacctcccctatttttaacatactgcgttagtgtagtgtattagttatgattataaaccaacatattacatctgataatgatgaaaattggcaaaccaataacattattattaactaaagttgatacttttttttttgagacagggtcttgctctgtcgcccagactggagtgtagtggcgcaatcatagctcactgtagcattgacctcttgtactcaagtatccttctgtgtcagcctcccaagtagctgggattacaggcttgtgccaccacactcgactagttaaaatttttttattttttatttatttattttttttagacagagtcttgctgtgttgcccaggctggaatgcaatggcgcaatcttggctcactgcaacctccgcctcctgggttcaagcaattctctgcctcagcctcccaagtagctgggattacaggtgcccaccaccatgcctggctaatttttttgtatttttagtagagatggggttccatcatcttgtccaggctagtgtttaactcctgacctcgtgatccacccaccttggcctcccaaagtgctgggattacaggcgtgagccactgcgcctggccaaatttttttttttttaatagagacaggatttcactatgttgtccaggctggtcttaaactccttggcattaagcagtcctcctgtctttgcctcctaaagtgttaggattacaggtgtgagccactgcaccgagctaatattattttatattttactttattttgtatttatatattaacagtgtaaatgtatattcgtatgttgaatgtgtgttatacaatcattttatattttaacttactattattttttattctatttaaaaaaatctattgagacttagttaacttttaccactactattcgccatagtaccggatgttctagtcagagtaattagacaagaaaaagaaaagatatcagaattggacaggaagaaggaaattttttcctgttcacaaattatgtgattttacatgtagaacttccaagaacttcccccaccccacacacgcacttagaagtaataaatgaattaagcaaattggtagcatacaaatggaacctgcaaaaatctgttatttttatacattgtcactgaacaacccaaaatggaaattaagaaaacattttcttttcttttttttctttttttttttttttgagacggagtttcactcttgttgcccaggcgggagtgcaatggcgaaatctcggctcaccgcaacctccgcctcccgggttcaagtgattctcctgcctcagcctccccagtaactgggattacaggcatgcgccaccacacctggctaattttgtatttttagtagagacagggtttctcctttttggtcaggctggtctcgaactcccgacctcaggtgatccgcccccctcgacctcccaaagtgctggaattacaggcgtgagccaccacgcccggcttagaaaacattgtcttccatatactttaaatcatctttagctcacttataatacctgatacaacataaattttaggtaaaatagttgttatattgtgttgtttagggaataataaaaagaagaaaaagtctgtacatgttcagtatatacctaaccatcatagacctaatcacatagtacatgatcagagggtggtcgaatctgaggatacagaaactccaagtatggagggctgactgtaatacatcattggatgatagataaagaaaatgtgtaatatccatccagtggaatataattctaccataaatacaaagtggggatgcgtgctacaacatggatgtgacttgagaaacctataatgaagccagtcacataccacatggcatgattctgattatatggaagtccataataggaaaatctatagagaccgaaagattgctgcttatcaagggctggggactggcagaagaagatgggaggataggagattgacaggtaaaaagtacatgggcttatttttgaggtgatgaaaattgtgattatgattgcacatatatactaaaaaccatctgttaaaagtattaggagttttcaggttcattccaaatctatataatctgttactgtttttcttgtatttaccaatgagaataagacttcagggctggatgtgatggctcactctatcggcttcccaaagtgttgggattacagatgtgagccaccttgcctggccaatacatatcttatacgaagtccacaataccatggatactcatccatgtccgaattctagacagtactgatggtaaccaaggccctaatttaacttctcagaatatacagtgctgggctcctaacttctcggaatatacagtgcagggctcctaaacaaggcattggctgaagacctcattcatgaccataatggcttactaaaataagttcaaatcagttgcatgaaatatgatatgggccaggcgtggtggcttacgcctgccatgtcagcactttgggaggccaaggtaggcagattgcttgagcccaagagtttgagaccagcctgggcaacatgacaaaaccccgtctctacaaaaaatacaaaaatttcctgagcatggtgacatgtacctgtagtcccagatccttgggaggctgaggtggaaggatcactttagccttggaggttgaggctgcagtgagctgtgatcataccactgcactccaatctgggtgacaaaatgagaccctgtctcaaaaaaagaaaaaacatggttcagtgattagttacttttcagtcatgagtctcttcattttaactttttgtaacagatttttttcagaacagttttaagtttacagaaaaattgatcattaagtacagagttatttaatgatcactcttctttacggtttgccctatttttttttttttttttgagacggagtcacgctctgtcgccactctggaatgcagtcgcacagtctcagctcagtgcaacctgcacctcccgggttcaagcaattctcctgcctcagcctcccaagtagctgggactacaggcacgcaccactccgcccagctaatttttgtatttttagtagagatggatttcaccatgttggccaggatggtctcgatctcttgacctcgtgatctgcctgtctgagcctcccaaagtgctgggattacaggcgtgagccaccgcacccggccagtttgccctattttttatatattgtattactgtggtacatttactacagttgaaccaatatggatgcattaatgtttacattttacattagagttgactattgtatattcactggactttgacaatgtttaatgacatgtgttatttctgttagggtagtttcactgccctaaaaatcacctatagtttacacattcattcatctgccctttgcatcctgaaatcccttaaaaccaaagactttttcatgtcccatagttttgtcttttgcagaatatcttatagttggtaatacattgtatatggcctttttagattggattctatcacttagtaacatacttttctttttttctttttgagacggagtctcactctgtcacccaggctggagtgcagtgatgtgatcttggctcactgcaacctccgcccccttggttcaagcgattctcctgcctcagcctcctgagtagctgggattacaggtgtccgccaccatgcccggctgatttttttatttttagtagagatgaggtttcaccgtttggtcaggctggtctcaaactcctgacctcaggtgatcctcccgcctctgcctcccaaagtgctgggattacaggtgtgagccaccacacctggcccagtgacgtacttttaaatttcctctatgtcttatcatggcttgatatcttcttttcatccatatgattatatttaatcatatggatgtactgcagattgttcatttgtttatcaagaatctcttggttaactctaaattctagaaattatgaataaaactcccataaacatccatgtacaggtttttgtgtgaacatgttttcagcttattttgataaataccaaggagcatgattgttaggttatatgttgagtatgttttgtttagttttgttttgagacagagttttgctctgtcgtccaggctggagtgcagtgtcaagatctcggcttactgcagcctccacctcctgggctcagacaattctcctgcttcagcctctcgagtagctgggattacatgcatgtgccaccatgcccagctaatttttgtatttttagtagagacaaggtttcaccatgttggccaggcgggtcttgaactcctgacctcaggtgatccaccctccttggcctcccaaagttgtgggattacaggcatgagccactgtgcctggccgagtatgtttagttttataagaaactgaccatcttccaaaataggtgcactgttttccattcccacaagtaacaaatgagggttcctattgcttcacatctttgccatcatttggtgttctcagtgttttaaattttagccattctaataaaggttgtgttagtctttaatttttaaatttgtaattccccagtgacaaaatatgcatgttttcatatgtttatatgccatctatatattttatataatcatgtcttatgcagcaaagacaattttatttcttccttctaaatcgatatactttttatttcctctgtcttgttgcttatctaggactttaaggatgttgttgaatagtagtggtgagagaagacattcttaccctgtttctggtcttgtgtagaaagcatctagtttctcactgttaagtatgatgttagctgcaggttcctcattgatgttctttctgaggaggaagttctctattcccagtttgccaccgtgagtggatggtagattttgtcaaatgttctttagtttttacttttgcctcctttcatttctgatcttagtaatttcttttttcttaccatgactagaggtttatcagttttattggtgttctccaataaccgacttctgttttttttttttaatctctattgatttcctgccatttcattgacttctccaattattctgtctgtctgtctgcttacttgggtttaatttgctctcttgtttttctgttttcctgaagtagactcttttcttttttctgtttttttttttttttttttttttggagacagcagcctgctgtgtcgcccaggctggagtgcagtggcatgatcttggctcactgtaacctccatctcccaggttcaagtgattcttgtatctcagcctactgagtagctgggattacaggcatgcgccaccacacccagctaatttttgtatttttagtagagacgaggttttaccatgttgtccaggctggtctccaattcctggcctcaagtaatctgcccgccttggcctcccaaattgctgggattataggcgtgagccactgcacccagcccgaagtagactcttagatgattcattataaacccttgttctttcctggtgtaggtgttcaatgctgtaaatattcctctatgcactgcttttgctgcataccctaatttttgataaattttgttttcattttcattttaggtcaaaaattatttttgatttctcagacttctttgatccatgtgcttatttagaattgtgttgtttaatctctaaagatttgggggagttggtaactatctctgttattgatttctagatgaatgacttgtggtctgagcatactttgtatgattttttaaaatttttcatattaaggtgtgttttatgccccagtatttggtttatttttgtgaatattcctgtgaacttgagaagaatttgtgttttgctattgttagatgaagtattccatgcatttcaattaaatccagttgtttgatgatgctatttactttactatgtcctttcagattttctgcctgttggatctcttaattactgctggaggggtgctgcagtctccaactatacaagtagattagtgtattttttctttgcagttctatcagttgtattttgccacatgtattttgcaacgcttgttatgcaaacacacactaagggttgtcaggttttcttggcatgttgagtcctttatcattatgtgatgctcacttatatctctttatttattttaaaaatttaatttattttttttagagacagagtctcactgtgtctcccaggctggaatgcagtggtgtgatcatatagctctttgcagccttgaactcccaggctgcagcaatctacctgcctcagcttctcaagtagctgactgcaagtttgtgataccccaactggttaattaaaaaaaaaattttttttttttttttttttttttttttgagacggagtctcgctctgtcgcccaggctggagtgcagtggcgcgatctcggctcactgcaagctccgccttccgggttcacgccattctcctgcctcagcctcccgagtagctgggactacaggcgcctgctaccacgcccggctaattttttgtatttttagtagagacggggtttcaccgtgttagccaggatggtctcaatctcctgacctcgtgatccgcccgccttggcctcccaaagtgctgggattacaggtgtgagccaccgcgcccggccaaaaaaatttttttttttaaattttttttatagagatgaaggtctcgctgttccccaggctggagtgcagggtctattcacaataaattatagcgcattatatccttgaactcctggtctcaggtgatcctccatctcagcctcctaagtagctgggaccataggcatgtgccactgcacctggcttatctctgtgttttttcctttctctgaagtgtactttgtgatattaagatagccatgccatgtttcttttaattaatgttagcattttatatatttccctatccctttacttttaatatgtgtgtctttgtatttaaagtggtttccttttagccaacatactatgtttttaaaatccactataacagcatctgtcttctaattatatttggactattgacattcaaagtgattattgatacagttgtattaatatctaccatattttttacttttttctattagttgcccttgcttttgtttctttttttgtctctgaccttccttcttgggctttaattgagcattttacctgaggtgtgacatattttgtaatcatatgatttgttagtgagcctttgttcctggcctgggttgtggccttctgtggtattgtaagaaagatatgtggtcttttttcctcagtgcctaccatggttctcctatttttttttttattttttttggagacagagtcttgccacccaggctggagtgcagtggcacaatctcggctcactgcactttccacctcccaggttcaagtgattctcctgcctcggcctcccaggtagctggggtaacaggtgcgcgtcaacatgcttggctaatttttgtatttttagtagagacgaggtttcgccgtgtttcccaggtcagactcaaactcctaactcaaatgatcctgactcaagtgaactcaagtgatctgcctgcctcaggctcccaaagtgctgggattacagacatgagccaccatacctggccagcattcagaattcttgttaaaggttagggaagctatcatgttgttcttcagaagactttgaccattgttagatattcattattcctgctacatttggagaagaactttttgttgactcttcaacagtttttaggggatttatagaatttaaaaaatattttgtaagaggctatcttgaggacatttcattctttctcagaacccatctttccagccaggtgtggtggtttacacctgtaatcccagcactttgggaggctgaggcaggaatttgagatcagcttgagcaacaaagtaagaccccatctctacaaaaaatttaaaaattagctagacatggtgtcttgcgactatagttctagctacttgagagactcaggagggaggatcacatgagcccaggagatcaaggcttcagtgagctgtgatcatgccactgcactccagtgtggatgacggagcaagttcccatttctaagaaaaccaaaagaacccatctttccccttattttattttgccttgacattacacaatgtagtatcacatagtgactggtcaggaatcatttcctcttgaaatttgagaaagaggattttatgttcttttggagaaaagcactgctgatcccttcgtgtattttataatcatggtcaaattcaccatcaaaccatctggacttgaatgaaatccctcagaaattgcaactcttaacctgttcctcaaggttagcaagtcatagggtaccttgttatgtatctgccagaaaaaactcttctggcattttgtcttcttagtatgtttgtgtatgtaaggtaaaaataggtgggaaactgcccttgacgttcatgactggggattttgctgggtgagggggcgctgcctaagttgccataccttcttcttcatgcctgagttctgtcttcccagtagcttcctagcctagtgaaatgggacagagtcaaaggaatcagtgagtctataacaaatgttatacatgcaggttaaaatgacttcttttgcagaggaatattttctttcaaccaacttgatctgtctacgtctgatggcctggaatccttcaggaaagtgtggtcagctggattttgtcagaacgtggatttctacgggccttctggcctctcatgtttgatgaagggaacagaagaaaatggtttcacttcttcagtgtatatttatttattcatggatacctttttcagtttttatcctgtgtttctttttttctttctttctttctttttttttttttttttgagacagagttttgctcttgtcacccaggctggagtgcagtggcacaatctctactcactgcaacgtccgcctcctggtctcaagcgattctccttcctcagcctcccaagtagctggtattacaggtgcccaccaccacgcccagtgaattttttgtatttttagtagagacagggttttgccatgttgggctggctggtctcaaactcctgatctcaggtgatccgcctgcctctgcctcccaaagtgttgggattacaggcatgagccagtgcgcctggcctaccctgtgtttcatggaatgctgattggtgtgagatatgaaaggaaatggaagtttttcctggtaggaatgatgatcttaaattttttttttttgagacttagtctctctctgtcctccaggctggagtgcaatggcatgatctcagctcactgcaacctccgcttcctgggttcaagctattctcctgcttcagccccccgagtagctgggattacaggtgcatgccaccatgcccggctaatttttttgtatttttggtagagacggggtttcactgtgttggtcaggctggtctcaaactcctgaccttgtgatcctcttgcctcagcctcccaaagtgctgggattacaggtgtgagccaccaggcctggccaaaatttgttttctttgtatagcattttatttgtttctccaaggtgaactggatcctgccattagagaccaataaaacttgtagtgactacagtaaaaatgtagagatcagttgcatgttttcatggggtaattaaatttatgagaaagtgaatgtagacggaattctgacaaccatatttatttatcataaaataaatgtttggagactgccacatcgttttgtcgacttttttgttttgttttttgtttgtttgtttgagatggggtctctctctgtcagccaggctgaagtgcagtggcgtgatcttggttcaccgtaacctctgcctcccttgtttaagcgattcccctgcctcagcctcctgagtagccgggattaacaggcatacgccaccacgcccagctaattcatatatctgtagtagagatggggtttcaccatgttgaccgggctggcctcaagttcctgacctcaggtgatctgtatgccttggcctcccaaagtgctgggattacaggcatgagccaccacacctagccatttgtgaacttttatgaattgggtttacatccctgtactgtcatctcattcttcctcctgcattgcatatttgggatgttttaggactcagtggcctctgaggatgtggctgtgaacttcacacttgaggagtgggctttgctggatccttcccagaagaaactctacagagatgtgatgcgggaaacctttagaaacctggcctgtgtaggtaaggatgacatcattccttcttttagtcagttagagaagaagtatttcttgctttttaatgctttttcatgatgtctaatgtggaaaagggaatacttgggtgaataaatcagggttgtttgcaccttatcatgaacttagaatctagtcatttttctgtaatgtctatcagttcataaggattttttctgactatattttaggaaaaaaatgggaagaccagagcattgaagattggtacaaaaatcaggggagaattttaaggtaatttgcactgacaagataaagcaatgtctccttcttagtatgtcatgaaattttaaaaataagtaaacaaaccagtaagcccagcttcagatttatttattcctacaactttttcaccagaaaaagaaaaagtggcatagatgttcagtgttgcaaaatcattcacttggaaatagtattaagaaactgtatatatggatatcacttttttggtgatagctactgtcaagctctcttgcagagcattccatccattcactttcaaacaattcatacaggcctgaaaacttaccctttccgcgattatggtaaaaatgtaagtcgaatacctattaataaatataaagtcacaaaccactaaatcttgctttctattttttccagaaatcatatggaagagggactcagtgaaagtaaagaatatgatcaatgtggagaagccttcagtcagattctcaatcttaatctgaacaagaaaattcctactatagtaagaccatgtgaatgtagtttgtgtgggaaagtcttcatgcatcattcatcccttagtaggcacatcagatctcaccttggacacaaaccatatgactatcaggaatatggagagaaaccatataaatgtaagcagtgtgggaaagccttcagttcttgtcaatcctttcgaagacatgaaagaactcacactggtgagaaaccctatgcatgtccggaatgtgggaaagccttcatttctctcccaagtgttcgaagacacatgattaagcacactggagatggaccatataaatgtcaggaatgtgggaaagcctttgatcgcccaagtttatttcagatacatgaaagaactcacactggagagaaaccctatgaatgtcaggaatgtgcaaaagctttcatttctcttccaagttttcaaagacacatgattaggcacactggagatggaccttataaatgtcaggaatgtggaaaagcctttgaccgccccagtttatttcgaatacatgaaagaactcatactggagagaaaccccatgaatgtaaacagtgtgggaaggccttcatttctttcacaaattttcaaagtcatatgattaggcacactggggatggaccttataaatgtaaagtatgtgggagagcctttatttttcccagttatgttcgaaagcatgaaagaactcatactggggagaaaccctatgaatgtaataaatgtggtaaaaccttcagttcttccagtaatgttcgaacacatgaaaggactcacactggagagaagccctatgaatgtaaggaatgcgggaaagccttcatttctctcccaagtgtccgaagacacatgataaagcacactggagatggaccttataaatgtcaggtatgtggtagagcctttgactgtcccagttcatttcaaatacacgaaagaactcacactggagagaaaccctatgaatgtcaggtatgtgggaaagccttcatttctcttaaaaggattagaaaacatatgatactgcacactggagatggaccttataaatgtcaggtatgtggtaaagcctttgactgtcctagttctgtccgaacacatgaaagaactcatactggagaaaaaccctatgaatgtaaagaatgtgggaaagcattcaattatgccagttccattagaatacatgaaagaactcataccggagaaaaaccctatgaatgtaagcaatgtggaaaaacgttcagttattccagttcctttcaaagacatgaaagagctcataatggagataaaccttacgtaaagaatgtgggaaagctttcatttatcacacaaccttcgaatacctgtgaaaatgaatagtggaggacaggtctacaagtatctacatatctaaagaatatggaaagtcttcagtttgctttctgggtttcagacttgtttgggagctcacccctttctcctgtttctcacttttggaataggaatctctatcctgtgcctgtctcatattttggaaatacatgactagtttggttttcaccggttcggagctgaagaagaattttgcctcagcatgaattgagtctcatccatatctgagtgatgtgatattgagatgacactttggagtttgagtttaaacattaggcttcatgctggaattaactgagacttttgaggcctttgggatgagatgaatatattttacatgtgatgacatggattttgggggccagaggtgtaatgttttggctgagtgtatgccacctcagattcatatgttgaaaccttacccccgtgccccccctctcccccacaatgtgatggtatttggaggccctgtctctggtggtttttaggattggaggacatcatgaagatggaggccttgtaattgggattagtttcctgataggaatccctagagagctagctttgcccttcaccatgagagggtgcagtgagaagatagctatctttgaaccgggaagcaggcccttaccagacatggactatgccagtgccttgatattggacttcccagcctcccaaaccatgagaaataaatgtttgttgattaattaagctttccaatttatggtattttgttttagcaacccaagctaagacacaatccaattttaaaatggaggaaaggacttgaatagacatttctccaaagaagatacccagatggccaataagcacgtaacaatgctcgacatctttagtcattagggaaatacaaatcaaactcaagacatacatagcatctcattaggattagtagtatcaaagatggaaaacaagaaatactgtcaaggatgtggaatgttggagaacattgtgcactatcactgggaatgtacagtggtataagcctgctgaaaacagtatggcagatccccagattaaaatatagaaataacatatg

SEQ ID NO: 36263 - DNA, 17052 bp, Homo sapiens
ccctcccccggccgctggctcgctcggctcgcgacgctgcagaggctccgaggcggcggcggcgactccctctttccctccctcctcctccgtccgcccgtccgtccgcgcgtctgtccgttcggcccggtccggcccgaagcatggccggcgtcagcttcagcggccaccgcctggagctgctggcggcttacgaggaggtgatccgagaggagagcgcggccgactggtgagccccccgcccccgcccccggcccctttgtccccgcgccgccgccgcgcctttgtttctctcccgccccgccgccccgccgccgggaagggagggggaccccgaaatggtgcagcgggccgggagggccgggaggggctgcctttgtgcgcgccgggggaggggccggcgggccaggcggggcactgccgggccccgagcgcccggaggcggcccaaggcgcgcggtgggagcggcggccggacgcggcccggaggcgcggggtcccgatgtggggcccggggccgcgtggccctgcgggagcccatcccccaccctaccccccgggcccgggggacaggtgtgcacggggcggccaagggcaccttcgccaccttcgagcgggcgaggtccgggcggggacggggcggggaccgagctagcggagccagcgcagcctgcccggctcagcccggcccggccacagcacaaaggaaagcgagggcgggggaggagcggagcgggctgggggccgggcgccccgcccaccggggggcctctcggagtgggccgccctccccccgaaacctgggctggagtgaggtggaaggatgtttgctgccacatggcgaccgcgaagtgactcccttaccgccgcgggtcgcggaggaggcaggggtgagctctcctcccctacctgaaggggactgcggggactaggcagctgggctggggggcaccgagctgcctaaggggccagctgagatccctgggaggaagccctctggagaacaagtgtggagggagcccccaaagacggctgaaggggtgaacagatccaccggcccccagcaaggggcactcggtccctgatgggggaggagctgggccgcccctcaccccgccccccagctgttgtctcccgctgagctgggggaggggatggaccacctgctctggggctggcggcccagggtggtggaaaaaggaaaccgaggggttcctcacagccccatcctggaatcctttaacccccccgtaatactcttcttctagggaaggtgcccatctggttcctaggcctcctctccctgctggcagatgggaacaggttcttcttgaggaaactgaggcaaagaggagggcaggtctgagggaccccgcttgggctggcctcacccgcacactgggagggcagccaggtggggactctgacctgggggcttctggaggagaggatgagatggctgggcatccatggcatggtactgcagcactggccagcagccaggcctggagggatggacgcgagagacaagctctcgtgtcctgcaggtcagtcacaggagaggccggcacaggctcagcaggcaggcggcccacccattgtcccagccctgccccaggggggctgagatcatgggaggagctctgggcaagtggccggcttggcctggtgaaggagctggctttgggataaggccccgcctggggagaagcacagctcaccccagaacacctcctttgccctccagcctggaggggtgttgtctaccaacaccccattttctcctaaaagcagagctctggtggcctattgccaaggccacacaacccctgttgccccacatcctgctcaacacaggcctgcccccacccaccccagcagcatccgtgtggccaaagcgagttattcatcactggtgtgcgtcagcccccatctgggttgtgtgtgggacacacacagatgcacacatgtaccctcgcacatgcacacattcgttcactaagggcccagataacattttgaaaaaggggtgtgaggatcactttctacacaagagaatatgaataccccagggcccagcatggaaccaggggtgcagtgaggtctgaagactcagaggcagaccctgcacataggtccagagggaggggtgtcttgggtaaattgctgtctgccccccgacccttaccttgcctccaatggggaggggtggttgggggagttcactcctaggtggcagggcctctgaagtgcaccactactctggcacagggagcaggggacccaggaaatgaggttgtgtggtgggaagggccactgttgtcctggttgtgatatgactcactgtgatcatacacaagttcctggtcctcttggaaagaaaagggattgggcccagcactacctcggatactgaaggcctttctagcaccaccatcctgagagtgatggtcctgcggggtccacctgccctcagcccccgactccagctcaccctccaccccagctcaccccccatcccagctcaccccagggtctctggaactgccacattccagctcccacctcacgctagttcagtttatctggctagatggcttttgagttggtgtcaatatcacacatacttctggtatgcggtgtgctggaccccaggacccagagagcaggatgtgctgattgactgagtcagcgttcctgccttcaccaggcttacagctgggggcagtgtctgtctccaggagttggagctggtgagatgtgtagatgcctggtcgcctaccccatcctgattccctgtggtttcgccagcttccacctggtgcaccaccaggctcggggtgcctctgatgtggttgagaagcactggtctttgtattcctgctgggatatggtgggtgctctgggaggggcagctcaggagaggctgctgggggccagcactgggctctgaagaacggaagcattccactgggaataggcgtggggtagaggagcaggtcttgccttccacgtgaagagaactacataggcagaggcttcagggtgagccctgtccagaaccctgcttgggtcagggagccgtccagtgtgtcccaagtgtgtggtgtggacagggtggtccaatggaaaggcaggctggagggtttgaactggggtatggtttctgctgggggagagctgcggctggagcaggaagaggtggccggaggtggggagccaggggctgaggatggaaggcaccccggggagcctaggcaggccaagacaggtcctctcagagggaggcttgatgtctacagcagtctctaggaactagggtccctgggctctgcattagtttctcatcagtgcatggagagagacagagcctgcttctcccagggccctttgttcccgtggtgggttagggcagcaggacaggtggtgggccagctgtgctggaagcatctgtcagggccaggctggggctgggggtaacagttggaccaggagctcccagccccacagcccacctgtgttccttcctggaggtaggaagccgggaatccaggaaggggaggggctgaggccatttggccctggccacaacctcctgagacgtcccctccatccctcccgccttcatttcctttgtcccttcacttctgtcctttctcttcttcctcctctcctggtttctccctctgcttctcccctcctctttctcttctcccttgccctccctttctgcctcccctcctcacagccccagcctcctgccttggcacctggggaataggagtttggagaaggggttgagagccctttcaaacttcagggacaaggcccttcctcctaggccccggctctcctccctcccagagggtcctcagcctgggcctgcatggggtgatggaggaggcatctctgccttcccttctgtgcaatggttgctctgtcaccgcagcctatcaaaaggagccagggcacacaaagctagggaggaggaggaaggaggaaggccaccaggtcagctttctgttagagctcagacagaaggaaaggccagcagtctcaggaagcctcagccaggactgaggcagcctaggggctggaaggcctggagctcaggcttggccaccccggggccagagtctgggcgagagtgactgcagtgacctcatccccatttcagagaggcggagattgaggctgagggcgggtccccagggtcctttgtgttcaaggagaatgcagttggggtgggccagtcgtgtgccaattgcagggttgccatggttactgggggatgcccagagctgttgggagcaccaggttctctcttctcctcctccctccccgggggaggggcagcggggaccaaggcacgtgccaggtaagttcctggcactagccaatgggggatgaggatcctggtagccagggaacggtaaccaaggaaccgtcgccttggaatctccatcacacacccgctccactgggttgtaggctgccagggccagggccgggatgctgcgcactgagctcgaccagccagcaatttctcccctcactgcctgcgcccccctgacccaggcctccagcagtaccctgctgggctcccgcctgaaccgatgcctggccctgttgtcatggctacagcaggagccctccccgttcctgtcctacccactccatgtccctctccctccccagagccgtccccacccagaattggcggcctgggccctgacagtttgacagccacccctccctctccccagggctctgtacacatatgaagatggctccgatgacctcaagcttgcagcatcaggaggtaggaattccagccattccctcgccgccttctccaccccctcctcctggttgttttcttccccacccacctggctgtaggccacctccctgcctgcaccctgcagccccacacttgtctggatctggcgggtgtccttcctccagtcatccctgtgtccccagggtggggaggaatctcagagccttgttgaatgttggacttctgaggctgagcctccaacagggaaagtgacttatctgaagccacacagctgggacactttgggggaagggccctattcaccgccttccccagagccagaaggcttgattgtgcctctgggcactggcacctggtgagacatgatgatgtgtgaagaatgagacctgagtgtgaagaacaaacacttcctcagtcctacccccaaatcaggccctgcaggagtcacaggcaaagctacatccctgtgcgccaccacccccacacataccaacacaaaactgggacccacagaccccagaggccagaagacccctgggggtgcctgtggaggcctggaggagtctttgctttgagttccaggctctttttgggaagggtttaggaggcagagagacctgacactctcctgattaccctagaagggggcttgcaggagctttcgggacactttgagaaccagaaggtgatgtacggcttctgcagtgtcaaggactcccaagctgctctgccaaaatacgtgctcatcaactgggtatgcggccggggctggggaagggggctgagggcccagagctgctcatcaactgggtatgcggccggggctggggaagggggctgagggcccagagctgctcatcaactgggtatgcggccggggctggggaagggaactgaaggcccagagcagtcgccctccccgtcggccctctgacacccgtggagagggaagcccaccctcttcccaccccggggaagatgcaccctatcgtgtagggccccccttgtcctttcctgaccccctctttgctgggtactttgcaggtgggcgaagatgtgcctgatgcccgcaagtgcgcttgtgccagccacgtggctaaggtggcggagttcttccaggtgcgtgtcaggggccagcgctcttgggggtggggacagccaccagggtctgcgtgctggggtggggatggcgggaggatggtgccgcctgagcactgccgtcttcttgcggaagggtgtcgacgtgatcgtgaacgccagcagcgtggaagacatagacgcgggtgccatcgggcagcggctctctaacgggctggcgcgactctccagccctgtgctgcaccgactgcggctgcgagaggatgagaacgcagagcccgtggttagtgtgtgtttggcacccgtgggctctgcctgcgtggcctggtgcccgagtctggcctgcccggtccctcttagctctcaccctttaggtgtcgggggttcctggggcattcagcctgcttatgctgggtccttcgacactgcagggcaccacctaccagaagacggatgcagctgtggaaatgaagcggattaaccgagagcagttctgggagcaggccaaggtatggaaccctgagcccggcctggctgagccacccctcatggaccccatggggcaggtctgagtccctcactgcagtggcatggcccatgccacgtgccccgcccccagcgctgggttagggaggggctggaggggcagggtccaggcgcctaggctcggggcctacccttgttcgcaccggggcttgcagaaggaagaagagctgcggaaggaggaggagcggaagaaggccctggatgagaggctcaggttcgagcaggagcggatggagcaggagcggcaggagcaagaggagcgcgagcggcgctaccgggagcgggagcagcagatcgaggagcacaggtgagcctgcccgcccggagcgctccaggggcccccgggcgcaccctgacgggtgctggctgcttatcgttccaggaggaaacagcagactttagaagcggaagaggccaagaggcggttgaaggagcagtctatctttgtaagttctttgccaaggctcccggtctctgggtcagggaagtgagaatggtccctgtgttcctgggccttgtggggagatcagtggctcagggacagtggtggctgttctggggagctgcatgggcacagggtgccatggagcatgaggcctggcacctcatcacgtggggctctggcctctggccgtggaaaaagactactttggagaagcttgtgctctagattggaagagaaactccatctagacccagaccctcactgaccaggctccccctcccctgccctggggtttctcggcgattagacactgttctgcactctgaggggccacaggagtgaggcaggcggcatgggtgagcctgggccagtgctgagcatctgcaggcagtgtgtaccatctccttgggagcagcatctccctgggagcagcccctttgttccaggggtactgtctgaatctccacacattgggaatggcccgtaggtcctgtggattggtccctgagaatcacagcagagtcacatctccatgctttgaatttagtattttggaaatagctaatgtcattcaggactgagcatggctcagttcaggaagggaggtgggttgatactcatctggattgggactgtaatgggcagatgcatggctgtggggactcaaacgggctccggagtcacccacaggaggctgagagagaggaggcaagacagtcctgcaggcagcagcattaagtcactccagtcacatctgcccttggatggggtggggatgatgtgtggctggtaagctccatcctcagtcattcattcaacacacacctgccacctgccacataaagaacatggtggagaacgagctgggtaagatctttttttcataagttgattcatgtattttttttttttttttttgagatggagtctcactctgtcgcccagggtagaatgcaatggcgtgatcttggctcactgcaacctccatctcccaggttcaagcgattctcccgcctcagcctcctgagtagctgggattacaggcgcacaccatcatgcctagctaatttttgtgtttttgtagagactgggtttcaccatgttggccaggatggtcttgaactcctgacctcggttgatctgcccgcctcggcctcccaaagtgctgggattatagacgtgagccaccgcgcctggccacatgtatgtaactgtggcaaaatacataaaatgtaccatttcagtcattttaaaatctgcatttcattaagcggcattaaattcattcacattgtaggataaccaccaccaccatccattaaacacaaattctgcccttccccactcgccagctcctggcaacgaccattccactttctgtctctatgaagttgactactctggagactgcctatcagtggaatcgcacggtgtttgtccttttgcgtgtggcttatttcacttagcatgatgtccttaagattcatccatgttgtagcatgcatcagaatttccttctttttgaaggctgaatcatattccattgtatggatataccacattttatttatcctttcagagtgaggttttttaaaatttttttattttttaaatttttttgagacggaatctcgctctgtcgcccaggccggagtgcagtggcgccatctcagctcactgccagctccgcctcccaggttcacaccattctcctgcctcagcctccaagtagctgggactacaggtgcccgccaccacgtccggctaattttttgtatttttagtagagacggggtttcaccatgttagccagggtggtctcgatctcctgacctcatgatctgcccacctcagccacccaaagtgctgggattacaggcgtgagccactgcacccggcctgcctcccaggtttaagtgattttcctgcctcagcctcccaagtagctgggattacaggcgcccaccaccacgcctggctaatttttgtatttttagtagagatggggtttcaccatgttggccaagctgatcttgaactcctgacctcaggtgatccacccgccggcctcacaaagtgccgggattacaggcatgagccaccgcacccagcagataaagtttattatttatttatttatttatttatttatttatttatttatttattgtctttttagtagagatggggtttcaccatgttggccaggatggtctcgatctcttaacctcatgatctgccctcctcggcctcccaaagtgctggaattacaggtgtgagccacctcacccagccaagtttatttatttatttatttttatttttttgagacagagtcttgctctgtcgcccaggctggagtgcaatggcacaatctcagctcactgcaacctctgcctcctgggttcaagcgattctcttgcctcagcctcctgagtagctgggattacaggcgtgcaccaccatgcccagctaatttttgtatttttagtagagacagggtttcaccgtgttggtcaggctggtctcgaactcctgacctcgtgatccacctgtctcggcctcccaaagtcctggaattacaggcgtgagccaccgcaccctgcctgataaagtttatttatttatttatttatttttatttatttatcttttttaagatgaagtctcactcttgtcccccaggctagagtgcaatggcgccatctcagctcactgcaacctctgcctcctgggttcaagcgattctcctgcctcagcctcccaagtagctgggattacaggtgcacggctccatgcccggctaatgtttgtatttttagtagagacagggtttcaccatgttggccaggctggtctcaaactcctgacctcaggtgatcctcccacctcggcctcccaaagtgcactgcacccagccctgataaagtttatttttttgctaacatttcaaacatacacacatgcaggtagacagaatagtgttgtgaaccccctgagctgatttattttcaccagttatcaacatttcaggtaaagtctgaaggagcttaccattattttatagtcccatctggcccttcaagtatagttcacgtgagagtgacagtggacattctagcaggtcagtgtggtaccctttcaatttcaggtcctctaaggaagggaatatgcgagagactttgggatttagcactgtgaaatgctttctcttggcttaaggagctgttgctttctctcccctgttacgaattgtgttccatatctgagttccctttttgcctggcctgcaggggagctcccgtgtatctgaaaatgctttaggcacagcagtggctttgacccatgtggttagtgcgttgatctctctcctccctctgggccttacttgtttcagtgttcacatggttggtagtttattaaagcctttgtggagggctgggctcagtggctcatgcctgtaatcccagcactttgggaggccaaggcaggcggatcatgaggtcaggagatcgagaccatcctggctaacatggtgaaaccccgtctctactaaaaaatacaagaaattagccgagcgtggtggcgggcgcctgtagtcccagctactcgggaggctgaggcaggagaatggcgtgaacccgggaggcggagcttgcagtgagccgagatctcgccactgcactccagcctgagtgaaagactctgtctcagattaaaaaaaaaaaagcctttgtggtagttgcctctggtcctttctttgaacaaggcagaggaaccaactgagattacagcaggcagtgggcagagcagcaaaggctggtgggacacaggctcatgggaaggtgaagagcctaggctgactggaaccccgtgggctgaggagtgggggagatttgattgggaaaggagagcaagggcagaggaggagtttagacttcattctgggggtcacaaagttatcactgaggtgatagccctcctgaggtgggatactacgaagggcccttctcccagtgctcctgacataagctaaaattttagattataggctcaaaaacagagcagccctgggacttcaccaccttagcagcccctcctgcccaagctgccacctgagcagcaggggacaccgactaagaagcctttggtgtgtgagtgcagttgagcaaacatgcgcccgccttgtgctggccacccacccggagaccccggtcctcatcctgcgttgctcacagcggaggggggaggtgcctccggaaacaggaacttaggatgtggtgtcatcgtggtggaagccaggagcaccctgtggggacccagaggaggaaatgacctgaacaagcctcttgttcagaggtccttccccaggaagcagtggccacgctgcagctggaaaccagagggcctggcccccgggtggggagcaggcatttgggagggaggccagtctcccatgctgaggcttggaggtgggaacgggtgtgcctgttctgggaactgactgcgtcgtgctgaggacttgatgtctacatctcacagtatgtgggagccttggggtgggggccggcagggggtggtgttggagaggtgacggctaggtcaggcaggggtgggggacgtaggccaagtgcgggcgctgcccacccaaaacaacgtgtgcagtgggcaggtgaagccagtaggcgatggtggggccgggggtgagcgggtggcacacgcctgtcttaagggggctgcggcgaggccccggtgatggctgctccgggcttgcaggtgatgtcgccagggctctgtcacctcaagagaaactgggaccctcatctcagtatgaaagttcctggtttttaagtggtggtaactaatgaacatggtttaaaaatatcataccagcaaaacaaaagccatctgtgggtcatatttagccagtgcttgctgtggctcatgggaacccctgagggattttaagctcaggaaaatcatggtctgatccgcattttggaaaggtcctttcagggcctatggagagcaaataaggcaggtagcagtgaggaaggctggaccatgatgccacggtccaggcagcaacattgggagcatggtggccccggcactagggtaggaggtccaagaagttatctgcaaaacaaggagcacttctggagggccctaggcacctgcttagatatggggatgagcaagtgagtgagtgagcctggtgcccagaggcctggcaggtcagagatgaggtggctgagggccctgagggaagagaggggctgtgtgacagggtttgacggggcagaggtaccacctctgaaacccttcctgccagattgcgaaagaagcatgggggctgtaagaaggccagaaggggccgggcgcggtggctcacgcctgtaatcccagcactttgggaggccgaggcgggcggatcacgaggtcaggagatcgagaccatcccggctaaaacggtgaaaccctgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagaaggccagaaggccgggcactggtggctcatgactgtaatccatcccaacactttgggaggccaaggcaggaggatcccttcagcccagaagtttgagaccagcctgggcaacatagggagaccccatctctaccaaaaaattaaaattagccgggcatggtggtgcacacctgtagtcccagctactcgggaggctgaggtgggaggattgcttgagcccaggaggcagaggctgcagtgagccgtgattgtaccactgctccccagcctgggtggtagggcgagaacctgtcttaaaaacaaaatcaataaataaaatacagtaaaaaagaaggccaaaagcccctgtggggggtaggtgcaccagacactgtccctttggtttctagggtgaccatcgggatgaggaggaagagacccacatgaagaagtcagagtcggaggtggaggtgagagctgggggcaccagccaggtgaggcagacagggctatctcagcttgcctggcccagccccaaccttttcctcgtgccctcaggaggcagcagctattattgcccagcggcctgacaacccaagggagttcttcaagcagcaggaaagagtcgcatcggcctctgcgggcagctgtgatgtaccctcgcccttcaaccatcgaccaggtagtcctaggccccaccccccgtccggccccactcctcaggttgcggccctgagcctctctgggactctctcagaagggaggccttgcccaagcaacccttggagaaggcgagacccttcatccagcgtgcatccgcccaccacttcccaggtggcaggaccccaagaagggccagggatggtggtgaagtcgcttgtggctgaacagtggggagtgctagggcctgtggggcagctctggcatgggctgaggcacagcgctggccacggggagcagctcggctggggtgaattaggtctggcctggaaggccggaatgcatgcgtgctgggctcttgccccgggcctgagggagcctcccggagcttgcacccaggtgtccccgttccgcttctcagtgtgctgcttccgcctctcctgaagctcttccctgccctgtctgctggtctgagtgtgcttgccccatgctggggtcccgccacaggccgtccctgctgtactgctcccaggctggctgtgtgtctggggctggtgtgaggctgcggctggcttggctgattgtgcccctggctgaaggcagcttggacatccagggccaggccctgggggcgggagaggcctcgggcaggggtgggggagactgaccctctcttgtcctctgtctctttctctgtctgtctctctcggcaggtcgtccgtactgccctttcataaaggcatcggacagtgggccttcctcctcctcctcttcctcctcctcccctccacggactccctttccctatatcacctgccaccgcaccccaaacctctcttcctccctcccatgtaggtagcagccccaggcctcggcgggggtggtaaggagggccccgcttcccagcagccccccgccctcactcccccagtctgaccgctgatctctggtgtttgcccccagggcaggcactgcctgcctcttgcccctggccttatggggcactggcctccaggggcctagcttacagggtctggagctgtagtctggcccctggtggggctggagagctcccagcccccacccagattccagagaggaggtgctggccaggccccaaggtggacaatcctgtctcacccggctcccccgccctcactgacccacctggggtttgttccacaggcagccacctggacagccaccggaggatggcgcccactcccatccccacgcggagcccgtctgactccagcaccgcctccacccctgtcgctgagcagatagagcgggccctggatgaggtcacctcctcgcagcctccaccactgccaccgccacccccaccagcccaaggtgagagagggatgctacctgcaccaggcctcccatcatcagtccctggctgggagccccaggttgccatggtaaccgttctccagggatctgggccacccatcaccaagactgcactgccctggaggcggctgtgtggggaggagccctggtgtacagtcagacctgccctctctaaagcttagcacccgccctctcaagtgggaatcgggccttggccttcctcccggagctgccaaggggcttaaagtcactggggtcactgggtaagggggcagtgggacacctgcatggaagtccctggctccctcactccttagtgggtgggcagggtctccatcctccccgaggggagccggttacatatctcctctgcctgtgctgtgacagagacccaggagcccagccccatcctagacagtgaggagaccagagcagcagcccctcaggcctgggccggccccatggaggagccccctcaggcacaggcgcctccccgggggccaggcagccctgcagaggacttgatgttcatggagtctgcagagcaggctgtcctggctgctcccgtggagcctgccacagctgacgccacggagatccacgatgcagctgacaccattgaaactgacactgccactgctgacaccactgttgccaacaacgtaccccccgccgccaccagcctcattgacctatggcctggcaacggggaaggggcctccacactccagggtgagcccagggcccccacgccaccctcgggtactgaggtcaccctggcagaggtgcccctgctggatgaggtggctccggagccactgctgccagcaggcgaaggctgtgccacccttctcaactttgatgagctgcctgagccgccagccaccttctgtgacccagaggaagtggaaggggagtccctggctgccccccagaccccaactctgccctcagcccttgaggagctggagcaagagcaggagccggagccccacctgctaaccaatggcgagaccacccagaaggaggggacccaggtgcggcagggactgcctggtgggagggatgggagggagtgggggctgagcagggtgctggccctgcattcctcatgcttgcaccagtacccccttctctgtgacccacattatttgaggggaagtccatcccaccctccctccctgggccggctctgcttttgttcccaaggcaggcatccttgtttccctggcaaccactgatggaatcattggttgctggggaaacgggctcaggcctgataggtcagccccagtcctgctgggtggggccaagtgacctgatgctttcccctgcaggccagtgaggggtacttcagtcaatcacaggaggaggagtttgcccaatcggaagagctctgtgccaaggctccgcctcctgtgttctacaacaagcctccaggtagtactgggctggatgatggggaggaatttgggtgcgggggctggatttgagtgtgggtagccaccccaccactacccaccgctcacagaggctggggacacaagcggtctgctaggtccctaactcctctccctttctaacgccacagagatcgacatcacatgctgggatgcagacccagttccagaagaggaggagggcttcgagggtggtgattagcggtggcgccagccctaggctacccttgccaaggccgcccacctgcatcagcctctggccagacggcccgccgtgcctgcattcgcagcagctccgcctggcacccactccggattccggccctggctggggacttggccgcttccctacccacagggcctgacttttacagcttttctctttttttaaaaagttgataggagacttgtacagttgactggctttcctctcgttggtagttgagacgctgttgcaaattccacccctccttccctggtccagattgtagctcttagtcctccctgctcagctggccgggttggaggcctcaccctgcttggggcctggcgtggggggagctctggtgggaaaatgtcccccacctcttttcctagttttatgtttcttgggaaaatatcactttgtattctctgtccagggcttcagatattttgcacgaattttaaaacatggcaataaatggctcgtgggctctggctccctgggaccccctccccgcccttcttttgaccccttcctgtctggcccaaaggaagtagcaggcccagctggggcccctcggctaccccccgtctcctgccgggcaggtcccaggttggaggccctaggcgcggttcaggtcagggctatggatggggcccaggggctttggtggcccctccccaactccttcctctttgcttgggttcctttttcacgtttagtaactgttttttttttttttttttttttttttttggaaagcacaaacttctgtaacgggtcgtgctcatgtctgttaataaagaaatccagatcc

SEQ ID NO: 36264 - DNA, 39315 bp, Homo sapiens
tttactttgtctgctttgctaaagaaggccggtgaaccaggaccaccgcacacacaggcccaccaggggcaatgctcattccaagaccttaacttttaagagccctttgttccaacgttagtgtggacgatgctcttgcaggatgcctttccttttgggtcttagacaggtaattgtttctgcacggatcgggtttggaagggaagaaggggtgggagcttgtttattgtactactgctttgggtggagggaatattttagcaaatgcctctcagttagaccaggccagctcccacacagaactttccagtctcccttcttgtttgctagttgctccttactttcagagccaccgtgttcttaaccctctacgtccccgaggtttctctagggctgaccagttctgattttccatcagacactgtaaaactgctttggaaacttcacggagaaacagctgaagaatggggctggggaaggggagaggcagagtgcgattcttgctccaaaccccttttattccttctccattttgatttggctagttagtggagatttcctcacagtcctctggttctgaagggactctgtgttgggggtggggtgagggctccgttcttcttttaaaggaaaggctttcttcctttcaagcatgtgcctggggctgtgcagctgagggacgttcccgacgcctcaggggaaggggtgtggaattgaccccattttggccttactgaccagtttttcaaaaagacccctgtggcagagacttgattgctcggtgagccgccctttgaagtgggagcactgcattcattccagccggtaaagcagtgtggaatgagagaacagtagcaagccaccaactgctgtctgctgagaacacagctgttgccaactatttgttccagggcttctgagagtcagacacccccaccccctcttcgtctgagaggcatgtctgtatcggaatgtgtaactgtaaccagcagctgctggccataaggggtggggagggagcacacaccctctgctgcctgttcctgggtgaggaaaagccacagatgagctcacagcagaagccctagaggggagctgctagggaccactggttgccctcactctgagaaaagtgctaggtggacaactctcccttgagttgcctacagttctgttcaaaggaagctcctctgaaaagccccaaacattccattacagctcttgttatcttcagagtgttgcgttgacacagctgatgggcagagaggtgaccactctgaacatcccttctgcccccacaagaaaggctgtccttttttttttttttttttttttttttgagatggagtctcactctgttgcccaggctggagtgtagtggcgttagctcactgcaacttctgtctcctgggttcaagcgattctcctgcctcagcctcctgagtagctgggattacaggcatgtgccactatacccggctaagttttgtatttttagtagagacggggtttcgccatgttggtctgactggtctcgaactcctgacctccggtgatccggccacctcagcctcccgaagtgctaggattacaggcgtgagccactgtgcctggccagaaaggctgtccttttaacctatgggcagagtgagccctggagaggatttcaagcagtgttggaaataggatgaagctggatgaagcgtctcatgctgtgtcagcaggctggtagggtgaaaactgcctaacagagtggaaagagtgggctgggagctggaaagacctgcgttcatatcccagcttccctgaggtcttgggcaggcccttaactgttctgaacctcatctctgaggtcacacagggattccacgaaagaatgtatgtgaacgttagcacctgggctggtagagagtagacataactcttactttgatctactcattcccaaaggatgcaacactgcaggggtgcaggaaacgagaagcgaagggactgataccttgacaggagccaggtgtgctgggcaggagcccacagccaggggagtgagctcttgcatctgtagtcagtgactgccattgtgcagtgacgtacagctgggaggccacctcttactctaccgagacactgttaatcttatatactgaggtggcaagagggcgagggcttgtgtccagttacttggacatgtagtgagagaatgaagcagtgggtagcattaaactcttcaaggagagtgaagggttgggatggttgttttgggaaggatctgagaggatcaacagcaggtgaacctttagctcttgtgtctgaacagttgcctggtggaaggcagaatttagaagacctccgaaggcccttcctgccctaggcttctgtgactcaaatgttgcctgtacaatcttggagtagttttggttacatattttgtatatttctagtattttctgtcagacagtgtaactatgttctttattggagccatgtagccttctaaagatcacttggtgataattctgtttaagaaaaaatgacacataatgcacacacacacacataaaattcatctttatcgtacatatgtatgcactttgatttatttttttcccttaatccatatgattgttttttccccttaatcctgtgtcttatgtggtaggattattctgtttgtacagaggtgcatgctgaggcttagagaagttaagccatttgcccagcattgctcaattgtctagagaaagggtaattgaagatttttgttgctgttttttaacttgagtctttcccaaatcctggatttttctcactacctagactgtgcggctcaatgtctgagagtagagtatgattaatgcattgttctccttggggcatgtttctttctagcctgcctaggtaggagataaaatgctgcttaccccttaatcccagcttttcaggaggctgaggcaggagaatcgcttaaacccgggaggggaaggttgcagtgagccgagaggccccaccattgcactccagcatgggcgacaagagcgagactccatttcaaaaaaaaaaatcattcttgttgagtctcgttcttgtcacccaggctggagtgcaatggtgcgatctcagctcactgcaacctctgccttccggtttcaagccattctcctgcctcagcctcccaggtagctgggactacaggcatgtgccaccacgcccagctaattttttgggtatttttaatagagatggggtttcaccatggctggccaggctgatctcaaactcctgacctcaagtggtccgctcgcctcggcctcccaaagtgctgggattatagacatgagccaccaggcccggccaaaaaaaatgtagattctttatgtctgggccagggccccagaatatgcatttctgtgaagttccccaggtgtttctgatcccggttgtttccggccacactttgagagactgtcctccagagctgggcggcatggaaataattacaagccagcatgctgagactacaacagaggaacgcccagggactgggagagcagagcgtgggggcaggtatctgaatcaggctaggagaggctttcctgagaagccgatatctgatctgactcttgaaggatgaggaggagagtttaccagacatgtgagttggggaaagagcattccggacagatcaggttgggagagttgtttttgttttcttctgcagatgacaagggaagctgtcattcatctcttgagtcttggcattgaatttgcctggggcaagataaggaccttagttcaccaggtatgggtgtcttttatgggtaccaagaaggaggaagacctcagggcccttctttctaataatgagcatggcatgatttcagtgtctgtaaagggcagataaactgtaggatttattagttctttcatgcaagggacagttagacagctcatggaagctacagtgttgactaaaaaaaatgctttttgtgcttagatgagccagagctcagaagaagatagtcacctggtgaactttttgggtatggcactatataccaaattttagatataacaaacaattaggcatgctatccctttattatctgacaagatcagaaaataggttttctggttaagagaaattccattatgtgtacctaacaaagggattactaattttcggagaacagtattgcaacagaatgttcttagtcatgatttgaacgaattctatttcatgtttatccagaagatattgattgggtaatgtcgaaggtttcttaggagcaacactcagcatctgaaaagtcctgtgcacctgttctacccaaagcatgttgtggatacaaagaggtataaactccatccctgccctcaaggggtttacagtcagctagggaaagtagaataagtgcacaggtaatgaggacattctgcaggtggtagcaaatgacactagaaaagaatagaatgccgcagttcagaggtgtgaagaggcaacccttctgcaggtggcccttcccacagtccaatccagtagtatcagttgttgcactataggtgctaggtgtgtggaaggaccagtgggtggtaagttctagttgatggaatgcaggctagatccattaagacactaattttacatcttgcaccttggaatattgcctttctcagtgggaaagacccattgtcctccaagttgtccacaccagtgagatgggatgatccctgatactggaaatgaataatacccatcaaagccctcttagggtcccttttccaggttggaatttgtcatggaaagaggcacagggggcaactcctggcccaaggggctgtttgtatttttgaaagggtgagctggtccctgggctgatgccgaatgtgacaaggcaactagaatgttgcatggtacttactccctgggcataggaagtggctttagagtctcacaaggagagcagtggaaaggctgtgtgatagccagctaaagctgcagggtggagccatgactgtggagagggaagggggggaattgccggcttccaatttaacccctcaactgctgaatgttagccagcattgacttggggtatttattatttcaccacagcggccacccatgagggaggaggtcttatctcctttttgctgtaaggaaactgaaacccagggagaagttatctgttccagaacccagggctaatgtgtggcaggaggggcctggagtacaagtcttcttggtgtctgtctgcccctgcccgttgctctggcttggtacccatatccacagtccactgcaggcctcctcctccctgcctgctctgtgcacagcagaggaccgaatgttgactaccagttgctgttaccctcgggcccaacctctttccaccaggttgaggacaaattaagcaagatcttgcttggaaggaaactagctgtatatagcagcaaacaccaaggtgacacttgtttgtgctaccaaaagttgaagccagaatccttatctaaactgatttgtgaaagtcttgtgacagctccacagaacacctcatttccctactgtcaccacaggtgagaaaggtggtgcttacgcaagccctttcaggttaattttttttggggggggtggggggagggatggagtctcgctcttgctctgtcacccagactggagtgcagtggcgccatcttggcttactacaacttctgcctcccaggttcaaggaattctcgtgcctcagcctcccaagtagctggtagcacctgccaccatgcccagctaatttttctatttttaggaaagatggagtttcaccatgttggccaggttggtctgaaactcctgacctcaggtgatgcacctgccacggcctgtcaaagtgctgggattacaggtgtgagcaactgtgcctggcctcgggttaatttttgaacccccaaccatctctgttgaaagaagctgcttttttttttttttttttttttttgaggaacgtggcttgtttttcattgcatctctgttatcagagcaaagagaaagtgtactggacagtaacttagtggaaaagaggactgtgcctgctgattttgaaacattatccaggatggagccaaagaaaacagtcacttcctccagtgatagcccatgagtttgacccgccccctcccaccccttttccatgaagaggtaaattttagtccaggaaaacagaatactttggggctatttaaaaaaatgctttgaaatcccttcttctgccctaattccttagcactagtaagatactagtttcttacctcttcctctctagggcttcttgactcttatttcttgctaatttgtagcaacagtgggttgaaagagccctgagaatggacctgcctgagccatttctgtgcccctctgtagccattgtttctctgggcagagctcacctgaacttgaaccccagacctcacaagaggcttctattgctggttgctggaaatggtgataaaatcctgtgaggggaggggcagtgcagggaaggagacttggctttgggaatggctggagtgtgacatactgacttcttttcctgaaagtggctgagggtttgccgggactgtgttgcacataagacttcggtttcctctggcattgcatcaaggaggccagagtatttattattgtttggttttcttgcttaacacacaagacttaaggatctcccaactgtgatgcacggtctcgatgtggtttcaaatactgtccaattgatcttgtggtttccatcgagggtgtgaaatccctggttacccaccaggcaggcagtggtttgaatacctgtgatctcccacccctctgggtgtggttctggagtgccgtgggaggttaggacaggctggggcggaccgccagcacaaatagaacatacagtcattcctgcgtctctgtgtaaggttccagattcatgggccaggctcggcttgtgctgggttactgtaaaccaggatgagagagccacagccagagagccacggttcattctcgcactggtcatgtgaaaatcacacccccacagccttgccttaggctttgaaggaccccttcatgctgctgcttgtaccatgtagctaagaggcacgagggatgaccagctcctatggttacttgactcagcggtcgctaggttcaggactttgtgaagggtttttggccagggtaggtatgcttgtgagactgacatcagtcctgcccacggggaatttagagcggggtggtggcagggagtctgtgaggcactcggagaacaagactggctaaaacacggttctgtacaaaatattgtgctgcagtttggctaaaacaggggctctaaactgggacagttttgcccttcccccataggggatatttggcagtgtccagacatggttagctgtcacagctaggggagtaggaagttgctactggcatatctagttaatagaggccagggatgttgctaaacatcctacaatgtacagttcagtcccgtatgacaaataattacctgactccaaatgtcagtagggctaaggtggagaaaccttggggtagaaaccacagactcatagtagtccactctgcttgggaagcaggagtcacaggactgagggaagaagtaccatattgttttaataaaggggaaataggtagagctttcctgctgccttctaagcagtgtgtgttcattatctgcccagaaatttagaattttcacattggttgttcctttaatcactaggtactctgtcttattaatgacaggtacagagtcattttttgtgggccagtagatatgaccaagcccatctgaaatatggatatgaccaagtccatctgaaaagtcggatggaactgacgtttcatcccttactcaaataaccgggattactaccccccaggaggagaggatctcagtggtacccaaatgactttgtacatacaacttaaagaaaaagcaggcatagttattttagcagcagcccatatttcaagccaggtacctattgctgtgggttgggtttattgtaatctatcattagtaacatactaacacccccactcccccaaggttttctacatcactgaagtctattttaatcttaaagtccaagctctcagagttccaaaagttcttgtttcttttttttttttttttttttttgagacagagtcttgctctgtcgcccaggctggagtgcagtggcacaatcttggctcactgcaagctctgcctcctgggttcacgcctttctcctgccccagcctcccaagtagctgggactacaggcgcccgccaccacacccggctaattttttgtatttttagtagagacggggtttcaccgtgttagccaggatggtctcgacctcctgatctcgtgatctgcccaccttggcctcccaaagtgctgggattacaggcgtgagccaccgcgcccggcgaattttttaaatttttaatagagatgaggtcacgcttttttgcccaggctggtctcaaactcctgggctcaagcagtcctcccacttcagcctcccaaagtgctgggattgtaggcctgacccactgcacccagcccacttttttttcttttttttttttttttagggcggggacagagtcttgctctgttacctgggctggagtgcaatggcacgatctcaggtcactgcaacctccgcctccaggttcaagtgattcttccgcctcagcatcccaggtagctgggattacaggcacccgccatcatgcccggctaaattttgtattttgtagagacagggtttcaccatggtagccgggcagatcttgaactcctgacctcaggtaatctgcccaccacagcctcccaaagtgctgggattacaggcgtgagccactgcgccaggcaccagcccacttttttttttttttttttgagacagagtttcgatcttgttgtccacccaggctggagtgcagtagtgcgatttcggctcactgcaagctccacctcccaggttcatgccattctcctgcctcagcctcccgagatgttgggactacaggcgcctgccaccacgcccagctaattttttgtatttttagtagggatggggtttcaccgtgttagccaggatggtctcgaactcctgatctcatgatccacctagctcggcctcccaaagtgctgggattacaggcgtgagccactgcgcccagcctcagcccactttttaaaagttgaaaaacaacggtgccatgtaggcatagaactcattagtgggtccactggggcttaagggccactagtgcaatccccacttttaagaggggagaggcagtgatacaactgtgggaagaaaaggacctacttcatggcaccaactgtgagtggatgacagtaggctaaactgcccctctgctctgcctgagtgccacctgctactcacctgctccgctgcatgctacctgctatttcagccctcagctctctgcaccagcccttgctaaagaagccatgcttctcaatggacttactctgtagcagaagaggccagtgatgaggaattcctggggactgcttttccttctaagtgtccaggggtgaaagagtggtccatgaaccagggtccagtgcctctgtagcctgccagactccacaggcctgcatgccctgggacattgacaagtagaccttaataaaaccatgggatatgttgcaacttccgatttttgctgtgggattttcctaccagggtcaagtagctttttctgaatttgttattcaggttcctaatagcaacacaggaaatggattttaatttttttgctggctgctctgtttgggggctgtttaatgaggatgtagttgcagtgcagctttggcagtaacagtactggtgtggatgggagcgtagctaacatgtcacttctttttaaaatttatgtgtatgatctattatatgttttaatggaatgaggcatagagagtataaataatgtgccttgattctatgtaggtactcttgtgggtaactgtgttgggacacgtttgggattctagaaaacgaatatgagtctatttcatgtttagagagcaggaactgtttattgtatgttctttttagatccagggcagtggttctcaagcttgaatatacataaacataaccaggggagcatgttttaaaaggcggattttcagtccctgcccctagagggtctcagtctatctacattcttgacaaatatttcagatgatctggggcccatggaccacacttttgggaaacacatccctattttgttgcatttgttgtctaagcatgttcattgttatgtgggggcaaattcacttatttataagatgcccttattgtcctgattcactgtgttgcccttcctcagattcttgactagtgttagtctttgggagggaccagaccagattgttccaggatgccctgtgggttgaagtcagtggacctctattgtccccactactacccctgggactcccctttggggaccatgacactgtgggctcatcttgaagcagcagccatctcttttgatcctaggcttttcttacattggtcacaagctccagtctttggctttactctttagggtactctatagctaaagcatgggggactgggtcctcttaagcccagggagctggagtccagagcccttaaggagtaaaccacactatcagatctgagggatgaggctgaaccttatcagaagatttactggcttggttaggggaacctacccatgtagcccaggctatttgttcttttggaaaactactgaattcagccaaacagcataaaaatccattcctagtgtcccattgcatgcaagacaaagtcttggttaacttcttagcagtggcttgccctttatggggaaggatggaattgagtaagctcttttagccaaagcttatggaataattgtcaggtgtggtatatactagaaaggatacgaaagtagtacatgacaaccccaccatcaaagaaagggagattagactgggcacagtggctcccgactgaaatcccagcactgttggaggctgaggcaggagaatcacttgagcccagagtttgagaccagcctgagcaacgtagtgagatcctgtctctacaaccaataaaaaaaattagctgggtgtggtggcgtatgcctgtggtcctagctaattgggaggctgaggtgggaggattgcttgagcctgggaagttgaggctgcagtgagctatgatcgtgccactacactctagccttggtgacagagtgagaccctgtttccagagggggaaaaaaaagagaggggagactagactaacacatgggaagcaataggccaggactcctgctgcatcatcccccttcttgagcttactttcttcatcctcagcccttctgtactctccttctacccaatttgaaaatgtgtgcccttgaacagttctctttatttccctcaggtctttgaacagtctaaaaaaccaatagtggtcaggcacggtggctcacgcctgtaatcccagcactttgggaggccgaggtgggcggatcacctgaggtcaggcgtgcgagaccagcctggccaatatggtgaaaccctgtctctattaataatacaaaaaattagctgggcgtggtggtgcacgcctgatgtcccagctactcgggaggctgaggcaggagaatcactggaacctgggaggtggtggttgcagtgagccgagatcgtgccactgtactctagcctgagtgacagagaccctgcctcaggaaaaaaaaaacaaaaccaatactatcagggagaacgtgatcttaactttctttctttctttttttttttttgagacagtctcactctgtcacccaggctggagtgcagtggtgcgatctcggctcactgcaacctctgcctcctgggttcatgccattctcctgcctcagcctcccgagtagctaccacgcccggctaattttttgcattttttagtagagacggggtttcacagtgttagccaggatggtcttgatctcctgatctcatgatccgcctgtttcggcctcccaaagtgctgggattacaggcatgagccaccacacctggctgatcttaactttctaattgtaaaaatataggtaaaaatataggtgaatacatgaagctttgcctccttaccacctacaaatatgtttctaaggacctgggcttgaaagtgctgcattttcagaacttgaagattctatctaggatagaacaaaaatagctgattctaagttaaagttgtttgctgtcttatttagccatttcaaatgtctgctttatgaaaactgcgttatcctttagctacagagcattaccaaaatcatttagaactttttcctagtagatatgcagtgctagactttggtctcctttctagaaagccattcctggttcaagaatggaaggaaagtttgttttgttgcttactctgcaagagcagccacaacctggctgggggggataaataaaggctcaaggtaaagaataagtatgagagttgcaaaaatatttatatatttattcaagtctccaccataacctaagggagggactagccaaagccaacaatgaattcataaactgtggtactttggagattattttattttattttattatttattttttactgagacggagtcttgctctgttgctcaggctggagtgcagtggcacaatctcggtttgctgcaacctccaccgcctgggttcaagtgattcttgtgcctcagcctcctgagtagctgggactacaggtgcgcacaaccacgcatggctaattttttaaatatttttaatagcgatgggttttcgccatgttggccaggctggtctcgaattcgtaacctcaggtgatccacctgcctcagcctcccaaagtgctgggattacaggcatgagccactgcacccagcctggagattattttaattgttatacaaagcctatgagatctgacctcagctgaattcttagctcccctttcacactgctttccctgagatcactgtactcagctacactagtcttctttctcttccttgagcacaccaagcttgtttctgccctggtgtttttgcgtggatttgatatttcttcttcctggaacactgttctcaccggtctggttaagctggctctttttcagcagtcagggctctactcagatgtcacctactcagagtggcctttcctgaccaccctatctaaaactctttgtctcattatcgtgttttattatcctcatggagcttattactgctagtgaaattataattttgcttgttaattgtccgtcttcccaactggaacatatttaaaaatctttttgcctttgtcactctgcagtttcatacagtgtacctaggtgtgggcttcttattatctggaaattttgtatctttttttttttttttttgacagtctcactctgtcacccaggctggagtgcagtggcatgatctcggctcactgcaacccccgcctctcaggttcaagcgattttcctgcctcagcctcccgagtagctgggactacaggcgcccgccaccacgcccagctaattgtatttttagtagagatggggtttcacagtgttagccaggatggtctcgatctcctgacctcatgatctgcccaacttggcctcccaaagtgctgggattataggcatgagccaccacgcccggccgaaattttgtatctttaatcagtcttatatagaaaatttttagttatccctttaaatatttcctctcctccattcttttcttctcaagcttctttctcatttttcatttccatgttttctcttgtagaagcactttgatggtaattttctcagatctgttctctagttcatcaatttcctctttaacttggtctcctctctgtgtgacccatctgttgagttttttctttcaataactatttttctacaagttttatctgcctgttactatttcttgtttggtagtgttcttttcttgtgtttttaattctttctttttggctttaatcatttgagatatgcttgtatcttatagggactttttttcagggggtcttatcctgctatttgttgaatttgtcatcttgtttgtaatggattagttttgcatacatttttatattttggattgtgagcttatcttcaacagaactttatttttatttttatttttgagacagtctctcactgtcgcccaggctggagtacaatggtgcaatctcggctcactgcaacctctgcctcccgggttcaagcaattctcctgcctcagcgtccggagtagctgggattacaggcgcccgccaccacgcccagctaatttttttgtatttttattagagacaggatttcactatgttggccaggctggtctcgaattcctgacctcgtcatccgcccgcctcagcctcccaaagtcctggaattacaagcgtgagccaccgcgcctggccaacagaactttatgtgtaggaatcctttgtgccgtggctgagggtagatctgttcagttttgtatttctgccagatgttgcaggtttattgccagcctgggactactttttgtgttaaatttttggcttggggatcctcagaccatgtagtagtacaattcaaatctgaaataatctgtgatcacacattattagaggagatactgttttcctcccacttcagagtttttattgtcactatgtgccagtgggctaatgttttttctaatctgttctccccctctgagggcgccagctttgtactggttctcagttccaattccctgtttcaggtgggcccaagatcaacaaactaccccactttctaggtcaactggaaaggcctgatctcatttactactgtggtttctagttcccgctgtcgtttttggtcccaggtgatcctccttgctttcttgcaagttcagctttgtaattaaaagtgattgttgtatagccagggttttatagcagaataatttttagttacctacccagctatattgccagaagcggaaactctcccctcccaccccccgaatctcttgcttattgctatagctatagcatcccacatagtgcctggcacatggttgggggaagggggtcaatacatatgtgttaaatgatttggagaactgaacatttccattaggaattagttcttggccaggcacggtggctcacacctgtaatcccagcactttgggaggccgaggtgggaggatcccttgagcccaggagttcaagaccagcctgggcaacatgaggagaccctgtctctatttaaacaaacaaaaaaagatttagttcttcctgcagggaaagccagaggtgatgctccaaattaattcatatccagcagccaagatatttggtgtcctgtgctttagcatcccaggaaggacttcaattcttatttttcactcttaaactttaaagtgttttcctaaggacatgacgctgttgccattagccagttgctagcagagttttccagacccataaattggcagattaaaaccatgcctggggaaacattactgcccagtgtgtctttttatgctggcacttagaaagtttttacgctgattaaattgacctttacagtggctcagctaagaatagcaactgtaagatgtggaaactgttgaggaaaatgttgttagtcccacagtttatactgccaccaaagagaggagataattttttgcatatgtgcaaaaggcatactgtttatcctttccagtgtaaaaatgttttttccagtttggtgttggtcttgcttgtctcttctttatgcctttgttttctgtttggtaaccatgtgtgccttgtctctcagagctggtcactgtggcaccggggctgaaggcacatacctgtaatagatggggctcctagtagccactaccacggtcattcccgaggtgaaaggcctcgcgtaagcgcattcattatgcaccaaagttcctttttgacaagttgtacatttctagctttctggggttttgttttagccatggagttttgtgcaaatgaaaacattgccaggaagatgatatctttaaaatgcaagtatgatcttgttacctccctgtacagagtggtccccacctacctaactttcctatctactacttctaccatctccttctagccaaaagggctttgcttgtagcgttttctctgcctgcgatgttcttccctgtcctcttcctagttacttttttttttcttttctttttttttttttttttttgagacagtgtttcgctcttgttgcccaggctggcgtgcaatggtgcgatctcagctcaccacagcctccacctcccgggttcaagcgattcttctgcctcaggctcccaagtagctgggattacaggcatgtgccaccacacctggctaatttttgtatctttagtagagacggggtttctccatgctggtcaggctggtttcaaactcctgacctcaagtgatctgcctgccttggcctcccaaattgctggaattacagacgtgagccaccgcgccgcctagttactgactttttaaccgtactgtcaatctcagttcaagcttaccttcctcccagaagctgttctggaccttcttgaccagttcctgggtcttttactcactgtcacctaatctgcacttttccttcccaacatttattgtagtcgcagttttatctgcgtaagtattttaccatctttcattagactgtaagttccgtgaggatggcctaaacaatataataatgtgtaatgtgctttgaagatgcttggaagaaaagcataagctaggtgtggtggctcatgcctgtaaccccagcactttgggaggccaagatgggacgattgcttaaggccaggagtttgagatctgcctgagcaacatagtgagaccctgcctctaccaaaaaagtaaaaataaaaaagccagatatggtggcacatgcctgtagtcctagctactcgggaggctgaggcagaaggatcacgtgagcccaggagtttgaggctgtagtgagctacagtcgtgccactgtactccagcctggacaacagagcaagaccttgtctccaataaatacgtaaatagtaaaagcataggataatcataaagggtgctgataatttttcatatttgacctttccattgcattctttccagttcctttttcttttcttcttcatgtgtctggagcagcccacattgccacagagaacttggctgttctgaaacaattctgagtgaaggcaaagtgctttttggatggtctttcatgctcagcaatagtggctcacagaataatgttgatagtaggagcccagagaatttaattagcccaaggtcacacagttaatagccctactgtaaaagctgggctttgaacccagatccagctcactcttttttttttttgagacagggtctggctctgtcacccaggctagcgtgcagtggtgcaatcatggcttgctgcagcctcaaccttctgggctcaagcagtcctcccacctcagcctcccaagtagctgggactacaggtgtgcaacatcacacccagctaattgtattattatttttttggttgagatggggttttgccatgtccaggctggtctcaaactcctgggctccagtaatctgcccaccttggcctcccaaagtgctgaaattataggcgtgacccaccacacctggccccagcgaactcttaactacttaggctttgtgtagatcttaagccaccgggaggtgtttgagtcctaggtgtgcaacaattaggctcctcatataaggaggggtggaagatcaccaggcagcatttccacaccactgttctttgctgtggatttgcatgagaggagacatagatttcatgatatcttgcattggcttgaggctgctatgtcagggtggaaaggggatggggaggataataaaaccttaaagttgaaggagacggctgggcgtggtggctcacgcctgtaatcccagctactcgggaggctgaggcaggagaatcatttgaacccgggaggtggaggttgcagtgagtcaaaatcacgccactgcataccagcttgggcaacagagtgagactccatcctccccacccccacaaaagaaaatttaaggagacattacaggtgatcttaaccagacctagggccattgagtaacttgcctaaagttcatttctgtgtagtgatagagctgggatctacaaaaattagccgggtgtggtggcgtgcacctgtagtcccagctactcaggaggctgaggcaggaggatcagttgagcctggaggtcgaggctgcagttagctgtgatcaggccactctactccagcctgggcaacagttagactctgagtgaaaaagaaaaaagtaggggggtgcgaggagagctggggccaaacccaaggctcctgggttttccataccactattgactgacaccagcatgtctctctgaaggaactcactttggcactcatatctcactatctcctgaatcctccttcacctcttccttgctagaggtacaccttctttcgtaccgctgcagcagaaaatgacagttcccataaccaagactatcccaggcagctcagggactctgtatttagaggagggagaaggaccacaggggactagatatatagatggccacaacttgtgatggttcaacttagtgatttttcaactttatggtggtgcaattgatacatgcagccagtagaaatcatttgtttttcatttttaatacagtattaagtagatgacatgagatattcaatactttattgtaaaataatttgtgttagaggattttaccaaaccataggctgatgtaagttccgagcagtttaaggtaagctaggctaagctatgctgttcagtagattaactgtgttaaatgcatttttgactgacgatattttcaatttatgatgggtttaccagaacatgaccccatcgtaagccgagaaacttccgtactgtgttaaaaactgtttgaggaacactggattaaatgatgcttccactgttctgctctccctgggaaagcggaggcagaacggtgaagcagagtgaggtcttgtttattccaggccccctgcctcggtgcacagaagatccgagagaaaagctgactgacagcagtaggtcatgaggatgccacttgtttagatttcaaatgcattccactctatgtctcacttaagaccagttgacagccatgtgttccgagcctgggctgcctctggtgaattttcctgagacagaagtgtcattggattctttcttgtgccaagtgtaggcaccactgcctcttttagaaactatgtggacactttgaactgtgctcttttaagccagtgccggaagaatggcattcgcagggcctggtaaactggggagaaactttctgatgtttttatgaaaggcatgttttgctctgaagtcaaagagtgtgtgttctggccaaagtagcaagcatagatctgctttttccacacgcaccaggcttcagaggagaagttgactagatagccagtgtctcattttgtttgtggtgggcatgggatggtgaaaacggaaggaggaagaagtacaggggacaagatatttagatggtccacaacttgcgatggttcaacttaatggtttttcagctatgatggtgtgaatggcatacatggccagtagaaatcattctgtttttcacttttagtacaggattaagtagatggtatgagaaatccaacttgatagccagtgtctcattttgcttatggtggacatgggagggtggtggtggggcggcgggggaaggagcacatagaaggaactctgcgtgcaatgttgtgagggcctcattgtcagggtttatgaatttctcgtttccttctttctaaactgtcatatcagaatgtaaagtttttaagaccaagaaacacctaaagatttatggtggaaacgtgcactaagccggggaactggttttcagtcctgtgctttctcttgtcctctccgtgtggcttcaggtgccagtcctgtttctgcccagcctctagccctgtagacagtcactggagtgcctggtgtatacccttggccaagtagacagtgtagtaaagcatggcccagagaggaggagccgaccatgtgacttcagtttccactggcagctgtccgccggatgtgcactgtgggcagggccagcctgagttgccgcaaatactgtggctttagtttatttgctgagcagggcttttttccttcttaactctgagcttcttggggataaggacaatgtcttattcatctttgtatcccttgaacccaacacaatgcttggcacaaagacagcgtccagtaagtgactgtgttattgtttagaatgaagaaatgttgaaggccacatatagcagatgccttacaggtttcgtcatctgcatagtggccccaagtacattttgggctgaggttaacgttggtctgggaggtattttatatcttacatgtgaaacttttttttaaagttcccctccatcctcatccaccagtgctgtggacagaatttggcagacagctagatggccactcagtagtgccctttatgtgagtgtccctgacaagggacagtatgaatcctggatccagtcaggattctttttcaataagcaaaaatgatctagcagattgaaattagactgggttatctgagcagttcggccctttattgaaaagtaaagaatttcagttgtagattttttttgttgttgccctctttaggatcacactgtgaattaaccttggagagaaagtgttttaaaaagaagaatggaataactgagcagatgctaatcctagaatacataccgctttaattattccaggaagtttcacagaaaagccagttttatttaaaatgtactgctaattaccagggaatcatcaccctcctaccggctgaggttagcaccggaacatgaaatgtttctacttggacctaaagtgaggcagcccttgcctgtcctgtctgaggaaaacttcactctgccaattgcttttgtgtcctgaatctcctctcctctttaataaaccatattttttcccctaaactctgttgttgttgtgtaaatcttttaaagttttttttgtttgtttgtcttttttattttttatttttgagatggagtctcgctctgtcgcccaggctggagtgcagtggcgtgatcttggctcactgcaatctctgcctctcttgttcaagcgattttcctgcctcaacctcctgagtagctgggattacaggcgcgcaccaccacgcctggctaatttttatatttttagtagagacgggatttcatcatgttggtcaggctggtctcgaactcctgacctcgcgatctgcctgcctcggcctcccaaagtgctggcaatacaggtgtgagccaccgcgcctggccaaagttgattttcttaatggaataaacattgatacaaactgttttgggggctggtgaatagacaaccaggaggacaatgatgagaaggaaagtgttcaaaagctgtcatttaatatgctaacatgcttttttaattttttaggataaggaagcctgtgtgggtaccaacaatcaaagctacatctgtgacacaggacactgctgtggacagtctcagtgctgcaactactactatgaactctggtgtaagtccttgcttgggtgcctctcagtatcccagggtcccagttactgcctctgcttagtgggaaactctgggcattagcccttttcggattctcttggggacagtgttggtgagtggaatctgtttatgggttccagaagtgcttcctttgtagaggaagagagttctggtgctctttggactttgttagctgaagactagagaatatggtcttagccaggtctgctgcagaagctcttgcctgaggttctcctggctgccctctccattgtgtgctgagcagctgacaacaacttagatgcttccttgggccctcccagaagcccaggtttgcctttctttttttttttgacggagtctcgctctgtcaccaggctggagtgcaggcgcaacctcagctcattgcagcctctgcctcccgagttcaactgattctcctccctcagcctcctgagtagctggtactacaggtgtgcaccaccatgcccaactaatttttgtatttttaggagagatggggtttcaccgtattggccaagatggtctcgatctgttgacctcgtgatctgcccgccttggcttcccaaagtgctgggattagaggcgtgagccaccacacctggctggcttgctgtttttgcagagagaggttgcaagccaagctactatgaatgccaggccactctagatggtcactatgccattttcttgtaaggaccacaggggcttccagaatttcccatagaacctcatggagtgcctctgtttctgagggtccttcggaaaggaacagtctttccctaggtccttgcctatagaggaccttctggagaaagggagtcttgaggctcagctccttttatttcttacccagttctcacatggaagttcctggaggattctccagtgtacctaaccttttactgtcagctaaatcccatgtggaggctgggcacagtagctcacgcttataatcccagcaccctgggaggccaaggcatgtggatcacttgagcccaagagttcaataccagcctggctaacatggtgaaaccccctctctactaaaaatacaaaaattatctgggcatggtggtgtgtgcctgcagtcccagctactcaggaggctgaggcaggagaatcacttgaacccgggaggcggaggttgcagtgagccgaggttgcgccactgcactccagcctgggcaacagagcgaggctccatctaaaaaaaaaaaaagaaaaatgccatgtggaaaccatctttgtcttgccactggtttgactgaagccagaaccacttgcttcttcaagttgcacgacagtggtgatggtgttagggtcttcagggagtgacccaaggttgcttcaactgacactctttgtactctgaccttcctggaactcagacgagacagtgtaggatgctggacaaagaatgagagggtgttgggggggtggtgcttaggacagcgaggccccaggtgactgacattgccgtagttcttacaattgtctcttgagaaaggagactgcaggcggtttccccagatgattctaagccctcatcactgcctccatttggaaacagacttcgggtttgtcaaaccatgaccttgcccccaccatcctatctgcgcctttcccctttctcatcccccccatcaacccctgtgtcagtgatatggcaagaaagcagccagaaggactattgtttggtccagaaaggaaattagactcttggctgggaggtctgtccatctgaaatgcagttgtatttgtagccaacaggagtggttcctccaaacaagacctctccctcaccctcgcttttcccttttgaggactgaggacgggctcatctgcctttctgaggaattccaggagcagtccagtgcaggagagcacaaggctcaagatgtccccaccagacctgcagatatataagcagcagtgaaggagggcacagtcattgttgctattttagaaggggtggggctgagaaacttactagaggacacacagtgccaagcaggtagacagactctgtttaaatgttttaaaatgcagataaccacagggttcaaattctccttcccaccctttgttaaaacaaaagttgaagctgggctgccaaaaagccacagagctgtagtttgtttttctgggtcctggccaggcggcatcagttgtgaaaaggaacgaagttgctcatggccccgtctcagattgacagagcctcctgggcttttggcagagccgactcaggagccacctgaattgggtcaccaaagccagggcaggggggtggagtggtggggacagggagacccagagggcaaggaggtagtctgggaaagcaggtgcctcaccccaagggcttaaagaaagtcagagaaagagctgcatgaacggctaagtgtctctctagctacgggcgtttaggaaaggaggcccagcagagagcagtgtctagacggagagaaaaggtgccccgttaaatgagctggcatgtgttttccacgttctggaggcatgggagacataaaagcaaaacgcccttctcaggaagtcctccgatctccctctttattgaggtcatggcttctgcctggtgtgtatgggagggaggttgatgttggaacaaacacctgaagttctcatcaaaatggcactttttgttgctttcaaccctgttccctctaactgcctctcaactttgcctgaagtgtgaaagtcacgggctttgggctgatttccttcccaccttcctttggaaagaaaattcctcagccaggaaatcctttggcagagttttcatcagacagggcaactccttaactatagttgcctacaggaaaggcctccgggaaaaaatgccatttctacccaccctttacctctactaaactgcattttcctgtgtgctgaggaaaattctcaattctcacacacatacttacacacacacacggtttacacagacacacaagcacacatagacctgagctctggccggcaacctttcccacatgtcttttcaatgtttcataacccaaaccagttattgggcctgcatgtgttgagaacggcagatcctgtttaataggggcagtagttgaggctattaaggacctgatcgttgttagtattatctccatgcatttttacggcacctgtactttaattcatcattccatcagttattcattcagcaaacccttattccagtgctcttgaactttagcaggcatcagaatttcctgaagggctaccgaaaacacacacttctgggccctactcccagagcttttgattcaaaactgagaatttaaaaacctgagaatgtgcaattgtaacaagttcctagttgatgctgtgacctcctctgggctggaaactggagagacagaattcttaccttcagaaggtaatccagcggggaggggataggatgtgcattggcccaaaccccaaagccactcctccctgttctcatcctggggctctctccactcagcaagctacattttccagggagagatcaaagttgggaatttctgcccttgagatcatttgggagaatttcacccaggcatcagtttcccctggtttgggctttaggagggagaggggtatgtttctggacagtggaatttccctgaagtgacacaaaacaggctattagcaaatcctgtcagtgctgcccaactcgtttttcattttttattctctctctttttttctttctctctctctttcctttccctccctcccatctccctcctcctctctcccctccctctccactcttcctctcccctccctccccacttttcctcccccctccctcccacccttccctacccttccccccacccccacccttcccccaccctgccacccctcccccaccttcccacccttccccccaccctcccctccccttcctccaccctcccctacccttcccccagcctttccctttcccccttccccctcctccttccaccttctccttccttccttccttccttccttccttcctctttttgtgtgtgtgagacaaggtttcactctatcacccaggctggagtgtagtggtatgatctttggtcactgcagccttaacctcctggactcaagggatcctcctgcctcagccacttaagtagctgggactatgagtatgtgccaccatgcccatctaatttttgtatttttttgtagagataaggtttcgccatgttgcccaagcttcgttttttacctgccgtttttttttgttttgtttttagtttgtcttaagatacccattgttagcaagagctcagtaaataggagttgattgaatttccagtgccaagaacagaacctaaaagcagactttggacttgttcctaacctgtgtttcttttttccttttctttcttgagacagcgtctcactccctcgcccaggctgaagtgcagtggcatgatctcgcttcccaggtccaagcgattctcccacctcagcctcccaaatagctggaattacaggtgtgcgccagcatgcccagctaatttttgtatttttagtagagatggggtttcaccatgttggccaggctggtctccaaattctgacctcaagtgatccacctgcctcagcctcccaaagtgctgggattacaggcatgagccaccacactgggccctgtgtttctttatggaatactttttgggggttaaaagggaaattgaaaggaaattttaaaggaaaccctgcccatctatggttaagcctgtaacaacaacaataaacacactaagaacttaccatacatcaggcatagttctgcgtatactacatatattaactcatttagtcctcacagtgaccagataagttagagacctttattctccccgttttacagatgagggaagtaaaaccaaaatgaccaaggtcacaaagctagaatatgtgtttttaagctgggctttgaacccaggccatctgccttttctcttccacgtctgcagtcatgcttgtaggaaagttggctgggctttcagaagaagttgcgagtctctgacgtcttcatttcccaaattcaggccttttccactgtggcagtggcaggagctcttgctgagagcaaggaagggccaggggagccagtcacccaccgtcctgcaggatgggaggagagctcacttacagtatgcttgagcctcctaatggggaatttcctgccagttgaagagtggtgttttcccaagtttgtagtgaactcttggggtttgtagtgtagtcatggggcacatgactcagttcctacactggactgtgattgtttttaaaaacatgttttccattttgcttagcatgacaaatgcaccccacagtgaactcacaattttcaaaacttgtctttgaggaatgtagtctcttggtaggtgtgtgtttgttggggaaaggagggtcatatttctgtctctggtgtgtcttttgttgggttttccttttttttttttttggaggcagggtcttgctctgtctgttgcccaggctggagtgcagtggcgctatcttggctcactgcaagctccgcctcccaggttcacgccattctcctgcctcagcctcccgagtggctgggactataggtgcctgccactacgcccagctaattttttgtatttttagtggagacgaggtttcactgtgttagctaggatggtctcctcgtgattcgcccgccttgtcctcccaaagtgctgggattctagccttgagccaccgcgcccagccaggttttccttttttttaaagttttcttctttgtgcttacttcagcagcacctatactaaaattggaatgatactgagattagtgtggccccggccaaggatagcaggcaaatttgtgaagcactccataaaaaaaagtaaaaaatgtaaaaatgaactttcttccttggttttgaaatctagctaaaagattaaaatttttcctaagttggccaggtgtggtgactcacacctgtaatcccagcactttgggaggctgaggtgggtggatcacttgaggtcaggagttcgagaccagcctggccaacatggtgaaatgccatctccactaaaaatacaaaattagctgggtgtggtggtgcatgcctgtagttccagctacttgggaggctgaggcaggagattcgtttgaacccgagaggcggaggttgcagtgagccgagatcacaccactccactccagcctgggtgacagagcaagaccctgtctcaaaaaaaaaaaaaaaaaagcccttttttttttaaaaaaaaaattatacttctggttcagtgaatctagcctttttctggatcaaggattcctttaaaaatctgatgaacactttaaattctctccccaagaaaaacttgtaatcacactgcagtagtcaggataggctaagttgtgccacaggaacaagcaagtccaaaatcctagtgacctaaaaacagcaggtttattcctcactcacactgtgtgtccatcgaaggttggatgagagttttgtttccacttcaccatcctctgggacccagactgatgtgaaatcaccatctgggatgttgccagttgccaaaacagaaggaagactaatggagggtctcatattagcaagacacattttggcctctaagtgacatatatcacatccaatctcaattcattagttagacttagtcccaaagcctcacccagtcacaagggggtcaggaagttcaagcctacccacatgcctagaaggagaagaagcagaaatacttggcaaacatgaaaaccaatgcatgagattttctttaaaacggggaaaacaaaacaaaacaaaacaaaacaaaaacaaccatgttggccaggtgtggtggctcatacctgtaatcctagcactttgggagccaaggtgggaggattacttgaagccaggagtttgagagcagcctgggcaacaaagtgagaccacccccctatatctacaaaaaatttaaaaattagccaggtgtggtgtgcacctgtagtcctagctactagagaggctaaagtgggctccttgagcccaggagttggaggctgtagtgagttctggtctctactgtactccagcctgggtgacagagtaatacctgtctcaaaaatttattttaattaaattttttaaaaaattgtaaaagctgtgaaatagatcatatatattgcagtataaaagttagaagttggtttacctttaggtagagaactattgaaaaaatgactggtggccaggtaaaaaactagtagagttagatgctggctatcttttttttttttagagatgggatctcgctgtgttacccaggctgacctcacaagaagcaatcctctcatctcagcctcccaagtagctaggattttagttgtgagccactgcgccaagcagatgctgattacctaacgggagaatgtacttttaaaattttaaagtttggccatctctggtatttcacacctgtaatcccagcactttgggaggctgaggcagggggattgcttgagaccagagtttgtttgagaccagcctgggcaaccttgtgagacctcatctcaacaacaacaacaacaaaattagtggggtgtggtggtgcatgcccgtagtcccagctactcaggaggccagagcgggaggatcacctgagcccaggagatcaaggctgcagtgagctgcgttcacaccactgcactctaccctgggtgacagtgagaccttgtctcttaaaaataagttaaaaaaaattggcctggcacggtggctcacacctgtaatcccagcactttgggaggctgaggcgggcggatcacttgagctcaggattttgagaccagcctggccaacatggtgaaaccctgtctctactaaaaatacaaaaaaaaaaaaaccaattagatgggtgtagtggcacgcacctgtagttgcagctgctgaggaggctgaggcacaagaatcacgtgagcctgggaggcggaggttgcagtgagctgagttcccttgccactccagcctaagcgacagaatgagaccctgtctcaaaaaataaataaataacaataaagtaaaaaaaaaaaaagttataaagtaacacagaagtataatggactgtgagattacactgagaaagtaagagaagtataggtaatacaaaatggttgtcagcccagaataatttagacttgactccgaaatacacatgcagccaggttcttaagcagagtgtccaccccaacaaccctaggagatgttatcaaactgcatctgtagccagtttcacctccataactcctttccagcctctccacccttctgcaagggttcctctgccagtgtctactcttaagtcagccagaattcataaagaaagaaacataagttaagcaagtttgactagtgaaccgggaaagaccaaaaaggagactgctaagttcactttatggtctctggttaggaatggattttcctgtctgctgatgggtaacagggaaaaaaatcctctgtctgttctcttgctgcaaggctgcagcatgaagctttggttgaacagcgatacccactgaaagcaattaagtgccgtggaatggtactgccagcctgccggggctggggggcatgtcactgtcctgccccacttggtggagggcagctttgtgaggagattcaatgggggcattccagggggacagagaaagagctgtcgccagatgccacaccctaaatgccaagggatcttttggaaaattgtgtatatacaaataagggggaaaaacatcaaggatttattcatttttacaagtctgttttgtgggggagggaggcatttttttctttttttaaacaaggttaacttgatttaactcattctgacaagagatacatgtggaactacttttaaaattttaaacacaaatttataattacaaagcagatgataaaaaatacacatagcatttggaatggaaaacaatggaagtttttcaagaatagagaacaaacaatattatctattctcatttagtaacaactcatcttaaaattattcctttgatacatttttagttgagaaaaaaatattctttttactacagagaagcacatgtccatcttagaaaaattaggaaatagaacaaaggagcaggtactgtctgtcatccagagttaccccatggttagagcttcctgaccatacccctcctttttctgtccatatatacttttttttttaagactgaatctcactcggttgccaggctggagtgcagtggcgtgatctcagctcactgcaacctcccctcctgggttcaagcgattctcagcctcccaagtagctgggactataggtgtgtgccaccatgcccagctaatttttgtatttatttttagtagagatggggtttcaccatgttggccaggatggtctcgatctcttgatgtcgtgatccgcccaccttggcctcccaaagtgctgggattacagggtgtgagcccctgcgcccagccatacgtactttttttaagcaaaagttaggatcatattttattttgtcatctgctttttttcatttaatatcagaaactctttgtatgtcaaaaataatattatgtgagtaattttttaatgattcatattatttcattgtatagccatattcctagaggaatttaaaaacctacccagaaattattgattaaaaaaaaaaagctagccaaagtaaaattagtcatagatatttttaaaatttaatttgttttggccgggcgcggtggctcacacctgtaatcctagcactttgggaggctgagacgtgaggatctcttgagcccagggttcaagaccagcctgggcaacacagggagaaagccaggcatggtggcatatgcttgtagtcccagctactcagaaggtggaggtgggaggacagcttgcgcccagaaggttgaggcttcggttgagctgtgatcgcaccactgtactccatcctgggtgacagagcaagaccctgtctcagaaaaaaagaaaattaatttgtttctagttttatattttgaaagaaaataatcaaaagaagaaaatttaaatttcttattctgtcatttaaagatgtcattatttttgttttcctttcagttctttccccctcgtgcgtatatgtgtatgtgtgttatgtgaaaagcaaaattcctcattaattaaaaaaaaaatttaaaagccttttgtgccacacatttaaaaattggagaggaggtcttatattggggtttgctgagattctctgagtatgatcccagagacagcacagagggaagtaaagagctgtggggcttggcctctgttccgccacccttccctggagcagggaggaagaagcggctgctaatggccctgcatctactgcaagggcaggccaaagggagggagagttgattgtggcagtgggagatggaattgtacccgattaggattatgtcgagagcagaggaaatcatttacactctctagggaggagatggacctgaggcaattagaatttttccacctctaactttagtgattcttgtattacagaggcatacatgatagagaaaagcacctgatttttttgatgctatcaggagaatcataagacttcttttgtcagggggcccctctgaggccccttgcaagtgctgatcttctgagttgcgggggaggggagatgggcactaagaaagtgaagcattttctcagaaatctcttaagagaggaggaggagaccatcccagaaggtctgcatatttaatgctcacaaaacctataatacggggggacccatcagtggtgctggagagatgccttggcacttgtgccttcccccaaggtgctggaggcgtcctggagtgagagacctgctttgctgtcatcattctgttttgttttgttttgttttgtgacggtgtcttgctcacccaggctggagtgcaatggtgcaatctcggctcactgcagcctccgcctcctgggttcaagcaattctcctgcctcagcctcctgagtagctgggattataggtgcatgccatcacgcctggctaatttttgtatttttagtagagacagggtttcaccatgttggccaggctggtcttgaactcctgacctcaggtgatctgcacgcctcggcctcccaaaatgctgggattacaggcatgagccactgcacccagccattcttttttttgagacagagtcttgctctgtcgcccaggctggagtgcagtggcgcaatcttggctcactacaacctctatctcctggttttaagtgattctcgtgcctcagcctcctgagtagctgggattacaggcgcctgccaccatacctggctgatttttgtatttttagtagagatgggggtttcaccatgttggccaggctggtctcgaactcctgacctcaagtgatccacccatcttggcctgggattacaggcatgagccaccacgcccggcctgttgtcatcattcttacattcctgcccacttctatcccatgtgtctttcactctggcacaagcatttatggaaattgatcacatggcttcaatgtaaattaactgggtgaggcccagccatgccagcttcaaccacgtgggcaccgtccagggacctccctgttccgcaagctgcccctctggctggtactcactgtgtgcctctctgtcttgccttgcccaccccccagggttctggctggtgtggaccatcatcatcatcctgagctgctgctgtgtttgccaccaccgccgagccaagcaccgccttcaggcccagcagcggcaacatgaaatcaacctgatcgcttaccgagaagcccacaattactcagcgctgccattttatttcagtacgtacacccaagcccccatacccaccctcaggagctcaggtgcacagacccagggctcacactgaatattggtggccaggctcctgtaggcatagggggtttgtcctctccctgcccctccgtagagcaaggtcttgaaagtacaggaacaaggggacactccttcagcacagaggagcatgtgctaggggtgcagttccctgaagccactgggccattccaaagctcacagtggctgggttctggctggatctctgcttctttagcacctgcgtacatacctacctacctaacttcctcccttcctccctcccttccttcctccctccctctttctctctttctttctttctttctttccctgcctgcctgcctttccatccctccctccctcccttcttttccttccttccttccctccttccttccttccctccttccttccttccttccttccttccttccttccttccatccatcctccctccctctctctctctctatttctttttttttttttttttttgagatggagtttctctcttgttgcccaggctggagtgcagtggcgcaatcttggctcactgcaacctctgctttccaggttcaagcgattctcccgcctcagcctccaaagtagctgggattacaggcatgcaccaccacacccagctaatttttgtgtttttagtagagacagggtttctccatgttggtcaggctggcctcgaactcctgacctcaagtgatctgctcgtctcggcctcccaaagtgctgggattacaggcgtgagccaccgtgcccctgccctccccttccctcccctcttttcctttccctcccctcccctccccttcctctttcttttcctttctctttcttacccttcctttctttcccttccttcttccctccctcccttcattcatccatctctctctctctctttaatggcagatagtcagataatagaacaataattattaacatttattgagcacttactatatgccaggtactgtgctaagcacctagtccttctagatgtggaattgaaacaattgtgggccgggctcagtggctcacaccgggctcggtggctcagcactttgggaggccgaggcgggcagatcatttgaggtcaggagtcagttataacgtgagtgaattgagacttggggttcattggcctgaattcctcccattttgcttatttctgtgtgatatgcctgagcagaggctgccatgaaaggggcgggttggggggtggcattgggacttctgagcaccaagaaacttagtgactctctgaagagcacttcccggacttccctggggctccttacatgtgacctctcatatggtcagtggaggcccagctgtgccagttttccaaagccagtctacagtgtattctacaaaataaactttcacaattgtttctttacaattgtttctttttttctttttaagacagaatctcgctctgtcacccaggcttgactgcagtggcgtgatcttggctcactgcaacctcctcctctggggttcaagtgattcttgtgcctgagcttcccaagtagctgggactacaagaccatgccatcacacctagctaatgtttgtatttttagtagagatggggttttaccatgttggtcaggctgttctcaaactcctgagctcaagtgatctgcccgcctcggcttcccacagtgctgagattacaggcgtaagccactgtgacccaccattatttcagttccacatctagaggggttaagtgcttagcacagtgcctggcatatagtaagtgctcaataaatgttagtaatgttatattataattaaattatctgtgtcataaggcattcagcacattcaaaagataactcacctagcatgtttttaataagccttggatggcagaggccccttaccctttgccggtcacccatctgctcctgatctgagtcaaggtgaagcttggtttgtgtttccagaccacctccagccacagtagagacaacagagatttctaaccccctagcaaaagaccctacatagtgcatttggaaggttaggaggaagaaaagtagttaagaagtctgaagttagggaccctggccctgaggcctgtgggacttggatgaaggacacactctaagcaagaacatgagacttgtgtgcatgtggaagtgggtccattccaggcagaagttattttttggccatctaccacgtttgcctaattctctgccttaactcccaacaggcgtgaagtccttgcctacgaagcagctttaggggctctcagatttcaagaagctaggttaggcccttcccaaactgcccctctctctctgcagaattgctcgcagctgtctctcctctgctcacaaccaagagctgtagccatcacttgttgggtgctctggggtgggaagagacaatgcaaatattcagtgggagctttgcagtctgcctagaacaatgaccagtgcagtaatttctccttcctacctccccattttagggtttttgccaaactatttactacctccttatgaggaagtggtgaaccgacctccaactcctcccccaccatacagtgccttccagctacagcagcagcagctgctgcctccacagtgtggccctgcaggtggcagtcccccgggcatcgatcccaccaggggatcccagggggcacagagcagccccttgtctgagcccagcagaagcagcacaagacccccaagcatcgctgaccctgatccctctgacctaccagttgaccgagcagccaccaaagccccagggatggagcccagtggctctgtggctggcctgggggagctggacccgggggccttcctggacaaagatgcagaatgtagggaggagctgctgaaagatgacagctctgaacacggcgcacccgacagcaaagagaagacgcctgggagacatcgccgcttcacaggtgactcgggcattgaagtgtgtgtgtgcaaccggggccaccatgacgatgacctcaaagagttcaacacactcatcgatgatgctctggatgggcccctggacttctgcgacagctgccatgtgcggccccctggtgatgaggaggaaggcctctgtcagtcctctgaggagcaggctcgagagcctgggcacccgcacctgccacggccgcccgcatgcctgctgctgaacaccatcaacgagcaggactctcccaactcccagagcagcagctcccccagctagagcaggtcctgccagcacccagcaacttggcaaagcaaccagggtaggggagaaccacgagagaagcattaagtgactttcaaagactttcagagtacagccacttggttcctttttgtttgttttccttctcctctcctgcattttcctccatctccaggtacagttcggggtgtggatgcctcttcctccacaagggcacagtgttgtggagggctaagttggttctgtgactcattcctcataccctaactccatctcctttctttaaagtcaaatctcacctacctgtttgggtcagagagatgtgttttaaaagcccccaaggaaggaggctgggactgtgccctgacatgattcttggtgatggaataggtttgtgctctgattctagtttaagagaacgttgctgtatctcagtccaggagaggcagcccatcttggccctggatgaagaaggaaacccacagaggcccagggcttgtcattgggctgccagtgtctgccaagccagcattgagctaatcctgtgggaggatgagagctactgggccgttgtatgataggttggtaggggcttgttgatctgtcaaattccaggtgacaagatctatgcaccccatgcgtccttgaggggcctcttccccgcaggctctggctggccgcaggctggttctggtgtgaaaggttatactgccttttctttgtttgtttgtttttttctctaaaaacaaacagcaaaagacagctgaaaacaagaacttcaccggtgggcaggcaagaattctcttctggaaaatgacgtttgtggctctttcccaagttggccttcaaagagcctgcctgctgttgagccagaagatgtctcgtgtgaaggctggggtggcggctgtcttggaacctctgtgagcaggaggccctaagccgcagcagtggatagaggtgcagctctctgcctctctgccctttggtctgtgttcacaggtgacccgtgtcagcctgcatcgcaagcacacaccctgcgggccttcaagtctcactgttccgtatgaggaaacagacagcggactgaggaagcgatggccccagagaaagggcccctgtagcctggctctcacacagtattttatctttgattctgaataaatattttttgtggggttttttttttttttttggtggcagttgtttgttttaaactgaccacttggaagaaacaccttggttatctgtggttttcatgccttgtccctgcctctacccccaccccttttgagtcgggtgactcatttttctgtgtagagactcggtggcccaggcaggaggtgaaagcagccatccggaaggccctggggacccttgtgcctgttgctcgccttcaggtcaccagctgagctgcgataggaaaatctgaatggaggcagcaaacagccaaaacaaacattccccacccggccctgtgcatatgaagtctttcttcccccaactcttgaacgatgatgatattcagacgaagcattgatgttatggaagaaagaaagaaacaaacaaaatatatatatatatgtccaaaaacagacaaatccaagggtgtgaggtaaacgagtgtctgcatttagattccacaaaaccaaaatccatgttgaacaaagttaagtccgtacacagtgactttttgggtgagccgtgtgtgtctgtctgttgtgtgtgtgcctcaagccctgttttcctgtgaagatactttgagtggcagccattctctccacgtgaaccacacgtctggagcacagacaggcctctcaaggtcattgatcttacgcatttactgtttaccgaacaaatgtctgactgtgtactcgggtgtactccgcagcattgtcgactgcagtcccctgtgtttgccagagatactgtgctcgaagtagaggttttactctactcatcactgcgatttgcacattgctccgtggacactcggaggcctgcgttctgttccctataaatggaagcgtgctctgagcctgtctgcctccctcggctgctgctggtcctcagtaccagcgcccgggggtgtccacaaccacttgggacagaagaaggtggaatttcagacagaagcttgactgggtcttcaatgacaggcttggactagctgtggcccagacatcggccctgcccagaattgccaggaggaggctttgcaggctctagaggagccgcagggcctgcctg

SEQ ID NO: 36265 - DNA, 18397 bp, Homo sapiens
gcgcctgcgcgggaggccgcgtcacgtgacccaccgcggccccgccccgcgacgagctcccgccggtcacgtgacccgcctctgcgcgcccccgggcacgaccccggagtctccgcgggcggccagggcgcgcgtgcgcggaggtgagccgggccggggctgcggggcttccctgagcgcgggccgggtcggtggggcggtcggctgcccgcgcggcctctcagttgggaaagctgaggttgtcgccggggccgcgggtggaggtcggggatgaggcagcaggtaggacagtgacctcggtgacgcgaaggaccccggccacctctaggttctcctcgtccgcccgttgttcagcgagggaggctctgcgcgtgccgcagctgacggggaaactgaggcacggagcgggtgagacacctgacgtctgccccgcgctgccggcggtaacatcccagaagcgggtttgaacgtgcctagccgtgcccccagcctcttcccctgagcggagcttgagccccagacctctagtcctcccggtctttatctgagttcagcttagagatgaacggggagccgccctcctgtgctgggcttggggctggaggctgcatcttcccgtttctagggtttcctttccccttttgatcgacgcagtgctcagtcctggccgggacccgagccacctctcctgctcctgcaggacgcacatggctgggtctgaatccctggggtgaggagcaccgtggcctgagagggggcccctgggccagctctgaaatctgaatgtctcaatcacaaagacccccttaggccaggccaggggtgactgtctctggtctttgtccctggttgctggcacatagcacccgaaacccttggaaaccgagtgatgagagagccttttgctcatgaggtgactgatgaccggggacaccaggtggcttcaggatggaagcagatggccagaaagaccaaggcctgatgacgggttgggatggaaaaggggtgaggggctggagattgagtgaatcaccagtggcttagtcaaccatgcctgcacaatggaaccccgtaagaaaccacagggatcagagggcttcccgccgggttgtggaacacaccaaggcactggagggtggtgcgagcagagagcacagcatcactgcccccacctcacaccaggccctacgcatctcttccatacggctgtctgagttttatcctttgtaataaaccagcaactgtaagaaacgcactttcctgagttctgtgaccctgaagagggagtcctgggaacctctgaatttataactagttgatcgaaagtacaagtgacaacctgggatttgccattggcctctgaagtgaaggcagtgttgtgggactgagcccttaacctgtggagtctgtgctgactccaggtagtgtcaagattgaattgaattgtaggacacccagccgtgtccagaaagttgcagaattgatgggtgtgagaaaaaccctacacatttaatgtcagaagtgtgggtaaaatgtttcaccctccagcccagagagccctaatttaccagtggcccacggtggaacaccacgtccggccgggggcagagcgttcccagccaagccttctgtaacatgacatgacaggtcagactccctcgggccctgagttcacttcttcctggtatgtgaccagctcccagtaccagagaaggttgcacagtcctctgctccaaggagcttcactggccaggggctgctttctgaaatccttgcctgcctctgctccaaggcccgttcctcagagacgcagacccctctgatggctgactttggtttgaggacctctctgcatccctcccccatggccttgctcctaggacaccttcttcctcctttccctggggtcagacttgcctaggtgcggtggctctcccagccttccccacgccctccccatggtgtattacacacaccaaagggactcccctattgaaatccatgcatattgaatcgcatgtgggttccggctgctcctgggaggagccaggctaatagaatgtttgccataaaatattaatgtacagagaagcgaaacaaaggtcgttggtacttgttaaccttaccagcagaataatgaaagcgaacccccatatctcatctgcacgcgacatccttgttgtgtctgtacccgaggctccaggtgcagccactgttacagagactgtgtttcttccccatgtacctcgggggccgggaggggttctgatctgcaaagtcgccagaggttaagtcctttctctcttgtggctttgccacccctggagtgtcaccctcagctgcggtgcccaggattccccactgtggtatgtccgtgcaccagtcaataggaaagggagcaaggaaaggtactgggtccccctaaggacatacgagttgccagaatcacttccgctgacacccagtggaccaagccgcacctttatgcagaagtggggctcccagccaggcgtggtcactcctgaaatcccagcacttcggaaggccaaggggggtggatcacttgagctcaggagttcgagaccagcctgggtaacatggcaaaatcccgtctctacaaaaatacagaaaattagctgggtgcggtggtgtgtgcctacagtcccagctactcaggaggctgaagtgggaggattgcttgagtctgggaggtggaggttgcagtgagccaggatctcaccacagcactctggcccaggcgacagctgtttggcctgtttcaagtgtctacctgccttgctggtcttcctggggacattctaagcgtgtttgatttgtaacattttagcagactgtgcaagtgctctgcactcccctgctggagcttttctcgcccttccttctggccctctccccagtctagacagcagggcaacacccaccctggccaccttaccccacctgcctgggtgctgcagtgccagccgcggttgatgtctcagagctgctttgagagccccgtgagtgccgcccctcccgcctccctgctgagcccgctttcttctcccgcaggcctgtaggagctgtccaggccatctccaaccatgggagtgaggcacccgccctgctcccaccggctcctggccgtctgcgccctcgtgtccttggcaaccgctgcactcctggggcacatcctactccatgatttcctgctggttccccgagagctgagtggctcctccccagtcctggaggagactcacccagctcaccagcagggagccagcagaccagggccccgggatgcccaggcacaccccggccgtcccagagcagtgcccacacagtgcgacgtcccccccaacagccgcttcgattgcgcccctgacaaggccatcacccaggaacagtgcgaggcccgcggctgttgctacatccctgcaaagcaggggctgcagggagcccagatggggcagccctggtgcttcttcccacccagctaccccagctacaagctggagaacctgagctcctctgaaatgggctacacggccaccctgacccgtaccacccccaccttcttccccaaggacatcctgaccctgcggctggacgtgatgatggagactgagaaccgcctccacttcacggtgggcagggcaggggcgggggcggcggccagggcagagggtgcgcgtggacatcgacacccacgcacctcacaagggtggggtgcatgttgcaccactgtgtgctgggcccttgctgggagcggaggtgtgagcagacaatggcagcgcccctcggggagcagtggggacaccacggtgacaggtactccagaaggcagggctcggggctcattcatctttatgaaaaggtgggtcaggtagagtagggctgccagaggttgcgaatgaaaacaggatgcccagtaaacccgaattgcagataccccaggcatgactttgtttttttgtgtaaggatgcaaaatttgggatgtatttatactagaaaagctgcttgttgtttatctgaaattcagagttatcaggtgttctgtattttacctccatcctgggggaggcgtcctcctcctggctctgcagatgagggagccgaggctcagagaggctgaatgtgctgcccatggtcccacatccatgtgtggctgcaccaggacctgacctgtccttggcgtgcgggttgttctctggagagtaaggtggctgtggggaacatcaataaacccccatctcttctagatcaaagatccagctaacaggcgctacgaggtgcccttggagaccccgcatgtccacagccgggcaccgtccccactctacagcgtggagttctccgaggagcccttcggggtgatcgtgcgccggcagctggacggccgcgtgctgtgagttctgggctctgtgccagcatgatggggagggcgacgcgcatttctcacacggcagggagggccacacgcgtttgtttctcacacgatgggcagggcgacacatgtttgtttctcacacggcggggagggcgacgggcatttctcacagggcgctccctgggtcttttactcacataggtctaaatcccatgtaaacacgtgttcaggactcaccaagcccctgcttgtcatttaactcaggaaaactctcaggaacgacagcacttggatttgccttaatcttaagagaagttgccttcggaaatgcgtttttctttttttgctcattcatttactcagtgtccacgcactgaccctccgtgccgggtggtttggatcctgctcccggggacagacacacagtgaggggaagccataagcaagtccatgcagacacagcgtcagggagtggtcatgcagagagcacgctagaagccagctgtgcagacacggggcagggaggtcccctctagaagccagctgtgcagacgcaggggacagggatggcctctctggaagccagctgtgcagatgttgggggcaggggtggcctctctggaagccagctgtgcaggagtggggggtggggaggccactctggaaaccagctgtgcagatgcaggggacaggggtggcctctctgagctgacctctgagtagagagacccaagagaagtttctcaaagcatcttatcaagctaggtatggtggttcatgtctgcaattccagcactttgggaggccaaggcgagagggtcacttgagcccaggagttcaagaccatcctgggcaacatagcaagaccccatctcttaaaaaataaaaataaaaaattagctgggaattgtggcacatgcctgtggtcccagctactcaggaggctgaggcaagaggatcccttgagcccaggggttcgaggttgcagtgaaccatgattttgccactgcacttcagccttgctgaagaccccgtctcaaaaaacaaacaacaaacaggcatcttatcagatctcggtcttgaaagcactcagcgtagtcttgcccaggggagggtgggtgcggtgtgagcccgtcctgcgaaattagctgtgctgtgttaacagaggacgcgtcttcctgtggaccgggtttatctgcggctttcatttctcggaggtgctgtttgccttgcacttgacccccagcaaacctcaggggtccttctcaggcatggctgggctgggatctgggaggactttggccacaagctcctaggcctggaaaggttctgttcagcccctgcccagccttgcttggggtcatgggacaggcatgtgtgccagttccggtaccagccagttcctggaggtcagccccttgggggcccctcaggggtggtgtgggcccagccaggcggtgcgcctcttctgatatgccctgagagttgatcacgctggtgccagggtgccaagggctgcagggctcggcacggccgcctgtcccagggtcagtgtgctgcagggctggccaggccactccgccctcccagggcaccagggcccgggggtgctctctgggtgctctcaggctcgtgtggccccttgggtgtgagcaagcctggctggcctctgtcccgcaggctgaacacgacggtggcgcccctgttctttgcggaccagttccttcagctgtccacctcgctgccctcgcagtatatcacaggcctcgccgagcacctcagtcccctgatgctcagcaccagctggaccaggatcaccctgtggaaccgggaccttgcgcccacggtacagcggcgggcggcgggcgggggcactgagctggggagcgcaggtgctgaagcgccgtctcctgcatgtcccagcccggtgcgaacctctacgggtctcaccctttctacctggcgctggaggacggcgggtcggcacacggggtgttcctgctaaacagcaatgccatgggtaagctgcccgccgcccagcgcccgggccggggtctcctccgtgctgcctgccctggagactggaggtccgcatgaggggccctgggcacggtgctgggccttgtgttttctgggaaatgagtcctatgggctgatgcctctcccaactctggccttctgtgctcctaaggagggttctggggccctgcctggaggtgggctggcaccacatatctttccgtcccatgccaggttcctcctgagtcaggcttagcacggcttccccaggccactctgagctcctcgtggggagagagcctcaactctccgcctgtgattggcccatctgtggggtgcagagccctccaagtgaagaatctgtcccccaaccccagagctgcttcccttccagatgtggtcctgcagccgagccctgcccttagctggaggtcgacaggtgggatcctggatgtctacatcttcctgggcccagagcccaagagcgtggtgcagcagtacctggacgttgtgggtagggcctgctccctggccgcggcccccgccccaaggctccctcctccctccctcatgaagtcggcgttggcctgcaggatacccgttcatgccgccatactggggcctgggcttccacctgtgccgctggggctactcctccaccgctatcacccgccaggtggtggagaacatgaccagggcccacttccccctggtgagttggggtggtggcaggggaggcaaggggctggccgggacgcgtctcctcaggccccagcagacggtcccgtgttgtggctgcaggacgtccagtggaacgacctggactacatggactcccggagggacttcacgttcaacaaggatggcttccgggacttcccggccatggtgcaggagctgcaccagggcggccggcgctacatgatgatcgtggtgtgtgcccccacactgtgggtctttgggaagggggccgcccggtgcccagtggctccttctctgtgcagcgtcatcctcgtgcctgtgtggtcgccgaggatgttttctgagggtctttgtgatatcgagggaatatcaagaagtttgcaggcttggccccagctgtccagggaggtcgggtttgagggtccccagaaatggccgggtgctactcagggttctgtcagatgtaggttacttgaactgccttaaagcaaaaggccaggggcatgataaactgatgtcacctggtcctggaaagtggagggcccggtgggcctgggcatgggtatcgctggaactgtggaggctccgtgtgccttctggccgtgcctctccttctggccggctctgaatccctggaaaggacggcgtgagtgagggcagcttccagccctcatgctggcaccacagagcggagacttcttcccatcagctcccatagaaaagtcccaaagcaggactcttgagtcacccagcacaaagaggcccttccctgagccagtcccacagccagaaggatgcagtttgggggctggtccagcccgagtctggtgtccggcacgatggccagaggaggaggtgggaggcagggcgagctgaaaagatccaacagttcctgcccggaagatccacttcagcagaggaagcacagatgagatgtggggctgtgctgatgctgcctgtttccatccctgccttctgcaggcagcaaacagtagtagcccttaagagcaggagtggaaacacagacttttttctttctcacatttttttaattataaaagaaaagtgattactgtagaacacttgggaaactctagaggtttaaagaaaaggtaaaggtaaagcttccattccggcgcgcccctcatcagccagctggtcctgactcgcccggccctggctcctctccaggcaggcgtgtgcaggcatgtgcaggtacacaggcaggcatgctgtacacacgcatgatgtcatccccagcctcatcctctcactgtctcagttttccccgtggctggcgccagggctctgggccaccctcaccttgacaggtttccctcttcccaggatcctgccatcagcagctcgggccctgccgggagctacaggccctacgacgagggtctgcggaggggggttttcatcaccaacgagaccggccagccgctgattgggaaggtagggcgagggtccaggggacgggggttagaaagcagaggcctccagccagggggagccggcagctgctcaggaagacggtgggatttgaggagccatcacgcccagtgggacagctgagaggaatgggccacagtggcccgtgacgatggtggctcctacaaggaatggccccgtgagttcttccatcagcaggcctttgacttcatgggcagctgggcctggcccaggcacaagccctgcagaccctcagtgaggccttagggtcctccttgtcctcccagccccccaggggcctccaggcagggcccccgctgagggagcagctagggagggtctggtgcggatgtgaggctgcctggcagggcttgcacggggccgtctccgctgcccttctccctgacgctctctggttctgcagcccagcccctgggtggacgtgttgggggtgacccctcgttttcccagggttgaggccccttggccccgcatcagtgccttgtggagaaagagctgctcattgacctccagggtgcaggtctctcagatttgcaaatgtgggcgtccactaagagtgaggctgcccctctgctcaggctgaggctcagtggggcttccatgcaggccctgggtggggccgggtctccccactgcagcctctcgttgtccaggtatggcccgggtccactgccttccccgacttcaccaaccccacagccctggcctggtgggaggacatggtggctgagttccatgaccaggtgcccttcgacggcatgtggattgtaagtgtggccccctcctgagcatccccaaggcctctggggactaccccaccctcctcactctgggcagagtcacctaccagcagcgcttctcttgcaggacatgaacgagccttccaacttcatcaggggctctgaggacggctgccccaacaatgagctggagaacccaccctacgtgcctggtcagctcgccccccacctaccctggggacttaatcaaatcagagactcccttgtctggcctgggagacttagcaccctcatctctgagaagcagatgggccagcggggaaaggggcgggggggggatccccaggagaaaggctcaggctgggagactcagccaagcagtgcagacagggtgggtgcagaggcacaggccctgccggaggagacgccgctcacaggtgcttgccagagcacagtgaggccgactcgactcagagccgtctcgataggcgcagggaccatgcagcggagacctacccacccgtggggagaggtcaggcccaactcgaatgcagcacgggcaagtggatttctagccagggagcagggtgggctcagaggcaggaattaccaagaagaagcatgggggtcagggggattctggctgaactgacccagcaggattcttgctgaaggcaggccagggtgaccagacatcgcctgaggggtggtggaggttggggcttctcgccaaactgtcttagcaggaatggcagaaactgggttttacaaggaagtacaaggatgggcctgggagaaggtttgggggcctgaggctatagtttggcccagcaaagaatcagtgagaggatggggttttgggcttaggtaaacaggcaggggagtgcttgaaatgggccaagagacggtggatgtgaagtctgggggtctgcagagcccaggctccagcacccgcccagccctgtcttagaagcagtggagatgattacccaggttcccgggtaacgccagccccacagaggcgtggggagcggctgcaggtgcacctccagggccagcctgaagaggcagcgacctgcacaggggctcctgggaggtggggggcagggagggcaccttggagcctgccgggaggaagctccctggaaaccagcccccgcctcttccaggggtggttggggggaccctccaggcggccaccatctgtgcctccagccaccagtttctctccacacactacaacctgcacaacctctacggcctgaccgaagccatcgcctcccacaggtgagggccacgtcccgccccactgggctctgccctcacagcctgtcctacaaggttggggcctctgcagggcctcagggaggaggaaaagcggaggcccagaccacccggggcccgctggcggcccgagtgctctccccacccgctgcctgcaccccagcctgaagctggagcgctccttcccacttcatgcctggggcttggagaggaaggaccctggatgctgacaggagtctgcatcagcggggacctcatgactcctgtgaggctggggggggtcctggctcacctacaggcatcaggtggcccagacagaggcaactgtgcccgcagacatgggcagtagcctcgccgtcctcctccccagcctctgcctcatcccagaaagctccttgctcccagctctgccctgctggtgacagggttcccgagtgaccccgctccacacagccctcacggtgtcccccaccaccccagggcgctggtgaaggctcgggggacacgcccatttgtgatctcccgctcgacctttgctggccacggccgatacgccggccactggacgggggacgtgtggagctcctgggagcagctcgcctcctccgtgccaggtgagctcctaccaggaggggctgctcagcagagtagagccgggggcctctatgggaggcttgccggggccccccacccacttagcaggtggggctctgggtcacttggcctgagctggctctgctgcagcagcctgaggaccagcctgactctgccctcccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagtctggtagggtgggggtggcggcatggcaggtgggcgatcccacccacccaagactctcccctgggaatcccacccctgctggagaagcaccccatgctgggtggctgagaagtgcagctctcccgaggcggggactccaggggaccgcggccccagcacccaagtgcttcctttgcccccgcctgccctgcagccccaggagccgtacagcttcagcgagccggcccagcaggccatgaggaaggccctcaccctgcgctacgcactcctcccccacctctacacactgttccaccaggcccacgtcgcgggggagaccgtggcccggcccctcttcctggagtgagtgacctaggcaggggcggtggcccatgtgtgccctgggggaggggcacgtaactcccaggcagccctgtcctgctgtgggctgtgttccccaggacccagcaggttgccgctgagtgagacaacatttgggcctggcttaagggggaagggcagcaagaaaacccagtaatatcccccagacaggccgtagtacacacgaggagttcctaacaacagccctgcacatcagtgtgttgagggaggattcccagagagtgaggtgattagttaactatttgcagaagtcaatttatttttcttgcataccatagaaacataagttccagataaattaaatagttaatgtcaaaaatcaagctgtggaggccaggcacggtggctaacgcctgtaatcccagaactttgggaggctgaggcgagtggatcacctgaggtcaagagttcgaggccagcctggccaacatggtgaaacccatctctactaaaaatacaaaaattagccgtgcatggtggtgggcgcctgtagtccctgctactcaggaggctgaggccagagaatcccttgaacctgggaggaggagattgcagtgagccgagatcgcgccactgtactccagcctgtgtgactccatctcaaaaaaaaaaaaccaagctgtgaaagactccacaggaaaagataagtgaatgtgtatctctggggaaaggtttcatttagagaaaaaaaaaaaaaaaaggtgaactttatttgaccatagcagaaaaaaaaatgtaaatctctgaatataaacacaaaaagattaaaactgctctgaacatggactgtaacagcagagaaggcattgtcaataaaacagcaaatagctactcttcctaataggtagagaactcatacgttggtaagaccaagactaagaaccaaattggaggaacactgtttgcaaaacaggagatacgaatggtatccacacattcttcacccggaaatccaagaaacgcaatttgtgttttaattactattttaatgaccttgttgtttctgtcactacacttttttttttttttttttagtggttgccctagggattacaattaacatcttaattttagcctcgttggaactgatgccaacttgctttcaatagcataaaaaagctttgcttctatgtggtttccattgcctctcgttcctctgtgctgttacacgtctgtatccatgatgagcccatccacgcagatttataatgaccgccttattcaattatcttttaagtcaaataggagggaaaaatgggttacaaacaaaaagtacatacacactgtctgccttttatatttactgatgtagttacctttacccatggttttatttcttcatgtggctttgacttcttgtctaacatctttcatttacagcagaaggactccctttagtatttattgtagggcagttctgctagtgatgaattctctcagtttttgttgacttcagagtctcttaatttctccttcattttttgaaagttctgctcaacgtagggttcttgactggcggtcgtttctctgaacactttgaacttgtcagcccatggcctccgtggtttctgctgagtagcttctgtcttgcctcttcccagattctctgtctttggcctttgaagtcccgatggtgtgtctaggtgtagatctctgagtttatcttactgggagtttgttgagcttcttggacgtatgcattgatgtttttcatcaaacttgggcggtttttcagccattacttcataaaatattttttctgcccctttctgtcttctactctgggacttccgttccacacattggtatgcttgacggtgcccaggggtctttgcagctctgttgactccttcctcgttgtgttttctttctgttcttcagactgcttagtctgactgccctgtcttcaaggtcactgattcttttttccaccagttctcatctgctgttgagcccctctagtgaacttctcattttagttgctctcttttcaactccagaatttctgtttcattcctttacgtttctctcgttaaggatattccctatctggtgagtcatgttctcacactttcctttagttcttcagacacggtttcgctgagctctttgaacacatttaaagtagctgacgtaaactctttgtctagtaagtccaatgtctgggcttctctagggacaatttttattaactactgtccccccatctgtgggccatactttcttgtttctttgcgtgtctcatacatttttgtttcagactggacattttaaacgcagctgctgtggtcatcagattccccatccccctcaggtctcgttgctattgctgattgttttgtgactttcttgagctaattccataaggtctgtgttcttcattgtgtgtggccaccaaagtctctgcttgactagcttagtggacagccaataattggtcagatatccttcacagatggcatccgtgagtctcccagcctttgctggggcgaggtggggagcaccgtcaacacttagctaggccaaggattcttgctgttcttacaaagattcagccattttgttaaatacatgctccccagatggctgcaaacccttggttagtttcaagagtcctaaaaatgtcaactctgaccatttttgccgatgttcctgttttcacagaggagaggatcttgagaggggcttactccaccatcttcactgacatcactccaagaaatgtattttgcaagaaatattttgaagcagaaagacaccatttattttgcccatgaattagaatacattagagaaaataagactatcccttgctggcaagaacacagtgacacagtagggtggaatataaattggcacatttgtggaaagcaacagtacatatcagtcaatgtttttgagattcacattgatgcgttaattttacaaatagaaatagggcctaaagaagtcacctcaaaaggcatgaacgctccatgaatgtatccatgcagggatcatagctgagcactggatgccccctgcacgtccgggggcaggaaacaggacagggcagagctgcgtcacagggcaggacagtctccgttagacggagaatcctccgtagagctgcttgcacatgtacattcatctttttgtcagatgttaattcaagttgcctttggttgtgggactgggaggatcttttctctttgttgatactttttcgtactttccaaatacttgactgatgagcacatgctgccttggttaccggaggataagtgagcgagcaaagtgaggccagtgctgtgtccatcctggtgcctcaagcacaagcccctattcctgccctgagcccagctgccggcatgtccggggagaaggcttctcccagctccggcattgacttctatctgctggaatcatccctgcccgtctgacctgagtcctccaagtcctccggcaccttgagctccagagagcagaattcagcctcttcctgtgcctccccagggtgggcatatgagccagccccatcccattcatcacccgtatgcctgtgtgcccatcccccttgcaggttccccaaggactctagcacctggactgtggaccaccagctcctgtggggggaggccctgctcatcaccccagtgctccaggccgggaaggccgaagtgactggctacttccccttgggcacatggtacgacctgcagacggtgagtctggggaccctaagccctggggagacgggagaccagagcagccctcccacctgccccctccacccagttggtgtgaccaggtggcggaaagaggaacgtatgtgttgagtcccggccatgtgccaggcccccacccggctgctccgcacccatcagcctctccgctcctcacaccatccccatttcccagatgagcagactgaggcctgcttgcagaacctggccaagtcccacggccatcacaggctgtgcctgtgctgagctggcatacccaggcctctcaggcactgtccccactcagtagccaggagggtccctacctacagtgagccctgagtctgcgcctgaagtcacagttcagcccgtctgtgccaggcctcctaggcctccacgtggagccccgggagatggagagcgtggttcctgaggacagcatgggggcctcggcacggcccagaatcctcaaagcaacatctccctccaggtgccagtagaggcccttggcagcctcccacccccacctgcagctccccgtgagccagccatccacagcgaggggcagtgggtgacgctgccggcccccctggacaccatcaacgtccacctccgggctgggtacatcatccccctgcaggtacctgggccaggcggctatggtgggggtgtggacagcacactgcagagctgggggaggcacagggagatggtgggggagaggcccaggtggggcttctgaggggccgccccccgcagtgtaggttatcaaggagccagccaggccagtgaggtggggagggcacagccccacaaaggcgtggagcatggccggcaggagctcagtggtctgcatggtggaggttctgccgggcccggcctcgggcagccgtgggatagcacttgaggtggggaaggtcttgggtcatcaccacggggttccagcccctgcggccgcaggtgttcctgcagatcctagttactggcagcctggtgctgtaccagcctagcattcccgggccctggaggcctccacctccaccagggtggggatgatgacatcacgtgtccttccctttccagggccctggcctcacaaccacagagtcccgccagcagcccatggccctggctgtggccctgaccaagggtggggaggcccgaggggagctgttctgggacgatggagagagcctggaagtgctggagcgaggggcctacacacaggtcatcttcctggccaggaatgtgagtcctggggctgctcaggctggtgggcaggggccggctcggggttgagaaggggtgaggggacctgggcttgggggtcccacgatggctacctgccactaggacactctagcaggtggcctggggtcctagagtgagcagtggggccgtgcactctgccctttcgtgtacacagagggaggtcacctccctgatgccatcatgagtccctgttctcatgggtgttcctgccccagctgtctgctgacacctccacattctctgccttttcatctctctctgctcggcccagaacacgatcgtgaatgagctggtacgtgtgaccagtgagggagctggcctgcagctgcagaaggtgactgtcctgggcgtggccacggcgccccagcaggtcctctccaacggtgtccctgtctccaacttcacctacagccccgacaccaaggcaagagggcccagagtggcacagggatcgcgtcccccagccgtggtgcagggggcagaaggtgctgggcgtcctggtgaccgatgccaggaacagaggatgctgggacctcccaagggggtctttggggaggagtgggaagggtcaggccacacaggctgtgcctttcctcctcctgtgtctacacgtgggtgatggggccacaatgacgacctctgagccgtgttgaagcagcaccgcgtttctggcgtgcgttaaggtgacccgcactgagagccggggtccccctgcgcctgccggggaggaaccgggtgcgaagcatcccagggccagacggagctgccccctgagcgccgggcctcgctgctgctgggatctcggggccagatggagccgccttctgagcgctggggtctcactgctgctgggatctcgggctgctccatttgtgctctctcttttccaggtcctggacatctgtgtctcgctgttgatgggagagcagtttctcgtcagctggtgttagccgggcggagtgtgttagtctctccagagggaggctggttccccagggaagcagagcctgtgtgcgggcagcagctgtgtgcgggcctgggggttgcatgtgtcacctggagctgggcactaaccattccaagccgccgcatcgcttgtttccacctcctgggccggggctctggcccccaacgtgtctaggagagctttctccctagatcgcactgtgggccggggccctggagggctgctctgtgttaataagattgtaaggtttgccctcctcacctgttgccggcatgcgggtagtattagccacccccctccatctgttcccagcaccggagaagggggtgctcaggtggaggtgtggggtatgcacctgagctcctgcttcgcgcctgctgctctgccccaacgcgaccgctgcccggctgcccagagggctggatgcctgccggtccccgagcaagcctgggaactcaggaaaattcacaggacttgggagattctaaatcttaagtgcaattatttttaataaaaggggcatttggaatc

SEQ ID NO: 36266 - DNA, 4029 bp, Homo sapiens
ggggagctgcgggccaggcggcggccccctagcgtcgcgcagggtcggggactgcgcggcggtgccaggccgggcgtgggcgagagcacgaacgggctgcctgcgggctgagagcgtcgagctgtcaccatgggtgatcacgcttggagcttcctaaaggacttcctggccgggggcgtcgccgctgccgtctccaagaccgcggtcgcccccatcgagagggtcaaactgctgctgcaggtgaggaccgcgcggtgcaagaggcgggcgcgggcgcggcgggccgggcggggcgcgcgatgcggcgcgagctgcagggcgcggggcgccgcggaaaatctgcgccaggccacaggcccgggcgcccgcccgcccgcccgcccgcccgcgggggaagaaggtgccctctgcgtagagacaggtccagcgtcagtcgcagattcctggtgtcgggtggcgcccggcgttcgggtgtctatatatggaaacccacccggagccggtttacgtgtgccagatcctgcgcccgtgacagcacgggcgtgcactcaggcccggaggcacctagtgattgccagtatttttggcaccgtcttatgcgcacgcacctttacaataaaaacatcaaaataatcatcacccaagaattcccttatcgtatctcatgcacaatgctgtatgtaggctgacgccttcatctttatgtaacctctgtgagagagttattcttctccattttacagatgaagctgaggttttgaaatattaagaaacaattttcggaataaactcagatcatcctgtctccaaatcttttcctcccctacctggtcgctgaatggtttatcatcctctcgtgttttcctccacctgcccaaaaggtcagggcccctcaatgaggaagagcccaatttgggagtcagaattactaacaacaaaacccccacaaattgctcacaacggcagcaaacccttaataattgattacttggattatctgcttgaaaactttggaggcctaatgtttagtggatttattctccttcctctattagagcatctagtagagatcctcatctccagggtgatcagagtgacactgagaaattgtcattttttggccatcatgtctattaaatccaaagccctttgaagcagggagtgttactcatttctgtcccccagtaagcccctcatacagttctcaaacctagggaaagtgaaataaataaatggctatagctttatataattcaatcaccttttcagtttatttggggcaataccttttccctcaaataccctaataattgaagcaacattggattattttggcttgttatccagtaactaacatggataacagtatccatttacacgtcctcagtatccatttgatttcctcatcctttttttcttcaaaaaaaaaatctaggaagtgcaaacctttttttttctcctgtcctcttcccttctctctaccctgcctgtcctctgtcacccaccctcccctccaccaggtccagcatgccagcaaacagatcagtgctgagaagcagtacaaagggatcattgattgtgtggtgagaatccctaaggagcagggcttcctctccttctggaggggtaacctggccaacgtgatccgttacttccccacccaagctctcaacttcgccttcaaggacaagtacaagcagctcttcttagggggtgtggatcggcataagcagttctggcgctactttgctggtaacctggcgtccggtggggccgctggggccacctccctttgctttgtctacccgctggactttgctaggaccaggttggctgctgatgtgggcaagggcgccgcccagcgtgagttccatggtctgggcgactgtatcatcaagatcttcaagtctgatggcctgagggggctctaccagggtttcaacgtctctgtccaaggcatcattatctatagagctgcctacttcggagtctatgatactgccaagggtgagagaggggcatcggggagaaggagggtggtgtggaaagaggatcctatgggatctataactcacaaaggacctgatatatattgatcttgttttttctagtctctgggataattgaggcttctgaatgaggaggtgatgtgcataagttaatagctgaagcgttccttgtgtcctctactgaaataaactctggcctttagttattcagagaggaggaggggggagcctgtctccctctagacacagccatagcagttactgagtttaacttgaagccacttccaatgccctgtatacaagctgagcactgcccctccggggtccggagagggcagcagccacctttgctgtctgcctggtcatatgtgaagcacctgcacaggggcaggttccccgcaaggtcagagcatggagctggaggtgcagtggcctctctccctccacctgctttctgctgagaacaggcacttcatagccgttcggcttctgggctctgtccacagggatgctgcctgaccccaagaacgtgcacatttttgtgagctggatgattgcccagagtgtgacggcagtcgcagggctggtgtcctacccctttgacactgttcgtcgtagaatgatgatgcagtccggccggaaagggggtaagcttgtgctctactcatctaaacttgtttggttttgcccgaggagaacattttacagggctcctttcagtcttccttactggaaattaattttcaaaattatttgataaggacttagggaagaaagatggtattaattccccctaacgttctcaactatcctattagggaaaagtattttccattttattagagatgataagaacatgaatagtaagacatttagatgtgaatttaactaggtatccagcattatagagaccctaggccctcttcccttagagcctgggtgcaaaagctagggaaaagaagtagttagctacttcttacaaagaactcttgcttccctcctagttacaggtgttagtgggatggggtgtttagctgggtagagatggcctgaagcaatctgttgtgccagagaaagttttggcttctataggttgaaccatacgaaattgccactttaaaagtcaaaaacagtccaatgttagcagtttcgtatgtttcaacgaatagttacagccttttatttagactgcataacctcgtgcaggatcatctgaggctcggcctcagttcggtcctccataaaaaaaggtaaccgcgtagcataatactcctgctccactgcgcccttcttgtttcgcagttgggcagtccatgaattacttggttaattgccccagttcttcactgaccttgaactaatggagtaggaatgacaggagacccagcctgccagtgaagcaaggaaggagatgtccagtgggatgttgcatggagctgggactccatgcccagatgaccctgattttataaaactggtaacagtgtgtacagatatgtttcaggggaaaagtctctttcctccagcgttacggagccctcaccagcatttgtttccacagccgatattatgtacacggggacagttgactgctggaggaagattgcaaaagacgaaggagccaaggccttcttcaaaggtgcctggtccaatgtgctgagaggcatgggcggtgcttttgtattggtgttgtatgatgagatcaaaaaatatgtctaatgtaattaaaacacaagttcacagatttacagtgaacttgatctacaagttcacagatccattgtgtggtttaatagactattcctaggggaagtaaaaagatctgggataaaaccagactgaaaggaatacctcagaagagatgcttcattgagtgttcattaaaccacacatgtattttgtatttattttacatttaaattcccacagcaaatagaaaataatttatcatacttgtacaattaactgaagaattgataataactgaatgtgaaacatcaataaagaccacttaatgcac

SEQ ID NO: 36267 - DNA, 11010 bp, Homo sapiens
cagaccccagttcgccgactaagcagaagaaagatcaaaaaccggaaaagaggagaagagcaaacaggcactttgaggaacaatcccctttaactccaagccgacagcggtctaggaattcaagttcagtgcctaccgaagacaaaggcgccccgagggagtggcggtgcgaccccagggcgtgggcccggccgcggagcccacactgcccggctgacccggtggtctcggaccatgtctcccgccccaagacccccccgttgtctcctgctccccctgctcacgctcggcaccgcgctcgcctccctcggctcggcccaaagcagcagcttcagccccgaagtaagtgagcttcccggcccttcccggagtcgcgcccgccgggaggcgagcccgggggtctcctaggggacagcctctattcggagaggagggcttttgggatctccgctgctcaggcctgcaggattccccctccctttctttttcctcttcgtctccaaacttccagatcgatccaacttttgcccgcttccaaccagctgcccccaccccctgcgccgccgactctccttcccattccttcttttttcccagtccttggaagaactttacaactggggcgaactcccccttccccgattcccttgggctctgctctcagctctggaaccgcctgataaacatttggactccgctcaaaccccgcgctgtcccggctcctcgtcatgcgcgagagtttgttgtttcttcgacttcccagctctccagcgctctcccgccggcgcgccctccgatgggcgcttcggcctccccgggtggcccaggccttcagcggacgagtctgcggccaggtgggggtcgagggtggacggccgagcgtccagggccacagcccccgtctccccgagaggaccccgctgtgtccctacccgcatccctggcgtcgagggtcgcagcgccggcgcgctggccgcgtttccgtacacacaaagctctccttgtgagccgggcgatcggccgggtcgctgcctccccctatccccacccgcgtcggcgccttcaggccctttttgttgttaatagtttttctgtgttaattgcagggagcctgggggcgtcgcttggggaatggggagagggtctggtccggggtgccctcacgtcggggctggctcgggcgccccccaccctcaccccggcccagacggtggcccaccgggccccagaggaagctgcgtgggagttgtctgaggaggtttttcctctctctctcttattttggggtgaaggtgggagacggatttaatgagcttcttattttgggccatctcaacccactcagcctggcaagggcctgggtgcggttgggaggggccaggaagggccctagaagggggatgggatatgggtttggcttctcctccttggtcccaccccggagaaaactctttggaaagaatactgtcttctctctgcgtccctgaaagggtctggggccgactggaaaagtatggccccaggaatcggggtggaagacgaaacgtggagtgctcagagaccagggagagtaaaaacctgccctggtgctggaggctgagcctgactgtccgggaggagtcgtcctcttcccaggcctagagtcctctgagacctgaaagggagcgcccctaacaaaacgagcctgagcatctggggagctgccgaccgccaacttcactgccttaccttttttccctcccctgctttgctgggtcccccaggggaggggcggctgccctggctccgttttaattgggtcatgggcggtcccagtgccagaaccaccatttgcttctgggcccaggaagggagggaggagcagccccagaggctaggatccagggcctactgcagagctggaggtccccccaccctcccctggacccctaagccaaggtgggaggtgttccgttgactttctcctaggggataccttgcatctctctcattcgcaaagacaaagccagccgactgggttctttgacccaacatagttgcttttttctccaggccaatgtggagggaaagctggggtggtgcaggcctcatgcagctgggtccctcctaccaggcctccagagtcctgcaccagctccaggacagccctctcctccccatggcctgtctggcgctgggcccttcctcccacccagccgcagacacaagagtcctctcttctgtggtttcgacctcatagtctctgtgaggagagaaacttgcctaggcctggggggaggagagggatgggggcacttcctttccaggccttgcggctctcttgactccagggaagtccttcatttgactgagccttcatttttctcccgagggtatggggtggaggttgtaggtgtgaatatttagacccccctagcttcttgaacgactccagaggggatttcccccagagctcctggatgtggattctccccatctcttctgtcccgtcttccttctgtcgttctgtcttctccccatcttccttctgtcgttctgctctaggcaaattctctcagctttgctctctgagggttgacggggcctggcctcagtcctcctgccttccagcgtcagtagaccagtcccatccttccccaagtcctgaagcagctgctcctcaaccaagggtcataagcccggggtgtgtttatcctgcaggtatgctaggggcaaaagacatttcctgcatagttaggcacaggccacagcaggcctccccaggcactggctgtggcatcagccagaacaggtcagggcaagcctgcagctccctgagagcagccccggactggtgtggactgcttggctccctctggtataccaaaggttaaatgtcactccttcctctacccctgaggaggggctctcagagcctcagagctaggtggtgctagggttgttctagccaagactgttggctgggaaaaggctgggttgtttacatctcgggttctagctcgcatcagccttggggggggatcacttcccagaaccatgttgcaattcttgcccctgtgggctcaggtccccagtcagctgctcttgagtcacccccagtccccatgcaagactactgccccatcaccaggacctgagcccagaggtgaaggaccatgtggcaatccaatcctgatgaccttggctaggagatacagcacccaacagcagcctcccccatctcccctccaagatcccatcctgggcaacctacagccgcttcctgaactccctaagaaagcaaagctggagcagggactagagctatctgggtggtgtcttctccccataaaagaatccaagcatcttcatatttcatatataacttggcttgttttacttttttttttttttttttttttttgagacagagtctcgctctgtcacccaggctgagtgcagtggcgggatcttggctaactgcaaccttggcctcccaggttcagcaattctcctaccacagcttcctgagtagctgggattacaggtgcccaccaccacgtgcagctaatttttgtatttttagtagagacagggtttcaccctgttggctaggctggtctcgaactcctgacctcaggtgatctgcccgccttggcctcccaaactgtcgggattacaggcgtcagccaccacgcccagcctggcttgttttactttgaggctttaagaaaatactccattgttcttacaataaaggctgactttctcctcaacagggctttgcagtgtgtgtaccttttaatcaaacaccaaaaacctaacattaatttaatttaaggcaatatgccagcctttatattatgaccaattcacaacatacctgaaataaaatacagtcaccaagtctcctcctccacccctatgtcccacttcctctgttgagaatcttttttttttttttgagacggagtcttgctttgtctcccaggctggagtgcagtggcgcaatctcagctcgctgcaagctccgcctcctgcgttcacaccattcttctgcctcagcctcctgagtagctgggactacaagcgcccgccaccgtgcccggctaatattttttgtatttttagtagagacagggtttcaccgtgttagccaggatggtctcgatctcctgacctcgtgatcagcctgcctcggcctcccaaagtgctgggattacaggtgtgagccaccgcgcccggccactgctgagaatcttaaataggcctttaggttccaagccataggtcagatgctgcttggataaggacagcggcaggatcctggcttcagctggatcacacctcttaccacattccaagttcctagtttcccctcgtagcagccagccttagctctagctcttttttctgccctcctttctaaaaagatctcagctgtgagggtcctggggacatggcactcccatcccaggagggcctcaggtcaagcccaatagtagagctcactcagcctgtcaacacccctccccacacatcatgggcatagcccagtcccaggtggaacatgctatatttgtaagaacactgacatgggggagaaaagtgctagaaggaatcacagctctgagaagacatctcagaaccccattaaaccaccagggctctctctcattttcaagagagctacagccaaaagcctgtttgggcccatagccccgaggggacaagctatagccccgaggggcctgggccagagatcaggtctagcctgggagttcctccagacctgctgccggagccaagctgggaacccactgccctttccttgccaagccaaggctgtatgctgggcattgtcggggaggtagaggcaccctatgggccaggtggggacactctaagccatacccctttccctacaggcctggctacagcaatatggctacctgcctcccggggacctacgtacccacacacagcgctcaccccagtcactctcagcggccatcgctgccatgcagaagttttacggcttgcaagtaacaggcaaagctgatgcagacaccatgaagtaagtgctagaccctggcaggagttctgcctagcatccactgacaatgccagcgccagagatgttcctacctgaatgcctggcttgtgcaccccactcccccatatctcatccccacgtgctgatcctgaccctctcatattcaccctgacctcataaccttggcctttccccacattgacacacagcaagtcttacccaacactgatcgtggagacctttctctttcatacactgcactgatcccaatcctcgcacccaaacccactccagggccatgaggcgcccccgatgtggtgttccagacaagtttggggctgagatcaaggccaatgttcgaaggaagcgctacgccatccagggtctcaaatggcaacataatgaaatcactttctggtgagtccaacaggcaagcaacctttctcacatctggttattatttcctacccattgtgcttatgcagggactcagagaccccctgccccactcccctcagttcctgggaagcatccgtgggagtggggaggaaaatggctctcatccttgagagaggtgtagccatcaagggtgcaccccagtgccagagagccagagcctgaggatcccttgttcttgagacagaggcgttgcgcatgaggtagcaggaagagctgggtcaggcagaggtggctgggccgcgcagtcagacctgggagagtgcagggaaggagaatgttgcccctctttatcctaacacaccccatcctctccccacgtggctggacctcagcatccagaattacacccccaaggtgggcgagtatgccacatacgaggccattcgcaaggcgttccgcgtgtgggagagtgccacaccactgcgcttccgcgaggtgccctatgcctacatccgtgagggccatgagaagcaggccgacatcatgatcttctttgccgagggcttccatggcgacagcacgcccttcgatggtgagggcggcttcctggcccatgcctacttcccaggccccaacattggaggagacacccactttgactctgccgagccttggactgtcaggaatgaggatctgaatggtgagccaagtatccctgggacttactctggaaaaagccaacagtcatttgtaggggtggttcccctccctccttccaaaatctccgggctagaagggaccacagagaccttctgatctaacttctgacaaaagcaggagtcctgtttgagctatttacatctggtcccccctctcacccactgactggctttccagtcaaagacttcaaagcatccttattgcccacttttccagaccgatgtcatgtctcgctcccgggagaaactggggactagagagagccttggcttcccttaccacaggtcttcccgggatcggggtcctgcttccaagcactctctcacctccacccagaggagcttgctgactggctttgtgcttaaataccagataaaaagctagacctcagaatttggccactttggattgaaaacatgggcagcaggcttggaggtgaaaccaaagctgctggtggggaagcagggaggctgagggaagggactcaggctgctatcgtcactgtccccatccttccaggaaatgacatcttcctggtggctgtgcacgagctgggccatgccctggggctcgagcattccagtgacccctcggccatcatggcacccttttaccagtggatggacacggagaattttgtgctgcccgatgatgaccgccggggcatccagcaactttatggcgagtagtctacacccacgcctgctccctcctctgctgcttgttccctcctggtctacgcatttcccctcttttatgccttgcagtctccgcaccgccccctgccaacctgcccctgcctctatcagctccacttttgagcccatcttttgtgtcgcctcccagttggttgcttcagcctcccctagaagcccatccacacctttccaagggtattgtctgcccatctgtctgtccttccgtccccgcctcctcctaagtctgaaatgcccctcgtgttttctgccccagggggtgagtcagggttccccaccaagatgccccctcaacccaggactacctcccggccttctgttcctgataaacccaaaaaccccacctatgggcccaacatctgtgacgggaactttgacaccgtggccatgctccgaggggagatgtttgtcttcaaggtgagaagaagtgggctggtttgaaagacaaaagggccctatgggctgggcatggtggctcatgcctgtaatcctagcactttgagaggccaaggcaggtggatcacctgaggtctggagttcgagagcaggctggccaacatagtgaaaccccgtctctactaaaaatacaaaaaattagccaagtgtggtggtgggcgcctatgatcccagctacctgggaggctgaggcaggagaatcacgtgaacctgggaggtggaggttgcagtgagccgagatagggccattgcactccagcctggacaacagtgtgagactccatctcaaaaaaaaaaaaggcgggggggtactctgtggtagggcggctgggtggaagtgacaacagctggactaaaaactaaaactgaggaacaaacagcagtgcgggagctttggggactgaaccagagacctaggccgcaagacataatggacttttcctgcattgaccggcttccaggagcgctggttctggcgggtgaggaataaccaagtgatggatggatacccaatgcccattggccagttctggcggggcctgcctgcgtccatcaacactgcctacgagaggaaggatggcaaattcgtcttcttcaaaggtaaccaggcactccactttagtctttgggagtgaggcgggtctccctagaggagctgatttcctctaaagtccctagagcctaagttgaacccagacgttgccctcctgtcctccccaggagacaagcattgggtgtttgatgaggcgtccctggaacctggctaccccaagcacattaaggagctgggccgagggctgcctaccgacaagattgatgctgctctcttctggatgcccaatggaaagacctacttcttccgtggaaacaagtaagacctcaaccccttaaccccaggcctccctcagaaaccaccaccaccccaaattccctcagttctggagaaagacccactttacccccaacatgcttccctggagaaggagctggctgagcctctgctgttgcctagaaatgggcagcctcctttgggcaccgtgtgagtgggatgtgaccgggtcattccagacctggtcatttggcgcctcctgcccccagcactgcgcctccaccccagcagccaggcactgtcattagggctactggtggctccttgcagcctgggccctcccttccacccccaccttccgccgctttcagcagcaggtcctcattactcaaaacccctgtccccaccctgtccacagctatcctttgcccactggtggattcggtccgggtcttgcgcctcctgaggacatgcccagtgtccgccactgcccttcctttccccttccccaggtactaccgtttcaacgaagagctcagggcagtggatagcgagtaccccaagaacatcaaagtctgggaagggatccctgagtctcccagagggtcattcatgggcagcgatgaaggtgagaggggcaagggaaggtgtcgctgagagaaggatgggaatagggagttgaggaagagcgggagggaagcctgagggagtgctgtgtggaaaacaacggcgatgataataccacataccaggcgctgggctaggtgcttccacacgtggtgcccattcatccccaccaccttccaacctggtactataagcacccccattttacagctgaggaagctgatgctcacgaaggtggagggaagctcagctgccctcacattaacagagcttccctcgctcctctcctctcctctctttgggtcttcccttccttaccaccttctgattcactccctgcagtcttcacttacttctacaaggggaacaaatactggaaattcaacaaccagaagctgaaggtagaaccgggctaccccaagtcagccctgagggactggatgggctgcccatcgggaggccggccggatgaggggactgaggaggagacggaggtgatcatcattgaggtggacgaggagggcggcggggcggtgagcgcggctgccgtggtgctgcccgtgctgctgctgctcctggtgctggcggtgggccttgcagtcttcttcttcagacgccatgggacccccaggcgactgctctactgccagcgttccctgctggacaaggtctgacgcccaccgccggcccgcccactcctaccacaaggactttgcctctgaaggccagtggcagcaggtggtggtgggtgggctgttcccatcgtcccgagccccctccccgcagcctccttgcttctctctgtcccctggctggcctccttcaccctgaccgcctccctccctcctgccccggcattgcatcttccctagataggtcccctgagggctgagtgggagggcggccctttccagcctctgcccctcaggggaaccctgtagctttgtgtctgtccagccccatctgaatgtgttgggggctctgcacttgaaggcaggaccctcagacctcgctggtaaaggtcaaatggggtcatctgctccttttccatcccctgacataccttaacctctgaactctgacctcaggaggctctgggcactccagccctgaaagccccaggtgtacccaattggcagcctctcactactctttctggctaaaaggaatctaatcttgttgagggtagagaccctgagacagtgtgagggggtggggactgccaagccaccctaagaccttgggaggaaaactcagagagggtcttcgttgctcagtcagtcaagttcctcggagatctgcctctgcctcacctaccccagggaacttccaaggaaggagcctgagccactggggactaagtgggcagaagaaacccttggcagccctgtgcctctcgaatgttagccttggatggggctttcacagttagaagagctgaaaccaggggtgcagctgtcaggtagggtggggccggtgggagaggcccgggtcagagccctgggggtgagcctgaaggccacagagaaagaaccttgcccaaactcaggcagctggggctgaggcccaaaggcagaacagccagagggggcaggaggggaccaaaaaggaaaatgaggacgtgcagcagcattggaaggctggggccgggcaggccaggccaagccaagcagggggccacagggtgggctgtggagctctcaggaagggccctgaggaaggcacacttgctcctgttggtccctgtccttgctgcccaggcagcgtggaggggaagggtagggcagccagagaaaggagcagagaaggcacacaaacgaggaatgaggggcttcacgagaggccacagggcctggctggccacgctgtcccggcctgctcaccatctcagtgaggggcaggagctggggctcgcttaggctgggtccacgcttccctggtgccagcacccctcaagcctgtctcaccagtggcctgccctctcgctcccccacccagcccacccattgaagtctccttgggccaccaaaggtggtggccatggtaccggggacttgggagagtgagacccagtggagggagcaagaggagagggatgtcgggggggtggggcacggggtaggggaaatggggtgaacggtgctggcagttcggctagatttctgtcttgtttgtttttttgttttgtttaatgtatatttttattataattattatatatgaattcc

SEQ ID NO: 36268 - DNA, 15665 bp, Homo sapiens
gtttgcgtgtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggtagcgcgccggactctcccgctctgcgggctgtgcttccgcatctgccccgcgcctctgccctgccggcgtcgcctgggggcgcgagctgttccccgaggaggggccgcggctccgtcgttcaggcgattcctcccctcgctgcggtcgagcgctctcggggactgtgccggcgtttcacgcctttttctgcggggagctcttgtagtttttcatattttaaagggtttatgatccccctcctctcaaatgaattaattatttctgttgataaggcgtttttcccaaacttatagttcagtgaacaaaatgcacttgcaggttttattgagagcgcggatccttaatttaaaaggacgtctttttttggtacctgagttattcgttgtatgcataaagcaggactttcatgttcatagcatgagaaatcctgcttttctgtgggtgtgtttttttatcccaccacgctttttgtgagtcatgtggtttacagcttacagtgattgaggtgcagtaaacatcaggagaaaatagaaatatgctttgttagaattagttctctgaatttctaatattagtacactgagtggtcttggcatttacttgctgacaataaaagttgtaggacactattttataaccagatttcattctttttctgtggttcctcatagcaattttaggatgacttttattgaggttttgcagctgtagcaatagggcaaagggcacaaatactagggtgttaataaaatatttgccatattaattttccataagtaatttgagaggttattccttttaatgaagagtaaaagtaacattgaagctatcttttctttcacagatgctaaaaagtaggcctgggttaaaataactcctttgagtaaagagtaacagatgtaaggacatattttatattcaggaaaggaaagactatctggcctgccatttattaatttttgctatttcttatttagtaggagaggcatgaagttaggaactgttgttatattttagttattacaagactcccttggagtgcttactagaatgcatctgtgattctgattctatgggtatggggtgaagtccagcaatggctttttaaagaagcccctcagggaattctgatgcgacttgaccttgaaccaccttccatgggggtcagggatggaggtggagtagctttagtaccagccatctcgcagcctcttcctcctggacactgaggacttgaggagggacctagggaattcgggagagcagcagttctctcacacgctgggggttctgccagccggggattagagatgatgagagaggcagtgccacacatcagtttgtcattgcttgagctgtagtggacaagggcagatactggaaatccagcgaagaattgactaagagcagtttcccaataagtaaatcactgctgtattgactttgagttatgaattctagaatctttcactgttctacattgcaggtggtggcataaacatcgggtggtgttcagatcctgctgccggcagctcgaggctaggatggctggagatgtgagggcctttgtctcatcacatccgagcacagctcagcaagatgctcttagctagaaaacagattttatgtgttaatgtaagtgtttagggtctttgccagatttgctcttttccaactcctttatgtccaatttctttgttattacagaatgaatcactgtatcactagtggacacacatagtggacacacacttaaggacagttgaaatgggctcactttggggtattttttttggtcttttaaaatagtctgatttttgtttttgtccaaaaatttggatagctttattaataaacttttaatgcgaatattataatatagttattaaaagggcaaacctaggccaggcgcggtagttcatgtctgtaatcccagcactttgggaggccagcgtaggcgatcacttgagcccagggattcgagaccagcctggacaatatggtgaaaccccttctctactaaaagtacaaatgccgggcgtggtggcacgtgcctgtagtcccagctacttgggaggctgaggtgggagaatcacctgagcccgggaagtcaagactgcagtgagccatgattacaccactgaactccagcctgggcaacaggagtgagactctgtctccaaaaaaaaaaaaagtgcacacctgaaatgcattaaaagaatattcatgttttattttcttcttagtctatgggcaaatatgacttcctaattctggaagcccttttttggagaagctcaacagaaatttttgaaatataaggttttagtataaagaacaatataactatttaaaaatttccctgtgcagaaatggcagataatggggactcttccttaccttgttccgagttctgtctggatattccagctgttttaaagtgagtaacagttgcaaatgttcaggctggacttgatatgatttttcctagatgtgttgtattgatttgctgcttccacagggcccacttgacttcatgctggattagagttgagctgtaaacttcaggaataaagtcagtttggaaacagagctatgcttaaaagatttcacagatgcctagagtttgctaataaatgtggggcaattcatttgataaagtgataataataaataaagttttcatctgggcactgtgtctcacgcctgtggtcccagcattttgggaggccgaggtgggtggttcccttgagcccaggagttcgagaacagcccgggcaacatggtgaaaccttgtctgtacaaaaaatgcaaacattagctaggcgttgtggcatgtgcctgtggtcccaactacttggtaggccgaggtgggaggatatgagtccaggagttcaaggctgtgacaagccgtgatcgcgccactgcatgccagcctgggtgacagagcgagaccctgtctcaaaaaaaaaaagttttctatttagcagctgattttatgcagttttgaagcgagacaatttcatgtacgagctgtctttccattttgtaggaacactgtcacaggagacaatttcatggacctttgagctgtctttccattttgtaggaacaccatcacaggagacaatttcatgtacctttgagctatctttccattttgtaggaacaccgtcacaggagacaatttcatggacctttgagctgtctttccattttgtgggaacgccgtcacaggagacaatttcatgtgcctttgagctgtctttctattttgtaggaacgctctcagaggggacaatttcatgtgcctttgagctgtctttccattttgtaggaacactcacagcagtgcttggggttcactgttacctaaatcccatgatgggtgagaagactgaatgggacgtttattttttgtgttaaaaagcccacgcaaatagagtttaaaatagtctcagtgagctgggcattgtagcatgtgcctgtaaccccactactcaggaggctaagacagagtatgagctcaggaggtcaaggctgcagtaagctatcatcgtgccgttgcactccaccctgggtgatagagcgagaccccatctctaaaaacaaaacaaaaaaattcctcagtaatattattgactcatgatagtacattttttttgtttgtttgagacaagagtcttcttgtgttgtccaggctagagtgcagtggcacgatcttggctcactgcaacctcagcctcctgagtagctgggactacaggcctgcaccaccaccacaccctgctaatttttgtatttttggtagagatgtggttttgccatattggccggctggtctcaaactcctgtcctcaagtgagccagtcacctcagcctcccaaaattctgggattacaagtgtgagccaccatgcctggcccatgatagtacattctaataaattgtgtgtaaggcagatatatatttatggaacttcataggagccatattaaggggtgtatcttaagtatcacattaaggatcacagaacgcctactgaaccagtgagagtcaacactcagctagatgaggaatcttgtagaaacaaacagaatggatatttttggtgtttcctctggatttttgtctctggaaaaaaaacagccttgtagctagccacaaggtatgaggggtgatgttgagccgtggttgagggtgcagactctagccacaaggtatgaggggtggtgttgagtggcggttgagggtgcagactctagccacaaggtatgaggagtggtgttgagcggcggttgagggtgcagactctagctaggctcttggcacttcataactgcatgagcgttacgaacttggccccgtgggtcatcttacctgtaaaaagggcatacttgtgcctcactcatagggttgtggtgggattaataaaggtttctagagcactcctgtcacatgggcagtaatgccactgttattactgtgattacttctctcacattactaagtttgcaagttattgtgagagctgattaaggcaaacattaattttagaaagtcaagtttttcagttttttttatggctttgacatgaattacctaaaaatgtaaaaataaacacttcaaaaatttgttgtgctaatcaactgcccagaacactttttccggaattttaggtgttttcttagctggttgagggactccatacaaaagtgtagaacagtggttggtatcatgtgccagtttggtcatgtgttttgcagagttatgtcattgtaacttggcaggtggacttagaggcatgcggaagaactgctgagcactttaattgctgacttgcctaaagaaaaagcatgcttatgaggtgtataggcaacagagttggaaaagatacttacaattcaaggcaatcaaagaatttaaaaacaatttgaggccagcgccgtggcttaaacctgtaattccagcagtttgggaagccgaggcaggcgaatcatctgaggtcaagagttcgagaccagcttggccaacatgttgaaaccccatctctactaaaaatacaaaacttagccagatgtggtggtgggcgcttgtaatcccagctactcgggaggctgaggtgggaggatctcttgaggctgggaaacagaggttgcagtgagccgagatcacgccactctgctccagcctgggtgacaaagtgagatcccatctaaaaaagaaaagaaaaagctgcctttgttgaggaagtcacaggatgacttggcagagcagtgtggctgcactcacccagctcctcctccaagcgcttggttaccgtggaaatgtcgccaccagcagatgctgctggatgtttgctgatgtttgccctcagctcatgctcctccagtcaccccacagatgccatttcaccaagaaaatggggtggtgggaggctggggagctcccctctgcctgcctctttcagcctctcctatctgaactcccaagtcccacagtaacttccctctctctccatagccacggcttttgaaagttgtccacactgaagtcctctgttcctcagtccttcagcccctgcagtgtccccgttcccatatcgtcctttctggtaacctctctggggcactcggcacagctccccggagtctcctgccttggtttctgagactgcctccttggcatccctttcctgcccccaactctacagtgggcttctgcactcactcccaagcctggcacctgccaccctggctgggatcactgctggatgtaggtggcggcagtaaggtagctctctccagcccagactccattgtacagctccaggccagtcgctacctggagggcctttttctctggatgtcccttagttttctcaaactcagtatatacaaaactgaactcttcaattcctgctttcttagaaataaatacatggcccagaatcccaagtggaaaaggtcctctgtgggccagtccacctgcgcatcggtccccactgtcctgcacttctgcttccttgccctggtgctggatctgagacctggctgctggtcttgtgtctttctctttacacatggaattctctaaggacagatatttccctgccaccccgtgaccacactgccgccccgtctcctgtgggttaggctgattctgtcatccagagttcaggctttggagccagacagagtgcatctcagctctgccccttccccgtgcggctgggcatcactcacgtgacctttctgagcctgaattccatcacctaaaacatcggcgacatctatttagaggtgttgaaagaattagaatccatgagtgaaaagtgcctcatacatggtggattctcaagtgttcatgaaactggtctgtggtgaaatcagaggatgttcacgttctcgtggcacgtgagctttatgtggtagtttgcctctgttagaattctccgggttagatgcagtgggccggagcttgaaggcaaaaggagagtcacatttgtatctttaaagttacagttactcagttgccctctgattattgttgttgttgttagtttgagaaggagtctcgctttgtccttcaggctggagtgcagtggcacggtctcagctcactgcaatctccacatcctgggttcaggtgattctcctgcctcagcctcccaagtagctgggattacaggcgtgcaccgccacacccagctaatttttgtgtttttagtagagacagggttgcaccacgttggccaggttggtctcgaactcctgacctcaagtgatccgcccgcctcagcctcccaaagtgctgggattacaggcgtgagccacctcacctggccctgcactctgtttattaaatgcctacaaattattaaaaaccacagatgcttataatatttactattttttacgtgcaagaaaagggatggtaaaaatttgttgtgacctttcttttttcttaagtacacaatttacaaccctgtccaaatgatatttcaagtaatttattatttgcatggtgattccgtaagttaatatgatgttactggtatttattgtatctgtccctgagcaaggcattgaagggagaataatgaaatattattttgactttcctaatgcctgtgaccatttattttgttggtgtatttattttagcttctgtagggaagtattttgtgtttaagtcaaatcaaaagacagtttattagtttaccatgaaaataaagctggattctggcaacctgaccaacacattctcactgtggacgctgcgggaaactagagtttcagaaatgggcgttgtcagagtgaccggactcagaggggcccatgtctaatgcaaacatcactttggggttttgaaagcacatggacggggagtcgcatgcccctgcagtgggccgtgtgctcactttggggttttgaaagcacatggatggcgagttgcatgctcctgcagtgggccgtgtgctcaccttggggttttgaaagcacatggatggcgaggcgcacgctcctgcagtgggccctgtgctggagttctgatacggtttttttcaccaaagctgaagggcagtggagtctttgtgaagtgtgggctttccccctccccctctccccaccctgctccatggtttacatttccatcttaatttttaaaaaatatttcccaaagtagagaatatagtgaacccgtctgttcctattgttccacttcaacaattgctggtattttgctggtcttgtgttacctaacccctcatttttttaggctgtgtgtttcatggaaatcccagatataattatttcacctgtaagttacagtcaggttgtaaagatttagttttatatgaagaaatgttgtgcatatcccattgatttcccgtgactgctgtgagaggatgctgcaagctgaggggcttaaaacaacagaaacttctctcacaattctggataccagaagtccagaatcgaggtgttttccaggctgggctctctctgaaacctgccaaggagagtcctcatgcttctcccagcttctggtgctgccagcagcctcttggagctcctaggcttgtagacgcctctgcagtcctcgatgcccccagagcctcctgtccctgtgtctttatgtggccattttcctctaaggacaccagtcacaccagattaggggcccacctactccagtatgacctcatcttaccttaactgattacgcctgcagtaccgtttccaaataagctgcgctgtcactttgggggtttaggacttcaactgttttggggacacagtttaactcataacacatgtaagtggctacaagcttctaaagggcattgagttagtatttataaagagcctttaaaatgtcatatcctttgttccagaattttaggaatttgtctttaggaaataatgaagtatgtatacaaatttaagggggaaaatgttcacagatgaataatattaatgaacaatcagagagtaacagaagaatggtgtaggaggctcttctcgcattgctataaagaaatacatgagaccgggtaacttatgagaaaagaagtttaattggctcacagttctgcaggctgtacaggaagtgtggtactggcatttgcttctggggaggcctcaggaccttccaatcatggcagaaggcaaaggggaacaggcacgtcgcacggtgaaagctggggcggagtgtcacacacttggaacaacctcagctcactaccccgaggacagcaccaagaggatgacgctcaaccattgatgagaaattcatcccatgatccagtcgcctcccaccaggcctcacctgcaacgctgggagttacgtttcaacctgagatttgggcagggacaaatatccaaactatatcaaatggtaaagtaatggcatagccatttgatgaatcacgcagccatagaagtttgccatttttggaaagtaggtaatgtatgtaaaagaatgctcttaattggccggcgctgtggctcacgcctgtaatcccagcactttgggaggccgaggtgggtggatcacctgaggtcaggagttcgagatcagcctggccaatatggtgaaacctcgtctctactaaaaatacaaaaattagccagacgtggtggcacacacctgtaatcccagctacacgagagtttgaggctggagaatagcttgaacctgggaggtggaggttgcagtgagccaagatcatgcaactgcactccagaccaggcgacagatcgagactccgtctcaaaaaaaagaaaaaaaaaagaatgctcaaaattaaagcagcatacaaaatattgtagtacgatcacaatatgaccatattttgctatgtctgaacagaaataatatgaacaaattaaaaaatatatatctataagaaaggggaaagaatatagtaaaaatattgccaggcgtggtggctcatgcctgtaatcgcagcactttgggaggccaaggcaggcgtatcacttgagtccaggagttcaagactagcctgggcaacatggcaaaaccctgtctctacaaaaaatacaaaaattagccaggtgtgatggtacgtgcctgtagtcccggctgcttgggaggcggagatgggaggatcgcttgagcccaggaggcagaggttgcagtgagccaagatcttgccactgcactccagcctgggcagcagaaccagatcctgtctctggaaaaaagatagcagcagtcacccctaggtgttgggattggaggtgatcttattttctttttatttttctgacttttctaaatctctgataaacttgcaattaaagaaaaaataacagaaaatgtgttatatgcagtattattggaggtactattaatatttgcaagtgttcagacctaattgcggggaaatgatggcaggattctacaggtatattttagagcagttgtgagatgcatgtaactatttgtaaaggttcatacagatgattactagatcagcataaataatatgtctgtggacgttttctgcaggactttgataacttgttacctgagtgaaatttaattcctgggcgattctgggagatggtaaagtgaggcggaaggagccagcggccaattcctgaactattctgggaaacggtggcgtgaggcggaaggagccggtggccaaggtcccagtagtgtcacatgatcttcccgcgtgtttgctgcactgggaaaaaatgttgaagaattagtttgaaaattgccccgttggccaggagtgatggctcactcctataatcccagcactttgggaggctgaggtgggaggatagcttgagcctgggaggtcgaggctgcagtgagctgattgcaccattgcactctaggatgacagagtgagaccctgtctcaaaaaaacaaaacaaaaattgccctgatccacacaaattcttggttttgtttttataaatgtgcttctataaaatgaaagccaaagtgttctgttatttcagtttttttttttaatctccttttaggttaaaaattttgcagttatttatcttgtggatattacagaagtgcctgacttcaacaaaatgtatgagttatacgatccatgtactgtcatgtttttcttcaggtacgttatcttaaagttgttactgaaattgaatattgtcagtttggaagcttaatgtaatcaagatctctttagattattttattttgaaggaagttggttgtacagtcatgtcccaaaatcgtttgtatcaccaggcaatcagtgtgaatctttgaaataattttcaaagtaacaattctagttttagcatttactcagtaacaaattacccttttgaaataactttgcggggaaacctaggtgaagtgtaattcaatgaaagatgttgttactgacattttagatacctggaactataatctgttcatcaaaaatgttgtaaaatcacaaatttaggccgggcacagtggctcaaagcgcctgtaatcccagcactttgggaggccgaggtgggtggatcacaaggtcaggagttcgagaccagctgggctaagatggtgaaaccgagtctctactaaaaatacaaaattagccgggcgtggtggtgcatacctgtaatcccagctactgggaggctgaggcaggagaatcacttgtacccaggaggtggaggttgcagttagccgagatcatgccattgcactccagcctaggcaacaagagcaaaactccgtctcaaaaaaaaaaatcaaaaacctaatttattaaatatgttatcatcaacttcggtgtccttttttatatccaagaggaacacctgaactactttgcttataaatacaagattattttatcagctcaaaaatttcattatggaaatttaatggggaaagaaatcaccatctgatgctgtttttacttgtttagttaccatagaggttggtgaattagctacatgagcattagaccattctccaaaagtggagcctcctactcggtaaggaaggtcaggtgggttgtatagggtatgcgttagttttgtattctttgtaacaaattagcacgcattgagcagcttaaatcaccccgcttttctgagctcacagttctgtaagtcagacatccaggcagggcccgctggattcctgctcagggtctcacaaggtctgaaccatgggctgggtgcttatctggagtgtttgaggggcttgtttgggttgtgggccgagtctggctcttcgtggtggtgggtctgagatctgcttccttgctgctgttacctgaggccactctgctgccagagacccagttaccctcaaagccagcactggcatgccggcacattgagaacttttcacacaggttctctgacctgaaaagttctgcctgagaaaatgctctggttttagaggactgtgataagattagacttgcccaaataatccaggatagtgaccttgttttatttatttattgagatggagtctcactctcacccagggtggagtgcagtggcaccatcacagcaagcttgaactcctggcttcgagccatcctcccgcctcaggctgccaaagcgtgaggcactgccgtggttctgggcgtcgggatacgctcccctggacacgcccttggcttcctaggtgcctcctgttaggttgagaagatctgtgaggtgcaccctgcatttcttgtgaacttttcatctttcctaggtttcagcaaaggttgcgtggctgaccctcatccttttctctactgtgtgttcagcagccatttctgaatttcagcccctttggccatccggagaggctaaagaatttattccttttgttaacagttcttacactaatttgcctctttcctctcttgaaggcagcacctccgagactttgcttggaagtttccgcagctaaatatcccgagtgtgttgcttttgagctctgacttcctataactgcggaccccgtgtccctgttcctcggccactctgtaacgggggtccccttttctccgtttcccagtaacacactcctcacttccttccaagcccacaccaggtgttcctgaagtccatatttctgttaacagcctgttcgaggcaatagaggccttttctattttgcccctcagaattcttcaggtgagaacagggagggccgtcttaggtctctgccccccacagcgtgcagtggaggccagcctggggctggagatgctgtgaggggcaaggaggctgcaggcaacagccttgggtggcgggagcagcctacttagtgtagtttgatatttttaggactgatgctgtactcagaaaaggagatgaaacttccttctgctgtttctgtgatttagaattttaagacaaacggtactttagttaacttatgcaccaaacatatatcttgagcccccaccaggtttgtggtctagtggtggagcctaatgtcagataagacaggattcccactctcataggacgttgtctgatagaaacagctgagtaaattagcagggggttctgaagaagtgaaaggaggcagatgtttatgagatataaataccgaagaagtacacccaggtcagatagggctgcagggagggtgctacgggcagcccccagtcattgtagaaggagcttggtgcatgctgcatgtagggcctgcctgcagcatggagaatgagagggcggccagaggtgggctccagaccctgatcagatttgcctctcctgaaccagagacttcacggggaatactttctacggaatagtaggtggaagccaaatgcatgatcttgtggaagtgaacgttaaaaaacagtctttaggtggggtatgcctgcagcccagccactctgcaggccggggtgggactggagctaggggtttgagtccggccttagcaacatagctcgcatctctaagaaaaataatcaggccggcacagtggctcacgtttgtaatcccagcactttgggaggccgaggtgggaggatcacttgaggccatgagtttgagaccagcctggccaacatggggacaccccatctttacaaaaaactagaaatttatctgggtgtggtggctcgtgcctgtggtcccagttacttagagggctgaggtgggaggatcatttgggccaggaggttgattttgccactatgccctagcctagatgacagtgagaccccatctcaaaaagaaacttcaacaaaccaggataaatttatgccagtacaacaaagggttaatatccttatcttgtaaagtgcacatgagtattcatgaggaaaagaactagtctcttgaaagataagtaaagaattatctacttccctaaccataaacatgcaaaatgtcatcttcatttcatagttgaagggcttttaatacaatttatgtcattgctcataagagcactgtgaaaaacttacacattgcttttatcaggtaaattagtacaaattagatgggggtctcattttgttatccatgttgatctcggactccgggcctcaagtgatcctcctgcctcagcctcccatagagttgggattacaggcatgagccactgcgcctgccctcctttgaccttttaatttccccttagaataactgtcctaaataaatacagaaaaatgcaggaaagagcatggtggacaatgcattgcatctttaaaaacacatttagctgcttcctgtattctcctgcatcatggcatacactctcgattttatgcgttcttcagtgatgttaacaagagcttgtcacagtgggaaaaatacggcattgttttcaaggaattcttttttaaagagacttctatgagaatggatgcccttgtttctcgttgcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtgagcctgtgcgttttgcatactgggttggtttgctggggctgcggtgacagcatatgccgcgagctgggctttaacagagatgtgtgctctcacagctttgcaggcgggggtctgagatcagggtgtcgcgggtggggggtcactgctgaggccgtgaggggaatctgctcaggcctgtccctggcttctgggggctgctggtggtattttcagttccttggtgtgtggatacttcgccccatctctgccttcacctgtgtcctccctgtgtgggtgctggtgtccaaaatttccccttttcgtagtgacaccagctgtgttggattggggcccaccctgctccagcatggcctaatcttaactaattacatttgcaaggatcttatgtccacaaaagtcacagtctgaggtgctgggggttaggacttcaatatataaattttgcggttacacaattcaatccatgacagaatccaaaggtttactctggttataaaaacagtacaataaaatattgtttatagccttccctgtaagga

SEQ ID NO: 36269 - DNA, 23200 bp, Homo sapiens
cgggctccggggatgaggtcgcggccggcgggtcccgcgctgttgctgctgctgctcttcctcggagcggccgagtcggtgcgtcgggcccagcctccgcgccgctacaccccagactggccgagcctggattctcggccgctgccggcctggttcgacgaagccaagttcggggtgttcatccactggggcgtgttctcggtgcccgcctggggcagcgagtggttctggtggcactggcagggcgaggggcggccgcagtaccagcgcttcatgcgcgacaactacccgcccggcttcagctacgccgacttcggaccgcagttcactgcgcgcttcttccacccggaggagtgggccgacctcttccaggccgcgggcgccaagtgagtgtggtcccggggagcggcgccccttcccggctcgggcggcaaacaggaggtggggctgggcggccagctggggcgcgcagctgccggtcgcccccatgaccccggggcccgcgtgtggcctcctgcggccacaggagtgagcctggcacacctgatgaggaggaggaggtgcgtttgactggggactgataaatgaaggttcagggagatggcaggctgggaagccctgggtatctgcacctgtgcaccgagagggctgagttaggccatacctgatgtccctttcagattgacagcactatcaggactccagggtttcaaatcagtggtgtggagcctggttctaattcaactgtgaacctggacatgtcacttcagcctccctgcagcctcttctatggttgtagaaaggggttatataaggatacaaccctttgagccctaatgtctctaagagggaaagagaggggagttctggtgtgcagtgtatttgggcaacagtacagatagtcattcgtttgctcctctcaatcccttttacgtaggaagtgtccaggaagggtctgactctctctgagaactgttggaacttgggggtggctggttcagagaacagagtagagagcgctggggtggggataaggggagaccacgacccatgaagttgtcaaggcaggggcttgtcctgaaggagtgagccttgagagccctgtattgacagatgttaagtcagggagtggttactatcagcttctagaaagattcattcggctgctgggagagaagtgggttggagaagagtaaaaatggaggcggggaggtttccccagcccctggcttagagcagtcttccatccttaccttggttcctcagccatcttccgggttttcgtttctcttgaactttgaattcacttgtactaaagagaagttacaactggcatttagtgtttgccattaaatgtatgggagtataagacttgattaagcagaggaagtgtttgtctcctaggggccttagggatccataacttacaagtgagaaaaattaaaatctgggagataacctctttccatgccttttatttcatggatgagatgactggcccaaagagaggaaggaatataatgtcctagactccaggtctcatgacgtcaaggttgtttccactgcaccagggtctgcaaactggccagagggattggtcctctgccagttttttaaggcccatgaggtgagaatggtttttacatttttaaagggttgtaaaatgttttaaagaagaatacactacagagaggaatgtgctcccacagagcctaaaatactatctggcccttcaaatcctggagttccctactctggccaatgattgaaccataaagtgcattacctatttttgtgccataaaagcaaattaaatattgagtgatttggttgttatttcaacacttgccttttctcccagttattgggtcttttgtcacctctataataaatgagaggcaatttatgtaggcttggtaaaccaaacagcttagttttctagaaagttttctattttgttgttattgttgttttgaaacagttttgctctgtagcccaggctggagtacagttgcatgatctcggctcactgcaacctctgtctcccaggctcaagtgattcttatgccccagcctctcaaatacctgggactacaggcacacaccaccatgcccggctaatttttgtatttttagttgagatgggttttcgcctcattggccaggttggtcttgaacccctgacctcaggtaatccgcccaccttggcctcccaaagtgctgggattacaggtgtgagccaccatgcctggccagcaaatggcttagttttctattatctgccatttccagtagagctctttctccttcagggcaaagaatgaaagaaagttaatcgttcctaccagaagtgttgaagaatcagagagctaaggtgcacttcttttcccttacccactccttccttccctctgggcctcctcctttgctggggactgagggttgggacttcctcaaatctgcttccattcttggagcaatgcccaaggggaattgtgactgcagcagcttcctggatatcactaatatagtcactggtacaagtacatttgttgtggtcaagttctttcagctatttaaaaagcctcaggcatgctgggcaagttcatgcaagttcactgcccacttcctttgctcatgtggttttgctgtccacaggtatgtagttttgacgacaaagcatcacgaaggcttcacaaactggccgagtcctgtgtcttggaactggaactccaaagacgtggggcctcatcgggatttggttggtgaattgggaacagctctccggaagaggtgagtgtccagggatggttactctgttatctctttggatctggctgtcaagagttctgtacctcctctacttgcgtgtgttttctaggtttgcatatagcaagtagcctgaagggcttttggccttctactcctgtgtgttttctaggtttgcatatagcaagtagccggaagggcttctggcctttgaattggcagtgtttgatgcttcacagttttcacgtgaccaaaggggacaccgttacagaagttcatggccatgtctggttagatgaaggatacccaacatagactacgatgctacttgatgtcctgtttgaggagtaggctgagtgtctgtataaatcataaagtttgattggaacacagccatgcctattcatttatgcactgtctgtgactgctttcaagctacaatttgagagctgagatagagaccaaatggcctgcaaaacctaaaacactgtctggatctttaagagttcactggtcgggtgcgttgactcacacttgtaatcccaggactttgggaggcagaggcaagcagatcatgaggtcaggagttcaagaccaacctgaccaatatggtgaaaccctgtctctactaaaaataccaaaattagccgggcgtggtggcgtttgcctgtagtcccagcaactcgggaggctgaggtaggagaatcacttgaacccaggaggcggaggttgcagtgagccaagatcgcaccactgcactccagcgtgggtggcagagcgagactccgtctcaaaaaaaaaaaaaaaagaaaaaagacaaaaagagtttgctgactcctgtcacctgctcagtttgtttctcagcactgtgctttgcttaaagtcctgctgtaaaactctgagatattgattagatatggacttcaggagtcatgatttttaccatctttatttagtccctgggtcatatgatgaaatacttcagttgttttttatctgtgtaattgcttcttgcattataaggtttttgtaacactcaccattcttaacccaaagcaagctttattaaatatgaaaataggtcatcaaccacatttcattttgtgtacgttaagaactattagtttggccaggcgtggtgacttacgcctgtaatcccagcactttgggaggccgaggcgggtggatcatgaggtcaggagatcaagaccatcctggctaacacagtgaaaccccgtctctagtaaaaataaaaaataaattagctgggtgtggtggtgggcacctgtagtctcagctacttgggaggctgaggtaggagaatggcgtgaacccgggaggtagagcttgcagtgagccgagattgcgccactgcactccagcctgggcgacagagcgagactccatctcaaaaaaaaaaaaaaaaaggaaaaaaagagaaagaactattagtaaatcttagataaataaaacgataaacctatattcatttcaactgtgtggaaaatgttactaatgattatttctgagtaagagtactttgcatatttgattttctattttccagtttctttaaatatgaaattttatgattgacagggaagacattttttaaaaataaggctatatggttttttgttttgttttgttttgtttttgttttgagacagggtctcactctgtcgcctttgctagactccagtggcacaatcttagctcactgcaatctctacctcctgggctcaagccatcctcccactttagcctcccaagtagctgggactacaggctcgcaccaccacactcagctaatttttacagtttttgtggagacaaggtctcactatgttgcccaggctggtctcaaactcatggactcaagggatcctcccacctcagcctcccaaagtgctgggattacaggcatgagccactgcgcccagcaggactatactctgttgggataattgacttaaaagataaaagatggtttaaataatattttggtgttaagatatttatgtataaaaggtagttatgtgtttaatcaaaaacacagtaaacctcattttgcttaagtgaatagtgaataatttaaggaaatggttttggatcccattcctctctatatgctcttatgagtgagtgccactgaaatgaaaaaatgctagaactgattttccttaaaataaattatttgttctatgcttaatgacagttgctgttctgtttttctgtttaaggaacatccgctatggactataccactcactcttagagtggttccatccactctatctacttgataagaaaaatggcttcaaaacacagcattttgtcagtgcaaaaacaatgccagagctgtacgaccttgttaacaggtaagacactgaaatattttggccctatgacttttatcaatgaaatcagagcttcctatagggtaccattaaagtggaggagggataggtatgaaaaaaacctaaaagacatcaaaataataaaaagtggtggttgtattaagacaaaatatgttctttcctcctgcctttcagaacttctgtcatgtggccatattgccttctacattgaaacaatcacacaaaacccaggatggcagaaagtcaaaattttagttcccttcttacatgccgttttccctatgtcaggaccctggagagggggtggtttggcatcgggcagatttgtgtttgaattctggctcctgttacttacatgccttaaacagaacactctcctgagcttgattctcactctgtaaagtggggataataatgccttctttgtagggctcagaatagtatgtgaaatgtatctgtcacggtgcctggtacaaagtaaggctgttgttattaccattattctttaaatgatcactttcacttagggatttgtcactagttcttcacaatgttttatccccatttgcctttctcgagcctggggactcatagaggacggtagacccttaaagcttcagaggcagctgcctggaccctcactttagagcaaaggaaaatcacctttagccaggcgcagtggcttacgcctgtaatcccagcattttgggaggccgaggcaggcagatcacttgaagtcaggagttcgagaccagcctggccaacacggtgaaatctcgtctctactaaaaaatacaaaaattggccaggcatgctggtgcatacctgtagtcccagctactcgggaggctgaggcaggagaatctcttgaaccagggaggcagttgcagtgagccgagatcctgctactgtacttcagcctgggctacagaggaaaactttgtctcaagaaaagaaaaattaccttgtattcagattctatccagatgacttctcttaagaaaatagtaacaattgtaagagaccatcagagacatggacagatttagaattactgaatcttagatccccactcttttatcgtacttggctatgttgccttgaacaaactacttatctttcgagatcttggtttctctatctgtgaaatgggataatagtatatcctagaatcatgagaactaatgaggtaatgagtttaaattgcctagtacaatttcttatacacagtaaatcacagaccatctgttatatcttgccacttagtgatcttcctagagtttacctgcctaattatggagtacagtggacaaatgggcagatttgtatttgagttccacctcctgttacttacaagccttgtcacctgaaacaaattgccctactgagcatcaaagtcttgctgctcaaatgagaataataatgcttaccatataggtatatacatatgtatttatgtatatacacacaacatacatgccttatagggctcagagtaataatatgctagagtacaaatggggctccagtggattccataagtcctttacagtacagactttggtaattatccacaaaaatgcattttatgaatagttccaactcttaaaacatcttcaaagcaaatcttagtcttatagtcctgaagcaccattttgtttcctttgcttccttgaaacaccattctttttttttttattatactttaagttttaggatacatgtgtacaatgtgcaggttaattacatatgtatacatgtgccatgctggtgtgctgcacccattcttttttttttttttttttttttttgagacggagtctcgctccgtcgcccaggctggagtacagtggcgcaatctcggctcactgcaagctccgcctcccgggttcacgccattctcctgcctcagcctcccaagtagctgggactacaggcgcccgccaccatgcccggctaattttttgtatttttagtagagatggggtttcacggtgttagctaggatggtctcgatctcccgacctcgtgatccgcccgcctcggcctcccaaagtgctgggattacaggtgtgagccactgtgcccggccagctgcacccattcttaattggaattagttgctgaaaggaaaccaaattgtttgtatgctgattacacctccatttcctaaaaggcataaagaaaaaagattagggcaggcacagtggctcatgcctgaaatcccagcactttgcgaagccgaggcaggtggatcacttgctgccaagagttcaagaccagcctggccaagatggcaaaacactgtctgtactgaaaatatgaaaattagtcaggcatggtggtgcacacctgtaatcccagctacttgggtggctgaagtgcaagaatcacttgaatccagcaggtgaaggttgcagtgagccgagatcacagcactgcactccagcctgggagacaaagcaaaacagtctcaaaaaaaaaaaggaagaaaggaaaagatcaggaggaaatataccaaaatgctgtgtgttttttttttttttttttgagacggagtttcactccgtcgcccaggctggagtgcagtggcgcaatctcggctcactgcaagctccgcctcccaggttcacgccattctcctgcctcagcctcccgagtagctgggaatacaggcgcccaccaccacacctggctaatttttttgtatttttagtagagacggggtttcaccgtgttacccaggatggtctcgatctcctgacctcgtgatccgcccatctcggcctcccaaagtgctaggattacaggtgtgagccactgtgcccagcctgctgtgtttgttttaaatggtggttttattagcaaactggttttattagcaaatgttttcagttttccacatcctctgcactgtgataatttttatgccacatactttcaaaatgaaggaaaattaattttaaaatatttgttgcaaaaatcagtccacaagtcaaatgcagtgatgtgcacctgtagtcccaactactcaggaggcttaggcaagaggatcgcttgagcccaggaattcgagactatagtgcattgtgatcatacatgttgatagctgctggactcaagcttaggcaacatagcgaaaccccatctctaaaaaaaaaaatggtccataagattttactgtgaacatgttcagataataagctctgtcctgatcacatgtcttccagctataaacctgatctgatctggtctgatggggagtgggaatgtcctgatacttactggaactccacaaattttctttcatggctctacaatgacagccctgtcaaggtatgtgattatatgacttcttatttatctcctatgaagaaagaaagtgcaaggagccaaactctggagtagacaaccacagcagcagcaataataaacaggaatatcaacatgggggcagtagggactgggacacttaatggatgttaaaggtttctcctttaatcttccctggctcccttagagtataagttttcttctcctttagtgttgtttttttttttttttaattgagacagaggctcactctgtcacccaggctggagtacagtggtgcgatctccgctcactgcaacctctgtctcccgagttcaagtgattctcctgcctcagccttccgagtagctgagattacaggggcccgccacctggccggctgatttttgtgtttttagtagagacagggtttcgccatgttgggcaggctgctctcgaacccctgacctctggtgatccgctcaccttggcctcccaaagttctgggattacaggcgtgagccaccgcacccggcaatctcctttagttcttaactttgacaatataggtttaaacagtggtaaatttacatagtagactaaaaatagtaattacaattcccagaccactacagaaaaaataaactctattaagcaaacaaatgttataaatgagaaaaccaccaaaaagatattaaaacatataataaaatacaaagaaaacatataaaagacatacaggccaagcatagcagctcatgcctgtaatcccagcactttgggaggccaaggcaagcagatgacttgagtccaggagttcaagaccagcctgggcaacgtagtgagacctcatctctacaaaaaataaaattagctgggtgtggtggcacggacctgtagtcccagctactcgggaggtagtcccagctactcaggaggctgatgtggggggaggctgacgtgggaggatcacttgagcccaagaggtcaaagctgtaatgaacctagatcacgccattgtactccagcctgcgtgacagtgaaaccctgtctccaaaaaataaaaataaagaaaacatataagatacacaaaacctacaaaattaaatggtaggaataaaatgcagatgcctacaatcccacctactctatgttgattttatagtttaactctcaagggacacacttacttcccttatatccaaatccttgggggaatgttgcctacccagtacgcctccctataatcaacactatgaggcagtgcataatggctgcccatttacagtttgtattttagcgtacttgcaaagtagcggaaaccctaatcttcactgtagcaaatttcacgattgtacatgttctagatttgttgtggatttaaaaggaaaatcttaagtgtaaaagcagtttgtactgaggtaccttggtagttcataaatctctaagggtcttggccaggtgcagtggctcacgcctgtaatcccagcactttgggaggccaaggcaggcagatcacgaggtcaggagatcgagaccatcctggctaacacagtgaaaccccatctctactaaaaatacaaaaagaaattagccaggcgtggtagtgggtgcctgtagtcccagctgctcaggaggctgaggcaggagaatggtgtgaacctggaaggcagagctttcagtgagccgagatcgcgccactgcactccagcctgggcgacagagtgagactccttctcaaaaaaaaagtctaagggtctcattgggtctctattactaagctcagaaaatgggaagaaagaaaaaaacagattctatatgatgcacagagacagattaagagtggttttctaaggccgggcgtggtggctcacgcctgtaatcccagcactttgggaggccgaggctggtggatcacgaggtcaggagttcaggaccagcctggctaacacggtgaaaccccgtctctactgaaaatacaaaaattaggccgggcctaatttttacatgcctgtagtcccagctacttgggaggctgaggcaggagaatggcgtgaacccgggaggcggagcttgcagtgagccaagatggcgccactgcactccagcctgggcaacagagcgagactctgtctcaaaaaaaaagaaaatacaaaaattagtcgggcgtggtggtgggcacctctaatcccagctactcgagaggctgaggcagagaattgcttaaacccgggaggcggaggttgcagtgagcagagatcgtgccactgtactccagcctgcgcaacagagcgagactctgtctcacaaaaaaaaaaaagagtggttttctggaacttgatgaatgtttgtgacctcccagatgtgcagttcatccctaggtaatgaactctgatgtgatgtcatatcgtaattgtctgcatatctgtctctgctagtctctgctggatcgttgagggcaagaactctgttttattcaccttggaaactcagtgtctgccacagtgtgagcctcatggtagttgctgaataaataggaaaagtaggtgggtgttgaaccaagaattcagattgttaataccccatttgtctctgaaatggcgtctatgtatatatgttcagggtgtatacccctcgagctaggtcgcttgctacgtgaggttacagtctagtgtttgtgcttaaggagtatcacagaaggaaaaatgactagccaaagatgcaggattgggaaagggaagaaaatatcaaccccagtgtcatttaaaaagcatgactagctagacagcctgaacttttttggcttttttttttcttttcttttttttttgagagggagtctcgcactgtcgcccaggctggagtacaatggcacgatctcggctcactgcaacctccgcctcctgggttcacacaattctcctgcctcagcctcccgagtagctgggagtacaggcgcacaccatcacacctggctaattttttgtatttttagtagagacggggtttcaccatgttggccagactggtcttgaaactcttgaccttgtgatccacccgcctcagcctcccaaagtgctgggattacaggcgtgagccaccgctcccggccggcctctcttaaacaataattcctaagcaaccaggaccttctgtgtgggtgtgcctcaacccatcttcacagtagcttcgcagacatatggggactgtagattctccttcatttctaccaggatttattgagagccggtgccgtagcatgccgcatgctaagccttggaaatgctgaatgaatggtttctgctcttagggaactacagtctgaagagaaagacagacatacaaacaaagtacattgtagggtgaccagtatgatagtagaagtatgtcctgaggtctccacaatccatagacactggttcgaatgccaaagtggagggtactgcattagcttctgtgggatgaaggagtgcatggttgtgtctgtccttgacaggctgagtgtacagggagcgttcacatcacctgaggactctgagaaagaggaggtgtggcaaggagacacctttattcactctgagccagagtctgggcacactgtcacttttatccctccctctcaaacccctgtgaggtgggtgatatttgcctttggattttgtttgtttggttggttttgtttgtttgtttttatagataagtaactaacttaaaaggtaaagttacctgcctaagaccccttgactactaggtggtggagccagctatgaacctcaaagcccttgataatcttgtaaccaggcataaactctgatatgatgtcatattgtaattgtccacatatctgtctcctctgctagtctctgctggatggttgagggcaagacctctgttttattcaccttggagacccagtatctgcccacagtgtgagccccatggtagttgttgagtaaatacttattgaataagcggatgggtaggtgttgaatgaagaattaggattgttaataccccatttttctctgaaatggcttttacatacctgttcttgaattgatcttgagttgtccttttcaattctgtgacccatgatgcccagacattgataatcaagtaccagacattggattgaactagttacaaataatgactattcttctatttctctttggcacttaactagcttccataggagaaacttcataccaatgtgaatgactctaaaacaggcaagaaatgggaattttaaacttttaataaatctctttttgccgtgatgaattgaacatggtttcagttttgtttttgtttttgtttttgagacggagtctcgctctgctgttgcctaggctggagtgcagtggcacgatctcggctcactgctacctccgcctcccaggttcaagcgattctcctgcctcagcctcccaaatagctgggactacaggcatgtgccaccatgcccagctaattttttgtatttttggtagagacgggatttcaccgtgttagccaggttggtctctatctcctgacctcatgatctgcctgccttggcctcccaaatggtttcagtttttatcttgtattggccactctgttataaaatatgctgcatttaacatttacattaagatattccatgtatgatttatcattcttcagctaaaccttgaagtaagaaaaagaatttgctattttttttttttttgagtgggattgtcttaagactttttttttacgtaagtaaggctgggattatatagttggaaaacagcctgccatgggttcagatacctgatttgtagttccagcttttgaaactgcctaggggcatggccccaggcaggtcctctcctgttcatttctcctcttatagaaaaagtgatttaccagatgatctttaaagcaagctctcccagccctgacatgtatctctgcagcagggtttctctacctcagtactgttgacatttagggctgaatatttctttgctgtgggggctgtcctgtgcattgtaggacgtttagtaacatccctggtctctacccactagatggcataccacccccgttgtgacaatcaaaaatgtctctagactttaccaaatgtcccctccagagcaaaattgcccccagttgacagccactgctctagactaagtttcttgcttccaaatagagccttaccaaagtgtattacataaagaagtcaagtggttttactcctcatgaccaaatattctttccctccttaggatgaggtggtagtaaatgaccgatggggtcagaactgttcctgtcaccatggaggatactataactgtgaagataaattcaagccacagagcttgccagatcacaagtgggagatgtgcaccagcattgacaagttttcctggggctatcgtcgtgacatggcattgtctgatgttacagaagaatctgaaatcatttcggtaagagcacctttgagttttttgtttttgtttttttttttttaacatgcagtatgatttattttatataatgttcaaaagcttgcaaaaacagcatattgtttacagatgcatattttggaggtaaaattatgaagaaaagcgagatcattataaacaaaatttaggagggggctgggatggagaagggcatgcaaaagggctttaacggtgttggttgtaatctatatcttaaagtgggtgtgggtagtagggtgtccagttttttatttatttatttatttatttatttattctttattgatcattcttgggtgtttctcacagagggggatttggcagggtcataggacaatagtggagggagggtcagcagataaacaagtgaacaaaggtctctggttttcctatgcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacacgtttcagagagcacagggttgtgggtagggtcaccgatcaacaggatcacaaggcagaagaatttttcttagtacagaacaaaatgaaaagtctcccgtgtctacctctttctacacagacacggcaaccatccgatttctcaatcctttccccgcctttcccccctttctattccacaaaaccgccattgtcatcatggcccgttctcaatgagctgttcggtacacctcccagacggggtggtggctgggcagaggggctcctcacttcccagtaggggcggccgggcagaggcgcccctcacctcccggaccgggcggctggctgggcggggggctgacccccccacctccctcccggacggggcggctggccaggcggggggctgacccccccacctccctcccggacggggcggctggccgggcgggggctgacccccacctccctcccggatggggtggctgccgggcagagacgctcctcacttaccagacggggtggctgccgggcggagaggctcctcacttctcatatggggcggttgccaggcggagggtttcctcacttctcagatggggcggctgggcagagacgctcctcacctcccagacggggtcgcggccgggcagaggcgctcctcacatcccagacggggcggcggggcagaggcgctccccacatctcagacgatgggcggccgggcagagacgctcctcacttcctagatgggatggcggccgggaagaggtgctcctcacttcctagatgggatggcggccgggcagagacgctcctcattttccagactgggtagccaggcagaggggctcctcacgtcccagacgatgggcggccaggcagagacgctcctcacttcccagacggggtggcggccgggcagaggctgcaatctcggcactttgggaggccaaggcaggcggctgggaggtggaggttgtagcgagcggagatcacgccactgcactccagcctgggcaccattgagcactgagtgaaccagactccatctgcaatcccggcacctctggaggccgaggctggcggatcactcgcagttaggagctggagaccagcccggccaacacagcgaaaccccgtctccaccaaaaaaatacgaaaaccagtcaggcgtggtggcgcgcacctgcaatcgcaggcactcggcaggctgaggcaggagaatcaggcagggaggctgcagtgacccgaggtggcagcagtacagtccagcttcggctcggcatcagtgggagaccgtggaaagagagggagagggagaccgtggggagagggagaggggggagagggagagggagaggggagttttttgttttttttaatgaaatggggtcttgctctgtcatgcaggcaatagcgcagtggcacgatcatacctcactgtaacctcaaactcctggggctcaagtggtcctcccacctcagcctcctgagtagctagaactacaggtgtgcacctctacaaccagctaatttttaaattttttgtagagacagggtcttgctatgttgcccaggctggtctcaaactcctggcctcaagagatctagcctcagcctcccaaagcactggattacaggcatgagccatggcagctggcctgagttcactattttttaactatggatctcaaaccactttttattattattattattattattaccttctaacatactatatgattgattttaattatttttttcctctttttttaaattttactttaaattctgggatacaagtgcagagtgtgcaggtttgtttcataggtatacatgtgccatgatggtttgttgcaaactatcaacccgatatctaggttttaagccccacatgcattaggtatttgtcctaatgctctccctcccctcacccccacattccaacaagccctggtgtgtgatgttcctcttcctgtgtcccatgtgttctcattgttcaactcccacttatgagtgagaacatgtggtgtttggttttctgttcctgtgttagtttgctaagaatgatggtttccagcttcatccatgtccctgcaaaggacatgaactcattcttttttatggctgcaaaaccagcttttttatgtaagagtgatgtccagcttcatccatgtccctgcaaaggacacattctcttttatggctgcaaaaccagcttttttatgtaagagtgatggaagtactctggatagaagtgcaggtcaatagaacccttttaaggacattgaatagactaacagaaacctgtcctaaggaaataattagagttacacaagaaagttgtgcagaggtccttcccaggattatttgtatgtatgtatgtatgtatgtatgtatgtatgtatgtatgtatgtgtatatttatttatttatttatgaacgaacttcactctgtcacccaggctagagtgcagtggtgcgatctcggtctgctgcaaccgccgtctcccgggttcaagcaattctcctgcctcagcctcccgaatagctgggaatacaggcacgtgccaccatgcccagcttatttttgtgtttttagtagagacagggtttcttcatgttggccaggcttgtctcgaactcctggtaaccataaaaatgttgacaaatttaatatgggttaatgtttagagcactgaatgaaaaaacagttacatattggctgggcacagtggctcatacctgtaatgccaacactttaggaggccaaggtgggaggatcctttgaggccaggagttcaagaccagcctggccaaaatagaaagaccccatctctattattattattatttttaataaagttacatattggctgggcatggtggtggctcacacttgtaactccaacactttgggagaccaagacaagaggattgcttgagggcaggagtttaagaccagcctaaacaacatagtgagaccccatctctattttaaaaaataaaaataagtggccaggcacggtggctgacacctgtaatcccagcactttgggaggccaaggagggtggatcacaaagtcaggaattcgagaccatcctggccaatgtggtgaaaccccgtctctactaaaaaatacaaaaaaaattagctgggcgtggtggcacatgcctataatcccagctactcaggaggctgaggcaggagaattgcttgaacccaggaggcagaggttgcagtgagctgagattgcgccactgcactccagcctgggtgacagagctagactccgtctgaaacaaaaattttttttaaataataataaataaataaaataagttacatattattacaactatataaaattaactacataggaaaaagactagaagaagacatcaaaagttaatggtgtggtgtcacttggagtactgtaatgaattcttataatgaattctttaattcttttttttttttttttgagatggaatttcgctcttgttgcccaggctggagtgcaatggcacgatctcagcttgctgcaacctccacctcccgggttcaagtgattctcttgcctcagcctcccgcatagctgggactacaggtgcctaccactgtgcccagctaatttttgtatttttagtagagacagggccttcaccacgttggccaggctggtctcaaactcctgacctcaggtaatccacctgtcctggcttcccaaagtgctgggattacaggtgtgatccaccatgcctgtctgaattcttcaaattctgtaatgaatttaaaattttctctatataaccttagtttttctgagctgcctggatatgtataatacctgttcaaggtcacagtaaaaacacacacacccaaatcccactccagaagtcttaaagaatgtatctcttggctgagcacggtggctcacacctgtaataccagcactttgggaggctgagataggtggatcacaaagtcaggagttcaagaccagcctggccaacatagtgaaaccccatctctactaaaaatacaaaaattaactgggcatggtggtgcgcacctgtagtcccagctactcgggagcctgaggcaggagaatcacttgaacccaggaggcggaggttgcagtgagccgagattgtgccactgcactccagcctgggagacagagcaagagtccgtctcaaaaaaaaaaaaaaaaaaaaaaaaagaacgtatctctttatagcagttttcccaaaggggcagcatgttcatttatatagcccaatgcgtaaggaatgtcctgaaattctcagcttccctgcccacacctcatgtttctggggcatgacccttcccactgcactcagcaccatgagaagtacagtgtcacaggaagtgctccatggccactccctgaaattcaagttaatataatatagcctgatttttcatttactcacatgagcctaacctgcttttatagtgacaaaaatatatatagagagagaatttttagctcaggtgcggtgactcatgcttgtgatcccagcacttcgggaggccaaggcaggcagatcacctgaggtcaggagttttgagactggcctggccaacgtggtgaaaccctgtctctactaaaaatagaatgatattagctggatgtggtggcgcatgcctgtaattccagctactcaggagactgaggcaggagaatcgcttgaacagggaggtggaggttgcagtgagccgagatgcagttgagccaagatcacgccattgcactctagcctgggcgacaagagtgaaactccagctcaaaaagaaaaaaaaaaaaattaaaacagcagaggatatttaaaaaacagagtgtgccctagattctttttcttctctgtctattttaagcatgatgccaggcttggcattcatagctagactttcattgtttctgttctctccaggaactggttcagacagtaagtttgggaggcaactatcttctgaacattggaccaactaaagatggactgattgttcccatcttccaagaaaggcttcttgctgttgggaaatggctgagcatcaatggggaggctatctatgcctccaaaccatggcgggtgcaatgggaaaagaacacaacatctgtatggtgagtcttgtcttctgttgtgtgtaagaacagaacagtgccccatccggaactggtatctccttgggtccacaatgtcacaagccaggctggaagttgccttgagaaaatccagaaggttattttcctataaaatttgtaccccatttgagttatgtctcaggctacttggttatctttgactagtgaagggagagagtgggtttggtgaaaagggaaggagcaacaaagcatcagtcaatttattgagattattaccctgccccctaaaaatagtaataatgaatgcttggattgtacggagccccatccaaaattctttccattcatacttggacttctggatctagttatttgatcttgggccccattttttccactgcagaatggagtgatgatgctttatagtgttgtgaggattaaatgagatgagtgccaggcacaaactcagtgttcaattaaagggaactgcttttattataccagagagcttaggtctctggatctaatccctctattaatccctctgttttggatgagtttctgtttagtggttgtcttagtccattttctgttgctataactgaatcccacaggctggatttttattttattttattattattttttagacagtctcactctgtcacccaggttggagtacagtggcagaatctcagctcactgcaacctctgcctccaaggttcaagcaattctcctgcctcagcctcccaagcagctgggattataggcacccgccaccacgcccagctaatttttgcatttttagtagagatggggtttcaccatgttggccaggctggtctcaaactcctggcctcaagtgatccacctgcctctgcctctcaaagtgctgggattacaggcatgagccactgcacctggcttagactggataatttttaaagaatagaggtttatttagctcacagttctggaggctgggaagttcaagagcatagcaccagcatctggtaagggccttcctgctacatcatgacatggttggggatgagagtgggcatgtccactcaggtctttcttccttttataaagccatcagtcccatcatggggccctgccctgattaccttatatgatcctaattacttcccaaaggcctcacctctaaatactataccatcgacatatgaatttggggattaagtttccatcatgagatttgggagatgcattcaaaccatagtagtgattttcatcctcttctctaaacatagtgaaatttcagaacaggctgggtgcagtctcagaaaaaaaaaaaaagaaatctctgaacaacaaatttgttttcattgcatgtcttgtccttgttatagtctctgctattttcacatggatttggaatagaaaagagatttgaataataaggtaaatggctctatttatttgcagtaactgatgtaggagataatttttaaagacaacttaacccaattggtagggaaaatagatagtatcaccagatagagttttatagactgcctccttcctgcacaccttcattggtattgagttattggtgctccctagtaacagtgacagactcgaggactgggatttggtagataattgaaaggggaatgagtggccttgtgcagtgcttcatgcctgtaatcccagcactttctaaggccaaggtgggaggatcacttgagcccagcacaacacagcaagttgtgttgggcaacacagcaagactccatcacttaaaaaaaaagaaattaggcccaaaacagtgactcacgcctgtaatccgaacactttgggaggccgaggcgggtggatcacctgaggtcaggagttcaagaccagtctggccaacatggcgaaaccccgtctttactaaaaatacaaaaattagcagggtatggtggcaggcacctgtaatcccagttactcaggagcctgaggcaggagaattgcttgaacctgggaagtggaggttgtagtgagccaagatcacgccactgcactccatcctggacaacaagagcctggacaacaaggcttcgtctcaaaaaaaaaataaataaggagctgagtgcaatggctcatacttgtaatcccagcactttgggaggccaatgcaggtggatcacttgaggccaggagttcaagaccagcctggtcaacatagcaaaatgccatctctactaaaaatacaaaagttagccaggcgtggtggtgcacacctgtaatccagtgactcaggaggctgaaccacaagaattgcttgaacccaggaggcggaggttacagtgagccaacatcacaccattgcactccagcctgggcaacagagggagactctgtctcaaaaaaaaaaaaaagaaaagaaaagaaaattaacattaaaaaggaggaaatgtataaagttgtatatcaggataacaagtcaggtatctttgacagtgttgtttctgttttcccaggtatacctcaaagggatcggctgtttatgccatttttctgcactggccagaaaatggagtcttaaaccttgaatcccccataactacctcaactacaaaggtaaagaggcttagtcagtcttaagatgtaactttctgtaaaggaattggcagatccttcctttcttccttccctgccaggtttctcccatattcacacctcttttagactggctttcctgccctggcccagcgtggctgtttcctaccatagtcagcctgtattctatactcattagtgcattaccagtttgtttcattcccttttgttttctgcagataacaatgctgggaattcaaggagatctgaagtggtccacagatccagataaaggtctcttcatctctctaccccagttgccaccctctgctgtccccgcagagtttgcttggactataaagctgacaggagtgaagtaatcatttgagtgcaagaagaaagaggcgctgctcactgttttcctgcttcagtttttctcttatagtaccatcactataatcaacgaacttctcttctccacccagagatggcttttccaacacattttaattaaaggaactgagtacattaccctgatgtctaaatggaccaaagatctgagatccattgtgattatatctgtatcaggtcagcagaagaaggaactgagcagttgaactctgagttcatcaattgtaatatttggaaattatctacaatggaatcttccctctgttctctgataacctacttgcttactcaatgcctttaagccaagtcaccctgttgcctatgggaggaggtggaaggatttggcaagctcaaccacatgctatttagttagcatcagttgtcaccaacagtctttctgcaaagggcaggagagctttgggggaaaggaaaaggcttaccaggctgctatggtcaactcttcagaaattttcagagcaatctaaaagcgccaaaattcgctatgtttacagtgatactattaagaaaatgaatgtgattctgctctgtctttttaagtatgatcaaataaaaaatttgtacatcacaatcatttctacc

SEQ ID NO: 36270 - DNA, 5996 bp, Homo sapiens
actgaggggtcagtggttccgggtaggagctaggtgaccctcggctgctgcagggatctgcagcgactgcagccatgggggcccacctggtccggcgctacctgggcgatgcctcggtggagcccgaccccctgcagatgccaaccttcccgccagactacggcttccccgaacgcaaggagcgcggtgaggcccagtgcgcaggcgcagccagagggcgtggggcgcgggtgcctgaacacctggcaccccagggctggcaccccagggctgggctctaacctcaggtgttgtatctgggtttgggtctagactaggagtccacaggacgtgcatgaccccacctcagtgtggaggcgttccagcccaagggcacggcttgagcaaaagccagggagcaaaagtgaggcgacaagtgggggttcgggcaggaatgcgacgcgcagagctgggtcgagtcttttttttttttcttttgagacggagtctcgctttttctttcaggctggagtgcagtggcttggtctcgattcactggcagcctccacctcccgggttcaagcgattctcctgcctcagcctcgcgagtagctgtgattacagatgtgtaccaccatgcccagctacttttttgtattgttagtagagacggggtttctccttgttggccaggctgctcttgaactcctgacctcaagtgatccgcccgcctcggcctccccaagtgctgggatcgcagaagtcagtcaccacgcccggcctcgggccaagtcttgggggacgtggggagtcatgggagggcagggacacgttcattgtacccccttcctgatgtcactgcaattgtggggtatgcacaaggaaataaggaagattcgagctgcaaatactgtcctgcaaagtgctttgttttgctttgagacgggatcttgctctgttgcccaggctgagtgtagtggcacaatcacagctcattgcatcctcgacctcctgggctcaaatgatcctcccgcctcagcctcccgagtagctgggactacaggagcgccccaggatgccagactgattttttattttttgtagagttgggggtcttgctgtgttgcccaggctggtctcaaactcctgggctcaaacgatccttctgcccagcctcccaaagtgctgggattgaagatgtgagccactacgcccaggatggttttttggttcgtgtgtttgtttttgcttttaatgtagtaatatcacaggcataccgagcaccagctctgggccacgtcccacattaggcaccgcggatacagcagggaactggagggatgcaggcactgtctccagagaactcagcacagtgggaaagattgtggaatcaggcagagctgggggtgtcaaagcaggcttccaagaggcagtggctggaaacaaagacgtgaagggtggccggtcgtggtggctcatgcctgtaatcccagcactttgggaggctaaggcgggcagatcacctggggtcaggagtttgagaccagcctggccaacatggtgaaacaccatctctactaaaaatataaaaattgaggccgggcatggtgtctcacacccataatcccagcactttgggaggccgaggcgggcagatcacgaggtcaggggattgagaccatcctggccaatgtggtgaaaccctgtctctactaaaaatacaaaaattagccaggggcgtggtggtgcacacctgtagtcccagctactcaggaggctgaggcaggagaatcgcttgaacccaggaggcagaggttatagtgagccgagatcacaccactgcactccagcctgggcgacagagcaagactccatctcaaaaacaaaatacaaaaattaagccgggcacggtggcttatgcctgtaatcccagcactttgggaggccaaggccggtggatcacctgaggtcaggagtttgagaccagcctggccaacatggtgaaaccccgtctctactctactaaaaatacaaaaattagccaggtgtggtggcgcatgcctgtaatcccagctgtctgggaggctgaggcaggagaattggctggaacccaggaggcagaggttgcagtgaaccaaggtcaggccaccacactccagcctgggtgacagagcgagactgtctgaaaaaacaaaacaaaacaaaacaaagatgtgaaggggcatgagtaggggttgaccaaagagaggtggcagagccaagcttctaagcagaggagggacacaatcagttttggttggtcaaaaggtcacactgtctactgagtgggcgacaagcttgagacagagacctctaagcagcctggatttgagagaaagttgggagatggtataatcactccagtgtccacactccgggtagtccttccgccccagctgaacctgcagttcattggtccgtccaccttcctcccactgcctcacataccttgctttccccaagatcagctttgcaaacgctagcaacctgctgcccttctctcttgcttactctggataaactcacctctttcccttccttggtgcctatccccgtgcaactgaacataatggggggcggggagataagaaaaaaacagctctaagccaggcaaaatggctcatgcctgtaatcccaacggtttgggaggcaaaggcaggaggattgctcaaggccagaagttcaagaacagcctgggcaacatagcaaggccctgtctctacaattttttatttttattttttaattagctgggtgtggtggcgcattcctgcagtccctgctgaccggtctcccgattggtactccagtggactctttatggtgcctggcctttctcttacctcccggatccttcactctctccctccctcctagatcactgtcccctgccctctctttcctcctttccaccccctttcagccagtcactttgctcactgcaacatctgccttcccggttcaagcgattctcccgcctcagcctcccgagtagctgggattacaggtgcgtgccaccacacctgactcatttttgtatttttagtagagacagggttttaccatgttggccaggctgatctcgaacttctgacctcaagtgatccacctgcctcggcctcccaaagtgctgggtttacaggcgtgagccaccgcgcctggcccatatttatttatttgtttgtagagatgggctctcgctctgttgcttaggctggagtgcagtggggtggttatcacccactgcagcctcaaactcctgggttcaagcgatcctcccgagtagctctggatactccgtgtgcactaccgtgcaaagataattttatttttttctggacatgggatctttctgtgctccccaggctggtctccctaatacttaagcactgccagacacgctgtggtgctctgtcttctgtctgttctgtgtctccctctgagggcagggacacttgtgtgttgtgttgcctgctgtatccccaccactaagcacacagtaggcagtctaaagtccttgctgctagctgattataagttcaagacaaaagagggaggagtctaggattgccacctggagctccaagtgcagatagggaacagccaggggctgcaggtgatacccaggcctggggctcaagcgaggtgtggggtggagggaccacatcgggctcatctacatacggggcggcagcagagaaaaaggctctcaggccgggcacagtggctcacacctgtaatcccagcactttgggaggccaaggtgggtggatcacctgaggtcaggagttcaagaccagcctgactaacatggcgaaaccccatctctactaaaaatacaaaaattagtcgggcatggtggcaggcgcctgtagttccagctactcaggaagctgaggcaggagaattgcttgaacctgggagacaggggttgcagtgagctgagatcttgccactgccctccagcctgggtgacagagtgagactccatctcaaaagaaaagaaaaaggctcccagaacaaagcgtaaggtaaggcagccatagagatgggaggaaacctggggaggagggatgtgggaggagccacaggaaagaaggaagcgggaggctggggtcctgggctgttgggtggccctgtgagagcccgtgtctgggcagtgagggggtagggcagaagccagggaatgggacaaggggcaggagaggaggacctgggcctcagtgggatgagagaatcgcagctgggaagcaaaggggagagaagccagcaggggacgactgccattgagatgtgaatatatctcgtctcacttgcgcagatgggaaggagctgggaccgagaaagatgtggtggacgtcaggagggctagggaggctgggtctgagggaggcggtggggaacgagtgcaggatcgccaggcacaggctccggggtgagtgtccaggattcctcatgctcccatcggccccctcctgaaggttgatttgtccggagtcaggtttgctaggtgagtggggcaccgggacccagatactagtccagctgtcttctgagcccacgcctaagtaccttacaggtactgttagctcagtggatgctcgggtaacttccatgaccggatggtcagttctgaggctgagagagaggccacgccgccggccagtgcagagctgggccttgggtgggttgcagacaagaaaggctgggagtgctgcctggagccccaggtgcaggtggaggggctgagggttactctgggagaaggtggattctgaactcggactctggagagcggggctgtagagagctggggacgggcatccctgtgggaggggaggcaaggatccggcacgggatgttgaggtgcctcagggtgatggggagccaccttctcctgtctggcccttggtgtctggagttgcctttgtgcaaattagaaaaggaggccccttcaggacagtgcatccgtcaaaggcatctgccatccactgccatctggatgtgaatgggggacaccccaagccgtgccttcctgaagccgtgtgcctcggtcccctggggatccccggaattggggtggggagcctccagcctggttgagccccgcccactccctgcagagatggtggccacacagcaggagatgatggacgcgcagctgaggctccagctgcgggactactgcgcccaccacctcatccggctgctcaagtgcaagcgtgacagcttccccaacttcctggcctgcaagcaggagcggcacgactgggactactgcgagcaccgcgagtgagcacccccacaccagcccccaacaccccggcccgcaacaccccatacccccagccttccacacccctggcccacccaagccccccacatgcccagcccgcccaagcccccctcccacccccgccaacacccacagcctgcaccccacccaggcctggcccctggcaggatgtggctccagaggccagggacctgaactgccactgaggtttctagccgggccccaccttagtcccagagagggctctctaggggcctgtttgatggggacagggcaggtggctgaagccacctaggggagtggccaagcccaggttccagtgggaagccctgccacctgcgtgggcagaccccagacccaagccacaggcactcggacatgtcttcttcagaggcctcccccacagtgctctgggacggcccctccgcttcccagggcttggggggcgtgtcctggccagggaccctgacagcccctctcgtgcttttcccccagctatgtgatgcgcatgaaggagtttgagcgggagcggaggctgctccagcggaagaagcggcgggagaagaaggcggcagagttggccaaaggccagggacccggggaagtggaccccaaggtggccctgtagggggtgcaccccccaccctatggaccagtcaaataaaagccttcaggcccctca

SEQ ID NO: 36271 - DNA, 5904 bp, Homo sapiens
ctggactgctcgctggccggcagcgcaccgttttgaaggtcctagcccacctgggctggctcacgcgcacgactagccgctcccatacagcacgcccggactctgtcgtcgcttaaggccactcctattctacggctgacccctggtggtcacgtggatctgttcgccacgcaagtctgggtccttcggcgattgaccggggtccttgctgttcgggagcctctcctaagctgcctgttcgcgcgagagtttggaggggcgggtttggggtcggtgtctgattggggctcgcaccgcagcacgctggagtcccgcttaggtaccagttagcgtcaggggagctgggtcaggcggtcgccgggacaccccgtgtgtggcaggcggcgaagcgctctggagaatcccggacagccctgctccctgcagccaggtgtagtttcgggagccactggggccaaagtgagagtccagcggtcttccagcgcttgggccacggcggcggccctgggagcagaggtgggacggatgcgggcggcgaggcgctgggcgctgagggttggggatggactgaagcgaaagcaatggcggagtccttagaaagggggctggtgtccgtacgggtaatcacttacgggctggaggtggggacgcaggaatcttcggtgcaggatccaaatgggccctagttattgctctcctcgctggcctcctggcctgactgagggctccctgccggcagttccctagtgcctgtagtcctcacgtaatcgccaacttacctcctgtagctgccacaaagccccgtgaaccctaggcatgcagtgctaaagtaccaacacttagggcctcacctatccacgtagagtctggggctgagccgcaagtcctgagctcgcgctcccacccaccaccctgggggaatcagagccctcaagcgctggaacagagaagcccctttgtgtcccggccatttcctggaaagtagagccagagtcacaatgaggcctttgaaagccttggggtgaggattgggggggtcagggaaaaatggagtcggctcctcacacttatgttttattcccactcaaacccaggtggagcgaccccattacgctaaagatgaaaggctggggttggctggccctgcttctgggggccctgctgggaaccgcctgggctcggaggagccaggatctccactgtggaggtaaaggcacaacgggaaaaagaagtggaggaagcagagccttgggagggcatgagatccaaggcctgggagaaggatgaatggaaatcctgggttgatcccattctcctcacaccctaccccctaccctgtcccctgctctcattctctcctcttccaccagcatgcagggctctggtggatgaactagaatgggaaattgcccaggtggaccccaagaagaccattcagatgggatctttccggatcaatccagatggcagccagtcagtggtggaggtaactgttactgttcccccaaacaaagtagctcactctggctttggatgaaattcgactgcttaaaaaggaccttggtttaatagaaatgaagaaaacagactcagaaaaaagatttggctctgtctcatttggaagaagctgcaggcttattccccatgcacttgcttcctggctgcaaaccttaatactttgtttctgctgtagaatttgttagcaaacagggagtcctgatcagcacccttctccacatccacatgactggtttttaatgtagcactgtggtatacatgcaaacatccgttcaaaatctgagtcggagctaaaaataaaaaatgaaaaaacagaaataagaataaaaggtcttatcctcataattaggaaattttaatcgaaaacaacacacatgtacacaaaggtgtatctaataagcaatatataaggcagtgttaagattacagtgctagcctgggcatcatggcaaaacaccaactctacaaaaaaatgcaaaagttagcagtgcatggtggcatgtgcctgtagtgacagctgcttggaaggctgaggtgggaggatcacttgagcccaggaggtcgaggctgcagtaagccgtgattgtgccactgcactccagcctgggaaacacagcaagaccctgtctcaaaaaaaaaccaaaacccagcactttgggaggccaaggcaggcggatcacctgaggttagaagttcgagaccagcctggccaacatggtgaaactccgtctctactaaaaatacaaaaaagtagccaggcgtggtggctcatgcctatagtcccagctactcaggaggctgaggcaggagaatcacttgaacccaggaggcagaggttgcagtgagccaagatcgcaccactgcactccagtctggttgacaagaacaaaactctgtcttgaaaaaaaaaaaaggccgggcgcggtggctcacgcccgtaatgccagcactttgggaggctgaggtgggcagatcacaaggtcaggagatcgaaaccatcctggctaacatggtgaaaccccgtctctactaaaaatacaaaaaattagccgggcgtggtggtgggtgcctgtagtcccagctactcaggaggctgagacgaaaagaatggcgtgaactcgggaggcagagcttgcagtgagctgagatggtgccactgcactctagcctgggcgacacagcgagactcctctcaaaaaaaaaaaaagaaaagaaaaaagattatggtactttaatagctgttgttcacagagcctacactacatctttaatactgtgcttactgaggatattagtctcaatttaaacaaaattattattatttttttgagatggagtttagggcttgttgcccaggctggagtgcaatgacacgatctcggctcaccgcaacctctgcctcccgggttcaagcgattctcctgcctcagcctcccgagtagctgggattacaggcatgcaccaccacacctggataattttgtatttttagtagagacagggtttctccatgttggtcaggatggtctcgaactcctgacctcaagtgagccaccctcctcggcctctcaaagtgctgggattacaggcgtgagccaccacgcccggccaaaaataaaatattaatgaacacatggacacagggaggggaacgtcacacatcaggtcctgttggggtgttgggggctaggggagggatagcattaggagaaatacctaatgtagatgacaggttgatgggtgtagcaaaccaccatggcacatgtatacctatgcaacaaacctgcacgttctgcacatgtatctcagaacttaaactataatttaaaaaaaaattatcttcatctatagaaattagaagtataagttgatcaggttaatcaaaaaattctgtttataacttggagctaatgttaactgtcttgtttcttagaattgtacaatgaggtgccgggcacggtggttcatgcctgtagtcccagcactttgggaggctgaggcgggtggattacctgaagttgggagtttgagaccagcctgaccaacatggagaaaccccgtctctactaaaaatacaaaattagctgggcgtggtggcacatgcctgtaatcccaactactcgggaagctgaggcaggagaatcacttgaacccgggaggtggagcttgcggtgagccgagatcgcgccattgcactccagcctgggcaacaagagtgaaactccatctcaaaaaaaaaaagaaaaaaaaaaagaattgtacaatgaggtaaaataaaatcatatagttgaaactactgccaagtacagtggctcatacctgtaatcccagcactcttggaggccaaggcaggcagatcacttgagcacaggagttcgagaccagcctgggcaacatggcaagaccccgtctctacaaaaaaaatataaaaaagtagctgggtgtggtggtgtgcatctgtgtgaggctgagatgggaggatcacctaagcctgggagatccaagctgtagtgagcctcagtcatcacaccactgcactccagcctgggcaacggagtgaggcctgtctcaaaaaaaaaaaaaaaaaaaaaaaaaagaagtactttgaaactatcaagtaaaccatattaatttaaaaccaggccgggcgcggtggctcatgcctgtaatcccagcacctggggaggccaaggtgggcggatcactaggtcaggagatcgagaccatcctggctagcacggtgaaacccgtctctactaaaaatacaaaaaattagctgggcgtggtggtgggcgcctgtagtcccagctacccgggaggctgaggcaggagaatggtgtgaaccctggaggcggagcttgcactgagccaagatagtgccactgcgtccggcctgggcgaaagagtgagactccgtctcaaaaaaataaataaataaataaaataaaataaatgaaaaccacactaggccaggcacagtggctcacgtctgtaatcccagcactttgggatgccgaggcaggcagatcacctgaggtctggagtttgagaccagcccgaccaacacagagaaaccccatctctactaaaaatacaaaagttagctgggtgtggtggtgcatgcctgtagtcccagctactcaggaggctgaggcaggagaatcacttgaacccaggaggcagaggttgcaataagccgagatggcgccaatgcactccagcctgggcaacaagagcaaaaccccatctcaaaaaacaaacaaacaaacaaaactaattaaaatcaattagggaaagctttttagaataggttgttggagctagatttggaaagaaaagtaaggatataaattactaatgtacagaggtagaagagagtgacccaaggctgaggacatttctaggtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcggtgagctatgggaatcggtagctggttcttggacattaaggggttgttggagaaccaattagaaagttaggctgatatccttgtcctcctctttggaagtgaaggcaagaggcctcttattgccctgtgtcacccatttctcccttgggttggcagtgtgagagcattgtggaggaatacgaggatgaactcattgaattcttttcccgagaggctgacaatgttaaagacaaactttgcagtaagcgaacaggtaagctgcccccactttatctcctgttctagtagctctgtggaacctgacattccctaactcacccatacacccccatcccagaaacctctggtattaggtcaagagctgtcttccatttcccttggcttagggacttggggtgttcctccacattttctgtcagctttcagaatttgtgtccccttgaccctgagatacaggtgagaggacagtggggatgttttatcatttataagcatatattctgcagaatggtggttggtgtgtgtttgtgtcagcttggtctgggaaattttcttgatactggcagatatcagtatgagaatggcatattcctttaaattgtttgccatttgcagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagt

SEQ ID NO: 36272 - DNA, 9506 bp, Homo sapiens
agagagcgccggaagcggtccgagaatgaagagtaagcggggccgcgaagttggagagggttggggacgttaagggtcggggtcttggtactggtgggtgaaatgggtccgggctacctgttgctgcggagtcctaacagaaccgctacaggaatgggcccaccctacctaagaaaaactgagggctggagcacgggttagcctggctcgacctctgagctagggagggatgtcagggctggaggcaggttctcccggaggctgctcagtggtgtgcgatgctagaggagggttccaggccttggctcaacttggccactatctcccggggtgaccgcggtcaagatcctgctcctttctgcgagctggtttcacactcttaacctgatgcaaagcgccgagagctgctggggaatgatatcactaacccaaagctttggtccttaggggtagaagacatgtgccaaggaggggcgtgtagacaccgttaagactgggccttcaatcagaatttttatttttcatctctgccactttctacctatatgatcaagtagattgtctcggcatgtctgagcttcagtttgctcatgcacataagtgtaatgagaaaaaatatgtgtaccttgtaatgaggtttctggcaagtaatggatgttcagtaattgttagatgtgtattgttgcagaaagacttccaagtctgttactaagcacctgtaacagatgaagcaaagttatcaggccccgcaagttgctctctacagtttataatccccatcttccatttgagggagaactagatgctatatataaaacttgcaaccacattggtttgcttgatcaaacaaacatacctggctgggtgtggtgggacacgcctgtggtcccagcactttgggaggctgaggcagggggatcacttgaggccaagagttgaagaccaacttgggcaacaacatagcgagaccctgtctctacaaaaactggaaaaaaaaaaaaagaattagccaggtgtggtggcacacacctgtagtctcagctactcaggagactgaggtgggaggatcacttgaaaccaggaggtcgaagttgcagtgagctatgattgtgccactgcactccagccagggcaacagagcaaaacccagtatcaaaacaaacaaacaaacaacaaaaaaaaaaaacttgtaaccaccttgcatcaaacattctcagggaagtacaagaaagctggaattaaatttacagagtatagtgtaaattacattttctagctatttagctcataaaccaggccttagtagtcccattcttattccattcacacctgtactctgtccccagtgccatggttttcttctttcaaaaaattaagaaacagaagtgtggaatttattttagaggttgaaactttattgaccaatgtatattttgagtttaaaggaaaaacttgtattttatcagttcaggacaccatcgattatgtgacacattataatttcatattaaaatgtgaagaatctttttaaacatcttacagttaacaaaacctatttctaaccatctacatcctagacagctatatcatataacttttaatgagttaccttgttagcaagtgctcaagcttctaacttggggtattttaaaccaatgcaactcaaaatgtgattcactgacctgcagtagtatctgggaatatgttaaacactcaggatctagggtaggagaccaataatctgcattttaataagatcccagagatttttacacacgttaaattttgagaagcattctttttaaaccatgtgcttggaacttctagcatagatgtggccagagggtgggataagaggcatccaagaaagctttgctcttaataccaacctcatcttctcctatctctgaataagcagttgttctgctataagtgtagaagtgtagttattttcttttcttttcttttcttttttttttttttttttttttgagacagagtctcactctgtcacccaggctggagtgcaatggcacgatcttggcgcattgcagcctctgcctcccaggttccagcgattctcctgcctcaatctcccatgtagctgggaatacaagtgcaagccaccatccccggctaatttttgtatttttagtagagacggggtttcaccatgttggccaggccggtcttgaactcctgaccttgggtcaggatccgcccgccttggcctcccaaagtgctaggactacaggtatgagccactgcgcctagtggcgtagttattttcatagttagaaaagtcttgggtcttacagccatacccaacaagaattgatcatttcttttttttaatcccccaggtgtgatctaccatgcattgtctcagaaagaggcgaatgactccgatgtccaggtcagttcttggcagggagtccaggagcaacagaggtgatggcaaagatggctcagtagcttctgagcccccagcactgattgagatgtcctttcccacatcatactcctcatttttctggcagacatctaaggctggatcaaagtctgtagttctcattacctgttcccacgtgccagcctccttttctgttgtgccaaagtcaagtttggtaaaatgaggctttccttaaccttttatcatttcccactgtgttggggacaccaggctgtgcccacgtggtgggcagcatcattcaaccttgtcactgtgccctctgcacttctgcagaaggtgtgcaatcacatatcataagtgaaatttacagattatatctgaatgcctcggcctgctttgtcagttttgcaaaagttcctcttgtggctcataatgagagcattaccttgaaagcaagattttgaaagaccagtatacctttattttgcttctccatgaaagatgagccactcaggtatttaagagaatcagatcattgtcctattatagtcacaatgacgagagtgaattaatttttagttagcatctacaggtgcaaagctgaagcagagttcccaccatcatactgtgagctccctcgaaggctatatgtaccctatcttcccatccccattgctctcccacagaaggaaggctgcgttactattgacagatcagcatcagtctgtcagcctcagtcttagcatttagcacctggctagtgcaaaaagagctcaggaaacagcccagccaggagacaggccctcaggagagagaactgcccaggtctgtggcaggcatgagggcagtggcattgccaccaaatgaggaatccgttattggaactccaacctgagaggtagtgagcttggagggtttctttgtttgtttgtttgtttgtttgtttgtttgagaattgcacacaattacgacagtcatttttcccagaagtcctctctaagagcctgtgctcattcatggtaagttgacgccctgctctcagtgacacccttcagagagagcgagcctggggcctgagatgctctcgacggtaccttcctccaagtgatggtctgcggggcgggagcggaccttttggagagtggccacaccatgcccacagagctggaaacccggttaaggagtattgtcctaagggcacagtgtcagggtccctgcgccctgaggcttggccgaccctggagccctagttttgctgttttctgtagtgttaggatcacttcctccatagcttagtgctactctgagctcactttcatctggtcatgcctggttgaatatatttgttatacatttctcaagctttctcttctgccaaggatgagagaattcttcttcaagatagaaaggttttggtcctttcagaataacctcagaaaagcagggccagagcaggaagtgagcgtttgacacgctgttgtgtgtgacaaacggtcatgaattggtgtgtgagtgtgacttacatctcggcagctgtgggtagcagatgcatggcggatgagcaggttgagagcctcagtaggtaaagggatgggccccatttgctcttgcagtagctgccgggaatggcgggcgggatgcctgggatcctgggctgcccagaccggagcagtgagcgccgcacccccttgtccgcctgcagccttcaggagcacagcgggccgaggccttcgtgagggccttcctgaagcgcagcacgccccgcatgagcccgcaggcccgcgaggaccagctgcagcgcaaggcggtggtcctggagtacttcacccgccacaagcgcaaggagaagaagaagaaagccaaaggcctctctgccaggcaaaggagggagctgcggctctttgacattaaaccagagcagcagaggtaacccgagctccccacgtctttctgcccgcggtgcttacccttcttggtgtgtgaacttggctgagtggctggggaggcagcctggctccacctaagctaagggggcctctctgtcgtctgccacaagagggcagccttcctttaccaatctgggctgtgttcagcgaggcgggtgagacaggactcattgtctggcctctctcctcaccttcaggagtaagacccgtgcaagtacatctgttgcccatggcaacaggctgtttgtccttcggctttgttagacagaaaagaggaactgatatgtttttagtgtgtattactttgtagcttttgatagagccagacagtcacccactcgggtttcattgccaaagcaagatgttgcccacacgtttcagaagtttccaaaaggaatgcatcactgtcctgtcctgtgggaggatgtcttcctccagccgacccgccatccctccttggtgacgggtctgagtgtgggtgtcttggggctgtctgtaggcttttgcttggagatcaacggccaaatagcctcccacgctccagaagacgcttaaagtatgccatgctgttcccggccccactcaggagatcagctgggcctcaggtggagaaggggctgctgcctcccagggtttgcctcccgggtggagcccaggttgggtttgagcttaaggtcctcatttctctaacctaaggctttgtggtaacggattccccacaggatatcaagactggagataatggcccagaagaacgctgttggggtccttgcccctgctccccgcttcttctccccaccacttgcttgcccaccttccagaccagcctgctgcctcacatgaggacctgcgtgacaaccagcaacccctgctttactgggggcttactaggttcaatttcacgtaacagaaaacctcaaaataacagtagcttcaacaagactcacgtttatttctctctcatgaaaagaagtccaggtggacaccgccctgggctggtgtggtcctaccaatgaggaaactgaggttagagaggtgtaggttcttggtctcggttatcagctcaattgctcatcgtcggatttgcacatagttcctaatgatcccaggttgcagttgttggcatcaagtcaagctctgtgctatttggacattgtcatcccaagctcatgttgtctaactttttccctgtttctgactttgctgcagatacagccttttcctccctctccatgaactctggaaacagtacatcagggacctgtgcagtgggctcaagccagacacgtaagttgcattcctgaagctttgctctttggggtggatctcaagcctctgatcattgtaaatgcggcttcaggaaccagcgttggtattgcctggctgcagacggttaaagacctagttgcttcttttggaactttttatcatgatgtaaaccaagggcttctgtttaccctgcaggcagccacagatgattcaggccaagctcttaaaggcagatcttcacggggctattatttcaggtaatttacctaagagcgtgtagcacatggccatccagaggttcactctgtcactctgtggagacccagggcgtgtgttctgttggacacactctttaccgtgtggattccctgagatggcccccagtcaccatcatccccacgctaagggtgggagatgcttctcgctggctgtcttagccagtccggccatttgctggacacaccctaagtggtctctgtgtaccttctccacacagggacccctgttggtaccctaaagggcacagtggctgcgagcactcacccacggcctgggatcttgaacacagaatccctttcatccaatgctgtggtttcaaatgtcagctacacctgacagcccccaaggtgacatctccagcgtaggcctgtcccctgaactccaggctcaggcatccagctgcccacttgacatagccacctggatgttcagggggcatctcagactttacatagccaaagctgccaccgattctcctcacagcaacccctcctggtcttttccatctcagttaattactcagttatttacactggttgttcagaccaaaaacctaaacagtgtctatgtttcttctttcctaatctcctcgaatccttcggaacatcctactacttaaattcagccactgtcattccccagattacctcagacacagctcctcaccgcaccaggcagccagagtgccggttacgtagaaatcagagcacgttccttccctgcttcaagtcttctggcagcgtcccatcgtatgggagtaaacctgcctccttgctgtggtctaaggcctccccgctccctggggcagcaggcctcccacactgccttcctcctgccctgcctcagggcttcgcctctgctccttacctctacccgggagttctcctgtgtgtgcacagtccagcttctcattgttcagccctgctccaatgccactcccctcagggtctaccattgcaaaccatgaccctccacacattgccctgtccctactcttcatagcactcgttgctgtcagaaagtagaatggtgtggttcaccgtgcatcaccctgccttgctagaacccgggctccgtgagagtaggatccaggaccgcctctttccgtgctgtgtccctggcatctcctgaggatggtgcaggcattccacagctgcttggtgactctgtccgctacactgaggctcgggtcaggacgagggaggggctgctgcttgtgatggtggctcatctcgcagtgctggctgctgggcagctctgcagccacactcacgttccagccagcatcctgggcagtgcatggtggtgtttgtgcagatcctgcaagggagacctggctgcatcagagcagccagcccgtgggccctgatggtgctgggcacatatgtgacctttaattccagaatcctgcccaagacccctgtggccacagaccctccgaaggacacctcataggaacagtccagaggctgcaaagccccaggggaagcctggattcttgttggttacatcagggcccagctgttgagcccccaccccctgggtgctctgttctttcatctgctagctcagagggtgggatcagcacccccaacccctgaggcctgcttctctgtggttcccccagcaccacagaggcctgagcctggaactgtcctttttctttgcagtgacaaaatccaaatgcccctcttatgtgggtattacaggaatccttctacaggaaacaaagcacattttcaaaattatcaccaaagaagaccgcctgaaaggtatgtaggtgtttctgagggcattgcttgcgggctgtggctcccagctactgcgttagccttttcctcaaggctccaagagtttgatttgacccctcaagtcagcgcagattgcagatacttgctgaacctgcattaaagcctgcagagaccatcccctgcacccgtggctcccccaagaggtgtgtgtcagtgcagcctgcaaccccggccagaaatggccaaggggaaggaagacctgctcggctgtgcctcaggggacctgggtctgtttaggccccaggagagggcctccacctgccccaaaggctgctgctcccagaggaatgtagccaaacaggcagcagggtagaaacaggagtggcgcctgtccctggagttctgagctgtgtccttggcgataacacttgggttccatccgtggccagcattgctctagcagatactttgggtcagccaggatttctacaccccgccttacccacaaatccagagatatcaaaccatagttagaaggttttgttcctttaatttttcttttttttttttttggagacagtctcactcttccacccaggctggagtgcagtggcacaatctcgactcactgcagcctccactcccggattcaagggattcttctgcctcagcctcccaagtagctgggattacaggcacgcgccaccacgcccggctaatttttgtatttttagtagaggcagggtttcaccatgttggacaggctggtctcaaactcctgaactcaagtaattcacctgcctcagcctcctaaagtgctgggattataggtgtgagccaccgcgcccagccttcttcctttaatttttgagcttggtttttcttgttgcttcccttattttcctacatatccttctacctcacattgtaaacctcggaaagtggtgtaatagtttctccacagagcataaggccaggagcccatctgaaagttaatgtgggaaaaccagtttctggcaggtgttctgggactttctggttctgggaatttggtgtatagcctttgaccctgaagattaggtgccaagctacatttagcatgtgactagattgacctgtggcagaataaccacaggcaaccctaatgcccctccccttgtgggtttcccgtttcctattagcttatttttttcattcaatgtgttctgaataatattctacctaaaagtaaaatattaataaatatttttcctcatctttttttctcctgcctttttttttttttttttcagttatccccaagctaaactgcgtgttcactgtggaaaccgatggctttatttcctacatttacgggagcaaattccagcttcggtcaagtgaacggtctgcgaagaagttcaaagcgaagggaacgattgacctgtgaattctttgccgtctaaggcagttgtttatgacagctgaaaactggacactccctaaatgtccacctttcagtgaagagatagttaagccaattccatttatagaccacctccagccagtgacgctccgagttgaggatgttgaacaacatgggaaggtcgcagcgtactaagtgaagaagtcagaggacagaggaatttctctttctaggagattttcattttgtgtgactcccatggggaggaacagactggcaggaagcacaccggggttaacactggttgacttgaataggattattcgatttttaaaaatacttttccatgttttctgagtgctctatgataaatcagttgcatctgtgataatacagtacatatgtggacataaacagggatcaaataaaggaggtattgctgc

SEQ ID NO: 36273 - DNA, 6058 bp, Homo sapiens
gcccggagccgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcaggtgctggccggggagcaggggacagcgggggcggggcggggcggggggcgccgcctggggagggtctcgggcccggggcaaggcgggcctttgtctgcgctgcgaccctgtgacctcaggggcgccccgtgacgtcacggggagggatgacgtcaagccccgagggaggccccccccgcaggaatccgaggggtccgggcgggtcccaactgcccggcccggggcggaagacctcggcgccttctcgtggggtcaggaggggaagaggcccttccccgtcacctgagagccggcgcggcctcagccttgaactttgaatcctgggggaagaggacaaaacccgctcccgcgtggcagtttgagcctccggagctttcccccatctaacctcttctgattcttcgaacgttcagagaacggtagctattgttctcccatttcacagatcatgaaacgagattcaaagaaaggctgcgacttgcccagggtcacatagttacttaaaggcttaactaggatttaaacccggactgcttatgatcacacaatggaggaaggactgaatcctcccccgaagaaggacccctctaggcggctcccctctctcccgggggctggagtaaggcgggtggtccataagtcatgaagaagggggtcgcactcgtgttgttactgaactcccgctgccctctcaggacgcaggttagcccttggctcttgggcatccatcaagtttctgggcgccctgtatgtcttgaatctcctgctcacgcagggaacccctcaggcccgggtgtgggaagcagggtgaaggagccccgactcttcggaggtcatgcccccagagcgcaggggaaggccgagtcggccactgcctggctgtttgctgggacgaggggatcgagggcctggcagggatagtacctctgagacgcctgcctccggtgctccctcccgccgtgcctccctccctcgctcggtcctccgtagctcctactggcggaaatctcagcaggccctttgttttctgttccccacagcctgggccggctcctgccctcacatatgctccggcacaagctgcaggactgccccctccccctcggcagtgtacacatttactctcctacagacacagccccattgtctccgccactgctcttccccggccctctgggttccagatgaggccagctgagccccccgacccccccacagctgacccaccctgactgcctcgggaaaggagcgggggagggggccgtcaggccggattccttccaccaccttcttggcccccctctctgccactccccctcccggaaatcccctcttcctctcccactcccacaccccctccccccatcctgtcttcttccctgggccttggcctccactgcacagcctggagcagcctctgccctgcctgtcccccatcccccagtgcctgagctgtgctgctgaggcttctgaaggggagagaggtggttgggtggtccctgctcctcacccgccacggtacaagcacaagtgagggtgtccacagccctggctgggccccaagctgcaggctaagcttctgcctgaagcctagggacttgcctctgtcccctccctttctccaaaaccactcagtcagcacattcctgaagcagccaagtggaccccctccccctgggcccacccctctttccccactcctgcctgagctgttaggttggcccaggaaggctggttgccctgtgggcagacacaccccttcagtgcctgtggttgtattgtccttggcattgaagcatggccagtggtagtgggatcaaggggaggaggtgggtgctagaaatccttggggcagttggggcatggactgcctgggtcctggagagtgcctctagaactgggctcccatgtgggctctggttccgcctggatccctgcctgccttccacctacctgactcagacctgccaggaatgccctgccccagggccctgagtcctgctgggtgagccattgctctgcctgagccatgccaggcatgtgtgactggccctggctggggtcagcaagggcatgtcgacagaaagaagcatgccaacaggctccttgggtgctgacggccaggtagggtttggtgcaggagaaggcgggcagctagcaggaggggacggtcaccaggcttcagaagcccactgagcagtgcccagagtcttagctgtgcttgctggacatttttccttgccccagcttctcttccttgtgtgtgtggtgtagtagagcctgtctgagctgtggagtcagacacacatagccaggtgctgcttcacctgtaagcctcttcgtttcatctgtaaaatgggggcattccaccccttctcagaggcaggtggcaagggccgggtgggaatgtaaacaggtgccaaggagcatgcctttcctccccttttctgtgggagacacaccctcaaaggagcagggcagggtaaggtggccgcaagctgacctttgccctggttcttggcagaggaccttcctggggactgggcagccttcgcacttaatctcagcccatccctgttccccctcccagtcagctttcagcgcagccaatgaaaactaacctagggggagggggtgactgtgcagcgtgttcctttcccagtccagctgccatcctgggggagggggtgccagctgccacctgttggccaagtcctgactgaggcagctgtctgtgcctcctctaggcccagaccccccttcccaggacaggggctggggtcttctgggatcctggggaagtagagcccctcaggcctctgcttgcccttttgtctcatctaggctggttgggaaccggtctggtgaggaagggaggctgcctcagtggagggggtggggccaggcctccctttcccctaatgagaaacctttttcctgcccctcccccatttcagtgaaggagtcttcaagtgccctgaggaccagcttcctctggactatgccaaggtgagtccacactgccaggaagaagcccaagcacagtctgttgcccttggaggccggagctgctggcagccagtgggctcagggccagtgtcaaccaaaagccttgggatggtgcgcctccacaaaggtagcctgttccctcccaccaggccagtttgcaaacgaggcccctgtttgccctggagggcatgcacaatgcccagcctgtaggggtgcacagagctgctctgtgcccgcaagaagtgttccctccccttccggtggcaagccagacctgtggctgagggccagtatccctccaccaggggaaaggaagcagagccccagggacagcctgggattgagcaggctgattggctgcctcttcaaaggaagcgtcctgtgcaggcatgttaggacccagcatcagagcagatgctgcctgctgtgcccttcatccctggactcaagaggggcaaagagcccaagagaggctattacaggctccaaggtagagccagcccagttgggtctaggggtgggaactgggcactgcagtcagctctgaccctggccagttcccccatccctacccccagatctacccagacccggagctggaagtacaagtattgggcctgcctatccgctgcatccacagtgaggagggctgccgctggagtgggccactacgtcatctacaggtgaggctctgatgtgagggctggcaccacctctcccttggcaggcactaattgcagccttcccaccagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgaggtgggtggggtctggctgaatgtggaggagggggtacctgatggcctaggcatctcttaactcagcacctctgacatttccagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccaggtgaggccttccctgaactgtgggttgcagggtaggtgacaggtagtcaggatattgactcctgcctctctacttctgtggccccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacagggtgagatgccccttttcctgtcagcccccttttgcccttgaagccctagacagaggctcagcttctgatgtacttaggccttggtggtccctgctgtgctgctctgaaaccctcagtccttccctctgctgccagctccagcctcttcctaacaccctctgtcttcctcacgtagagctgggtgcctgctaccctgtacccactcctctcctctccctggacctccccctactgataactctcctcccttcccccatggcctggggctttgccaacagtgccctaagctggcaatggcacggcatgtggaggagagtgtgaagccacatctggccatgatgtgtgccctggtgagccggcaacggcaggagctgcaggagcttcggcgagagctggaggagctatcagtgggcagtgatggcgtgctcatctggaagattggcagctatggacggcggctacaggaggccaaggccaagcccaaccttgagtgcttcagcccagccttctacacacataagtatggttacaagctgcaggtgtctgcattcctcaatggcaatggcagtggtgagggcacacacctctcactgtacattcgtgtgctgcctggtgcctttgacaatctccttgagtggccctttgcccgccgtgtcaccttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttggagagggggccggacccccgtcagctgcttctgctgcctaggttctgttaccccatcctccctcccccagccaccaccctcaggtgcctccaattggtgcttcagccctggcccctgtggggaacaggtcttggggtcatgaagggctggaaacaagtgaccccagggcctgtctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagcaggggagccctgatttttaataaatccggaattgtatttatt

SEQ ID NO: 36274 - DNA, 39534 bp, Homo sapiens
ggccttcgtccctactgcctgggcgcggggcggggcctgggcgcggggcgggaggcggtgaccagcagcaggaggagaaagaacatggcgggcgcatcagagctcgggaccggcccaggagcagcgggtggagatggagatgattcgctatacccgatcgcggttttaatcgacgagctccgcaatgaagacgtgcaggtactggactgaggccggggacccgaggcgagaccggctggtcgcgtggtagagaagggggaaggcctgcgtcgcggtgggggtggccgaggtactgaatgagtcggactcgtagcagaaacttgaaggggaggcggggaatgctccgcgaggggctgtggtgacacgccccgaccctcccgggtacctctctagtaaccttgcttcggaccccctgaggcgtccgcccggagccttgcccttcccgggcggttgtcggggaacccgcttcccgcctgggcgccccatccgggccgtgaggtggccgcgtctcttgggcgagggagcaggagaagcgcggtgccaggccgagacggggctggagcggctgaggggcgcaggatgcccagaagccctttgaagtgcccctggatcccttcatctcggcttggaactggctcggcttgttgggtagaaagcgggggtgggatggccgattaatctggacgagtagtgtatccgctctgtgggaacttttctttgaaaccacaggtgttgtattcaaccgtttcacctgcttcaccactgccaaagtgctctctttttaaaattatcttacttcctaggtgttgtattgtctttccttcatttctcttccggtcccttctgagtgtttctcctgggaaatcctccgccggctagtgaggccgagttacacttctttttggaagtccttatgagcttccttaacagtaaaatctaaatgaaaggttatcttcattcttacccctgtgtcataatttcacctgttagcaccttttgtcttttgatctaaattcagccgtttctttacattgttcttctttctactttcttttctgaagctccgactcaacagtattaagaagttatcaacaattgccctagcacttggagtagaaaggacccgaagtgaattgttgccatttcttacaggtatgtgaatctttgtttaaagaaaggtagggacattccattttccagtagctttcaacactgacttttttagagtttattacccacattaaaatgagccaggtgttttttgtgcaaaagaaacagaacagagtatattgttagttgtggctagatatattcaaacatcaaccatttagctattgaaagtaattgatacgggagtatgaatttctaattcgttgtgcaaagcagatacaggaagacggttgagaagaaagaaaatgctgttaggattttgactgggtcaccttcctggtcgcatagtgaatctgttcctagttttgtgtcagtgtccagctgtgggagagctatccatgttgatgagtcctgttgttgtcacttccagatacaatttatgatgaagatgaggtactattagctcttgctgagcagctgggaaatttcactggcctagtgggaggtcctgactttgcccactgtctgctggtgagtatttataagctgcctaccctccttctacaacttttgcagtataaatgatacattgtttggtgatagacacactgcagcattttttatgcagatctttttatgggcagatagtcataatgttagtcattgagagaataagtactgtaggcactttgcactcaactccttttttttttttctgtaaataagagaacttcgtcctccttttctgcgtctgtagacttattagtttagatgtagggagaaaaagggtttgattgtttttatggttcccccgcgcgatggtggaagttttaattctcacctagcagcattttgtctttgtcagtttaacttttgcttctgactttgtgagtttgatgaatttagttcaatttaattgacatttattgagagtctactttatcagacacatcatagtttacaatgttaatgttgaagaagaccaatgtgagggggcttggtggcacaagcctgtagtaccagctactcaggaggctgagactggaggatcacttgagcccaggagtttgaatccagcctgggcaacatagtgagacccccatctcttaaaaaaaaaaaaagaccaccaaaatgaatctaatgaggtcactgcctttatgtgtcagcaaataattaccgtgcagtcgtaaatggaaagatataagtacccacaaaatacccacgtaatagaagggagaaagggattcactccgggtgatcagggaagaccttgggagatgatgtctgaactaggttttaaaggatgaccaggaattcaacagttggacaaggtaggggtgtatgtgtcagagctttgaatactgggtatgtaatactgattcttgtgatttctgtctctagttctgacttttccatggaactcctgaggtagattgattaatagataagtatgaatatatatatatagagagagagagagagagagagttttttttctgtctatgtatataggcctatgcttttttctacttgtatgtcaaacaggtatttcaaacttaacatacccaaaacaaaacttagctttatcccccaaatacacctctcatttagttgttccacttcagtaaatggtatcactatcttcccacttgcacaagccaaaacctagaatgtattcttgaatcctctgtgccttgttccacacatctaatccattagtaattcctatagagtctacgtatatttcaaataagtccactttcttccatccctcctattaccagcctagtccagactgtcatctttcctctagattgctgtagtagcttcctagcaatgctttccactcttgcctctcacccgactcttacagttcacatcacccagcagatggctcactctctgctatagctcttagaaaatccaaattctgtaccttagcttacaaggctttttatgacccgcctctgtaggattatcatatgcccagtggtactgcatgagaagaggtgacagtaggcagggaacagactgcaaaaggccttgataacctcttccattcacattggtcatctttctgttttttgaactaaccaagctcattattcccttaggacctttgccctaggtcttccctctaatgaaaagctctttcaagctttctgtggctggctccttgtcattcagggatcaacttcaatgcatctcctcagggaggttttccccaaccactcaacttaaaatagcctcacagtcatcccttactacatcatcctactccttttttctatagagtactcatcaccatctacttattttcttgattgattgttgtcttactccattagaatgtaaatgccactagagtgaggaaccttgtctgccttgtttcttctgtgtcctcaatgctagaatataccaataataatgtattgaaaaaatgagtttcagaggcttggaagcatgaaacaggctgggttcaaaactgccggagtgtggctgggtgtggtggctcacacctgtaatccttgccttgggaggccaaagcagcaggaggattgcttgaggccaggagttcaagatcagcctgggcaacatagtgagaccccaacacttaaaaaaaaatagctgggcatgatgtcatgtgtctgagtcctagctattcgggacgctgaggcagaaggacgaggagtctgaggccgcactgagccatgattgtgccactgcacttcagcctgggcaacagagcaagaccctgtctcttaaaaaaaaaaaaaaaaaagaactgctggagtgtgaagtgttgaggctgggtaggcagagtggtcatcaagggccaggcagagttcaaatcaagagaccactcataagcaattctcaggagcatggcctcatcctgtagtaatgatagctattatccagtggtactgcacgagagggggttacagtaggcaggggacagatcatgaaatgcattggcaagtgagaaacagtatcttttcaatgagtttctgaaataccttctaggaaagctgaatactgtctacctgtgtgtatcaaacaatttttaaaatatattattagacacacttcttttctttaactcattatgcttctgtttcactcttggttagttctatatgtgggttttatgctttaaaatctgtagctcatggcatgtgtagaatctacctggactacatgcaaactcagtaaggcagaggttcagagagccagcctgtttacactttttactaggccatgccatattcagttactgctcttaatccagaccatccaccccatttggcttcttttatttctaaagctgtaagcaaggtgtcctaccatctctgtactttaccttttttttttgagacaagagcctcactctgtcacccaggctcaagtacagtggcacaatctcggctcactgcaacctctgcctcccgggttcaagtgattctcatgcctcagcctcctgagtaagctgggtttacaggcgtgtgccaccatgtctggctaatttttgtattttttgtagagacagggttccaccatgttggccaggctggtctcgagctcctgacctcaagtgatctgcccacctcggcctcccgacggctgggattacaggtgtgagccaccgtgcctggccagtctctgtagttttcacttgattgttctgtcagaaactcctttctgccctatggctaatggaaagttgctgaatgtgttctgaaaaaagcaattttgcattcagcattttataggttggataaaaggatgggatggagatggtggataagggttgcttgcacctctgggaatggtggaaagatactgaaaaggctgtggactcagtgacctgacaagctgttatcctgtatttgtggtgcctaacattggtcatagttttgtacttactcttgaggaaatatacatgatcctgtctgaatttggctatgtatcttttaaacctagtgattcaactcacagtaatattaatattgtgtcaagtcttttacactgtgtcatttgtagacaccatctgggaattgccatctgggacacgagatcttggcttttctacagaagtcgtgtctttgggttggccgcaccatatgttatcactgtgtgagctgaaagtaaccatttggtatgatgcagctaacattctggttacgtgtaccacctcccttcagtcactttaaaaggtgattatctgtttctaacctgattcaataagttttcttctctggttttcctttttaatccattcagcctcctttggaaaatctggcaactgtggaagagactgttgttcgtgacaaggctgtggagtccctgagacagatctcccaggagcatactcctgttgctctggaagcttattttgtacctctggtgaaacgcttagcaagtggggattggttcacctctcgcacatctgcatgtggtttgttcagcgtttgctatcccagggcatcaaatgctgttaaagcagaaatcagacagtaagccatggtatttttttgccttgttaaagcagaaatcaggtagtaagctatgagttatttgggattactggggacttgtagctgacaatttacatagtaccttgttaccaatgagtggctgatactaggatagtaggatttatgacatctttcttttttttttttaagagataaggtcttgctctgttgtctaggctggagtgcggtggcacaatcatagctcactgcaaccttgaactcttgtgcttaagtgatcctccagcctcagcctccaagtagctaggactaccgacatacactactgcgcctggctaatttttaaaaaaaatttctggctggatgcagtggctcatgcttgtaatcccagcactttgagaggctgaggtgggaggattgcttgaactcaggagttcaagaccagcttgagcaacatagtgagaccttgtctctactaaaaagaaaaaaattagctgggcatggtgggacccgcctgtatttctagctactcagaaggctgaggtgggagttcacttgagcccccgacaaacaacaacaaaaatatttttggcatatagatagggtcttgctatgttgcccagtctgctttcaattcctggcctcaagcagtcctcctacctgggcctcccaaagtgctttgattacaggtgtgaggcaccatgcctggcctatgatgtcattttttattatccagttgaatatgttttatttttgttacttctataagtagaagcttagtcactgattattgtaagataaaacctctaaaagtctgtctgtgtgtatggggggcaggtttattcagtgttatttgatgggaaataccttcattgttttatgttgcaggcaattccgttccttgtgctcagatgacacaccaatggtacgacgtgctgctgcttccaaattgggtgaatttgcaaaagttttggaattagacagtgtgaaaagtgaaattgttccactgttcactagtctagcttcagatgaacaggtaaactaactcttagtatttaagggacacagatatgctcctttcctctaaattttcagaatttctttggggagttttagttttcttgttaggattctttttacagaattagtgctgattctggcctggttaaagtgtaacatgcttatctcaatgttcttatgtttctttcttaaccagaccatgatttctctcttacattagcagctgttaaaagagtggggagtcagagaggaaatgggagccataattagaaaggaagaccaaagctgcatggagggtaacatacctttgggaattgctggctgtattgtaatatgagggagtaatgtttcctggaatttttgacttttcagataaataagcttagaatgtgttaggaaagctatttgactctctgcttcttctatagtagtgtatgggattacttcacataatcgtattcaattctgaagatctagatctctttggtgtagaaataacaataaaactagcaaacatccaaatgaagtacttaatttttctctgcctttaagtagttatgtgtattaagtaattcagtccttacaacagccccatgagatagcccattttacacattagaaaacaaaggcacagaaagtttaagtaacttgctgaagtttgcatagttagcagtagtggagtcagaatttgaatctaggtggtttggctccagaatttgtgcccttcacagctaggctgtcccgcttctctgtaatggtgcttaataggatcagctcccagagttcctggactctagaatagtccttttgggcttttaatttgcatgttgcctgccctaagatcgcttcatgtgtacaggaccacaagccccaggacacatattaatgagtctcattttcagatcctaaatctaaagatctaaatcctactttgaaaataattttaaaaattattagaatttttattctaataataaatgtacaaaatgaatgtataacttaatgaactattagaaggtaataccaacttgttaacgatcacctatgataggagacatcactttgacagccactatcccagaatccctccatggattccctttcaaacacaatctctctttcctcctccacttgccactccatttccttaagagtaacattatcctgacttttatggtaagcgcagcctttgttttctttgcactttttcttttcttttcttttctttttttaaaaggagtctcactctgtcaccaggctggagtgcagtggtgcaatctcggctttctgcaacctctgcctcccgggttcaagcaattctcctgcctcagcctcccaagaagctaggactacaggcgcatgccaccacgccaagctaacttttgtatttttagtagagacggggtttcaccatgttgaccaggatggtctccatctcttgaccttgtgatccgcccaccttggcctcccaaagtgctgggattacaggcgtgagccaccgtgcccggccttctttgcacttttattacctaaatgttatagtttaaaacagtgctttacaacagaaatataatgtaagctacctgttgattttaagttttctactggccatgtttttataagaaaaaagaaataggtgaaattaacaatatttgtattcgaccaaaattttccaaaatcttattatttgagtgtaaataacgtgtaccagccacatttcaagtctcagcatgagatgatgttgttaatagggtggtagtgaagatggaaaggatttggatgtcagtttggaagtgggatcaataggttagtattattggattggatcagtgggagaggaatcaagatctcctagattttttgcttgagcaactgggtggatgatggtgtcatcgttaagatagagaaaattctgggaagaggaacaggtgtaggagagaaaacgaagttctggaagagaagtaatttttttttttttttttttgagatggagtttcactcctgtcgcccaggctggagtacaatggcatgatcccagctcactgcaacccctgcctcccgggttcaagtgattctcctgcctcagcttcctgagtagctggaattacaggcgcctgccaccatgactggctaattttttgtattttcagtacagatggggtttcactgtgttgggtaggctggtctcgaactcctgaccttgtgatctgtccgccttggcctcccaaagtgctgggattacaggtgtgagccactgcaccagaccagagaagtaattttttaacaaatatgtattagcttatatttcagtagttgattagcagtcccatgatttagcatcattttcgaaattcaaaaatatctgtgtagtcactaccaagaacttagtcctgtcttttttagcctgtgcacctgcatacagaggaatgtgtgtgtctttggcatatagtcagttattgttgatacacagtttctaagatttgtaatattttggaagttggagtcactgttatgtctctcaagtatgtgtatacgtatatacataactgttattgtacacacttaaaattttttacctatttctcctgggtgctaatgtttacatgtattaagattctaccttatatatgtataatacacaaatctacagtctcaatttctaatttctcattgatgtttcttttttttcggtgtttttttttttttgagttggagttttgctctgtcacccaggctggagtgcagtggcgcgatctcggctcactgcagcctctgcctcctgggttcaagcaattctgctgcctcagccacctgagtagctgggattacaggcacgtgccaccatgcctggctaatttttgtattgttagtagagatggggtttcaccatgttggccaggctggtgttgaactcttgacctcaggtgatccgcctgcctcggcctcccaaagtgctgggattacaggcatgagccactgtgcctggcccctcactgatttgtcttgtatattttccacttgttcaaaggacgtaggtgtcacgttgacattggctgtttacatttggaaagttgagttcattaatcccatacttttctaatttctgtgtttttctagccacagcttcctcaaagttattctgtccttgatcttcgacatttaaatccaactgatttttgtttttgatttctaacttttaattgttctgtgtatttctttccaagtcattatcttatgctgcctacactcctgttactgcgaccctgatctgagttttttgaaaactaagctttctaagtgatttcctttactcttactcttacctttgtcctaatctgttataaataacttgtacaaatattgttttcatttttatccctcaactttctgttatagtaaggctttgaaggcatcattaaaatgttttttttttcttttttacttaattttaaaattttcatttcctttatagaaactctgcattctagccaaggtaattacttggctgtttactcatagtacaaagtcatttctatctttatgactttgacatgccattccaggcaaagggagcagctctttctttttttttttttcctttttgttttttgagacagagtgtcactctgtcgcccagactggagtgcagtggtgcagtctcggctcactgcaagctccgcctgctgggttcacgccattcgcctgcctcagcctcccgagtagctgggactacaggcacccgccaccacgcctggctaattttttttgtatttttagtagagatggggtttcaccgtgttagctaggatggtttccctctcctgacctcgtgatccgcctgcctcagcctcccagagtgctggtattacagacgtgagccactgggcccggccgggagcagctctttcaagatataaatacacggccaggcgcagtggctcgcgcttgtaatcccagcacccagcactttgggaggccgaggcaggtggatcatttgaggtcaggagtttgaaaccaggctggccaacgtggtgaaactctgtctctactaaaaatacaaaaattagctgggcgtggtggctcctgcctgtaatcccagctactcgggaggctgaggcaggagaatcacttgagcctgggaggcggatgttggaatgagcggagattgtgccactgcactccaatctgggtgacagagtgagaccctgcctcaaaaaaaaaaaaaaaaagaaaaagatgtcaagacgtgaaactatataaggtgtggcagtcttggtggtgttaatttttttaaacacctgcaccaccccacagcagttccccatgggtctcagtaaatgtctgaattacagaaattttgttcctttaggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagaggtaaagtgatcatttttaagtactaaggaaataaacctgaaaacacatagatttgctgttgtacccaaagtttctgaattaattcttttcaatgggaagtgctgtggcaaaaatatgtatttacagattgcacaattttgttttgttcttgttaattcttttgttagtatacattaaaacccgttcaaattcttttatagctccagaaagccatgggtcctaaaatcaccctaaatgacctcatccccgcctttcagaacctacttaaagactgtgaagctgaagtccgggcagctgctgcccacaaagtaaaaggttaaggagttcaatttatgttggaacatgtgtcattcattttggtgcatttttttgttagtcaattttgcatgttttttgttctagaatatgtttttaaaatacatagggatgtttttagtgtgtggaaatgttacattgtcacttaaagatagtctctttatatttaaaaccaagaaatcattttgtcttgtttttgtaaaaaaaaaaatgcctttcaggttggattggtgtgatatgcaatggcatagagagttcacgaaaaagtttatttagaacaagagctgttttccttatttgcttaaacatataatttaattgaaattattgataaacctggttaaatgtcctcatttggctctttgtaaatggccctgtgaaagcattctttttttctatttatcttttagaacttggtgagaacttgcccattgaagatagagagaccataattatgaatcaaattctgccttatataaaggtaaacctgactttattttgtttcactctcttttatatgaaggtaaaccttaatctcattatttttgtttgtttgtttaccttaaagctctttgagtttaaaggttgacagggaatgaatggggaagatgtgttaatgtgcaacattgttattcatcacttattagcccattgtaattgtaaactgctctttggtgcataggtttatgttacctaacaagtagtctgaggaaacattatcaactaatcagtattgaaatagtgctgtctttaaattccttggggtcaggcatggtggtacatgcctgtaatccaagcactttgggacgctgaggtgggaggatttcttgagcccaggagtttgagaccagcctgggcaacatagtgagaccccattgctacaaaaaatacaaaaattagttgagcctggtggcatgcacctgtagtaccagctacttgggagtctgaggtgggaggattgcttgagcccaggaggttgagatggcagtgagctatgatcatgccactgtactccagcctaggtgacagggtgagacactgtctcaaaaaaaaaaaaattaggccaggcgtggtggctcacacctgtaatcccagcgctttgagaggccaaggtaagaggattgcatgaacccaggagttcaagaccagccctggcaatgtagtaagaacctgtctctgcaaaaaatgaaaaaaattagccaggcctggtggtgcatgtctgtagacccagctactctggaggctgaagtgcttgagcctgggagggtgaggctgcagtgagccaaggtcatgccactgcactccagcctgggcaacagagcaagactctgtttcccagaataatggtatggaagtttctgttgtcttgtaataaaggcttttaatttcgattttattttaggaattagtatccgataccaatcaacatgtcaaatcggctctagcttctgtaattatgggattgtctactattttgggcaaagaaaataccattgaacatcttctacctcttttcttagctcagttaaaggatgaggtgggtcttgctttatgttctgttgcctttgatagtaatttgattttatttgattttggtttagggtttcattaaaatagaacccccaaaaagaaaatggataaaaaaatcataacttattttaaaccaatgacacctgtgattttgggtatggggttataggttcctcagaaagtgggcaaaagtacccattagagtaaacctagaaatatctgtttatcatctttacctgatttttgctttatactccctggtttctttaaagctaatgtgtctttgtttaaaaagtttcatttatttaagtttaaatatagtatcaaaaattataatgatacctaatatttactgagtaattactacatggcaagcatgagccttagtgctttgcatgtatttttacatgcaattctcacaacaatcctgtgaggtaggtcttattattatccctttttgtttgtttgtttgtttgttttgttttttgagacggagtcttgctctgtcgcccaggctggagtgcagtggcgcaatctctgctcactgcaagctccgcctcctgagttgatgccattctcttgcctcagcctcctgagtagctgggactacaggcgcctgccacagcacccagctaattttttgtatttttagtagagacggggtttcactgtggtctcgatctcctgacctcgtgatctgcccgtctcggcctcccaaagtgctgggattacaggtgtgagccaccgcacccggccaattatcccattttacagatgagaaagctgaggcatagagggttaaagtaacttgagcaaggtctttcaacaatgacagatctgaaatttgagtgcatctgatttagttccagagattatgctctttaccatcttacggacttttcttgtagtctttagtattacggacttttaattgaaatttctgattaagatcatttatgttccttgagttatttatgtattcactattatttcttcaagattatccatttttttttcacctgagtcttacctcaccttttatcttaccctgacaggagactgttgggcagagtacttgatttttaaatgtggtcttttggggcttgtgtacttgcagtgtcctgacgttcgtttgaatatcatctccaatttggattgtgtaaatgaagtgattggaatccgtcagctctctcagtctctccttcctgccatagtggagctggcagaagatgccaaatggagggtccgcctggccatcattgagtatatgccgctgctggcaggccagctggtgagtatgtgttgctccatgaactgcagggtagtgtcagatagtgacaatttaccatggcaagtaggaggcctagtagcctgtatgcttatgtttgtttagatgcatgaaagtatggccttgttcttgttacctataggatggtttttatgtttgttagtgcatacgtttcttttcttttaagatggagtttcactgttgttgcccaggctggagtgcaatgatgcaatcttggctcactgcaacctccacctcctgggtttaagcgattctcctgtctcagcctcccaagtagctgggattacaggaatatgccaccacacccagctaattttgtatttttaatagagatggggttttaccatgttggtcaggctggtcttgaattcctgacctcaggtgattcacccgcctcagcctcccaaagtgctgggattccaggcgtgagccactgcatctggcctattagtgcatacatttctaacaaaaaggtataggttgagtatccctcatctaaatacgcttgggaccagcatgtttgggaccagaagtggattttggaatatttgcattataaatatttactggttgagcagcccaaattcaaaaatgcaaagtccagaatgctccaatgagcatttcctttgagcatcatatcagtgctcaaaaagttttggattttggagcatttcacattttggatttttggatttgggatgcttaatctgtattacagaaacatatttcacctcatcaccaccgaaaaacaaagccatagaataatcagtttcttggtatatataatgtaaattttataatatttaatgcctttgtgacttaagaaatgtttaactgagaagaaaagggattatggttttagggtaagtctgctgtgatttttgctcaaggaaacttccctgtttgccttgtattctaagcaaaatgtccctaggtaccacttgccctacattctgattaaagggagttgaggaatcaccatatagaaaagaagtattgaaaggccgggcacagtggctgacacctgtaaacccagcactttgggagccagaggcaggcgaatcacttgaggctaggagttccagaccagcctggccaacatggtgaaaccccatctctactaaaaatacaaaaattagctgggcacggaggtgcacacctgtaataccagctactcgggaggctgaggcaggagaatcgcttgaacccaggaggcgaaggctgcagtgagccaagattgcactactgcactgcagcctgggcaacagagtaaaactttgtgtcaaaaaaaaaaaaacaaaacaaaaacaaaaactgaagcttgtaatgttagtattttggtcaaagtccacattatcacattatctgttactgtttgagtttcgtgatcagtgttaccctaactaataccatgttagttaaaatttcaaagctgggttttatagccacatcctttcctttttttgagtaggtggcctagacagttctaagtttgatgtaccttcatctctgttggtagcacttattacagagtattgtaattgtctgttacagtctagttggagagatgggtgatctcttttagggcagggactgtattttatttccagtccctaccatagtgcccgtcattaattaggcacttaacattttttattttgggggcagggtcttgctgttgcccaggctggtcttgaactcatggcctcaaatgatcctcctgcctcggcctcctgagtagctgataataggcatgagccactgtgtatagccaacatttgttgattgttgagtattttttgagaaagatgtgtcagtttactattgacatcgctacagtttgtttccccttcctcactcccacttccattcctttcaggtcacaacatatggaatttattttttcttgtcttgaacccctgaatttgtatttttaattttagtacatttagtttatgaacatgcaatttgtggatgtctgtggcattatatgttttataaaattgaaagtgtccgattctttgaaaagtataccagaggtattagtgcatggcaaatgggatcaggtgaagttattttgtcatcctttttgtctgtcactcccaagtgctatgggtcatcttctcttcactggtgattgtcatggatctacttttcagagtggagaggagcagtgattaactgatttgctgaagaccaaaactatctggaagggagggtgcattttagtaccatttcttttaacctctgctccttctagacctggaaagtttcccagggttgctagctctatagagagcagtgtgaaagcaaggcagatggtgtctttggctgacttacacctgtctggcaggggtgacatgcctcagtcatgaacattttgctttacaattttaacttcttgttagtatatatattctccttaatttctcttcatatctaaatatttttatatcagatagtcattttataaaattctctcaagactttatgtatgacctggcttgtggacgatgttaagtaagtgtaaagttaaactacaaaaaccggaaaataggccaggcgtagtggctcacgcttgtaatcccagcactttgggaggcctaggtgggtggatcacctgaggtcaggagtttgagcccagcctgaccaacatggtgaaaccccatctctactatacaaaaaatttagccgggtgtggtggtgggtgcctgttacttgggaggcttcttgggaggctgaggcaggagaattgcttgaacccaggaggcggaggttgtagtgagctgacattgcaccactgtactccagcctgggcgacagagagagattccgtctcgacaacaacaacaacaacaacaacaaactggaaaataaaagttaattaaaactgaaggaaaattctcaacctgaaatgaaaaagaaatcttggctgacgtaatctaagtgtatgccaaaatttgttcattatgatcttttagtacaaagcaattttgggccaggtgcggtggctcatgcctgtaatcccagcactttgggaggctgaggcggacggatcatctgagtcaggagttaagagaccagcctggccaacatggtgaaaccctgtctctactaaaaatacaaaattagctgggcatgtgctgcatatctgtaatcccagctacttgagaggctgaggcaggagaatcacttgaacccgggaggtggaggttgcagtgagctgagattgtgccactgtactccagcctgggcaatagagtgagactccatctcaaaaaaaaaaagctattttgtcttattcaatcactattttcaaagcactgacacattatattacctctctttttttaaaatatagaatcaccagtcaggaacttcttagagttcaaagaagcaagactgtaaatgtgtagaccccagaagggaggcactaggaaagtgtgtcacagcattctccatgtggtgtggaagccccggggttagaggactgtgtaaatctgctcccggagcccatccccagcctgcactgaagtggccacctgttgacagtcgggaggaacagggctgggagagcaagccatgcctgggccatatgccctgtagtcctgggcctgctttattctccctccagggctttctcctgttgtctcgaaaatactctctttaactggggatatctctatgtcttgaggtcagttgctttatccttaaggatttgtcataatagtaaccaaaaagggaagacgattgagaattagtaatattactgacaggtgttttcctgggtaattcatttttacaggtaatccagatttgcttggcagaccatacacagtgcattcttcctgctcttttgcagtgttgtggctgacttctggccaccctgttctcttttacctagcagggcctatgccagctcacgtatgctttttttttgtttatgatttccgtccaataaatagatttatggtttgtttgtaattcctgtggtgtttctatctcttatttgtttatttggaaacaagtttttttagccttcaggtaaccttggtgtaatgtaaatagaccatctttatttctgaattttggcaatgtatgttaatggaatcttctgtatctgtagggtgtggaattctttgatgaaaagctgaattctttatgtatggcttggctcgtggaccatggtgagtagataaaaacagattattgaaagcccatatatccatgattttcatacatttccttttagaaaggaatctcagtctgaccagatattttgccttaatattgtaggaatgaagaaaggctctaattaaagtttaatcttctgaatataaatttgacgtttctaccaattttttgtatcttcgattttattttctccattaaacaatttatttgcattattttcttactcaatctattacattatcttcagaccatctcttttatatatctacttactcctcccttatctgaagatcctctttttgaccatcctgtaattggtgtcttcagcagctatacactaggttgtatggagattggaatcagatgaaaggcctgggtgggagaaatggctacttggctttttgaggtgacatagaagaggagatctacagtgagacagtagaggattcttaggtgtgggaaacactagctttgccatagggagagagagggcctggatttctggtttgggtgaaaggaaggcttactgcttgtactctcactgctgctgctacagtgctaggagagggtgagctcagggcaggtcagataggacagcaggaatgagcaagtgacttcctggtgaggcttcaggtagaggtatatgtgtgtatccccttgtgtgccaggcagcagtgggtgacagatgtaccgtctctgccagatcccaggtccagacttgacagcttcagtgttgtcttagacctgtttcgatgagtgtgagtgcccctatggggtcatgtgacattgtccttgagctttgtttccatgttttggtggatataatagataacctgagtcagttccacagtatcttttatatacttgatatatgtatttagtgtatctctttgttcatctatgggtgcttatgcctggaaatttgggaggaatgaggatatttgtgtctgcttatacgtgtgggtggttttgttaaaggcatgtttgcatcatatggaggatcatatggttaagagtgtgaagaggaaggatgtgaaaaaatatgtgaaaatgtataagggcttatatatgtgggtatttccagtgttttcaaactggattgtagacttctttctctttttcttctctaaagttatcttattgtggcctatttatttctttttaaataaaattaaaatttggcaaatcataggaaagaaataccacttttaaaaaaaatgtttatgttatatctgataaatatttgacgttactgggaatggtgcatcctagcaaatcattctgtgcttttttaaattttattttactttaagttctaggatacatgcatagaacatgcaagtttgttatgttacatagatatacatgtgccatggtggtttgccgcatctatcaacctgtcgtctaggttttaagccccacatgcattaggtatttgttctaatgctctccctcccctcgcccctcaccccctgataggcctcagtgtgtgatgttcccttccctgtattcatgtgttctgattgttcaactcccacttattagtgagaacatgtactgtttggttttctgttcccgcgttaatttgctgagaatgatggcttctagcttcatccatgtccctgcaaaggacatgaactcattccttttttatggccgcatagtattccgtggtgtatatgtgccacattttctttatccagtctgtcattgatgggcatttgggttggcctcaagtcattctatgctttctttaaaagttggcattttagattaagatggtgttttattttgaggaatttttaaagttctaatattccacaaagaattaaattcctggcaccctttctctgtaagattgtcttctctatgcaacttgattactccttcctcttttcggattttctctttcagtttgggagcaggagaaacccttgtttatttcactgcagcagcatgctgaagtggggactgcaagagttccatgaaccaatgaaataacagctctgaaattgttttgtacttaatcacaggagcttttttgcttttgcatttcagataagtgttatataatgatcactggatcagttagagtttttgaaacttttcccctagttaggtaactactaaaagaacattgtgaaaattccagagaagtataaggaagaaagtatcactcacctatattcctgtggttgagtagacagttttgatcagagggaggaatgtagaagggaaatttatttatttattataggagaaaggagaaggtatcagttattgagcatagatagacattcaaagaaaccttgcaggtcagccaggccttgagaggagatggggagagagaaagagacagaaatagacaaaagaaaacaggcagaactctggaatggtttgcattcttctgaaaacagtcagaggaaccaagaacatagtaggcatctggccaagtagagttcagtgcagttaaggtcttggtcaaggctatgcatgtgtgttccccagtctctggtttttctggcagtagagatcccttcctatggtaatggcattatgataaaaatctaaagcgtgttaaaaaaaatagtaatttgctgagcatggtggctcatgcctgtaatcccagcactttgggaggctgaggcgggtggatgacttgaagttaggagttcgagaccagcctggccaacatggtgaaaccctgtctctactaaaaacacaaaaattagctggatgtgttggcgggcgcctgtaatcccagctactcaggaggctgaggcaggagagttgcttgaacccaggaggcggaggttgcagtgagccgagatctcgccactgcactccagcctgagagacagagtgaggctctgtctcaaaaaaaaaaaaaaaaaaaaaattagaggagaagacacaaatactctagctagctcctctttagtggggaggacagggaagggtttgggccaaagacaaagactatggatatgaagggaaggaatctgtattacagtaaaacagttgacttgagtttgctccttagtgcatctgagtcttaccgaaaggttgcttctcctgtagactgtcagtttaagtgttgataatcagttgtatgggtcacttgtctatgctgtcttgcttgttctcaacatcattgcccagaaggatctatgaatagaagaagttgcctatttcttggttggaggcttgtataaattgcctaggactgggactgtggcttggatagctattcctgcccttcctatcatcccaggaaggttgggcccacctggggagagaagtagaataaggaattagtacctaccaccctcgatttgttaatctgagcccaaattttgagtcttactggatctgtaaagtgaagtgacaccaggcttgtttttgttcagtgctgtatatagcaactaattgtgagaggattgtagctgagacctttattatctagctttatgtctttgataaatgatcaaaggatatagggaattattagatgttaaggcaggcacattgattcaaagacatttgacatcttgtttcaacctaagcattttcatggagaggaagcaagtcagtctgatgtttgtatttgctgttgtatagatgaccacagtggcctctacaccatttccttgttgtctttctcagtcaacgtcgcttctccgtgatgttgctggaataatcttgctaaaattccacattggtcatcaggtcacaagtttgctttaaaaacccatcactgtttttcctaatcaaatctaagtctttcataatgctctgcagtctgggtccaccctaattgtctaacttagaagtctcacaggtttcagttttttctgtttgtgtcctggatacatgtctttaccctttctaggaattcctccccgcttctctccacttacacagatcctcccaaatcttcactgcccagtcaaggcttctttctgtgccgaagccttcctagaccttccctgttcactcttctctgcactgctacaaccctcacagcctttactacacaatgccacacttcattctaattgctcttacaccatgtgacttcatggagtgtgttagctttcatttctctgataagagcatatttcttgtgagggaaagtatcttctgtgttctttttgtagcacatagtaggcacttgtatttgttaaataattgatgatgcatatggtgagctccttgcatcccttttctgtggatatgcacacttggaaactgagttggagctgagcatgcttgtcattgcagcatgattacatgtggagtctgattgcagaggggttttgcttttggtccacatttgattttcatgtaagtaaactaggttatgcttaaaaaacaataagcgatatgagaacatgtttttgacctcttctgcagtatacgccatccgagaagctgccaccaacaacctcatgaaactagttcagaagtttggtacagagtgggcccaaaatactattgttcccaaagtgttagtaatggcaaatgatcctaattacttgcatagaatgaccactttattctgcattaatgtaagtataacataactgttattgctaagcttaatcattaaagcaaaattattcatgactatttctgaattatcagtatactgtcttctatttggaatatatgtcttgtattgattaattggaatagacaggagatgagagaaaatgtcaattttaaaattcatgttaaaatctacagtattggctgggcacagtggctcatgcctgtaatcccagcactttgggaggctgaggcgggcagatcacctgaggtcaggagtttgagactagcctggtcaacatggcaagaccttgtctctactaaaaatacaaaaattagccgggcatggtggtgcatgcctgtagtcccagctacttgggaggctgaggcaggagactcccttgaaccttgggcagggggcagagggtgcagaggttgcagtgagctgagatcgcgccactacactccagcttgggcgacaaggcaaaactccgcctgaaaaaaaaaaaaacaaagaacaaaactacagtattttaaaagttcaacttatttgtgaattctggtctaattctctgatcatttgaatgattcttgtgtcccccactcagctgctcaaactagaaatattttcctattggtcaattattttcttattaaatattaatttgtttcattagattttggaattttttaaagtattttaaatgtgccatcttacttatttttctaggcactgtctgaggcctgtggtcaggaaataactactaagcaaatgctgcccatcgtattaaaaatggcaggagaccaagtagcaaatgttcgcttcaatgtggccaaatctctacaaaagattggaccaattctagataccaagtaagattttagtgtttagtcttgttttaaaagtgtactttaaattttaccttatagtggggagtaattagctaaaattaagttcagggattttcactttacttaagatctgggtttgcttaaagaaaataatttagcaactatttttgaggatgtccactatgacttttatatttaagctctgtaaatgtgtagatccttgtctgaagctgattttgctgagaatttctttagacattattttgtgtatttgtcaagtttataaatgtctttatttttttactttaaattttaacaattaccattaaccatatacaccaaaaaggatttctatggcccattagactgtctttcacagataatacttttgaatgtcagtgctttacagggagaagtgaagccagtactacagaagttaggtcaagatgaagacatggatgtcaaatactttgcacaggaagctataagtggtatgtatttccttcttttgccttgcagcttatgccttggttaactgggatttatctctattatgtgagaggtgttaagtgggtaggatgataagtattatgggaaacagggagggtagtaagttcctggaatgctggtgtctctctgattagaaccctcttggcccaccattttctcataagtgagcaggctatttttcttagttacatgtaggactgggtaggaaatacgattctcactggtaagaatagtttttcgtttggaatttaaccagtttttaaagtttcacttctgattagcctggctgagtaaagacagtaaccacagtgagaagttgttagtttgatacgtttggatcattgttattgtgcttaatattcacatagatcgttcgtgaactttctgtaccactaacctgattttgtttggaattttccagttcttgcattggcataatgaggagcaggagggaaaaggcctttactagattcttgtcacaaatttctagtcaatgtgttcttaactgggtggagaaagaatggaaaaccttcaagatctcatccaagcaaatggcaacaacttagaagaaatcatttagtgacttaattctttctaaagatgaaatgggattgttttttactcgtcttccttgttaaatcattatttaagccgttcttattgaccaattcctgacacttgattgtctcctaatgctttatccatcaccacctgggctcctgcatcctcactgtggaatcaggcaccagccacataatgttccagacaaagcctggaagggtgtggacccagacgtggagtggagtgattctcttgacgtttacatatatctctgtgtctctccatcattccaaagctaaatgtacatgtttagaataacttattttataaactcttcgggagacatgttgagatttgaccgtaatgaaagccacattttcctgaattatgatggtctgcattagtctcatgtgaaaggggaatgtggaagctcagggttaatgtagtggttgttttggtttttatttgctcaattttgtctgtactcatgtcattcagaaacctgaagtgtggctgcatcttgctgctaatgtgtgatgttgacgcctaactgaatttgaacagctcaccactgtgcctacatttaaaaatacttctctctcttttctaaaaagctttaactgtagtgcctcctaataagcagtatgtttgtttcattgtgagattgcagttctgtatttcgaatgagtctaagaaccacagggataatactgtgcagatttcctgttctttacctggctctgcttccagcagtattgacacctagtccttgctgcattgtacagtagcttttcaaactgcagttttattgctaagtttttagtatgggtgatactggagtcttatcatttgaagtgtttgcttttctacttttacagtaaaacctcattaattctgaaatttaagataatgagttaagctgaagagtttactgaagcaaattaatagtgaggaagcctatttgaactacttaaacagtattaaagccctttttaaaaagcacctatttgggatcatttgaggtcaagaattcgagatcagcctgaccaacatggtgaaaccccatctctactaaaaatacaaaaaagttagctgggcgtggtggcacacacctgtagtcccagctactcaggaggctgaggcaggagaattgcttgaacctgggaggtagaggttgcactgagccgagatcgcgccactgcactctagcctgggccatagagcgagagtccatctcaaaaaaaaacaactatttttcacataatcaaactcaccttgtctcatgacttttggttaagggggttttcccatagtttatttttctctcagtgcatcttgctatgaggtttgcttgttacccttttggtttttgaattgttgattttgttcacaacctcttttaaatctaacaagtcctgttctgtttagtgaaggcccaaagactcctctaagactttgtatatttgttacataaaaccaagttttactaaatactttaaaatttgtcctacattcgaaaaatagaaattgtaaatcagaggttatctgtctgcattttaaactgccaaattaccttatagtaagtttctattttatgactttgggccaagaattaagtattttcctaagcacaaatctttttctatattctcattttaatatcttatgctattattctgtaaacattttaattttagtttcatgagtctttattttttgttacctgcaagttatgttcttcttcattgaatttcatatttgagagacatttgtcttcatgaagcagatttgcactggaaccattgctttactctggttggaaatgccattgttttggggacagacttttaaaatgcccttgtgtctcccagtgaggagccctaagcattgacttctctaccctaaaactgtttgagagagggagagtgggccctggctttctcaagcatgggtcgggggttcagcggggcctctgtcttttgtggtgacccctcaggggtttcattgtttccttctgacttaagcaatagagagagaatttgttttggtactcttcagaggaattgtgctttggctcataacttggccatgttctccatgaattagttctcctatttttttttttaactaccttaaacttaagggaaaagttctcctatcttgatttcactggaatataggctttaggagctctgtaaggctggtatttttgtctgttttatcttctactgtatcgccagtgcctggaacagtgtctggtgcacataataggtgctcaataaaaatgtgttcaatggatgaatttctaaaatatcctccaatgtgtgcatggaacaaataatcaaaagaaccagactgtgtcttattctcccactgacagaaagattttcctgctttcaggaaacaagctttatgtggcccttttctggtcccctggcttagactacagttctgtgtggatttgtctgattgcttcagacatgtaatgttgtttttcatccttggcagcttacatcagttgtttgtttgattagaaaaatgaagcagacacacacacacacacacacacacacacacacacacacacacaaacatataacctatgccaataaaaatgtctcagcaacagtggaattcaccttggtgtttctctctgtaatttgtgtggggtttacccctcacaggtttaagagaccaggtcttgtttctctctctgtgctaccaagaagatgtgaacctgaggatgcatcttgtttcataagaaggaaggcaggtgaatatgtggtttctaacgaggtcttgttgaaataacgggctgccctcagctcacagaaataccacagctcagccactgtgatgcagagccccaggggtctttgccagacaacttgtcctgactcaacagagacggcagcctgacctttgagctggcttgtccaggcattcaggttgcttgcgtagacttccagggaagcaagcctgtccttcctgacccggcggttaacctggtgcacttttgttcctttgttaactgttgtgttgtcactaaactgaaaggctggggcttgcccttagacgtcacattggctctgtccctgtggcgatggcagggcagggtggccaaacaggtcaggtgcttgttctgtcctcttgccttttacttaaattcctctgacttttaaaaatggtgacactcttatcgtaaagcttcttatttttctccactgcttggatatgaaactgtagagggagaggccctgttgcccagtgttctcctggtttagcagctgaggtgactgcagtctgatgtgatgtaactgtttccctttgattctccagtattcctgtttccatccagttccttactctcctctttcctcttccctcgcatgtctccctccagtcctctgtacctagaatagtctcactgtcccccgtttgcctccacgagcctgctgtttccaggaaattacataacgttcagttgggatggaaatcttccggaggacgaatagagtttaattactcattgcgtcggaaagccaagccatttctgtctccagagttgttctcttaaactgatatgagttctgaaaggagccaggtctttcctgtggttggggctctggagaccatcagtgaccaggatgtggggaacagccaggtggacaccaaaaggcccgatggggtggcgctttccagggccccgagggaaaggcacctcagcacgaccctgggctgccccagctttctctgcccagtgccccatatacttgtaggctgctgctggacacccaactctgctggcacaactgagggcatcctggctgggaagcacaggtgggcttgggagggatgtgccctggtcagggacagttacagcgccactgtctgtgtctctagtggtggcacaaaggctgaggaagctagaatttcctgtgaaggacagtggagaacccagtgtccctcgggctgacaagaaccacttcccaagacccacagtgcctggagaggacatggggaaggtaagtgcccggaagcctggggtcaagtcctgccctcagggctgcgggcagccagggtggcatggtgtgcagggagctgccacagggtaggcggagaagcagcacctctcactttgtccccaggggaagagtccaattttaagggccgggagtagatggttaaagcctgttgctggcttacttcattctgggaatgctttctgagaggtgggtcgccggccagagctgtcactcttgtagcttgaggcccatctcctatcacctcccagtccaacagcgaggcccatacagaggacaccagtggggtttggtgaagaattgcttgtaaaaaggggctgttcccactttcctcacataatatagaagtgacttgccataattcctctcagttatttccattcaagataaaaatagttgcaagtttctctgtaacagctcagatgttctacaagccccattggatgccactctgtgtggaaatggtgtgaaaagccccagttcagcagtcagtgggtgccagccactgccccagggccattcattaggagggcgatttgtggcttacagatacattcagaaaaggagagcagcagggcttggctgcctcgtgcggatgccagactgcgtttagttcatggggaaaaatctgacattctcacacccattctagtaggttcgcttagtgaaaattcaatgaagtaacatcaaaaaggctgccttttaagtcacatggcttttcattttatgtgaaccgaaaccatgaaaacgttttttgccttttgttgaggtccagaatcgcagtcactcatcttagaacattcttgccttcctgaggggctgcacacttgtccgtgggcagctccagccgttcctgcagtggccgcacagtgagaggaagggctgggtgaccactgtccagttggattccaggggtggccagcccttggagtccatgtcgtcttcacagaactgggcctcagggaggagagcttggctgaaggagtgggagtgacagttacacattttttaggcctaaaccacagacttctttgggaagaaaggggttacgtcttcctacaaattcagagccagctgctcatgccatgaatgcgtggtatgacccgatctgagtgtggatcattgaggcggccctcccatggctgacctgctcagctctgacagggcccgggctgcctctgctagccgaggagttactgagaataagttgccgttactcgagccttggtcactgcagcaccttgtcaggcacttcaaatctcatgtcatcctcacccaccctaggtggtaggtgctatcattgttttttggtccctcatgaatctcctccaacccctggcatgtctatttgggaatcttttttccaggaaaggaggcccagtggtgctaggcctctgaggcttcagttcatttaactcagaaaaatcccccgccccatgactcagggagccttccatgcatttgtttcacttaaggaaaatgacccgagggtgagatggaaagggaattggctgttgccaggcagagccctgtgtgtcaggggccagcagccaagtgagtgatccaggaagtcatccaattgcaaccagaaattgttcttaacccctcactgtctagggtgcgtagtggacttgccaatctgtccgaatggggtgagcgtgagcgcgctgctgttgagagccctgggaactgtcagttctcagccagcctcagggccctcagggagccattggacatccctggggctgggcccgccacttgaagagaaaagggaaagggcgagagccagtctcccttggtgaagagcgcctccttggcacccttgaagtctgtggaggtgcctctgtgttggatgtcacatgtgtccacccaggcaggatctgccagggagcagcgagggtcacctcccacaccttgctgccgcgggtccggcagcggctcactcctggacgggacacagggtgcccccgctgaagctgctgacgggccttgtcaggcaggggttaacaggggatttgtttattgaatcaccaagtagctgtcacatgattttaatcaaaacaccatttccctgacaacagtgatgtcagtcttgttattgcaggaaggagcagctgtgagggacattcagtctccatgccgagcccaggtttggagactaaaatcaagtgaagcatccataaataatggctacagacactgcctgactgcgcccaccctcctcctcttccttttctctgcacacagtctgtcctgtacacacactgacccgagaccagcccctgcgccacgtcccagctaagaccatcttctgccttccatgccccttctactcttgtttctggttttttcctgcctgccttattttccccaaactcagagagtcccttgggccctgagggtctctgacttgtgcctttcgatgcgggtctcttctctggatttaatcagcacctgctggtgaaccaggctgttctgggcctgaggctggagccattctgcagctcaggaacctcacttgtcctagagccagcctctagcatctagctgcatgtcctgttcctcccacagagttaggctggcagggccttcgcgctgccctggggggtctcaagggcagctctgaggagctctgctgggagtgtgtgaaggggaggagctccttaagggccaacctcttggccagcggattttgttctcttgaacccagaaagactacaggagatgtgagtccagtcaaactgaggactgatgacaaagaccaaagcccagggatgttcagtcccatccccagtggcttccagctaaggcaattggaccttgaagtccatggggaagtcagacgtaggctggtgacagggcacacgggagcaggtccttaggctgacctcctgtcagtgccctctccactgtggggcctaggggccgagctgtccgcacaaaaagactcccccaggccttccaagtcttttccacactggagcttgacctaacagttggagataaaaaagtcctcctacctgtgacatagattctcagggatgttcttatgtttgtggtacccatgtctgatgcctagaactcatttccgaaaattcagaaatcctggggcagagttcccagttcttagcctgaagcagatgctcagaacagcacaaccacccttaagtcagtgaagacagagctcacaggcaagaagcagccattttctgtacctagtgttggggcaggcaagagttaaagtaagataggcagagtgggactctgtgacagccctccaggggagtgggggtcttccaggagtgccaggccaggctgcatttgcccctcgcagtaaaccctggggtgaaaccagccagcctgtgctccaagttaccactggagacaccagcctttacaatgatttgcctgggttagtggcagggctgagagggcgccaggggccgaggcctctgtcagaggttctttgctgcctcccagaatgtccctgcctggagggtggccaggtggtggctcccgggctgggtgggagccgggccttgctctcccaggcttgctctgtgcctagccctccttgcctggccctctcatccctggttcccttccactgcctgcctgcccttcagccctcactttgctggcacaggggcactgctaagcatttgggctctgtagcgactggaaggcagttctggcggatcccagacagaagagacaggcaaggctgtgcgctccgggagctatgtgtggcgtgcttggaggaaagggcttggtgggcttttcctccattccattgtgtcccacccccaactatgtgggtggccctggggtgacaatgaacagtctcctcagggtctgatttgtcagtcagccccactcggggcatttcacttttggggagtgaggagctggagccagaactgtcccagccgacctgaggagagagtgactcagttctccctttgagaagctcaatccctaatgcctcattttcctctgggcccacattttctgagcttttctgcttatccagcttttgggggctcggctccaggggaagtccgcttcccatgctgtggctccctcctgtctccaccctcccagacactgtgctggctcgggggctcagcccagctcatgctttccctgggcttggaatctctctttgccaatttcagagcagctctgagtcagtctgccctaggaaatccccccagaaacacggacaaagggaggcagcagcaggaaggcttgctggaaagaacagtggccgaggcgcctggcaagctctctgccctgcctgaccttgggtttggcctgagtgatttgtgggcacagcttcatacctggggggaggcaggtgtgccagtggcccctgtgtctgagggagggcccagccccttcgcctcagtcaggacccacatctgcctcctaagggacgttgtccaggatgattcctgtgcgataatccatcgctcaagggctgctcagcttttgaagtcactggtggggctgaaatgagaagggcagagcagccatgttctgtgcaggtgacatttcctttgtagccacatagcacccaggatttagtgcacaaagcccagaacttcctcccatggtgcccacgggctgctggcaagcaggaggctccctgtcacctggatccacccagggagggatgagaacccatcagcagggagggtccctctgagctttgtttgtttgtttatttgttttttgagatgaagtcttgctgtgtcgctcaggctggagtgcagtggtgcgatctcagctcactgcaacctctgcctaccaggttcaagtgattctcctgcctcagtctccagagtagctaggattacaggcgcccgccaccacacctggctaatttttgtatttttagtggagatggggtttcaccatgttggccaggctggtcttgaactcctgacctcagatgatccacctgcctctgcctcccaaggtgttgggattacaggtgtcagccacagcacctggccaagaacttttgagagagcagaggctgagtcaggggttcctaactttggtccctggtggggaggggggcctcgggggcccaggaaccaactcctgtcctgaaattctgtgtccgaagttctgggtctgtgtacatgctctttgggaatagtccatagcttgcatgtcaaggggatctctgagtcctcgatttaagatctagtggggcagaaagcagctgctcgccaggaacagaaccttgggccctgttcccacctgtcctgcgtcttgatggagaacttgggaagtgcaggcactgctgtctggttccatccactgggcagaggccctgggtttggggtgcaggcctccctgctgctctccttccccaccctgctggagccttcgactcacaaaggctgcagaactgaagagtgtcctggggagtgcggggttggggcctagctggccactggtctgttattttgcctgcgtcctggggcattggagttgtttttggcaacacagaataagaatgatggagaaatctggtgggaaagggaaaacattgttactgaaatttagtgctttccttaaaaaagaaatgaaactcagcaatactgaaattttgggtagccaaggggtaaccaccagtttaaggcagaactgagctattgtcagcagagtcaggcagcagtggacgttggtggagagggctccgctccttccagcctctgccagtgtgggccctgccgactgcaccttcccaccgctacccagagaccagcggctcaccccgcagggagggaactgtcaatgttctatagcatgggcttaattggaatggtttgagtgaaaccaaatttcagtcgagatcctgctgccagcaagctggatataacagtggcctttcactcagggcctggcactgaaacaggtccaggatgcaggagagcagcttggcacatggtgcctccagcaccctgagggcgtggagctgggcctcaaaagggtgccccgcccatgtgagggaatgcactgtgtgagcgcacgtgcagtgtcgaggcctttggcagaccccagagaagatgtgacatcgtgactaagtagcagtgtcttttgcctggcagctcgcagcacctcccctcccatttccagcccctgccctgtagctgcctgtcctcggggacccctgcatctgcctcccctcctcctaccgcggcatgaggcccttgcccaggctacctgggctgatgcgctttgccctgggactctgagaatcaaggagcagtaattaagcagtgcccagcagggccctgtccttgtgcaggctgcggttagcagtgcttccgtcagcgatctgcagcggctaacgtgtactcgggcgattcagagcaaggtattatttaccctgctgacgtcaatgagaacatattatccactgtccttttctgcagcctgaaatgagcaccagaactcagagaacacagccaccttccatactctaaaaattccacccaaggcccgatgaggcaaaaaccctatcgcattaacctgacattcacatcacccgggctcttagaaaagaagttgtttttattttaattcaagagggttggaaacataaaaacagtacattttccttgcagaaaattaccccatttaaattactatttggtacagagattatttattacactgcattttaggcaattttctaacattaagtgacaagttatacttttgattttttttttcacattggagctattatgatttgcactcataataccaaagctactgaactcaccaatttttttcttagtaattaaaaaaaagcacacagaaaatataactacagttagattaactttatcaaaagtaactctttcagaccaaacatccagcaaaaccacccacctcccttcagatataagcaaataatcttgccctttctacaaagtgcagatatctctgtatcccttttatttctcaaactgcagtccccgaagtgaagcaaacctttctctccacttctttccccttcagagattttggtgaaggcaggtttctcttaccacccatggtggaaaggtctcaccacttgaatttccttgactgagcaaatcttctgcagacagacaccacagagccagcagcagcccattatctgcactggggaatgtgacattattccatctggggtcatatgtttccaggatgttgttttgtacttctatttttaaagctcccctctacccacccactttgcctctgaaaagacagagtattaagtcaaagtctgttattacttttttaatcctaaaagtaataagcacttctagttgatggggcttgactgtaaggaaatgttacgcccctcgttgagacaaaggctgagttcatgaccgttcctggggtggaatctgctggcctgcagtggtggcctgatgccgtgcgatgcggccccttggcaattgaggaagggggtgttctgtaggaaactgctgtattgtaacttggaaaaactagacatctttgaggtgagcctaaacttctgcagttaactggacgctgaaaggcaggcgggtctgcggggtttttgtctccctcagcctggttcagtgcacggccacctggacagctgcactgtcacctgaaggcggcctcttccccaaagccaggcggctgttgagtggagaataaggttgtgggaacaatatcacattcaccctgtgcttgaccaaaatgggggctttgtttatacagctgtttgcttatgaaaagagtcagatgctactgaggaaagagaagggaaagagagggcttcttccagcactagaagccagagaaccaaaaccagaagccagtcaacccaagcgcgtgtcccagctccttctatcaccagctgtgatctcagagaagtcacaaacttcccaaagctttggtttcttcagctgtgaaaaataaggacagtatctccccagctaatttcatagaattgttgtgagggttagaagagaaagtgcttggtaaaactaatgtacaaatataagctattgctcccttgtgggtgggcgagcagagtatctgggcagaacccatcacagctctccctgggtgggtctgcgagcactgctgccgcctggttctctatctgtgccccagtgtgtgcctgagtctgctgataggttgaaacctgcctggagaagatgtggacacaaggtgggggtgcacgtaggatggctgtcttctagaatcagctaggctaccttaattaggacaaaaatggtaaaataagaatgtgagaggctactggaaggtgagaggctccactgctttcgttcacctgccaccaagggccagacaagggctctgacattacaggtgcttcagaccacactgtagaacctgtcagaagggagatgatagaaactttaagaaaatctctttgtccagtttagaaacagaggcagatgatactgctcttgtctttttttttttttttgaggtggagtcttgctctgtcgcccaggctggagtgcagtggcacgatcttggctcactgcaagctccacctcccgggttcacgccattctcctgcctcagcctcccgagtagctggaactacaggcgcccaccaccacgcccggctaattttttgtatttttagtagagacggcgtttcactgtgttaggatggtctcaatctcctgacctcgtgatccgcctgccttggcctcccaaagtgttgggattacaggcgtgagccaccgcgcccggctgatactgctcttgtctttcatacattgctctgaagataagttctataaaaaaattccaggtcgggtgtggtggctcacacctgtaatcccagtactttgggaggccaaggtgggtgggtcacctgaggtcaggagttcaagatcagcctggacaacatggtgaaaccccatctctactaaaaatatacaaactagctggatgcggtagcacacacctgtagtcccagctacttgggaggctgaggcaggagaatggcttgaacccaggaggtggaggttgcagtgagctgaaatcacgccactgcattccagcctgggtgacagagcgagactctgtctcaaaaaaaaaaaaaattaaataaattccagaagcaacaaaatgatcaaagatccctgcctgtacaatgactccaacttacgagcttccctgttctccaattttcacctttcatgtttaggcacaaagagaccgagtggctcgggtggcttcccaggaggcagttagaggcagcccagtttaggagtttgagtgtagcaggtcagccctggcaccggtgtcagccactgttcacagggactgagactgtgaaatgacacactgcatattgtctctataggaggtcgaatgggaaaaagttacctggagtatgaattttctttaaaccaatagggagcttaaatgtgactgttgatacaggttttaaaatgtaatacaaacatatttacgaacctggggcttgactagaggctggaggaccccaaaaaggagcgccactcactcactgtgtccttgcatcctcaactgcccgcatgtctccagaggctgcttagtgcccacacgcctgggaccaactgtgactccaggctgctgcttgtcaccttgccttagtttctggctgatcacctaatcactctggagctgagaatatccttctccccacatctaacccgtgggcagaattctgtgagcgtttccctgcctttaggactgatgacactcggtgtgtgggtggaggtgggggagtcgtcagtcttatgatgagtctcttctgctggagactttggtccacgagagagggtagggggcaggggagaggccgatactcctacagggggggtccccccttgctccccatcaaaatgcagagcaccccattactccagcaccagagttgggaagggacacaagaggcaagggctggcttcagtcttgggctcctgtctgtcccaaccactgactccagcatacggtttaaacacttgggagttcttgatatctgaggaagaaagggccactgactttttctttcctaggaggcaaaagtggatggaagagagaaggggtttgctcagatgggcatgaacagcccctgagccccatccccactcccctggtgggccctgatgctctcccacgcagggattctcaaggtggatggtgtagagaaccatcagcctccttttcccacggtgacagaaggcagtgcaggcagaggtggcgagggggcagctggggacggtcagtgtcaccgggaatgtgaaagtgggccccctcttcctgtcgggctaacatgctgtttgccttacagggaccagtgtatcagttgcgtggagatactagagacacacttgcccagctgggaattgcagagctagtgcatttctcccaaagcacagactaataccccagatttaaaaaaagaacataaaaaataaagtaccacacatattgcac

SEQ ID NO: 36275 - DNA, 39534 bp, Homo sapiens; identical to SEQ ID NO: 36274

SEQ ID NO: 36276 - DNA, 207924 bp, Homo sapiens
actggttccgcccgccgctcttccagccgagactcggcagcggcggtcggagcggctgccacgccgcacctgcccgcgagggggcgcgccaggcccaggccgcagccgactgccgcgctctctgtccccgccctccgccatccccggactgcgctcacctgtctgggccgctggcctgggaggcgggggccggcgggagccaagccgaggaaagggcggagcggctctccgggcgcgtcatcggagcaccatggcggagctaggagctggcggcgacggccacaggggcggcgacggcgcagtgcgaagcgaaacaggtgaccgcacagcggggatagtgggggtcccgtcgggcaggggacggcgagcggggccggcgggctggcaccgaaatcacccggcgccggcagccccctccccgcccgcgcggccgcggcccggaacaaccggccctgcgcgccgcgcaccctgctccgagagcgccttcccccgcccttcgccgccgcggctcggccagcccggctcggccccggccggggttgcggccgccctcgggcgctccaccgcgactttcccgcaacaggtggaggcgagccgggggaggaaacggagagaccccggccgctgccctccccgccgcggcctcgggtctaattcagttgaatgggaaatcgtatcccccagaccaaaccagtggccagagagtcgtcggccaggtgcgactggcaggacgagcagtttctgggcacctcctcccgccttccctggtcgccccgggtgccgggggctcctcagcggggtcggtgtggggcaggaccgcggggtgagcggcccgccccccaatctggtgcccgcagtggcgacgaccgtcgtccgaggggaccgagctcgggagggccggggcccagtgcagcacggtgggggtttgcgagtgcgggcttgacgggatcagactttcgttgacttgtcggagttctcagagttttttgtttttagtctgtgcaggagcccaaaggaggattgttggctctgcagcccgggatttggtggtcaggcctctgtgttgaggatacccctcccccacaacctccaggggcacacttagggacaggggatcacgtccccaagaccagcagcaaggcttcccaagaccagcagcaaggcttcccaaccccgcccatctctccatagtatgaagccgatttttctccctcgtgatttttttttctccagaggctatcttgcaaatccgtccctctccactggttccctcttctattcttggccagtaagctgtttctatatcttcctacacttggggatgggggcagtgaggcagtttcttactttaaaaagaaattcaattcttagactctccaattgcaagctgttttccacttccatacggtcacaatcggaagcatttgtttcctaaatgtaagaatcactgtctccccaccatcaagtatgcttattttaacgtgaaaggtccagagagctctgaaacagtatttgcaaattatgtatctgctattgctaggaagaggttgggtacgtaaagtctaatgatttaatcccttcagccaagatacctgaggttaagactgacaaagtatcttgaacttgtttaagtcatgctccttcctgtagggagtttgtcttaatgtgttcgcaagattggtagatcattattttgttttggggtggagaagagatgcctttgtaattgctttcgggaatttgatgagctagacgctgggacggggctcccccaagtgagggccccgggagaggagcatcctcatttgtaaatatacggcatgattttcgttcctaaccctgacccagtaactgcatgtgaaacaacattgttctagcgagctaagtgttagtttgtgctcaaaaataaactttctagaatctgcacgtgaacaacttgttcagacataagtgaactgactacaaactgtaggatattcagtgcctgagcatgttaaggaataggccgtgcttccaacaattaatatacaaatcaaccatgtgcctgtcagtgtaatattttcttttattaaaaagggagttaaattggctgttatctccttcatagaaaacatttcttccacacttttgcctaaaaacttcattttccaaaggacattttttatatatggtcttgaataattatactttataatttcactgaaaacttaattctggccccgcatctctttcctatttttctaccccaagattactattaatgtttttagtgttcagaagcatttgtgtcagcaggtgccaaagaaagaaggaaggtgtaaatgtatttttttgaatctaggtggtagttattttgagagaacaagtgagattgtttgaatttcaacaacttaagttattccatatatttaaaacacatgacctatatctgaatatgagactttaatttagcacttcattctggtgaacatatttcacattatacacatccaaatactgcaagtctcatttttttaaacaatcagaagtttgtatggaattgttgggggggtgggggggggtggtggtggtgggtggccgtggacagagaaactattaccatcaagagttgaaaattgccaccttaaatggcaacatttcttgagggattaattttatttctttttagaactcattattatgaggtagagtccactcttaaataactcttagtttttgggtctctatacaaagactggtctaattttagggcactttagatgagaatatcaggttattataaaaatgatacctgtaatgtgttcagaattatatgtgtgagtgtgtgtgtgtgtatatgtgtatcaaagatgaattgacagtggtggcgtgtggcctatgaaatgagaccgttcttaagcatattgaaagctattatataaacccaacatttaaaaaccctatttctgtgggtatatattctcaaagttagtcaaatcacattctttgtggcgaaaacatttatttttcttgaggatgaaaagttcttccaatataatatttttcttgccaacagccaaagttaagagctgggaaaaaaaaaattgccttggaaacaagtttaagacatcaccactagaggatgtcaagtcctttttcagccttttttgagtagtcgacctacgatgggtgatattcacaaaactgcctctacccaagctttgtatatttaattttatgttcatgttcaagagctgtggaaagcgagtgtacagcactaatttcctagtctgatagcctgttttaaaaacctcctgaactaaaagcaaatttaaagctgcttttgattaattcatgaagctttcatgcacgaaggaataagttaatgccaataacctgtcaattctgttgatattttgggaagtgggtcatgacttagaatctggaattgggctttttgtccattttagcaacctgtgtggtgaacatggcctctttcgtgaccatcctttcatgaacttttccaaatcaaaaagtgatcttgtaggtgtcacttaactctaagggtccacattaaatatctgcaattaaataagggctcagacgtcaatttggtattaagcttgtcccctttgaaagagatgcttcattcacatagctagatagcttttctcccatcctatatggctgttacctttacatcttgctaagtaggaggaaacgttattattagactaggcaattgtgctcaggagcatgcatttatgtaatattgataggcttgtgtgaaatatttttacacagtttatttacactggcattttctctaaaaaaattctaacatctttgcctcccaatgcatgagaaacaatcatttggaagagttatttttaaaaactcgggcctcgtattgatgtaagaattgaaaatattgaggcttagaataagaaatgtgtaccttctgtgtattcagcattatggtggttagaaggctgttgaacaaatgatccttgaatttagcaaggaagacaaaattcaccaacaaacagttgcaggttatgaggagttcagtgaaggaggaatcacttccggctgtggtcagcaggaagaacatactggatacagcactgaagttaaattttaaaaagtggtggaactggagatcattatgttaagtgaaataagccaggcacagaaagacaaacattgcatcttctcactcatttgtaggatctaaaaatcaaaacaattgaactcatggacagagagagtagaagcatggttaccagaggctgagaagagtagtgggggtagggggtgggaggtggcagggaggtggggatggttaatggtttgaaaaaaaaaaaggccagaggcagtagctcacgcctgtaatctcaccactttgggaggctgaagcaggcagatcacatgaggccaggagtttgagactagcctgggttacgtggtaaaaccccatctctactaaaaataaaaaaattagcctggtgtggtggcgcacgcttatagttccagctctttgggaggctgaggcagaagaatcacttgaacccaggaggttgaggttgcagtgagccaagattgcaccactgcactccagcctgggtgacagagcgagaccatgtctcaaaaaacaaaaagttagaaagaataagaatagtaacaaatactatttgatagcacagcagattgattatagtcaataacttaattgtacttttaaaaatatctaagagtgtaattggattgtttgtaacacaaaggataaatgcttgaggggatggataccccattctccatgatgtaattatttcacattgcatgcctgtatcaaaacatttcatgtaccatataaatatatatacctactatttacccacaaaaataaaaaaaaattaaatttgttttaatttaaaaaataaaaaaataaacttttaaaaatgggtaagtgggatataaaattagatggaggaaagggagaaaaagatgcaggtgtgaaaaagagcaaagttttggtcatattgacacatgtgtaaagctcaaagaaagtcctaggtcagttaggaatgattgttcatcgaagtcaaattgtggaagggctgaaggccaaactgagaggctagtacatttttctggggtagggtagtgggggaagtgttgaggattcttgagaataaaggatattgattaaagcaggaataatcaggtagttctgtgcccatgaatcttgaaatattgattgcaagttctaacaagagctcagctgtgcctttagctaatgaaagcaaagttcctccctctgggaaagtcattctcttccattgatttttttttttttttcttttactgctttgggaagggtgcacctggagggatgagaatgcatgaggaatatctgcctagccagattagccaaatctctggagatcaatgaagggctaggtctactcagctggtcctcatttcaaagtagcaacgtggacttgaggatggactgaagaagagttcagcgacatacacaccaactttgagattcctgcagaaatccaggcagtcattagcatggcaataggaagagacgattaatttaaggttctgcaggggcatgtgtcaaaggattgcaggtaaaaaggtgacatatgagacttttccaagtttgagtttggctcattgacttattggaaaatattcatgaggaggacctgttttgttctttaccccaaagagatggggggcgggtcttgctatgttgcctgggctggacttgaactcctgggctcaagtgatcctcccggcttagctgttcgagtagctgggactacaggcatgcaccactgtgtccagcagaatcaggttttggtgggagaaacaggaaaaaaacctctctgctttagacatgaaaatgtgtggtacaagagagatctgtaagtggaaatgttcaaaaggcaactggaagtataggactaaaagagaaaaatagaggtcaggactctgggattcactccataaaggaataatagctgaaggtttgggagtgaggagagctcagaaaaaccacaaaggggtgagacgacctgtaaagcatgggaggaggaagagccagcaaagcagacagatggaaaagcacagctgagcaatgtcacacctgctgagagggatggagaggtaagggattcaaagactgatgaagacattttataaaaagctgttggtttggttacaaatagtcactgaccaaccccagaagaggaatttcagttgttggtgcaagagttggggctacatcagattagaagtgattgtgagataagcagtttgggaagaaaggtagccaatttaatagaccctcccataaagcttgctggtgagaggaaaaaattacaaatccttgaataggcagagggattttaaaaaatctattctaaaatttgcgtacagtccaggtgcggtggctcatgcctgtaatcccagcactttgggagaccaaggcgggcagatcgcttgagctcaggagttcgagaccagcctgggcaacatggcaaagccccatctctactgaaaatacaaaaattagccaggtgtcgtggcatacatctgtaatccgaactacacaggaggctgaggcaggagaattgtttgaacctgggagacggagggtgtagtgagccgagatggtagcaccacattccagcctgggcaacagagcatgacaccttctcgaaaaaaataatttgtgtgcaaaaaaaattacggattttcttttattttctttttttagttttgttgactgtataggtaatgtaagcaccaccgttaacattatcccaaagagtcctctgcctccaacctaaattccctaatgctgcacctttgtagtgagactctcttcctacacctaacccctggcaaccactgatctgtttaccatcttcctagttttgccttttccagaatgtcataaaagtggaatcatacattgtgtaacctttttttctttttttttgtgagacggagttttactcttgttgcccaggctggagtgcaatggcacaatctcagctcacaggaacctcctccgcctcctgggttcaagcgattctcctgcctcagcctcccggatagctgtgattacaggcatgtgccaccatgcccggctaattttgtatttttagtagagatggggtttctactaaaccccatcaggctgatcatgaactcctgaccaaaggtgatccacccgcctcagtatcccaaagtgctgggattacaggcgtgagccgctgcacccagccccacattgtgtaaccttttgagtctgaatttttcacctggcatcatgtttttgagattcaggcacactgttgtgcatgttaggatgtggtacatcctttttcttgatgaagtagtttgccattgtatggaagtatcacagatggtttatcaaagaacatttgagttgttcccgggttttggcaattatgaataatgctgctgtaaacacttacctacaggtttttgtgtgagcatagttttcatctattctgggtaaatacctaggagtgggattgctgattcatgtaactgtatgtttaactttataagaaatggccaagcttttccagagcaactctacggttttacattcttacaaacagtgtatgtgagttctggttgccctgcatcctcactaatacttagtatcgttagttttgtttgtttttaaaactttagccattccaccaagttctttgagtaaagcaatgtaatcacctcaaagtaaaatagtgcctttttaatgctaacccatgctcacatgaattaggaaagcctggaggtggtgttgatcccagagcctaggtataatacggaatttatatttgactctaatatctttattctccttcattcttttttccccacagtatttctttttttttttaattttaacacaccattgcttgcttgaagagccatagtatctcttatttcctgtggagtatgcattctgaagttgattatagacggaagtgccattatatagcacattccctgccaattcaagttctctcttcctccttaatggtctctgttctaatcccttgagatatggctttctagaacttggaaataacttgttttgttgttagaaagctagacatattgttcatatactttgtttattatcctgattaattccttattggaacatcttatattgtcaaactgaatacttaccagttctcagatacagtgctttgtaaagccttgatagtctgtcattggacgtttcatcagttgctcatggtctaaggttctgtaagctaaatgtgaatggtatttaggcttatacttttttataaaattcagttttagggtttgtctcgttctctagcggtgatgttgtctacctctttactatcttagctcttgtaaaactctgagttacggttgttgacacatttaaatggcatttggattttctcttcagtaattattattctctttagtatctttttaatttgagaaatagcctgttgaaaaagatctgtaagatttttttattaggtaccactttgaaattttttttaaatatattttttgagacagagtctcgctgtgttgcccaggctggagtgcagtggcacgaacttggctcacggtaacctctgcctcccaggttcaaatgattcttgtgcctcagcctcccgagtagccgggactacaggtgcccaccaccatgcccagctaatttttggatttttagtagagagggggttttgccgtgttggccaggcttgtcttgaactcctgagctcaagcgatctgcccaactcagcctcctaaagtgctggaattacaggtgggagccaccactcccggctccactttgaattttgatttgaagagtaatatatagtatttgacactgagaaaaactgcattcaactgttcttcatccttgatgctcctatagaaatagttgtgaaaaaaagaatcatgagaaagtgccaaggaggattgacacacctgaccagatggcacagaggagcacggggtataaaacaatgcagggaggaggctgggagcagtgcacttggcatatgtgagctgcacttcataggcactgttagtaaatgatatatctttaagtttagagtattgagatttggggtatcttaaaatttctaattctgtgacttttaaaattaaatgatatgtaagcttcctttttggagttggctttctagtaaagagaactatccttcactatggcataacctctgagtataaaactcatttccccaacactgttgaatgtagaaaagttctctaggatcagtttaaatgtcaaggtgaagttctagaaaggagcccttccttagcacctccacccctcatcatgaagcctacttggtggcaataacatgcataataattggctgtaagatgtgttcctgtagcaaaacttttggctgcttctcaagattcgaatctgggcttctggttctcagaagctcctgacccaagcctttggggtggcaggcgcaccagacaggacctggttgcttacttcttgcattccagctggactggtttctattcatggtagatgctccaaattagttcagtgacaacttcaccacaggcgtggtgggttcatttaaatatgggtcactccttgaccccaaggttatgttgttgaaatgattattgcgcccatgtgctggagtatcattgattcacatcattggctctcaatcttggcagtgattaaaaatcacctggggaccatttaaatatcaggatgcccaggtggcatccaaggtaattatctgagaatcttgcaggatgggagtcaggtggcagtgtttttaaaattccccagatggtctggtgtgcaatcagtgctgagaactaatgattcagaaccatttcctattgtattcccttccatttgactattgtggtgtgtggtgtcaagtgtgtgcaccttgcttatggaaaccacatggaaaatcgtaatagcaattgccctaagtctagtgagtttactcaggttgtctcttattttgccccaggacttttttgaaggaaatatagatgtgaatacagttatgagtacaattgaatagctaagtatgcacacatatactcagtgtccacatgtacgcacatttctgtatgaatatgtgcagtgagacaaaataccattcagcttttgttttgactttgcctagctcctacactgccttcctctccctcctgccccttaaaaccaggaaaggttaaattggggtagatattaaagtattttgtagaaaattacatacttttcccagagatctttctagtgacccctgacctctgatcaccaggtccctggctctggagactggaccttgtttcttctgtctataaatagttgacccaagtacgaccttttcccttccgtgtgaccagatgctaatacccttcaggctaatctttctttccttcacctctcttgtttctcctcaccgcatgctgctgtgcccaaggcccagctggtaacctctgcggtttttaatgtgcatttttttctcagcaggattattcaacttgtgctttgattatcacctcaaattgtcatctctggctctacacactgaaatgtctacaggcacttctggttttgtttttgagacagggtctcgctctgtcgcccaagctgggatgcagtggcacaatcctgacttactacagccttgacctcttggtctcaagctattctcctacctcagcctaccgagtacctgagactacgggtgcatgccatcagcctggctaattttgtttattttttgtagagatgagatttctctatgttgcccaggcgggtttcaaactcctggacacaagcaatcctcctgcctcagcctctgaaagtgctggaattataggcatgagccaccacacccagcttacaggcacttctgagttgcattcgtgcctgctcctgaggttttgtggtgccatcttttgtgatttgaagctttttctgggagggcttacctttggcagcatgatttcctatccttttctcctctttgcagctagcatatgtctaactatgaagtccaaggcaaaaatgaagaggtcagtagtggatattggatgggactgattcctaaataagagtatctttgatttctctttaagattatatggaaactgagcatgtgtgaggctgtgaggtctgaagctcaaaactaacactaattgtttaggggtaattctaacctactattttgtgcaaggtctctggagtctggctgcctgggttccaatctcagctccaccacttggtacctgtgggatcttgggcatgtcatgtaagcattctcttcctcagtgtcttcctttttaaaatagggtattggtaatatcgtcacagggattaaattagttgatactaaagttcttagaacagtgcttgacacagcataggcaccaagtgtttgttatggttcttgtcatgattactgaagattagtattgcattactgtgaaacgatgggcacaccctggcatgctaagtttcttccttaagccgttttttatttataatagtaagctctccatagtgaaggcatcagaatgtaatgatgattcaggcctcattgtagctgtgtgatcacactgtcataggctggcactgggatcaaaggcatcattaaagcacttgggatgatggtttttacctgtcaaatgttccaggaggttgctgtacactggcctgtgagacccttagattgtgttatgtgatcacgctaaacacccataaaagcccttcttggcttttttttttttttttttttttgagacaaaatcttgctctggtgctctgtcacccaaactagagttaagtggcaccatcatggctcactgcagctttgacatctgggctccaacgatcctcccatctcagccccctgaggtagctgggactacaggtacacgccactattcctagcaccagctaatttttttttttgtctctttttgtagagacagggtgtcaccatgttgctcaggctggtttcgaactcaagtgatcctcctgcctcggcctcccaaagtgctgggattacaggcgtgagccaccgcacctggcccatagttttaaattttaagtcctttgctaaaatattgccacataggttatgttgctttaagccatagagagatggacctcctaacacccgttgtgactttaaacaaggcactatcaccacattgaatatgcttctctaccaggaaaatagaggaaacatacaacttgccttccacgagatgttcatgagaagcaggaggcagtttgggtttcttcaagcaaagtacatacatgaaatagaaaatatcagtaagttattaaagtcacaaattttagaagaaactttcttaagttgtagaggaccatttacaaggtgtatcctgggtgtggtgtgtgggcatgtgggtgaggcacatttctcactaagaaaatgatatcttgttcaacttggaatttagaattttatatcttttaaaaaatttcagccaggcatggtggctcacgcctgtaatcccagcactttgggaggccgaggccggctgatcacccgaggtcgggagttcgagaccagcctcaccaatgtggagaaacctctgtttctactaaaactacaaaattagctgggcttggtggcacatgcctgtaatcccagctactcgggatgctgaggcaggagaatcgcttgaaaagaggaaggtgcggtgagccgagattgtgccattgcactccagcctgggcaacaaaagcgaaactccatctcaaaaaaaaaaaaaaaattcataacttcgtaaatctgaaaatatgtcatttcctcagatgggtcctgggtttagattctcccagcaatgctcccaaattgtctttttgtatacagtagccactgtggaaattgattaaacaagtgttcctgatgccacctttgaaatattaaaatgtgttattcagtaaaaatagaactgaattattattgaaaataagttttgtatggatttacttaacactaggaataaacccatcccaatatcctggtgaagatgccctccctgtgtatataaaaagatacatccatatgctttgtgcagtgactgtataaggcccagatagagaaaaaatacaagagatgtctcaacagttgaaagtattgaaataaattgagaagagggaagctatttttagtctagaagacctatgagactcgaacaactttggatagaaaaaccccataatcttataatccagtgaggcctcacagggaagagccctaggttggcatttcagattcaatcctcggtatcccagctgtgtctaaaatggacagatttgagaatgtcagttcttcaacttatttacaaactgatcaggtccaatatttatctgctgcttgctgagaacagcatcaaagtttaaaaaaaaaaaaaagaaagagaaagtttccaaccatcaagcaagtgtgcaacacaaatctaaaccatatatgtgatgagacccacatgtcattgtgagagtgttgcaggactcattaatgacacccacagtagcaagtaagtcttcaagaaacctttggaagagagaaggcctgtatatgaaatgccagaaggaaggggcaaaaggttcagaactaggactctgggtatggagttcagacacctgtgaattgggcattctgaaccacttgtacaatgtgcaaagctgattttttcttaccatagcacagggttgctttctattacagatgtacctatctggaaacatgttcattcaacagtttgcagtcctgcagttattttcaaaacagtttttgcttccctctttttgtagtaaacacggtctttttccagtgtgctagataaagtctggctctgggcagtaaagggacatggctgctgcttatttcaggaacttaggggcaagtgtcttcatgcctgtggaaacaggagccagctagtactatttccagcaagaaatttaagagaaaggagagatttttattatgattttgatttctttactacaacattgcatgtgtctggagtatagccattacactttatgaaaaaggcaaaatggtcatttggggtgttttaggaagtttgccaaaaggctcctttgtcattataatccttcctaagctgccatccacgggtttaggtcatggatatgaaaagtgaaagggtttagagatgaagtagtgtcccctgagtgcttaccaacctgttaatctttttgagatgttaattttttcatatagagccccctaaaatcttgatggctctagatcagtcaagcctaagagaagacgtatttatggaaaaaaacaaaaaacaaaaaaaccttgctggattgctagtaatatctacttcttggaaattaatacttcatattttttaaaaaaattattgatgcattaggaatattttttgcttagcagttacaaattttaagaggcacatatacaccacggaatactatgcagccataaaaaaggatgagttcatgtcctttgtagggacatggatgaagctggaaaccatcattctcaacaaactatcgccaggacaaacaaccaaacaccgcatgttctcactcacaggtgggaactgaacagtgagaacacttggacacgggaaggggaacatcacacactggggcctgtcgtggggtggggggagcggggagggatagcattaggagatatacctaatgtaaatgatgagttaatgggtgcagcacaccaacatggcacaggtatacatatgtaacaaacctgcacattgtgcacatgtacactagaacttaaagtataatttaaaaaaaaaagaaaaaaaaagatgacaaatactaaaaaaaaaagaaaaaaaaagcttctaagcttggcactcaatcctaaatatcttatatctttataatttagcttaaaggcttttagtgttctggttggttactgacaattctcagtgtggctttcactgaaggaaaatggaccaagcctcaaacttacccaccacaattatataatttggcatttctgtgaggcacttccttcctctaggttggtttcagaactatgctggagaattgtatgtaatttttttttcttttgtcagaattggtgtgttaggcctttttttgtgtcacttaaacacctgaggctaggcaatttataaagaaaaaaggtttaattggctcagggatctgcaggctgtacaagcgtggcactgacatctgctcggcttctgctgagggtcccaggaagcctacaatcattgtggaaggtgaagcgggagcaggcacattcacatggcaagagagtggtgtgaggggaggtcccagacttttaaacaaccagaccttatgtaaactaactgagggagaacttacttatcaccacggggaaggagctaaactattcatggaggttgcaccgccatgatccagtcacctcccaccaggccccacctccaacattgggggttacatttcaacatgagatttggaggagacaagcatccaaactgtatcaattggtttcagttaataaataaaccaaaaaataaagtttaatgcctcaaaccttcatacgcttttctcatgaaaagcgttttatccaaccctctctccatccccatgtacggatctatgtactttagtttctactgattgagaaagtggggttacttcattataatagagaaggattttttgtaatctatatatctgtacttttgaatcatttaatgttcagatgaacaggctgcttagttctcattaaaagggttcatttgataatgcttttaagctcaccagtacttgattctcaaagggtgatcattagtgaaaataaagagggatttaataagtctaagatatcctgaccccaactgtaggaacattatattaatagagcattacagtattggaaaattatctgagtaaatagaatccatcctattcaatgaagattatgatcattgatacataagcctttgacttttgaatggcatgctttcgttcgcagcatgttgacttgaatgtgggaatggagtatcttaatctctctgaggtcactgactgataggttaagtgtcagctgggctcagcccaaacattagatgttgctgggaaggtattttgtaactatgattaacatttacaatcagttgactttaagtaaaggggattatcctggctatgggtgggccaaatccaatcaggtgaaggcctgggaaagaagaagaaggaggaagtctgccttaagactgtgacatggaaatcctgcttgagtttcgagcctgccagcctgctgcacagatttcacacttgtttgtccccacagtggcagcagccattattccttaaaataagtctttatatacaatatatttctctccagagaaacaaccaaaaatactattggttctatttcgtggaagaatcctcactgatacactcaccctcaagaagaaaattaacagtttttacccagaatcatacaaatcgctttatttaagagataaaatttaataattaatctttcctgatttttgaaggtaaaaacaggatattacgctttcagtaaaaaaatggatgtcttttaatttcaggggggtttaggagaaagaaatggaaagagtggcaaagtagcaaaggatggtgatacggtttagatatggtttcatgttgaaatatgacatccaatgttagaggcagacctagtgggatatgtctgggccatgggagccgatcttatgaatggcttggtactcctcttatggtaatgagtgagttctcattctgttcgttcatgtgagagctggttgtttaaaagagcccgatatctctcttgctccattgccatgtgacacacctgtttccctttctccttctgtaaacgtcctgagccctcaacagaagcaaataccagcactgtgctccttgtacagtctgcagaactctaagccaaaacaaaactttgtaaattatccagtctcaggtatttatagcaacacaaaacggactaacacagatgggattgaggaaaagtcttaaaacattctgaaatgaatgttcttcacctgtccgatgctttgctgtcctaaagacttaatgctgtcactatccttaaaatgcccaaaaagtcatacactgaattggtttgctgttctttagtatcgctcttcatttagatttcatctctcaagtcacatagctatagggatccacctataacaaattggctcattgaggggaaaactctcttattcatctttatcagtaggttttttgttgttgttttagatggcgtttcactcttgttgcccaggctggagtgcaatggcccaatctcggctgactgcaacctctgcctcctgggttcaagcgattctcctgcctcagcctcccgagtagctgagattacaggcatgcgccaccatgcccggctaattttgtatttttagtagagatggggtttctccatgttggtcaggctggtcccgaactcccgacctcaggtgatccacccgccttggcctcccaaagtgctgggattacaggcatgtatatcagtaggttttcattacattgtgggtgagagaatgtgggaagtctggaagccgcaggtgcggagatcagagtagtgtggccctcttctaacccaaacacctggagaaggttcagttgtttctgtgatttagcatttaaggctaaaacctcgggaccatcagttgaataagtaaaataatgaaacgcagagttgcttacaaaatgaagccatgcgagtaagtatgtgcacaggtacagcaaaggagagggctttatctcagccttgctttttccctctgcctgagtgttctctcttggttatataactcgactttccatttgcatcaagtcatggaatctcaggatcagaagaagctctagagattaaaaaaaaaaaaaattcaacctgtaaacagtgcattaatccaacatcatcattccaaatcagtgtttgtgcacagctatcttcaatgtcaagaaacataactttttacattctgataacttaacagtccctggtcccagttttctcttccagaactaaatttacacttccactaaaagtgtaaattcttccatatgttaacctttaattctgttattttattcctctggagtcttgtcttattttcttctatgttatgtctcctatgttatggcctagaatatttatggtaagtcctaggtcactctcttctgaaagtgttctcatttatcatcctatttcaaatatcttgcgagtaccatgtagtatgaggaccagtaaacagagaacgcttgtcctcctattaggcacgctggtgtctgccgattccactgtgacacttagggtttttacttcctcagtgcgctgatgatgtttagtgagcttgttgtccaagtgctcgctttgtttctggggcagcttgggtaggtcttcattttgtacctgtccagttgaactttttttacatataaaaagatatgttcctgtttattcttactgaatggataagaatatagcctattcagtgggaataaactgaataggctgtatcctgtctaagtatagctcattatttcattctttgagatcattttggacctgagtctatccatctcttagctttcttttttctatggatatagagcacttgttctcatattaatctttaataaaaacataactacctttctttgcattgcccacttctccatctttcatctggactattgcaggagcttggtattcacgttcaagcctatggataagtttttcacactgctagaggggtgtctgttaaaaaaacacaaacatgattgattctcatattcctgtttttacgtctatccctatgaccaccatttgatcccttttctttacttggacgaagtagttacatagctagtctctgtcccgtctctctctttctcacttcaagttcatcctggcctgtctggatcacacatttagctatcaatacccttcagtggctccccactgcctctgtttggtgaaaacattatgcctttggctctgtatcctctctgatggcatgccccaaagcaccccatctgtcatctttaacatgattttactactcctaaagcaaagcaagtcaaggaaccatagtttcattttctttctaatggtgtggctcaacaataaaactaaattaaacactaaattaaactgctcacagaccctcagtgaattaggtaacttacagaaacacagtccgggcatctgtatgaatcttctgttgaacccagcgattgatttctttccctcatttggaatctataaaattggatttcttagcctaattatcgtgagaagagaggacagtctttgcacatttaacttttatcaagtaattcagaagttcatgtagtgcacattaataaagtattatcaatgagagtaatgaacaagagggctgagaggcattccattatgtgctactgggttaaggtttaatgtggcatttcacacctaacatttaggaaagggttttaaagcttagtatccacaccttacatttgtataaatgaatccctagcgtttgaaatttgtttatgatagagcagacatgggaaaatggactctgtaggcaccatgaagtgttttgcagtgaagatttatagaaatgttgtaaaaggcaccacagggacctggtacttctggctgatggcatcaccgctactagggcagtatttactgtttttcttatatgcctgttaacaaaaagtggtcaaataaagaagatcaaagcaaatctgcctcttcctttcaaagggatgatatttctttgtgcagtatttctttatccagcctcttctatgctatgcatgatgctgcaagatggcagaatgttgtgcctttatcgtcacaaaagccatcagtaagtggcataattctaggaaactctgaggctgccctttaacttcaagaatagagtggcaaagaaccagctgggaccctttgttccttagtggttgtttgattccatgtcaacctgtgctggctttgtcattttcaaaatcatgcaaagtttttaagttgcataaaaatattgttaaaactcctgctagaagtaaatttcagtttatcttggggagatgcattaaatacttaaaagattgctgaagtccggtagttttgaagaattaaccatctcttcgaatgttgaaacgtggaaaagaattttggcacttctggaccctgatgaaaagtaaataacttatacatacgtggaacttgtaatttactggtgacaggccattcaatccagcagtaataatttctgttttcagctacagccattgaatagtacaaattaggctcttttttctttcaataatgtttttgtaaagctcactgggcttttagaaagggaaattttaggtatgtttctcactggttaagcagatttcttggattcattcatggagtgtgctgttttccaactttatggtcacacaagtctaggaagcataaatgtgaacagaaagctgactctatgtgtgcgtatgtgtatgcaggtgactacatgttagtcttttatatagcattgtgacagctaggcccaagtcatgagcttacttccccaaagatcagcaagtttgactctgtttcatattcatccaactcacaggttggacataggccagagatgccaaccagccagggtaggaggacaaagagacataaatttattgtggaccaagcgggtggggcctgcagttgctcgggggcctattggactgttttaatcatagtagctgagtggtaatgtttttacccataaatgtgaatacattttgaaattatactgcagaatatttttacgcaatataaagccaatctagttgtaaaatctaccattttgcactaggcagtgcctcatttctctcaaatttgtacaaagcctctattaatacaacatttatcactttaacaatttaaagaaagtaattgcaaaaccttactgattgttggagggctgcatgcccatttcccatggggactgatttaagcctctgtatctgcatgtgacatgcaaggatagttgtgccacatctaattgaaaatgctccttagtgctggagaagagttcaggaggctgggcgcggtggcttataacctttaatcccagcactttgagaagccaaggtgggtggatcacttgaggtcaggagtcaaagaccagcctggccaacatagtgaaaccccatctctactaaaaatgcaaaaaaaaaattagctgggtgtggtggcagatgcctgtaatcccagttactcaggaggctgaggcaggagaatcacttgaacccgcgaggtggaggttgcagtgagccaagactgcgactgcactccagcctggcgacagcgagactccatctcaaagagttcaggaattcagagtagtgtttattttactttggcggatatttaaatttaaggtctcaccatatccctttccgtatttgcctttggtttggatcaaaatgtaaaagggaattgcgagaagatggtacccacacctctacagggatcaagccacagtattcctggaattccccaggagctaacccctatatccattaaagattgggtgtgaacatttaagaaactaatctcaaatgaatttatgtcttaagtgaaaaatgtgtcctttataagggaaggaaaaaaatcctttattgttattatttgatcttgtgctgtttgcttttctgtgacagtgacacagctagttgatgttggggtcaggatttacacgacagcaggatgagagcatcttgactcagtggagataatgtgttagttattagagcagcagctagctttgtttggaagctgtaagctgtatttgggtgacaaacatttctaaatgaaattagtcatttgcttaatacagattttcattttctttaccaaaaggtagtttcaagtatgcttattttgtatgtggggttttttttgttattattttgcttttttgttttgttatgcttttgctattgtaaatactgacctgactctcttgaagtagaggaaagaagctaatgtggatttgaaaatattttcatttcacaaatagtatgatattgatgtatattacacctgtgtttattgatcatctgattaaagaaaaataataggaaataacaaatcatgtctcattcaagaataaaagtttacaaatatagaaaattatggaagtatgttacgtttacaatttgtatccatttttttatttcttaaacaataagatcttatatgcgtcctccctttccttccatctccacataaattggagatcgatctaggattctaaaacatctgggtcaaacatttgtcatcgggagaagcactggactaggaggaagatggtctaaattttaattgtagacttgctgccaactaacatttgacctaggcaaggaatttcacttcgtgagattcagcttcctcgcatgtaaaacgatgctgactcacttgctttctcaggcccattcagctccaaaactccattctattttattccaaagacccactgcacagattgacacaatttaaaataaactctaaaactgaaatttcctgcgtttcttcatgccagagatctaaatacatgtgaacttaattaaatcaagcagcctgtggagggaaagagttcttaagattcatttatttttttcagcatgtgtttgctcacaatttagtacatcccccagcaccatgctggacaataagagtagatacaaagaagtacttcctggtagcattgatagttgaactggaaataccttgaaaataattacaaagcaaaaaatggactagttacagcaaactattataaagtataataatagttggtatttattaagcacttcaagttgctagcactacacgcatttaatcctcaccctaataccataggtaaatgatagtcatcaccccaattttacagagaaaacggaggcactgagagagttaagtgaattgtccaaagttactgttccacgcaagagatttagagaggatattgtacttgccttagactcccttgggccctcttttgggtaagtaggtttaagtactgagaaaaagtaagggagtagttggggagtgggaggattgcttttgacttgctaagcagacttgatttttattaaaacacaaaagcaaaaaaaatgttttttcttaatttggcagttggcatgttttaatgtcatttattgtaaattttttttggagacagcacacattttaagcagtctagaagtggagagtcttaaagtgagatagcttatttcaggagaaaacaatagtcacatgattctgtgctttgaagaaaacgatccaaaaaagagctaaaattgggtcaagtgttgagcattgctcagcaccgctggtagcaactgcccagagcggtagggattgagggtggggggtgtgctgggtgtaatagagacaggtttttctcctttggagaattccccagtataggttctgtccttgaaacttgagttgcagaggagacactccacgttgtgatctctggtgggagccagcatagttcttcccttgcctgtcttcaccagagggtttcagggacatggcactggtggccctcatgactggtgctgccaaccctgttcttatacatgctctggggtggtaagaatgtcaggaaagtaaagtgagctgctctgtgggtaccagccatgccttcattcatccaggggcttgcaaacattgttatgatagacaacctggcccagaaaagaagaaaaagcctttcttcctcaggcttctgtctccatactgaggagtctactgctgcttgtgcaagcaaaactctttctcctcccatcctgctgcgctgccgctgagaggaagagggagctgcccagcggcctcacgctgtaaccctctgctggtgagttcccagaacccagcatcctgcaagctgccgcttctcagctggggagatggagccgctctgggcccttcttgattaggatatgttagggttgtcagggcaactgttaacggcagcatatcatattttcccctctctgctgtgggctgaatattttactgtgtggtagcaggaagaagattggaaaaaggtgctgcagcaggaagaagctgggatctgattgaacaggttgtgcagtggtgggaggcatcagaccctgcgtgtctgtagtagggcttttctggaaggagtgtgtgtgtgtgtgtgtgtgtgcgcgcgcgtgtacgtgcatgcatgagccggagcaatcaccagcgcatgtgcctgtcggggagtcagtgggagggggctggtaggggaggtggggaagctgctgctaggtgaggggaactgcagggcctcagttgccaagtggctggtactatctgtcagctgtttgcaaactgtttacccataggggatctattacaagtgctcaaatgaacaggcagcttaggaactagcagcttcctgggagctgcaattacataagcatatatttttaatataatcacaattaaaaaaaaaaaaaacaagtagcagcggtatgcctggatcagctacagctctccgacatgagagactgaagaagaccaatgcaaggccaattcctcttggtttattcaccattaatgaggaagacgaacagcaaaagaatggaaattccagaagaccaaaaggtatgcattagctccaccctttggtcggagccagatccagcccttgtctcccacactgcctatagaacgttttataaactgtgctgctcgtgcatgctccagggagtgcttgtgacctcctagcacggtttgctggtagtgtttataccctctgtagggttgtgtatgcatgaaatgggaaacagtttttgtagattcggtgtatttcagatcagttgccttttttgacttaagctactttcttggcctagagatgtttaatttttcccatgctcacttcagcagtgaccagtcactctgtcctcatcaagaggaggaaatactgagttatcaaggtttaaacgaacatctccccaccttccttaggtgcctcagataatttttgcttattttaatgaagtgagtttctgctttaaaggatgagttaaagtgactcaagagtgcaaccttttctaggcagagggtcaaaatgtcacttccctttctatactaaaatgtcaagagtaaagaggagcacagcaaacattgagggcgaatgtggagggtgaagctagggagcagggaggagatcatgaggttgtataactgttgatgataactgaattcgtgtatggcagttgaaatgcacaggttacagaaaagggaagtctgacccttgtgttgttctttcacagtatgaaaggtagcagcagcttaccagcttcttgagagcctgtgtactgcatcattgtcagcattgtctcacagctgccctcccagggctgtaattatcagccagagacagcaacatcagacatttttgaaaaaggagctttaaggcctgtgttttacattttccagcatcctaagtcttgcttccccttccccaaaatatataagctgttcttaaacagatgggttatgagttttcttgcttttatgtgctgattaatttttagcttgctcttaaattattctgtcactgaggtatcaaattttcttctgtgatgcagagaggtagcatgacaaagtagaaagcaaatatttaagcaatgataaagtgaagagtgttaaatagaatccagtgtctgaggactcgttttctttttcctgtttctcgaattaatcttactttgcttttcttaaatataattgaaactgtctacattaaatccaaaagcatattacttcatttttatgagacagtacacagggaagttctaataagtagaatcttactactgtagttgatttttatttactatcagacctggctcctgtctgagaaccaaatgacctcagaaatcaaatgatgctatgactggagggtgacttaatgtgattcttttatttgcctgtgaattacatcattgaaccagagtgtgttgctctggatgaaaactcaggactttaaatttttagcagcaaatcattttgcctctgaaaagttggtaacttttaaaattaatgtagatttgttgaattgttctcatggggtatttttggaaacattcttgatttgtggtacttttccttggatgtcttggacagtaacttaggatagccatccattttattcttaataattttcttttcttttcttttttttgagatggagtcttgctctgttgcccaggctggagtgcagtggcacaatctcagctcactgcaacctctgcctcccaggttcaagcaattctcctgcctcagcctcctgagtagctgggattacaggcacctgccaccatgcccagctactttttttttgtatttttagtagagacggggtttcaccattattggccaggctggtctcaaactcctgaccttgtgatctgcccacctcagcctcccaaagtgctgggattacagacgtgagtcactgcgccctgccctcttcttaataattttcttgaatacctctgcctgtctcctgttgttgtttttgtttagttgtcttttagtatttttttaaaaaggaagagaaaggggaggaaagaagatgcttcgaaaaacctacttatttttggcaatttttgcagcttcttggataagagagacttaatcaaggagtttctgaccccctaccatttttctttctatccctgcccatagtggtgggaagggcaagggtaggtattggaggaatactgggagaaaaaaatcctgtgctgataaggatgtccaaactttctgtggatcaccaattgtctctatgacacattcaataaaataaccagataaccgtggatatctctaattatgctcaatgaataacactattgactttgactgaatttttcattgggtccatcttaacaataggaatattcactttgtagtccagctttgttccatggaaaatgatggaaatgttctgtatatgcactgtccaatacaatagccacagctgcagagcttgaaatatagctagtgcaactgagaaacaaaattttagttaaatagccacatgtgaccaccttattggacaacacagttctggtctgtagcattgttacgttctgaatttgtgtcttctctggttcgttcgtccttactgcttcctgacgttggatatggttgggtcctgaaatgaatgtggttattaagagaacatcaaggagcagacagcctctgtactgcatgagaacacagaaacctggatgtgtagacaatttcattttaccttttccacttaaatgttgttgcactgttctgattattattattaccagtcactagttgcctgtatcatttgttgcaccttttaatggactcttaatttttttttctcctttttatttttattttttctttagtgacagggtcttgccctgttactcaagctggagtccaatggcatgatcatagctcactgcagcctccaactcctgggctcaagtgatcgtcctgcctcaacctccttaatagctggaattacaggcacatgccaccacacccaactaattttttaaaaagctttttgtagggatgggatcttgctatgttgcccaggtgatcttgaactcctgtcttcaagtgatcctcccaccttggcctcccaaagggctgggattacaggcgtgagccactgtgcttgaccatctcttattttctaaattaagtattcccaaagcatcatagcaagatgacatacagtttattttttgtgtgtgactattgcgatacacaatcagaaacttttcttttcctaccccatggcctcatctgccaaccatacccaaacctggttttcatgcttagtgtcttttttctaccagtaataaagaagtttgccatctaaatttgatgagttgaatgtttctgttcaggattatcctggctaatgatgagtaccatcttttcaggtaccatactgttgggcaaacatcaaataactcagtaagagagaacatggagattaacatctggccttctatggtggcttcatagttatctggtggggtgacaatagtttgtttagatggcagactagataattcttgaaggagtgattactcttccatgtaatcggtaggagtgtaatgttttacatacctgactgttattaccacagtaattaaataatcactgggagcgagctgggcttatgctgatgctcttatacctcggaacctcaagcctccttgtaatgctgacttcaggactggcttaggagagactgtttaggtgctgcagtaactaaatgcccttggataggtctcaaggcaaacctgccttagacggtgaattttgctgagcacagcgattattaagtaataaggcattttcctcctaaaccagcatttgttaaatgctcactctgtggcagattactctgctggggttttgtggaagtaatgcaaagataattgacatggtttctgctcacagaagtggaggaagaaaaatgtgtacaaataatgcaagagtataaattgaagtcaggaaagggagaggatgagagtggcagaaatgttaagtgtgtgccaactgtgaagccattagcttcaagattttaatctgaaacagggcgtttaagggatatagactcctatcccatcccaaatgtctggctgaggttggaagctcacacagaccttaaaggcgggagcacagaataatgggcaaagagtcttttaaatttcattatagaagcaagacatccacacaatgtttacctgtggatagacacttctagaggcttcatgactattacacaatacattttacaacttctgctttgtaatggcctcctgacccattctgtgaactgcctaaagcagtcatctgattgactttatactcctgtgttgtttttatataaaacctgattgatgtccagatctaatactaaatttgctcatgagacttgactctaaatgacttttacttgattttatcaaaattatcatctccctcaaaagacgaaagactcataactctctaggtggatcatggtcttcctgctttcagtctttcctctttccaacccatcctccatagcgtgccactatgacatctttccaatggaaatatctgcccattagaaataaacttctcatgaaacagaggtcttgactaggagtcttggagccatatttagtctgtagctaagtttatttgtcccctgcaggtgtttatgagtcaacatttaggaactgattttttcataatctagatttcagcttcccttgaaaaattggaagacacagccacccttgtcctctttcttcaaagcagtcatcagctggagctaagtagcagctgtcaccatatgctatagatgggtcatgcgtgctccagtgcccctcttctagaatatgcattacatggcctgcctcagttatctacattaccgtagtcattgcttttgtgacccctgacctaaggaatagtccaagccccttagcatggcacctagactacctaccagctggtcccttttgccttctccatcctctttcctgccactctttgcactttgtgctccggcagcaccaaagtgcttgttgcatttgcctgctccatcatgttcttgcatgcctctgtgtcctactcatgctcatctgtccattttcctcatcttgcttcctcatttggataactctgacttactctgtagaatcagatcacatggcatcttctccagactttccttgggtgccatctgcaggaaacctcctctctcgctcccagcctcctcattcctggcacaaagggcagcccctcactgtgctccttccgcactgtaaatccattactgacttacatcagtgtaatgaaatcatccatgcacacacccatgtccttcttgacactgtaagctttgtaagggccaggactcactcctctttataccctgtacttttcagagtaaatggaacattatgaaacaaaggtaaacttaacacttaaaataactttcacagactctgaaggtcttcataatatagaaattctaagaaatgttgatagcattagaattgtcctttcaaggtaactacttggaaagagacaattctgtgtttgatacattaatcatattgctctctatgaaactgcatttgtctattagtataccagagattatctctttgttgttgtcttcttctcctcctcctgctcctcccccctttttttttttttttttgaggcaaactcttgctctgttttccaggctgaagtgcagtggtatgatcatggctcactgcaactttgaactcctgggctcaagtgatcctcctcagccttccaagtagcttgcaactagaggtgcataccaccacacttggctgttttttttcttttaattttgtagaggtggggtctcactttgttgcttaggctggtctccaactcctgggctcaagtgatccccacaccttgatctcccaaagtgctgggattgcaggagtgagccactgcacccagccctgttttgttgttttctgtcatgctattcatttttctttggtggaaaaacaaaggtatatagttacaaggtgctattaattgaccactttgtgaatattaaggttaataatgctttctgtcccttttgttagctaatcatagattaaattgtaaagaaatacaacttctccttgagatcgggacacagtggttctgagaaactgtactcccccgcccccactttgttaaaatgtgtatttctggagcctgcagtgacttctcttcttttggcttttccactgtaaaggtagaatttcctccagttaaggtttccaaacgaaatataatctagtgtttaccatttatattcctatcagataagtgatgatctagcaactgtaatgtccttttctaagtcatgaatctttttgttttccaagagaagtcttagaataagaaatatgaatgcctctatagaatcattctcatatatctccttgtttctttttctcttttgttctgtaaggcttgcaccattgtcttttcccagtgtccttatgtgtggcattttagggctaggcaaaaggttttagccgtaaaatttaacagctagggaggcaaaaatgtattttagaacagtggtatcaaagatccttattttgaggaggaaatcttgaggtcaaattcattggcataaacttttatttgctgaagagatcttaaatgtaatattttattcaaaatatttatataaaaataataggggatggagcaaggatcacatcatctaatgtatgtcttgtactcattggattctctgtaactatttgaataaatgaatacagctgttccccaggcattatgtgttatataagtagaaattaccacatgcgttactgtgtacaagaggaacatgatttaacctgtgtataaccaaagtttttgtatagtgaggtacaatataaagtgtaatttgcttgctatataaaactaaaaggctgaaaaattgtgtgcctgtttccagagctataattgatggagctaaaagagctgactcctccaatcataggaaccaaacacaattaagtgtttacttagagcctcccagctgataactcttagatattatttattaaaagattatagtctgggtttgaattgaatgtccatttccattaacatctgtgtgtctccaagagcaactttaattcgttgttacagaaattctccaggtggctccaggcaccttgactatgtttttcatttagcagaaacttaagagcaatgaaggtgattttactgagagactccatcttaattctcagatcatctagacatttaggaaaagcccactttatgttgcaccttccatatgttatattaagtttatgttctagatttgccaatttgagaagataagtcataccccattataccccagacccagatgccgaggcccaaagtgtgtcacagatggacataaggcattgtttgaatgtttaccagagcattatttgacatttatgccaactgtaaaatgcaggtcctgtttttcaggctatctgcccagcaatggtttgttagtaaggaaattctcatataatctttctagattccaaagaatttacaatcccaggtccagtgtggagtgggaatgaagttcaggagtatagacccagaaaaattatcctaacagttttgatcttgaatatatatggtttgggggactagattcattctaaattaaagttgcaggcctaataaagtagtaaaaagatattaaaatacgaagattcagcagaacctgtcattctaaaaccattattggaacaacagtatggaggctcgagccacctccatactcctaataggattgctttcaaggtcaccagctgagtgcatgaccaagaggtgtcttggagttgggcaggagggaagagagttggaatctctattagccccttttaaaaacttcccaaataatgtagcttaagatctaagtaaaaatgcaactttaagagaagttacccccttacaaaccagttgtcgcctctgagccccgatttagaactatagaaattcagaaccagcccttatcagggatatcagtttacatagtgggaaaacaggatactaggaaagtttcaccacgttcactagtagtcagtggtacaggtcagagtttgccacagttattagaaatccaggctatatttggtgtgagaaactgtgaaaaaagtgcttagaaaaaagtgatagaaaaagtgctacatatggaaatatgcacattactgttattaatatttaaactttctaagcctcagattcccatctgtgaaatgaaatgaataaaatcatgctcacaggtgctggcgggtattagagagaatacacaagcacttagcttattctctggaaaataattggagctgattatgtgacaattataatattggtaatttataaccaaatgtctcacattttctgataacttctactgacatgttctgttgggagaatggcctggtggaaagaccatcatgcttgtctgtgccaaaccttagccagtctctttttatagagatattttccctaatctctttccttaacttgtgagtaaaaatttctaggaaggctgccttctttcttgtgttgttttagtcactttcctaccataggcatatgtgactggatctttgttctgtgtttgttcatgtgaatcagaagtcctagctgccaggtagattgctcatgcagtaccctgtaattttgttgtgttagatgaaggaaataaattgccataatgtcagatcacctcacttgttattttaaatatgattaagggagtgtacctgttattccttgggattaatggaaaactctgatctgccttaatcagggaacagtagcagtgatcatctgccattttaaaagccaattcaaaaggatttttttttttttgcaagggtttttttttccttctgatgtggggtgtgcatgtgcgctcgtgtgcatgtatgtgagttgcttgatggcaatgtcctatgctaatggacaggtttctgccagtggttgagattatggatgcttacactggggatgccaaatgtatccaggcttatttttgcaggcttattttcacatacttattttcagcaccaagacttcttattctaagtttggttagccatcttttctttcaatacttcttgtttctctgtgctagtcttgatttgttctctagtcactcagaagtaagtgctgtgaacacttacgatggagaaagcaccaaattaaatgttatttgcggctataattgaacatatatatgccagcggatctgtgtcctggtgaagtagatactgtctcgcttggagctcttccctctacctggtatgtacttctgctgcttctcctctctccacttcactctccctggtcaacacctacttgtccttcagtttaaatgtcatttccttggccaggcatggtggcttatgcctgtaatcccagtgctttgggaggccaaggtgggaggatcatttgagcccaggagttcaagaacagccctggcaacagagaccccgtctctacaaaaaatacaaaaattaaccaggtgtggtggtgtgcacctgtggtctcagctactccggaggctgaggtgggagaatcccctgagcccaaggaggtcgaggctgcagtgagccatgatcgtagcactatactctagcctaggcagcagagtgagaccttgtctcaaaaaaaaaaaaaattgtcatttccctaaggatgtccccagaccaagctagtctcagattctaggccctttcttactccaggcaaattgtgtattaagtgtttgctgagtcgtttattgtctgtctcctcaactagacgaagcttgcagaaagcaatgaatatgtctgtcagattcacactgtgcccccagcaactaatacagagtctagtatgcacgtactttcttttattgtgcttcatggatactgcattttttttacaaattgaaggtttgtggcaaccctatatcaaggaagtctgttggcgccatttttccaatagcatgtgcctacttctcatctctgcatcacatattggtaattcttgcaatatttcaaactttttcattgttattctatctgttatggtaatctgtgatgggtgatctttgatgtcactattgtaattgttttgggatgctacaaaccatgcccacataagatagcaaacttaacaaatattgtgtgtgttctgactactccaccaacccagccatttctgtctctctccctctcctcaggcctccctattctttgagacatgacaattttgaaatgaagttaactaataaccttacaatggcccctaatctaagtgctcaagtgaagaattacatgcctctcactttaaatcaaaagctagaaatgattaagcctagtgagggaaggcatgttgaaagcctagataggctgagagctaggcctcttgcgccaaacagccaagatgtgaatgcagaggaaaagttcttaaaggaagcaaaaagtgctaccatggtaaacacaaatgataagaaagcgaaacagcctgaatgctgatacaaagaagatttgagtggtctggatagaagatcaaaccagccacacgttctcttaagccaaagcttaatccagaacaaggaccctaactctcttcaattttatgaaggctgagaggtgagggaactgcagaaaaaaagtttgaaactagcagaggatggtcatgaggtttaaggaaagaaagtgtctccataacataaaagcacaaggtgaagcagcaaatgctgatggggaagctgcagcaagttatccagatcttgctaaggtaatgatgaaggtgagttcactaaacaacagagtttcaatggagatgaaacagccttctgttggaagaagatgccatctaggacgttgatagacagagagtcaaagtcagtgcctggcttcgaagaacaggctgaatctcttgttaggggataatgcagctgagtcattgcaatcattgacttggagttgaagccaatgctcatttgccattctgaaaattctaaggcccttaagaattatgctaaatctactctgtgtgcactctgtcagtggaacaacaaagcctggatgacagcacgtctgtttatagcatggtgtactgactattttaagcccgctattgagacccactgctcagaaaaaaagttttctttcaaaatattactgctcattgacaatgtaccaggtcaccctgatggagatggacaaaagaggttaatgttgttttctttttttttttttttttttttttttttgagacagagtcttgctctgtcacccaggctggagtgctgtgatctcagctcactgtaacctctgcctcctgggttcaagctattctcctgcctcagcctcccaagaagctgggattacaggtgtacaccaccacacctggctaactttttgtatttttagtggagacagggtttcgccatgttggccaggctggtctcaaactcctgacctcaggtgatctgcttgccttggcctcccaacgtgctgggattacaggcatgagccactgcacccggccacaaggaggttaatgttgttttcatgcctgccatcacaacatccatttttcagtccatggatcaaggaataattttgactttcaagtcttatcacttaagaaatatattttgtaaggttatggctgccataggtagtgattcctctgatggatctgggcaaagaaaattgaaaaccttctggaaaggattcaccattgcagatgccattaagaacatttatgatgcatggagggaggttggtgtgccaaacccctattgactccagcggggatggcaccaggttcaagaggctgaagaagagacctagagccagcgaatgagacatgggttttactggggacttacgtacaggtgagagagtccagtggtggcagactgggcaaaaccaccaccaccacttgcaaaacacatgcaatttatataacattttcacttaacaccctccccctagcaacttccacctggcaaacctcatttaacccaaaacaatgggccgtgatcccctgtatggcccatgttccacaggatgcgtctggggctcaggtgttcctcatagacaaggaatggatctctgggttggccacttctgagtacacattgaggtgctctgccatacggggtcattctcagggtatactcaggtcgcattatcactgtcaggtgcatctaccatacaaaactcaaaatatcaacattaacaggtgtttgtaagcagttgaccccaaccttcatgaatgactttgaggggtttaagacttcagtagaggaagtaactgcagatgtggtggaaatggcaagagaactagaattagaagtagagcctgaagatgtgactgaattgctgcgattccatgataaaacttgaacagattagtttcttcttatggatgaacaaagtaagtggtttcttgagatggaatctacttacggtgaagacgctgtgaacattgttgaaatggcaacaaaggatttagaatattacataagcttagttgataaagcagcagcagggtttgagaggatagagtccatttttgaaaaaagtcctgtggatgaaatgctatcacacaacatcgcatacaacagagaagtctttcatgaaaggaagagttcatggacttggcaaatttcattgctatcttactttaagaaattgtagctgggtgcagtggctcatgcctataatcccagtgctttgagaggcagaggcaggaggatcatttgaacccaggagtttgagaccagaccgggcaacagagtgagaacctgcctctaccaaaaacaaaacaaaacaaaacaaaacctagcttggtgtggtatcacaagcctatagtcctagcaacttgagaggctgatgcagaaggattgcttgagcctgagaggtcaagactgcagtgacctgtggttgtgctactgcactgcagcctgggcaacagagtgagaccctttcaaaaaaaaaaaaaaagggaagaaattgccgcagcaccccagccttcagtgactactatccttatcagtcagcagccatcaacatggaagcaagaccctccaccaccaaaaagattacaactcactaaaggctccaatgattcttcgcattttttagcaatcaagtagtttttaatgaagttatgtacactgttttgggacataatgttgcacacttaatagactacagcgtaacgaaaacacaacttttgtatgcactgtgaaaccaaaaaatgtgtgtgacttgctttattgcaatatttgctttattggggtggtctggaactgaactggcagtattctgaggtatgccttgttgaggcttcctaaatcttcattacatcaacaggtgtcacaccctagataaaaagttgagaagaatacatccaacaattttttacatccgtaatagtcttagaaactttggtatttactttttccactgaaacagttctctttttctgttgagctgttctgtagaacttgaaggaaattatttctaggtgctgattcaagacctcttagtccatgggtgctaagccagatggcagaagcccaaatctggttcctcataagataactgattggaggcaacacactctggccctgccagccagagaatgagacagcatagctggagaggtagtctgtctaggcctttaaacattccagggttcaggactttgttttgaatctagcaaaggcctggagatatcagatcaatcaccaccctgcctagtgataatgacggtgaattttgtattaacgacctttgtccactagcctttatgcagggatgacttgtttgttttcggctaggacattggcttggacagtctgcagtggcttacttggatcaaattctagagctagaccattccagaagcaccttctaccatcatttttccttgaactgccagagcttattataaaacgttcatttcgtgtttgtggcatatcctcattacagccgtgtttgaattattataagtattttctttccttttgcacagttgaaattcagttatcatgaccatattaagtgtaagccagggagaacttgcatacacaaatccttagtgatttaaactcccactgagctcttgactaatagtgtccctcactcccacctgctgctctgtggattaggaaatatcgtggaaagtgaactggagctgctgctaatttaacaaagtccactgtgtacctagccacattccctctagttctccacctattcagtgcatctcattaagccaccctcacaaatttccttttatgcttctcttttataatactatctctgcactgcctttttttttaaggcccagaaaaacaggttctttgtgggtagacagttcctggtgcacacctttcattcagcactgtaaagatgcaaagtggcaactgagatattaggattcaaaacctcagcactctggatttttaccctgggcttggggaatcaaattttctttttatgaatttgctagctctgattcttctgtgacaccacagtagaaaatcctatcctaattcttaatggtattgttcagaatcctataacttccccttacccatctagtagtttagaataccataacattaaaattagtatgaattttgagtggaactccaaactgacctcttatatcaacacttctaatcatcagccagattttctcacaatctaagtaatttcaaaattattctcactccactgccataagtttcagtgacacacatctactttgatgctgcatgaccttcacttgaacttcattcagccagctgtgtgggtttatgctgggacttgtttccacaccacctacgatatcatgaactcagaaattcccctaggtacccacagacttcagattcagcaaacaatgatttgctccctaccctatgctagatgtttccatacgcagtagtcttccgcttgtccttctaggagcctcagtcgatgcctgaaacttcagatggtaccaacccctatatgtatatactatgttttttctatacatacctgtgatacagtttaatttataaattagacacagagattaataacaataataaaatatagcaatataccataataaaagttatatgagtatggtcgctcccaaaatatcttactgtgttgtactcacctattttcagactgtagttgactgcaggtaactcagaatgcagaaagcaaaaccagcgatgagggtggactgccgtgtgtgagctcatcctcctacctgaagaaaagcctcacaccttctgaaccttcatcctctccaccacccccaggcttctgaaccccctgtgttctcacagttatgagtcctccttcccactcactggtgttttgtcaagcccggaactcacgggtaaccatttcaaagatgcacttgcaatgatgcctgggccttccttgcaggctggagtgtcccctcatagcctcctgtttctttaggtctgtggagtgttactgtgagactcctaaaaaccagctgtgtgggtcgtttctactttcttatcctctcaccatcagctgagcccaatttgctgctagccggttgtcaaatcacatcacagagatgctcaccccattttgtctactgtatgtcactcttttgcccaggctggaagtacagtggcacgatcttggctcactgcaacctccacctcctgtgttcaagcaattctcctgtctcagcctcccgagtggcagggactacaggcacacgccaccacacctagctaatttttgtattcttagtagagacagggtttcaccatattactcaggctggtctcgaactcctgacctcaggtgatccacctgcctcggcctcccaaagagctgggattacaggcatgagccaccacgcccagcatatacctcaatcttaacatctaatatttgctatgaatattgaggatgttttaaattagcttccaggcagggcaccatagctcacgcctgtaatccaatgctttgggaagcagaggcaggaggacctcttgagcccaggagttcaacaccagcgtgggcaacatcgtgatactccatctctgcaaaattaaaaaatagcccagcatggtggtgcatgtatgtattcccagctaactcagaaggctgaggtgaaaggattgcttgagtctgggagattgaggctgcagtgagctataatcatgccactgcactccagcctgtgcaacagaatgagaccctgtctcaaaaaaaacaaaaacaaaaaccgaaactgggtacagtgacacatgcctgtaatcctagcactttgggaggcccaggtgggaggattacttgaggcaaagagtttgaaaccagcctgggcaacatagcaagactgcatctttacaaaaaaacttaaaaaaataagtagcttctacatcataatttactctcttgactagagggagaaaataggtggaaagacatatagcctgtattattctaatttaaagttcaacaggaaagagaagaatgaggaacttctgttttcatttgatatgattttgaagaaggaagaggttaatgtttaaaaaggactgttggccactgacactggatttcactaaatcctgagtgtcaaaggtaattgcagtcatgtggctagtgacatagttttttggtgaagcattatcaagaggagcaaattgaatgctccagccccatctgaggatttcttggttatttattgtgagccattataactacagatgcttcatgagagagttaatataattactggtctatatctttttactttaggagaacagagttaaagaatgagtccattactatttcaggtgatgtgtttagaaagcagagctttaattcaggacttaaatggtattaaatggtgtttcttgaattccattcttctgacacttactgtcataatcatttgtagtgaaacctatgtagtcattcccagcatcccggatttggtttcttccaagattagatacactttaatgagtaggtaaatttcctatttcagtttctctttagtgtattttatcttcaaactttactgtgatattttagtgtgaacattaaaacaaaaaaaggaaaaccatcctgggttttgactgatggttcatcctggaccagtctatggcatttagcattatcttttcttttattgggaccctgaaacttacagtttatgagacttagaagttgactgaagagaagcaggcatccctgtatgaagtcatagcaggtatatcaacacaaagcttgggacagttaggctcacaaaaagtattggtgtccaaattcagaatgcttgatctctgttaagttaacatttgataaaaaaattaatttctttatcctgatgctgatgaagatctcttctgagaatcacagcgatgcttcaggactcataatgatgtgacaaatctttgttactgtggtctctgatgaaaaccaaattttcttttctttcttttttttttgagacagtgtctcactctgttgcccaggttggagagcagtcgtgtgatcttggcttactgcagcctccacttccccaggctcaagcgatcctcccacctcagcctcccatgtagctgagagtacaggcatgcgccaccatgccccgctaattttcgtgtctttgcaaagatggagtttcaccatgttgcccaggctggtctcaaactcctgagctgaagcgattcacccacctcagcctcccaaagtgctggcattacaggcgttcaccactgcacccagcctgaaaaccaactttctaacaggcaaattgggcaagttaggttttaatgtactaggagtagctctgaaattttaaattggaatgtgtgtcaaagaatttgtagaattgagggagcttgcagtgtgttgtggtgtcttggaggccatacggtgtaggagttaaaacttggaccctggagccagtccagagcccatttttgcctcctcctaaacatatgcttcaggcaaagtacttacaatttctgtgcctcacttgctttatccataaatcagggctagtagtgacacctatctcatagggttattaaagattaggtagaataatatctaaaacatgcttgtaactgtgcctaatcaggcactaatcaagcagcctgtaaatggtaacgaatgttattaatatttggaaagctttcttagttcaacagctttatcttagtagttttaagaaaccaacatttctgctaagatgtctaaattttgtgtttttttaaatgtcttctcttaaatttaaaaagaaaagaattctttaaaaaataaaatttgttttttctttttttttttttttttgagaatcttctcctggaaggatgtctaaattttggaagacttgaaacaagttaaaagaaatttgtttctggtctatgagaaaattgaaatcagtaattctgactttaggcaggttactaccccccttcccgtccttctctcttgttttctggatcttctgcttggcctccaggagtccagagagggaactgtgggatgtgaagactcattaaattcacatgaggtatcctttaagccctccattgagattgacccccgcttaagtacatttcagctcaaaacgctgccttcccccacttttctggggagcagggattacttttcttatagcccctgttaaaagaaaactccagaaaagttaaattcagtggagtttaattgagcaaaaaaacagaaacgattcacgaatcaggcagcgtccagaatcacagcagatttggagactccggggtgcctcgtggtcagaacaagtttatggacaaaaggggtaaagtgatttacaggaattggaagtgaggttcagaaacagtgcgattggttacagcttggtgtttgccttatttgaatgcagtttgaacactcagcagtctatgagtgattgaagtatggccgctgggattggccaacactcagctattgttacaggtgcatattactagttaggttttcaattttgtctgcctattaagctaggttacggtttgtccacaaggactcaaatatagaacgaagtcttcaggccatatttagtttgctttaacacccgcctcaagcttcattcctttttggaggtgaaaggaatttatccagtgttcttgcacgtcagtgaaggaaacctttccagtgaaaaggagtctgttgacctgcctaggctggaccagttccagtatcaacctgggccaactcccagtactgaggctggaagagcagatgccccctgataaataatcttttattgtttccagaaatttcccaaagcttataaaccttaaaatatcctgaattatctaaaactgtggattgtgtcctctaaaaactcctaccaatgcccttccctccccacatttctcttcccttccctacaggtgactttcaagtgtggtttgtgtaaagtattattagttccagctatttagtgacctcttcgttctcagtgaaacctaataccatccacagtaatgattatgcatgtctttaggtagggattaacttgttacaagttttctttgattaccacagtcatcttatgtatattcaattctccctatttgatattgttatattatacagtatatcagtggcaagatgtgttgaattgagatgaggctgttaagaaaaggttttctaggaaaacataaattggcatttactcaagaattttctttaacattacattcaattaaaaacacagatttttttgttgttgatttgacaaacaacaaagaaatttctcaaggcttaaatacattattaaatcttctttaccaatcactttggttttgttacatcagcatgtttataaaggttttctgaaggaaaagattatatcaacatacacttcacaggcaatgtctaatggttgtttttcccacagtggaaaagatactgtggttacatgaactacatttaaaattccttatttttgctacttgccagtaataagtcctatatataaattattagatttttatttttttcaaacttttaagttcaggggtacatgtgcagatttgctatagaggtaaacttgtgtcacgggtgttgtacagattatttcatcacccaggtattaagtctggtactcatatgtttctggatcctcttgtcctccggtaggccccagtgtctgctgttcctttcgatgtgtccctgtgttctcatcatttttcttttacttctgactttttataacttgaaaataatctcagatgcctagcgattgtctagctatagcaaatatttttattggaacttattatccttgacaaccacttttataatagcattgtgaggcaaacagtacttttacatcagacacacaaaaatggggacactaaaattaggacattatggctaatgttcatctctctctcccttcctctccctatctccctcccgagggggagaatatgtacccttgcagccaatttctgtaattttactatatatatatatatatatatatatatatatatatacacacacacacacacacacacacacattacatggaaatgtaatatacaattgagttcttaaaacagtgttcaggaagatactattttatggcttgcgaactcagcttatttcaccttataccttgttgtaagattatatgcctttctcagtcttttattttatcgtctgtttggccctaaaaaagggagttacaatgtttgcaaaattattttaaaaaacaaaagaagcagagggccaacataataaatactcatggaccccaggacccagaccttttaaacacattttaaatattttggctgggcatggtggctcatgcctgtaatcccagcactttgggaagccaaggtgggaggatcacctgaggtcagtattttgagaccagactggccaacatggcaaaacctcatctcttctaaaaatacaaaaattagccaggcgttgtggcacatgcctgtaatcccagctccttgggaggctgggcacaagaatcgcttgaacctgggaggcagaggttgcattgggccgagattgtgccactgcactccagcttgggcaacagagcgagactatgtctaaaaaatttttttaaaggtaaatattttatattaaaagatatatttatgggaaatgggctggatgcggtggctcaggcctgtaatcccagcactttgggaggccaaggcgggtggatagcttgggccaggagttcgagatgagcctggccaacatggtgaacccctgtctctactaaaaatacaaacatttgctgtggtggcacccacctgtagtcccagctacttgggaggctgaggcaagagaattgccagaacccaggacgtggaggttgcagtgagccaagattgcaccactgcactccagcctgggtgacagagtgaggctctgttcccccccaaaaaaaaaacaaaacaaaaaacgatgtatttatgggaatacaaattattatggctaatttcgtcatttcctgtgtatccttccgtagtctcacctccttccatctctctccctgtttccctatttcccttcccagggagataatatgtacccttgcagcccatttctgtaattttaccacatatatatatctataaataatacatcatttgtgtgcttaaattgacataaattatgtcatattaacatatcagtttgctacttttacttcccctactgaagttttaaaatacccatcccaagtgataaatatagtttaagtgctgcctagaattctgtagtgtgactttactgcagtttatttactattccccaactgatgaatggagaagttgattatagttttgttttttcactttgttgtgactacaaatcggtgctgcagtaactttttatagtgctctcttttagcatatatgcaaatatatattcctagaagtggtatgtgctgtgcattttcacatgccaaattgccttccgaaatagtttgatcagcatacttctgcctgcagctcatggcagtccctatttccccatattcacttccacttgatttagtaagacactttgatttttgagaattggatggctataaaatggtatttagttttaattagcaaaattaaacattggttaatgtagatttttttaaataatggaaaggacagcactgtttaggtggtttttttccccttaggggaaggcaagagaaattgctgcatcagtaatctggtataaagctaattgttttcctaaggtatgccgagtcactgggggaggaaacagatggtaccagcactgtgcggatctgtgggaagggcaattatcatctccattgacatggcgggtcagggttagagccaggtttcagattcttcttcccccacccccctttttttttccccctcagaaatccttgtttggacagattcttcttttggaaccacatcgagttgacagacctgagcctttggttttctcttcttcttgcttcacttccttttggtcattcagcatcaatactattaggtgggcagagaaaaagcaaagtacataaaaagttaagttggccgccttctttcagaataaaggagggaaagggagaaggcaccatttggggaagatttctgaggagagcatgtattgaaaactttgcttaagattagatttggtaattatttctgggtttccattattcatgtagtccttgggcctgattagcatttgtaaagtataaactctacacatgcaaggcattagcatgaataattaaaaggtagggagttagctatccatgactgtggttttcttttattattgtagagtctattttagttaacaagaggaagcttagacttgcagactgctggtctggcaacctcagttttgctttcagctcagccatatatcatgatgcattgtatggctgccttattttcctggaaaaagaaagttactttgctgggaaaaaaaaaatcagtattctgtgcactctattcatatcaattataagagtgcagtctgaattcctgagaggagagctctgcttagagtaagcatatcaaactaagtgtaattattattgtacttataatttaaaactaccttggtctttgttataacccattgattcaggacccatcagcccctacaaaatatcgctccccaaattttggacatttcccaggggtatctgatgtgctcacaaaccagtcctctgcaggaatgccacattcatcctggaagcatcttcctgccggtgctctgtgtgccactccactacttatgctttgcagttatgtttcccatactggggttccacaaggcactcctagtgcaggcctttaatgactgtgccaacaaaagagtgtttctaattcaggttacttttgaacttgtaagagcctttagtattttattacgaatcacaaagaaaggaatgtagtatacttatctggccagggaataattctgtgtgggatgtctatgtgtgtataccactttaggaaattatgtagcatgtgtatgcgtttgtgtgtgcacacacagagcacttcctaagagattcttcatttgctgctccttggtacaaaagccatgagctggatctattgttgcaaatggatgaattacacttttaaaatggcttttggtagattccttgacaagccctggtgtatttaattttaaagtcaaaattggacccctgctacataaaaaatctataaatctaacttggctgttggtgaaaaatgcacaaaaaggcatctcagcattttctagttcttggtttggaatctagtggcaaatactactacctctgtgaatgccaggctctggtccatgaagccatggctgcctgtggccctctgaattcacaggaggaatctttccttattctgcagcctcacacccagactgtgatcctcccttcctactccagatgttccagtgagtagaggagaagagaaaatttgtgatgggaacttaatggcttcatctggagccttatctgagagctgcatgtgagcaaaccatggtggatctgtctattctctctgttctggaaggatgagtgcgatgaaagttgtcatgctgtggtctgatcattgcgtaacttaagtttgacatgtgcaatatataaaaaaagccatctgggcataaaaattggataaataactagggtaaaataaatgataaataagattaatgagacaggagtggaagggaaaatctgaaaaaatttccatttccagcattataatatttagttagtaagagaaatgacaaccaccatcatgagtggagcacttaccatgtggaagccatgagggtgttctcttaagggaggtatttaccccattttacacaaggtaatacctaaaccccagggtgaagtaactagcaagaaatatacacagctagcaaatggtggagcagctttcaggcccctctgactccaggccacctcctggccctgtgataagaatataagaactggagaggaagtgagtgcttttcatgagggaacagacctccaggggtctgttgcccgaagcttcatagtgactggtcactgttctgcttctctggctactgaattagtgtcaattaaaataaatacatgtggcaaactgtttcaacatggaagagaattaagggaaacatttcaggtttttagttctactttggaaataatattattctttatttttcttttctcaaaaggagcatgtgattatgtttagaaagtttgtaaaacataaaatttacattgcaatgagggtaatcacaataataagattcttggaaaactcctgttgacatgtggatgtattttttttccgtctttttctgtgcatcttcccaatgatttggaaattagaggctctgctttaaaatctactaatggttatactgtaaaagatttttcttcaaataatcttacattatctgacagtgacaaaaatatttttattctgctttgtaatagatgagctttttctcttcttaaaataaaaaattagagaaataattaagacctggaatatgggattactcataaatcaaagcagatgttgaaacacctgatttttaagaagctgttagaagtttgctttttcccattcaaatccctttgggattcaggtagatgcacttagtgtaaccacaagtacaacactttgctacgtcagcattcctacgtttagaggacgatagtatgtctaacattactacaaaacctgaaaagaatttgatttatttagagttactttcaaagtgattcaagatcagtgaaaagatgtttactaaacttagggcaattctatgcaacagcgagacagatcctccataagtgtacagacgcacttagatgttaagagattaattaaaaaacaagtcaaatattagtatgttccataaagaaggaattgagaaggaaaattccatttgaagaatcaatgttgagactgtgagcaacagttttcctggcctgggatgccaacgaaaactgtagaatttgaaatttttattgggataattgtttataataattgccagtatttattgaacacttgctatgtgccaggtactttgtatagataatttaattttaatcctcacaataatcagatgataaaggcagctactacaatttcctttatatatgactaaattgaaactcaaagaggttaagtaacttgctcagaatcacacaactaggaagtgctggagtctgaactagaatacaggtctgtctgactcaaaagtccactcaactgtttttgtttgtttgtttgtttttgagaaagggtctctctctgtcacccaggctagagtgcagtagtgtgatcatggctcactgccagcttgacctcccaggctcaagcagttctcccgcttcagcctcctgaatagctaggactataggcatgtgccaccatgcccagctcattttaatttttgtagagatgagagctccctatgtcggccaggctggtctggaactcctggactcaagcaatcctcctgcctaggcctcccaaagtcctgggattacagctgtgagccactgcacctggccattcagggttttttaaaactgtaaaaggtttgtaaaaacaaaacacagagaagaatgtacaacatacttgtggcccggaagcctaaagtatttcctgtctgacactttatagattaggcttgttgacccctgtcttagctctttctctgtctggagagataagtagtggagtgatcaagggcatcagttgtggaattggagggctctgcattggcttcaggctgttactgtcatcagctgtgtaactaggcaccgttacctaacctctgagtcttgtttttctcaaaccctgtaaaatggtgataacagtacttaccttggggttatcgcatgaagccccatattagttaggattgtgaacaataaatgaaactattggcacttgtaaatcatgtgttcagaggaggtgggtgggttctttttctccttggaagtgaaaaagtcacagagcctcagggctgctagcccaaagaggaggccagagctaagaaatctcaggccggacaggatggcttatgcctgtaatcccagcactttgggaggccaaggcaggcggatcacctgaggtcaggagttcaagaccagcctggccaacatggtgaaaccccatgtctactaataatacaaaaattagcagggcgtagtggtgcgtacttgtaatcccagctacctgggggttacctggggggcagaggcacgagaatctcttgaacctggaaggcagaggttgcagtgagctgaaatcatgccactgcactccagtctgggtgacagagtgaaactatgtctcaacaaaacccaaaaaatctcagcgaaatggagctagtatcctaatgacttcctgaactttcagatcaaactgaagccttttctacttttgggcctgtcagttgtgaatgcctataaatttctttattatttaagtcaacttcgttgggttttccacacacacacacacacacacacattgccatataggtacaattgcccaagccacctgtgaccgaatggcttgtgggatctcttggttcacacagtctttcatctcctccatcttccatttttccaaactcttaggtgatgtttgggactctacctttcatctccctctaaccaccaaacattctcaatccatttcctctgcacagataagcatgttcccttagacacaggtgcatgtgaacacctgagtctcaactcacagagacttctggttttcatttcattttagaaccagcgtctgcactgtcttgtccaaagtcagttggaaagaaaagtacataaatttgtgactgtttctcctttcatctcccttcctatccatgaatcgggcaggtcctggtgttcccagtgtcctcagttacttgtgctactctatgtacgggccctattccctctactcctatcctatcatcatgctgatgatgaacatcacagtttttaagtgttcctctaaaaggcagatgggtttaactttacagtgtgcaaatctaaatataggattctttctttgtatctgaagagggatccctaaaacttttggggtccacaaattatcaagtatatgtgtatgtcctaatgtgcatttttctggggaaaaggtgtagctttcatcatcttctcaaaaggacacatgacctaagaaaaggataaagtctctcacctttgtcagttgagaaaaataacaagtctccatcattttaggaggtttatttgtcaaagttaaggatatgtggtcaggagtcaggtctaatgcctttctccaaagatgattttgagggctccaaatttaaaggggaaagggtggtatattgagaagtacacaattttcatgtaagagaggggctagggaaaaacagtcattcatgcctttgtctggctcagtgaatctgctttcttttttttttttttttttttttgtgacagagtctggctctgtcacccaggctgagtgcagtggcacgatctcggctcactgcagcatccacctcccgggttcaagcgattctcctgcctcagcctcctgagtagctgggattacagatgtgtgccaccacgcctggctaatttttgtatttttagtagagacagggtttcaccatgttggtcaggctggtctcgaactcctgacctcgtgatctgcccaccttcagcctcccaaagtgctgggatctgcattttttttttttttaagtaagatgacatagacatggggtagaggaaaaatgcagggaatatgcattttacataagataacaaagacaaaatggggcaggggaacaatcagattgcatttgcatctggtgggtggtgtggggaggtggctgcacctgcaaagataaactaccaatttacactgcggtggtgaaattttaacaaaaacaccttaaagatcttgcagctcactaggaattttcttgtgggcaaaaatattggggaggcctgtagcttttcatcttgtagccatcttatttaggaaccaaaaaaggggttcctaaataagccagtcattctacaattccttccttttgggagttggccttctcttcttacccccaaggttctgacagccatcactgctgctttggagttaggagaagctctgtcctcatacagcaagagagagatatgttcctggcagctcaggttgaaactctggcccagggaaatatcactacatgatggcacagaaagcagtactttacgttataggttaggttatggatcaaatgggctttattttattcatttatttttttttttgagatggagtctcgccctgttgcccaggttggagtgcagtggcgcgatctccgcttactgcagcctccacctcctgggctcaagcaattcttctgcctcagcctcccgagtagctggaattacaggcatgtgccaccactcctagctaatttttttttttttttttttttttttttagtagagacggggtttcaccttgttggccaggctggtctcaaactcctgccctcaagagatccaccctcctcagcctcccaaagtgctggaattacaggtgtgagctactgcacctggcctcaaatggactttggtcagcctaggagccaagttaacatatgtaatattgtttctgttggggaaatatttttaaatgccagttaaatgccatgttcacatgtaggggactaccagtactggtaagtatatatgtataatggtgtatgaaaattgataggatcttgtggaatagtatcttaagtaaaaagaaaaagagaaccagagaaacatgacattgacaaatgtttacactttttccccattgtttgttgagtgttaactccatgtagttttcacatgaagctcatcctatccatttattagttgtatgacataaaggaatgagggatgtgagaggatgcttaattgtctgtccttttgtgacaactaaggcttctcttcttttccaaccacaggtaattaggagctgctactaagaggaaacttaaacaatgtcccccagtggatatcttttcttcccctgggggaaaatacctaaatttttttgcaaatagttaatttccctttgccccaccctggggtagggagagatgggtccagtatattcatatgacaaaagaagtatacctgttcagtaacataacatggtttggggatgtaagttatgccctttataatttgtagcttaaggaacatcctgttataacttattattttaattgttccacagactgaaacattccttaccaattaagccctccttgagccattattttgaggggactttcagctttcttattaatatcttctttttccagtatttaatttttctttgttttgatatgtataaatcaaagagaaaaattcaagacctgtgatccttaaagataaccgtaatataaacttgaaaatgttatttccctagcaaaatctatagattctgttggtatctatagattctatccaaatgcatatcgtttttcacactggggacatgtggacctatagaaacccctgtagagaaaacctttccaagaaagtttaatatacctatcaggaatacattttttaaaaaaacttatacaggttgagtaaccctaatctgaaaatctgaaatccaaaatgctccaaaatctgaaactttttgagcacccacgtgactttcaaagggaatgctcattggagcagtttggttttttggattagatatgctctacgtgtgtgtgtgtttatgtgtgtgtgtgtgtgtgtgtgtgtgtgtgtattctcacacttctcacttgtcatgaaaataaacctatgtatttaaacccagaatctggaagactagagttcaagaatgaacttaagtaagctatgaccaaattggaacggtccacacacaatcacctggatatgcatttttctgagaggattcagagctcctggtcttctcttggagaaagttttaacaccatttaggaaagttttcggagtaagttagataatggacttaaataaggtctttctcctcttcttggaagaaccatcaattttctacatgttcaagctttcagggtcttagagattcaacggagatagaaggtgctggctataggtagaagacagtaatggtaaagataaagagggtcagtacaattccagaggccaagtagagcttctgctaggcctcattttgtgttttgagcaggttggttctgctgtataagaagttttagtgatgaccttagtgttataaaatgaggtgtcacgctgtctctcatttctctctgtttgtgtgtatgtgtgtacaggagataacctttcatctgtggtatctatggacacccatgctctgtattgttggattcaaaggctctcaaggaaatattctgtccactgatttaatgcataggatttgacacagtgtgaaattgtcatctcaagttttgtttttaggccccttcttaaggagagagacatcttttgaggactagtttttttctagtttgtctatatcctgtcaatacaatctttcatctcgtgtagacatgacttaataatgagggatccctgtggattagttgtagcctcagtgtacatgaaatgagagatgataatggttatttaaggatttttcttaatcatggtaaaagacataacagaaaatttaccattttaaccatttttaaatgtatagttcagttgcattaagtacatttaccttgttatgcaaccagaggatttttttaacagtgaatttttctgcacaagtatttctatcttgcctagtcagagatttctccccagaaaaccatatatcttaccccaaggacaatataagtaaaatatgtttgctaaaataactgagcacatcagtgtaagtttttacaataaataaaagactcaatgttacaactgccaccaaatctgttactaaatctgtcagaattctaatttagctactgcatatcacaccctatgaatgcagcctttcttgtagcaaatcttcacatttcccatttctgtttcctaagtaacagtctatttctaggtaggctgcaagactgaaggcacacaactcagcacgcttggttctactaattcgttgcaatgatactgattgcctgttacactaagataggctatttccagttatcttccatgtcatagatttcagcctctaaaaaagaaaagtggttttatatggtacaaataaaaatggtaaggtattaagaactctaaaggttgtaattacttataacctgagaggtcggtaggttgtgccttccccattttacagacatgaaacctgaagctcaaagcttaaataatagtctcccattacagctggatttcaacttacgttgccttgctatagagtactatagggtgttagagtctaatgccattcttagacttatggggagataaaactgcagatgggaagcctttatcacatatgtctgagagttttgaaaaataattgaatcccaatgagaacgatacaatgctctcggtatgggtttttcaacatgtttcataggaattactttgcaaaactttgagataatcattgtagaattatgacttctaaggggagggtttaactgacagatggtctcttagtctcccttcttcaaaagttgaaaatagaagccaggtgtggcaagtgcgctcctgtagccccacctgatccagtgtctgagacaggatcccttgagcccaggaagtccaggctgtagtgaacaatgttcaagccattgcactccagcctaggggacagagtgagacctctttaaaaaaggaaagaagaagccggtgcggtggcttatggctgtaatcccagcactttggaaggccaaggtgggcggatcacctgaggtcaggagttcgagaccagactgaccaacatggagaaaccccgtctcttctaaaaatacaaaaattagccagacgtggtggcacatgcctgtaatcccagctactcgggaggctgaggcaggagaatcgcttgaacccaggaggcagaggttgccgtgagccggatcgtgccattgcactccagcctgggcaacaagagtgaaactccgtctcaaaaaaaaaaaaaaaaaaaggaaagaagaaaagagcacaaaaaaaaaactgggaagacacatgagacaatgctttcacatcatttcttggcactattaagtataacagttttatggtttatattattttattcaaaagaatttttccaatcttattttcttcccaaaaacaatttttagttctaggacaaaggatttattaattttacataataaaattatacaaatatatatacactatttctgtccagtggtgtttcttccttccaagtagacagacattaagtactttatttaataatactctaacaggctttggtgtaagccactgcctttgctcctgagaatactttgaatgaatatatcattcgccatttctttatctcttggttttcaggaaaatttcttgggttcatctagctaagttaagatgcataattttattttcattacttttctgtattttattcttttatggaaatattgccctttatactgtaatttcaaaatcagttaaaccctactgatgcagctcagcaatcagaatgaatcttccaattttcaaatgataaaaaccagacaacagagaaatgtaactgctttttcccaaactcccaaaggaaaacattagagctaagattatatttacatgtgtttttaaatcacatacttttgcaacagatgacacttatttgaaagaaagttttccttttcattcatcagaaaattacatgggagggttcatagttccaggagtttaagatgaatatatactttgagttcaaaaatacttaatagtcactgtaaagatactaggtgtacttcccggcttagagataactgtgttcatattactgaatccaaagactgtaaaggaagtgattacaagtgtgttgtatttactgcctatagtatatatattccataatgtctgctcacgcaagggatctaggttgtgcactccttatgagaatctaactaatgcctgatgatctgaggtatgacagtttcatcctgaaatcatctctccccccaccccctgcccctggcccagagaggggacctctgtcttgcattatagctatttgtttacatgtcctaatcaccttcttttggaatataaactcatgggttgaggagcataacagagaaaatgtatttccccccgctctccccagtttccctagtaacttagctgaatgttgagatacagatgattaattatggagtagctctgggtgactatttgttatgtagacttaatgcatttataacatgtttattctgctgttttcctgtaaatgccattctttcagatcagaatctgaaaccaaagagagccagccaatcacgtgggcaggattacaggagcatcattttaatgtattgacttttcagtctatttctgtatttaaatctaggatttccattcaatcaatataacccactaattgagtgttagactcacattataaaaatgattttgaaaagaaaataagataggagagattatagtaaagctctacttttattatgttttattcttcagttttgttccttgcacagggatacaggtttgcccacagggtggtggttcttcatctctgctgctgtgtgagtaatggctgcccaccgcctgaagtagttgtcatgataaaccgggtgatgccattgaacagactgggtttgggcaccacagggtgagaaatctaggtcactagtcataaacagctttgtcctaggaagaagaggcttgctggttgtcatctgtctttgcacaaacagctcatcctggcacttaaaatcattggcataaattgggtcagatattagattgaattatatgaaattgccctacttgtccatttttgacctaacatgacaatttcatgttgttcagcttaacacaaagtacaatgaagaaaacctgttcaaatgttagtctcttatggtgtaatttttacattttttaattaaaaaaatgctaccagttaaaaacaggtttaatagtctgtgagaatttatatagttaacacctttcactttcagaagcatcattattctaggcagaaatgacataggagagtagagatggattctaggacttcataaaaaagttcaaagacatcacaaagtcctaacaacagtaatgccaaagtctttgcagcatgaagtctgcatctgaaagaggagtgattatggggagaagggaaagggatttttgggggataagatgagctctggaggggatgtaggatgagagtctacaggcaagggcctgtcagacagacctataggtgtgagagagcgggactcaggcccacagaagcagtgatgatgggaatataccttagtgccgagcttggctcatcttccaagcagcacaggtaggtagctggggagacaggcacatatgtttttccacttccacttatcccaaaaggatgaattcagactcacaccctgaaagatcatgctatgtgctgacgtctgaaatcaggtacctgagggatcccatttttgctttgctactagagaagtaaaattcaaatgtcctaaagaagcaattcatgtgttggttgataatattgaattgtagtcaacttaataattagagtgagaaaacactcatcagatcctttgtggcttgaattattgagaaaagggcattaagagtgtactgaatcaaaaaacaggtgatgaggtgtgagaataatatgagagcatgataaccagctaagtttaactaagatcatacagtatcttaatgacatcgtttggcatatttgtatcattaaaacaatatagtaagtatgatggaagtggcttttccttggatcttgtatttgtcataactaaattatattattaagattttattcagctacttaagaaaatcttcctgatggcttttaagtgtgatgttcctgaatcttataataatgattttctattcttggctctttgggttgcttctgccacttctattttgaaagaacttaataataaccacagggttaataataacagcatgtgattgttgaaggcttaatggctagagcatttcattgtgacttttcatgtagacatagaaggattttttactttttacaaactcacaggctatcttgtgccagcttatatatatatctggaagaggaattgtatatatttggctgacttcagttcacaagtgtcttatgaatctctgtggcaaattgatatatccatccatggtagaaggcaggagactgccatggggatttgtctccaggatcatcaaggtcctcagtataagaaacctgatgttacaggccaggtgcggtgactcacgcctgtaatcccagcactttaggaggccaaggtgggtggatcacctggggtcaggagttcaagaccagcccggccaacatggtgaaaccctgtctctactgaaaattataaaaattagctggatgtggtggcacgtgcctgtagtcccagctactcaggaggctgagacacaagactcacttgaacccaggaagcaaaggttgcagtgagctcagattgcgccactgcactccagcctgggtgacagagcgagagtctgccaaaaaaaaaaaaaaaaaaaaagaaacctgatgttacagagcattgtaatgaggtaagaatttcctagagtatattgttgccaaataaactaaataaatagtatgaagaggtaagacaaagttacaggcctaggcaagaatggaaaagaaaaaaaggaatcattaatgttcgggataaaaggacagatattaatcgagtatttgctggttaatagcaaaagaaacatacttttttttctagctgaggattttcatgagttgtttttcaggatacaagcgaatttatacaattccttacctgtcagtacaacatgcattggttccccttccccccaacagatggcaaggtgaattatgaaatctcataaaaaaaaaatacaactagtctactcttggaaggtagagatatgtccttatttgaaatggtttgcggtgtttttcaaggagatgagcacctactgatctctttctgtgcctattaaaaccagaaatcggagctggatgtggtgggcacctctgtagtctcagctgcttgggaggattgcttgagctcaggaatttgaggccagcctaggcaacatagtaaaaccactgtccctaaaaaacacatttttaaaataataaacatcagaaattggtaaaaacattgcaaaaaagagggatggtgagggtaagcattgtctgtttggggattgagattatgcctaaaattttaagattcctaacgatgacttgcatgtgtttcctattatgtgctattagttatttctcattgcatctaagaactttattaagaagtacctagcggccaggcatggtggctcatgcctgtaatcccagcattttgggataccaaggcaggcagatcacgagatcaagagatcaagaccatcctggccaacatggtgaaaccccatctctactaaaaatacaaaaattagctgggcgtggtggcgggtgcctgtagtcccagctactcgggaggctgaggcaggagaatcgcttaaacccaggaggcggaggttgcagtgagccaagatcgcaccaccactctccagcctggcaacagagcaagactccgtctcaaaaaaaaaaaaaaaaaaagtacctagcatggcacatagcaagaatcaatattttgttgctttactggaggagacactattattttttcttttataaacaaaagtagaattttgtgtgataagttttttcttggagcatattgtcttcataaaataaacatggaaaacatattgttttcttctcctacagttgatacccaaaaaaagctttgtgaaataatgccaagatagtgtcactactaccataaaactttaaaaagtgaataaaaatgtgagagaagttaacacttagcatatggtttttcccaaaactggaaaagcttgtacaagaatattatctagaaactacttaaaactttaaaaagtgactttgaaaagaaaatcgtcatagaaatttgccttttgtaagatgttacaattagctaaatatgaacataatgtgaaagtaaataaagcataagccgccctttcgcaataatactgtccttttgaaattttttgagaggcccttttcccagaataagtatgactcttaacagaggactttccgctctgtatattagcgtatgaagtgcgtgtccatgttaatggtccaacttcaagcatcttttgtgccatcattaacaactggaacacagaaaattgtgaacagaaatcgcctctagacatctctcagttgttaactgcctaaatattgtgaatgtaacatgcatttttctgatgagaaaagaaatacaatttttttttttttcctggagatcaagtcatgctctgtctcccaggtgggagctcagtcgcacgctcatagctcattgcagcctcgaactcctgggcttaagcaatcctccctgctcagcctcttgaatatctgggactacaagcacacaccaccatgcctggctaattttttttttctttaaatttttgcagaaacgggatctcgctatgttacccaggattcctggcctcaagcagtccttccaccttggtctcccaaagtgctgggattacaggtgtgagccactgcacctggccatatttatttagaaagtaaaaaaatttaaattgtttctaaatcatctataatccctaccatctctgtataactatgtcaacattttggtatttattattctggtctttataaactctatcgtatgtgtgtgtttacaaatctggcatatcattacatatatgattttacaacccattttctttacagtttacagcagaagcatttttgaaacattcttctgcaatggttaagatgggtatccacttatttaggatttcttcattaaggattcaaacatacttttccacctctccccaccacttgtcaatgtcatgggcaaagaaatggtggtttattttatgtttttgatttttcaatcctgccccttccataggtggtttatgttttagtttgcatttatttgattactggtgatgttacatattttgtatacttgttagcactttcctttcttttgtcaattacatatttcttctgacatttttattgggatgtttaaccttttataaataaagtttacttaccttttgtcaaatgtgttatagatacttttccattttaacatttgccattttgtttatttaaatttttgttgttttgagaatgatgatttcagatatcttcctattacagagagttgattttgggatagccttaggtggttcaatcagatccgcaccaaaatggtttcaaatacccaagtgacctgtaaactgtaaattcacaagacccaatgaaccctaaggtctgagctctggggcataaccacagcctcaaagctagggcaggattaagccagctcagatgcactcagcctgcagaatctaactaggtcagtctgctgtggctctctgagattgtggggctatttttgtcagtgtctcttctgcctatgaaaattagaattgaggaaagctacagatgcttcccatatggttgctattagtgaaattatatacagagaatttaatttgaaaacagttgatacactcacattatttagagacttaaagggctgtgaaagatactctagctatcacacctgcaactctcctgtttgcagggagccttcatcttacatgtggtagccttctgtcctgttcttgcttttgccagggaaggagccttcattctggtgttcatgattttgccgggcacataatgtagatcttcattaaggattcaaacataattttttcacctttctttcccctccccacatcacttttatttaaatatatagctcctagattttggcattgactttagtgaactcagcagatagctgctctagttcttcctgtatctaggatttagagaattttcatttgcaatcagttgcacttgttcttacaacagtttgtgtagatacagcagcaagcaggctgtgatggtttattactctaattggtctattagatgtacttgatgtttcacaaggttctaggaggagaaaaaaatgtttgtccacaacttgtggagcctactaatggagtttaatatctatttttgtcatctgtgaaaatgcattataggttctatttaaagcattaaaaaatctgaagtggccgggcgcggtggctcacgcctgtaatcccagcactttgggaggccgaggcgggcggatcacgaggtcaggagatcgagaccatcccggttaaaatggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaatctgaagtggaattgatcattaagtcatcaaactttgttaccttctactaaagcaatcaggtgaccctctaaatttgatttcccctaaatttccaattaatgtgcttatcctggtacatttgatttacaaagagaatttactgccacatggtattcattttatgggaaatgtcgtgtcgaaacaatattgtgtaactatatcttttaaagacaatcctgcaataataaaactaataaacataatgtaatgacatttgtaaagtgtatcccagaactatcagtagattaataaatattgaggaaaaggaacatcctcagtcaagtaagtttagagaccttattgagttgcttgctttactgtaagattcctcaagacatttaatatatgtgttaaaattctctaagagacacaattcataccatttttcatatacatttaatatcagaactttccaatatcagagcacactcttggtaaatcctgagctacagtagaagctttgaaataagtgattaagaatattaatgttacgattcacagcttaagaatcgttgaacatgggtctgggcacagtggctcatgcctgtaatcccagcactttaggaggctgaggctggagatcatttgaggccaggagttcaagaccaggttgggaaacatagtaagacccttgctctacaaaaaaaagataaaaattaacctagcctggtacttgtctgtaatcctaactgggaggctgaaacaggaggatcacttgagcctgggagtttgaggctgcagtgagctatgataacaccactccactccagcctgggtggcagagtgaggaccttgtctaaaaaggaaaaattatgatatttttgattcacagtttaagattaatcacagtttaagcaatattatgattcacggtttaagaatcactgaacaaatatctatattcaagtacagaaaacaaccctcaattgattaagaaaatgacttcccaaccctaaattctgttgtgcaagatattggtgaagaaagccgaggaattctacttattgtctaagagtttaataatttaggtggcaaagaaagcattaaataaatacatctacatcataccagaatgaccatgggcagagagaaatgggactcttttcttccattgcaaatggccgtcacaacaataatgatgctaagttatgccaggatccaactaaagtagcctttactccataattcaaaattactatactttactatttaataagataatgtttagttagcttttattttactttaggagaaaaagtatgagaaatatttctttttgcttttgtgtttaagaatagtgccagttcttaatagggctcaagctgctcaatgtgaggtctgtcctggccctaggaggggaatgctggactcacttgagatggatatttcagggcttcgcgtgagccaagaataagaatctcaagtcaactgatgcgtggtctcaagaaattgctcccagaaattcccccagctcagcacctgctgctctagataagagagattctatcaccctttgccacacagagccagcaagtttcaccttcaaattgctctttgctcaattttcatatttatttctggccagttttaaattaggcatctgacaatttattccatctgatcaaatcaatctgatttttttctgttgaaaaaaggttaaaaatatctgaaggtaggccactatgtaaaagaatccattttcctatttcctctgaagtttacagcaagacagttgtaatagaaatggagaagggagtaggtaagaagtttactttctttctttttgtatcttttgctttggagaaaacgtcagtgtatttttagaaaaacttttttttgttttgttttggtatgttttacattcaatttttttccattttaactaatgttcctgtgagtataaaggagccaaatgtcgcattcattttttttaactatcaataataaatagggattcagtggccttggtttaaatatttttaaatttaatttaatttgtaaaatacttttatatcaagggtacatgtgcaggtttgttatgtaggtaaataatgtgttcccggggtttggtatatagattattgtgtcaccaggtaataaagcatggtacccaataggtagtattttagtcctcacccccctcccgcccttcaccctcaagaaggccctggtgtctgttgttcccttcttggtgtccatgtgtactcaatgtgagtgagaacatgcagtatttggttttccgttcctgcattagttcacttaggataactgcctccatctccatccatgttgctgcagaggacatgatgctgttcttttttatggctgcatagtattccatggtgtatatgtaccacattttcttttcttttttttttttttttttgaaagatacttcactttttattcacttaaaatagcatggtcacaaatatatatacaactaaaacaaacccacaacaaaaggaatacatctctcagtaattaataagacaagcagacaaagaattcaatcaatagggacgtggaaaacttgtacagaatgaaaaaacctgatcaaatagacactgcatacaacatctgcacaatatatatgccttttagcagcaaaatggaatatatattttttttagttgaccaagttctggagcaaaaagcaaaactcaacacagtttagcggttttaaaatacacagcttgttgcctgccaaatcgatctatcatcttcggacctcatgctgagatccagacctgtgtatccaaccaacaatgtgctggaatggtcttgtaagagcagacagtgcccattttctttatcgtgcctaccattgatgggcatctaggttgattccatatctttgctattatgaatagtgctgtgatgaacatatgcatgcgtctgttttttttttttttgagatggagcctccctctgttgcccaggctagagtgtggtggcacgatcttggctcactgcaacccctgcctcccaggttcaagtgattctcctgcctcagcctcccgagtggctgggattacaggcatgtgccaccacacccagctaatatttttgtatttttagtagagacggggtttcaccatgttgtccaggctggtctcgaactcctgacctcaggtgatccaccctccttggcctcccaaagtgctgggattacaggcgtgagccaccacacccagctctatgtgtctttatggtagaacaatttatatttctttggatatatacccaataatggtattgttgggtcaaatggtactgctgtttcaagttctttgataaatcaccaaactgctttccactgtgactaatttacatgcccaccagcaatatataagcgttgccttttctctgcaaactcacccagcgtctgttattttttgacgttttaataagagcctttctgactggtgtgagatagtatctcattgtggttttaatttacatttgtctaatgtaaatctttctaaaaattttcacatacataatgtcagacctacagaaaagctgaaaagttgcaagaataggacaaagaattcccatgtacccttcacttggatttttcaaatgttaataattttaaaaaaatttgttgtggatctctagtggctatatatatttatggggtatgtgaaatattttgatacaggcatataatacataatcacatcagagtaaatggggtgttcattaccacaagcatttattctttctttgtgtaacaaacaatccagttatactcttttagttatttttaaatgtacaataaattgttgactgtagtcaacctgttgtactatcaaatatgagatcttattctagttatttttctgtaccgttaaccatccctactccctccatccccaccaccacttgcactactcttcccagctgctgataaccatcatcctaccatttatctctgtgagttcagttgttttaatgtttagcttccacaaatgagaacacacaaagtctgtctttttgtccctcgcttatttcacttaatttcttccatttccatccatgttgtagcaaatagcaagatctcattcttttttatggctgagtcgttctccattgtgcatacataccacattttcttgattcatttgtctgttgatcgacacttaggttgcttccaaagctgttgtaactagtgctgtaataaatataatagtgcagatatctctttgctacatttagtttcctttcttttgagtatatacctagcagtggtattctaggatcatatggtagttctattttcaggattttatagaaccttcatactgttctccatagtagttgtactaattaacattcccaccagcattgtacaagggtttccttttctctacatcctcaccagcatttgttattgcctgacttttggataaaagccattttaacgggggtgagatgatatctcattgtagttttgatttgcatttctctgataatcaatgatggtgagcaccttttcatatacctatttgacatttgtatgtattcttttgagaactgtttatttagaccttttgcccgtttcaaaatcagatcattagatattttcctatagagctgtttgtgctccttacatattcattattattcccttgtcaaatagatagtttgcaaatattttcttccactctgtggggtgtctcttccctttttgattgtttcctttcctgtgaaaagctttttaacatgaagtgatcccatttgtctatttttgctttggttgcctgtgcctctggggtattattcaagaaatctttgcccagaccaatattctggggagtttccccaacgttttcttttcttttttttttttttttttttttttttttgaggcagagtctcactctgtcacccaggctggagtgcagtggcgcaatcttgactcactgcaagctctgcctcccaggttcacacctttctcctgcctcagcctcccgagtagctgggactacaggcacccgccaccatgcccagctaattgtttgtatttttagtagagatggggtttcaccgtgttagccaggatggtcttgatctcctgacctcatgatccacccatctccccaatattttcttttagtagtttcatagtttgaagtgttagatgtaagaatttaatacattttgatttgatttttgtatatggcaagagatagagatctagtttcattcttctgcatatggatatccaattttcccagcaccatttattgaagagacagtccttttgccagtttatgttcttggcaactttgttgaaaatgcatttactgtagatgtatggattcattattgggttatctattctgttccattgttctgtgtgtctgtttttatgccagtaccatgctattttggttactatgactctgcagtataatttgaagtcaagtaatgtgattcctctaattttgttctttttgcttaggatagctttggttattggggtcttttgtggttccaaataaattttaggattgtttttctatttctgtgaagaatgtcattggtattttgataggaattgcattgaatctgggcactatggacattctaacattttaacaatattgatttttcatatttatgaacatctttccaatctttctttttttgtgtgtccccttcgatttctggcatcagtgttttacagttttacttgaagatatctttcacttttttggttaagtttatttctgggtattttatttgtagctattgtaaatgggattactttcttgattttgactgtttgctgttggtgtatggaaatgctactgatttttgtatgtttgattttgtatcctgcaactttactaaatttgtttatcagttataatagtattttggtaacgtctttaggcttctccaaatatgaggtcatatcatctgcaaacaagaataatttgacttcttcctttccaatttggatgcactttatttctttctcttgtctgattactctagctaggatttccagtactatgttgaatgacagtggtgaaagtggacattcttgtctttttccagatcttaaaggaaaggctttcagtttttcctcattcaatatgatactagctgtgagtctgtcatatatggcttttattatgttaaggtatgtttcttctattcccagttttttaggatttttatcatgaaaggatgttgacctttatcaaatgctttttcagcatcacttgaaataattatgtggttttttattttgttgatatgatgtatcacgttgagtttgcgatgttgaaccatcctttcattcctgggataaatcccactgggtcgtgatgaatgatctttttaatgtgttattgaatttggtttgctagtattatgttgaggattttggtatcagtgctcatcagggatcttggcctgtagtttgttttctttcttttcttttcttttttctttttctttctttctttcttcatttccttctttttcttttctttctttcttttttttttttttttgatgtgtctgtttgattttggtatcatgcctcttagaatgactttggaagtactccctcctccacttttttttctggaaaaaatttgagtaggattagcattagttcttctttaaatatttagtaaaattcagcagtaaagccatggagtcctttgcttttctttgctgggaaactttttattattactttgatctcattacttgttattggtctgttcaggttttggatttcctcatggttcaactttggtagatttgtgtgtctaggaatttatccatttcttctaggtatattattggtatatagttgctcatagtagcctctaatgatcctttgaatttctgcaatattggttgtaatgcctcctttttcatttctgattttatctggattatgtctctttttttcttagttgttctggctaatgttttgttgattttgtttatcttttcaaaaaaccagtgcttcattttgttaatcttttgtatttttttaaagaagttatgtttctctttttgtttggtttgtttttttgtttgtttttgtttttgttttttggtacagacagggtcttgctgtcttgcccaggctggtcttgaactcctggcctcaagccatcctcccaccttggcctccgaaaatggtgggattacaggcctgagccaccacacctggccaattttatttatttatgccctaatttcttttcttctattaatcttgtgtttggtttgctcttgctattcttgttctgtacaatgttgttaggttacttatttgaagtttttcagcttttttgatgtaggcacttagtgctataaactttccttttatagttttcactgtatcctataggttttggtataatgtgtttgcattttcatttgttacaagaaatttgttagttcattgacccactggtcattcaagagcatattgtttaatttccatgcatttgtgtagttttcaaaattcttcttgctattggtttctagttttattctattgtgatcagagaaggtccttgatattatttaattatttttgaattttaaaatacttgttttgtggcctaacatatgttccaaccttgagaatgatccatgtgctgaggagaagaatgtgtattctgcagccataggatgaaatgtcctataaatacctattagatcaatttgatctatagtgcagattgagtgtgatgtttgttgattttctgtctgaatgatctgtccagtgctgaaattgtggtgttgaagtgtccagctattactgtaatggtgtcattctctctctttagctctaacatttgctttatatttctgagtgctccagtattgggtgcctatatatttgcagttgttatatctgcaattaatgaattcactcctttatcattaaataatgaccttctttgtctctttttatagtttttgccttgaagtctgtttttgtccgatataagtttagttactcctcttttgggggtttccattgtctaatctatagactttataaagatttcatcatttgtcccaatatcttttctaacaaatgaaaatcaagattatgtattgtgctattttgtctctttaatctttatcacttcctctctgtctttgtagttcatgatattacatttttgaagcattcaagggcagttgttttgtaggatgtctctcaatttggatttgcctgatatttccttatgattagactgaggtaatatatttttcgcctgaatgccgcagaagtgatgttttgttctccatgtatcgtatcaggaggcacatgttgatttgttccagctttaacctccatcacgtgtttgaggtggtatctgctaagtttctccactatcaggttaccaatttttccttttcagttagtaagtatcttatgaggaattattttgaaaccatgtaaatattctcttctttcttatatattcatccattaactttagcctcagtgattcttgcctggatcaattagtatttgtattggttgccaaatagtgatttttaaaaattaattccttccacatttattagttggctttctaccataaagaagaggtctaacttctctcttgtttatatcagtgtagacttgtgaatatttattctatgagttataattctttttgctaattacatattttgatgctcaaattgtctcagatttgtatatatatacacacacatgtatacatacacatacacacctaaaatgtatgcatacactcactggtctttgcttttaatgtaactgattccttttctcttacacagtggaattcctggagcaggtgtgatagattatgaattgtatgttctggttctgctcatccattcactagtcatacgaacttgaacaaatctcttatatcctctattccaactttttctatgttaaatattaggaaataaatgaagatgatcttaaagaagctttcatttttgaaattctattaatgagttaaaatgtttgaagttatatttttataaagttttcagagaaagcaccttaaaaggaacttcaaagccacaaaaatcattagaatttagttctagaaggtactttagaaattatctaaactgtggctactgcaactaagaaactgaatttttaattaatttaaatttaaataggcacatgtggctggaggctaccctactggacagcacagctcttgagaataaatgacaggccccatgttacatgggccctactgtcagaagcaaagcaggatccctttgcatagtgcacactcaagtaaattaaaccaggctagggaggagacaagggcactgtgtgggacaccttacatttctttgatgtgcagaaaagactggaccataacaaagatcattggatgacaatccatgctgaattgccccacgagctttctgcttaatgctatgctttcaaaaaagaatgtataagtggaattggtagtatctaggcagagaaagagtacaagatacaatttgatggtttcatagaatgtatgtttcaacagaaaatgatgaaacataagtatcatcaagaagcagcaggctgcgctcataaaggaagggaagtataccccttcattgccacatgcgcaaggaggatcttaggccccgagcagagctgctgatgatggctagaggctgattttcatgttctctcttctccattgggaagatggtgtattgaaaacctctttatcaaagcatataaaagtaaaggattgctccatcctaaaaaaaaataaaaagtaaaccaaccttctcatacacctttcataactaattataatttttgataataaaattctggcatattaactttgtagcagattatttaaatcacaggaggttgaacatgatgttgtttagcagtatgtttattatatttcaaagaaagtttaaagatcaacaacacatcaagaaggctgatctgctctcagtagttcatagtaagagctgtaatctgagagtttatataactattttcagtagaaatgcctttgttagagaatctacagtactactggcaaaatttgtattaaaatgataatatattctccaaaaatgctaattctcctgtatgttcaattatataatttatgttcatgaccttttataaatgctataccaagatttatgtttgcttttaatgagaatatgcaatacatttagataataactcacctacagtgttggtaagagagtaaattggtaaaacctgtcaggaaattattctgggtgctaggtattaaagccctaaagctattcctacttttgacctactaattccccttacaatctaatctgcagttaaagctttatgtataaagtcatagtaaaaattgaaataacttgaatgtgcagaaggccaacatacttagcatatttggtacatctatgaagagcttttattgtcatggaaagtaattataaaaattttagattggccttgtatgatggctcatgcgtgtaatcccagcactttgggaaactgaggtgggcagatcacttgaggtcaggagttcaagaccagcctgggcaacatagtgaaaccccgtctctacccaaaatacaaaaattagccaagcataatggtgtgcacccgtggtcccggctacttgggaggctgaggtgggaggatcacttgagcccagggagagattgcagtgagctgagatcgtgccattgcactccagcctggatgaaagaacaagatgctgtcaccaaaaaaaaaaaaaagttttagattgacatgcagcatagaagacaatatttatagaataaactacataaaatatagagaaacagtgtgattacatctttgtctatcacattgtcacagattttacctttttgatgcatcttcttttctttcttgattcttttcctcacacttgtttggcgctgaggccgctctgttgtagtagtactcagccaactgccaggtgtcatccaatccattaaaaaacgctgttggcactacctccaaagtatatcacagttgtctacttatgtccatttctggtccagacgtcatctgctctctcctcagattatgatatcagtgactgaactgggctcactgctctacactcgcccctgccgtgtacaccctgacttctagtcagtctctacacagcaaccagagtcaccttttagactaataggacagattttggcactcttctccttaaagctttttacctgccaaaggtttcccattggtgttaatataaaatttttaatatgaactacaattccctgcatttgttctttctcaccactttttaacccagagtgactttctttctaccctcttaatattcattttcactctggcctcagggtctttgcccttactcatccctctatctgaagcactcatttcttggcttttggaattactgggtcctccttaacctgtactgctacttcctcagagaggccctccctgaccacccccacaaacatctcctcctcccacccccaatattgttttttcataatattgatctgatttattaacctgttctctcatatattatctgtcttcatccagtggatgtaagcgtcttgaagaacagctcctggaacacagcaggcatttggtaaatgagagacactagtaaatgaatcaccaccatcaatcaggatgaagcaataagggttctctttggcaaaatatatcactattctttttaaatgttcgtaaccaaagatttagcaattcctcttgaggaatttacccttcagacattgataaagtttgtacaactctataggcagccttgctttataatattgaaaaattggaaacagtctaattttgggaatctgctacataagttagtgcttccctatgattcaatattatacagccattaataaaggcattttagaaacatactttttacatggaagatgtcagatgtcaaacagattctaaaatagtgttacatggaagatcccattttcatattatacacatgtacatatttatacttcaaaaaatctacaagaacagatactaaaatatttatagcagttatgtctgaactttgagattgcagcttgttattatatcccagtgccactggaattgactcatactggagggtaggccattgcagtttagggtgtttcttgagctatacacaaagcctttcagggactaaacagatgagtctgataaccctctcctcctgcagtaatgctgttagagaaggttaatcaatgtgtttttggtttctatagagagaagacgagcacttctgtttgggagaattgagatgtactttagagagggtgagggcatgtgccttggctcttgatgtgtttggaagatttaacagaggtgattgaagagacatttcaggtggaaagaagagccagcatgaaagaaggaaatagagaaggaaatcatgaggcatattaaaggaatagcaagtgcatccattctgtaaaaccatgggatatctgggaatgggaataattcttgaaaagtagatggaaagaaattgcagtgacctggatttagtgggcacttggaagatatgatttgagcaggggaatgatgagctacttgagctgtttttttaatttttttatttttatttattttttttttagggagactaatctgacaagttataggaatgagttggtaggctaaagctggaagcaaagtggtaatgctggtttaagcctagactgtttgcccaatatgtcaagtaggctgtatgcaaattaggttataagagaagaatttcttcttttgggtatattagacttgacttttttccttccatctattccccagtttcattgtggcattactggctgctactcactgaggagagtgtattgtctagggctagtggttgggagcaatgagtgaatgttcatagcctgggatataccaaaaaggaaacatcaaattatatgtgttttttaaagtcaaagatattttgtacaagagtttcttacacatatggataatgtgtttttgttccctatgataacataggtattttagccccatattctgaaggcaaataactgaaagattacattggtttgttttaaggaaattaacaaatgtcccttttgaaagtaggtcaagttccttattttaatttctaacctaacataggactccagctgtcaggctctcccattaatcctctgtatcagtgaaatcctctctgaaatacattgtaattaatttgtaggaattgacaggaaaaggtagtgagttcagacaatatttcactacaagtttcccatgtgaaaggggacaattgaatctttgagctgttgcaaaaaaatggttgagaaatagtattttggcagaaattatttccattgaaagaatcaattgactcttgctagcaattgactcttgctagaaagagtctagcatttgactcttactggatttcagccccaataatctagactgggcaacctgattttgctgaaatgttccataagaactttcgcttcaatcataaatatttaaaagtgacttcattgtaattatccctaaaccagcatcagtctcacaagtgccacaggaaagccagtcatagctggtgatatgcctgtagtaagggtaggaagaagagtgggaaggcttgattataggcagagtagaaaagtattaatatagaaaataaaagtatcttttgttatagttttgtctgcttttgtgaagtgtagatggttctgcaattcaaggaccgcgtgcaagattccagggtaatgtaaatgcagattttgggaaacagtcatatgcggggtacgtttgtaactgaatctttatttagtgagtgtctcctaaataaacagcatgggtagcttttgtcactgtccaaggtactatataacttgggctaaaaaaacccccagcaacttccttttccagcatcttgaaaagtgtgtcctctagagactctctaaaggaaaaagaaaagagaataagataactgttgaaaaggaaagtaaaacccgagtgccagattagattgtaaatgttgaaaacaaacaaaaaccctcccaaagctccacttactacttttcaaacacaaaagcaatggcaaataaagaactacgattaagaagggtgtccagagcaagtgatgtgctgcagtacccctgggttgtcattgggatttggaacaattcaggtgtgttcaagtaagacccaccatgatcaaaaccagcttgcatcaaataatagactgggtgaactgggtcctttaataatgtatattgtatgtgtgcttttagcttttcaatttttcagcaaaaaaagcacaaacttctttataaaatgaatctctgcttttacttttctataaccataaataaaatataagtgaaatgtttctcagcatttgcctgttaaaataacaatagccaagctccccagcatttatgttagataaacgcaattctaccaaacaccaagagtttaaactgtaccattttgataatgatgataatgaaatttagtatatatgattctagtgtaaaatatgtgaaactctgcaaggaaaaaacatttaaattcttgtaaataatgagaatacactgtaagtgcaattttttttttcagaggaagtgcttagcctatccatatgctttcagttatctggtagaacaactagatcttcatcttttcatttatacattcactatcacacacacacgaaaacgcacacacaccccttttactcctcccacctctgatgtgttctaaggaatacaaaagaatgcagaaggacacaattctttgtggaataaagctttgttgaaagcaagcagaggagggtggggaaaatgagatattggccaaagggtacaaaatctcaggcaggatgactaaattctggagacctaatgtgcagcatggtaactatcattaacaatgctatatcgtatactttgaatttgctaagagagtagatcttgtgttcttaccacacacacaaaatgataactatgggaggtgatggaagtgttaattaactcgattgtggtaatcatttcacagtgtgtatgtagagcacaccattatgttgtacaccctaaatatatacaatttttatttgccaattatacttcagaaagctggggaggaaacaataagcaggactgctactagatatttcataacctcatggaattcttgctgcaacttcagagttcccgttttacaaaaaccagtttctctcttagtagccaaaagttaagagggagaaacaggaaagaagaaagaacaaagcagagcaaggtgtcagattgcagatttgatgagagaatcggaaaggatgggaagggcctccacatgttagcggggcaagacaaggctttcttcagtttcgagggtggcagcatagacaagaatggaggaaagagctgttgaatcatgaacttgactagagagcagggttagaacgactctgaagaaagcaggtaggcagtgaacaggaaatgaatccatgcacaaaaggggaggacgtggaccctcagagttctccccgaactcctctgtagtcaagtttataattcaccaactcccattacaaaatgtttattgtattttacatttgttagggattattgtgtgatcttgacttgaacaaatttttatttccccttgatttccatttctttacattaaattgtaagctatcagtttgggctttatccatctgccagtatccagcactgatgtagttttgctatatagtatattgaaaatgaaaccaagccaggagcagtggctcatgcctgtaatcccagcactttgggaggccgacacgggagggttgcttgagccaggagttcaagaccagcctgggcaacatggcaacatggcaaaaccccttccctacccccctccaaaaaagctgggcatggtggcatgcccctgtggtcccagctactcgagaggctgagatgggaggatcacttgagtccaggaggcagaggttgcagtgagccaagatcacaccactgcactgcagcctgggtgacaatgagaccttcaaagaaagaaaaagagagaaagagagagaaagaaaggaaagagaaagcaagcaagcaagaaagaaagtagggaggaaggaaggaagaagaggaaggcagggagggagggagggaaagaaagaaaagaaaagagaatgaaaccaaaagcggggtgataagctgataccttagtcttgagaaaataccaagaatgatgtgtggatttaggatcatgcctctttctatgacagtggctgtgcagtgtacagtttaagatgatacataattgatagtacccactgctccatgcactgggacagagaaattggcttgagccacttgtcgtatacaaaaacctttattctcttttctctcttgttgtcattcagctgtttttctggatgaattcaccaccatttagttaaaaaaaaaaacaacaaaaaactgtttttgctaagggaagagtggtgcactgtctccacacaatgtcctctgtctttccctgcctttcttctgtccttgtggtaccagtcatttcccatcagcaggcagcactggcctgaatgtctttgttgctcggaagtgagaagtcacctccttacttagagggagggtagatgctgcagcagaacatagtgcagccaggtcccgacttaagagttttcagctttatgatggtgtgaaagccatatgcattcagtagaaaacacactttgagtacccatacaacaattctgtttctcactttgggtacagtattaaataaattacatgagatattcaacactgtattacaaaataagctttgtgttagatggttttgccaactatagcctaatgtcagtgttcttagcacatttaaggtaggctaggctaagctatgatattcagtaggtgtattaaatgctttttcaacttatgatatttttaacttataatgggcttatcaggacataaccccattgtaagtcgagcagcatctgtatcgggatgaagagtctgccacttaacatcttcagcagttcttctgcatctcagagtttcctcatctgtaaaactggcgtcataatagggttgttgtgagattagaccagttcatatgtgtaaaagcccttaaaataatatctgacacataatagatgatcaataaatttcagctgccacccacaacaaagaattatccagtctataatgtcaggatcagtaccataagaaggataaaaagaaaaaaaaagtcagtagtaccaaggtaaggagccatgcacgcaaggtgttgcccatgtctatataggctacttttgaaaatggagtgggtggggagtggtggtcacacgctctgatgctgggtctctggggctgtaggggtggtgctgggctagaaggggcactccactggctcctcctaaggagtcggtagttccaagggtattaacaaggttagttgccaagtccagtgcccacacttgaccctcacgcgtcttagaaaccatgagtggccaatctctttattgggtcaggtccaactgctcaaaggggctagttcagaggggcttggcaggttttattttcttctaaaaattgtgttttccttttcacattgggcccactgctcacccaaactcattaagttaattggttgtaatcaaagtgttctggcccccaagtcacatgtttttaaatgctgtgagggcaaggcaaggttttaacctgatcctttctcctcggttcccactctatgaccctaaacaaaaagcccttctaaagataatcccaagtcaaaagtgtggtagacatgttgagttcacagtttacaatgcaatatatcactgactaaaaaatgataaactctgaggaccaatatttaacatatatagaaataacttctaaaactttagcatttaaattcactagttcttcttctcccctgggaaagccttcagaattattcagaacttactaaagcaagtcaagtttttggactttctgaacagggcacctaaatgtcattccatacactttctcagtgactccatgtctgttctcagcagtgaagggagaacagaggccactctgcctgactgattttaaatgatcgcctttttcagatgcttttagtatggaaacaaaatcagccataaccttcagggttttaaatgtcactgttaatgcatcaggaagcccaaagacagacagtctggagaaatagtatgtaatgtttagatgattttggtaaacagctaagtttttaatgtatgtttaatgtgcattctgtttggggcctctgagtttgaatccctgagaccgagctgatgtttagcaaccatttcttaaccaggaaaagcctcccctactcccagcccatagccatttgagcttcactggcttttttgaacagaagcatttcccagtttttgcttggttcagtgaacacggttactgtttaaaaacagtggctgtcgagttgtatgtctcaccaccctttgctctcctcttgagctacctcaagctgtgtgagagataatagttagcatgattaaacggccccttcactgatatttggtctttgcctggctgagggacacaaagcaagaagagggagacatgcagatatgttgcaggatattcaagaaagaaggattttagcatggaagacactaaactgtactgtaagttcttgggctcaaaatgtgttttgaaaaccttaataaggacgttcaagaatcaggcaatctttaaatccattttgacaaattaatacttataacaagtggaagtacagagtaggaaatcttctaatctttttttttttaatcattgttttaatgtccttagaaaaaggagtgggaatttaattaaataaaatgatatttattatataaactatggatttatacttctaccttcatgtcctagagccgtttgatagtttccatgaaaattaaaggcaaaccatcatcattctctattttccatacttctttctttttttgacaaaaacaaagtgagaagctgaacagtagcaaactagacaaacatacacaattatgctgctgtccaaaaaaaatttcagtatataatttactgataatttcttagacctcttaatatttgtgtctagatcagatcagggtttttgaaaaatggttgcttttctatttagagaggtgtatttggggagtgctgttgtttgcttattaaaaagaaagatcacatttatcttgcctacttatttttttattttgttttgttttatatcagaaacattatttgtgctgcccagttatgtctttccccagaatgctctcattttcatgatatgtaaacagtgagtcacacatgggctttacagagaaaatacaagcattggaactttatagactacatttcggggagtaacttttatcactttattttcttttctagaagtttatgtggatgttctatcaagtttaatttttagaataataaagctgccttattcactaaattatttgccttttaaaaatataaatcttcattttcacagataacatttgcaaatttgtgttataaaaacacacctcctacatttcatgtaggagacatacgtgaggtatatacttgccagtatccagcaactgttagaagatggattagtgtcaataagtggtttgcttttggtattttatgattataaaatatagagtccgggcagcatattagaaatatctttggggttggatctgaatttgtcttttagctctgacatttactagttctgtgatttcagacaggtgatttatattctataagtgtgtcaatatcattaaacaatagaataatctcaaatgttcagggttgtatatacattaaagaagagtaaaaatgccttgcctgatatttaatcggctaactgactttccattttttttgcccttaatgattctgttttatggagacgtatctttctttgcagaaagcatgtttacatatcttttcaagtattaggataagacatagttgatgcataagcactgaatttcattattatttgaatgtgataaaataggattgcttctatcagatgaaatagaggttactcagtaagaaaactggataaatgtccaattaagaaatttaaaattgaagggagaattttttaaaaatccagataattggtcaaaaactcctagataagtggcttaaaatactcaatttttgtatgcttgattttggtcctagttttccaatttcctgcaaaagtagataacacagaagctgcatgtttccataaattcaaatttcagtggaggtgcagggggagctgtcctctgcacacttcgcagctgtgtgtgtactcgacatacggcagccctgctgctcattcatgaaagtccacatggttgtgggagcagaacctgttttcaccatcaagctgctgtggaataatgaacagcatggtacacgtgacctcctctagacaaaaagtgctctctgtcattgtttggtctgacttcagcacttttcactacctgatgctttaatgcttattgtctttcctcacactagaatatatgctcatagagggcaggggatgttatctgttttgttcactgatgtatcccaagcacgtagaacagtgcctggcaaccagtaggcacttaattatcaaattaatgaatccatccctagttttcaatagcacggcaaagtaggagagaccacacctaatctctttattaaaagacaaacaaaatgaccaaaaagatatggttttatataaaatcaggagtctcactgcagtggaacatgctaattgtttttgtacagtagtccttccatccatggttccaagatccccagtgcatgccagaaatggcagatagtaccgaaccctgtatgtactatgtctttttctaggcatatatacccatgacaaagtttagtttataaattaggcacagtaagagattaacaacaatagctaatgataaaatagagcagttataacaatatagagtaataggagttacgtgaatgtggtctcgctctctctcaaaaatatcttattgtactgtactcaccaattttcagactgtggttgaccacaggtagcaggaacctcagaaagtgaaaccatggataattataactcctgtagttgatagaccactactggtttgttctaacttttggaagaagaaaagaaagtcagcatgcaatgttaatatcttctgttatcatagatgattcaaacagtgtttcaagcagaaaagaaaaaatcaagaagtttacttccttcatgaaagatagttaaattgaatactccagaaagataatttcatggtgaaatgccaggtcacaggccgaataacatctctccttgtctgaagcctgggtgaggccaacgttctgctcagccactgcaggagggcagccccttccacatacacaatgaaggtcatgtggtatggccaactcaagctcttttaccaggcgttttatggttggcatattttttagaagctacaaatcttgttaagcaaggcactcgaacactagctgttctcaaacttacattgcctctgtacctttaccaagaagacagaatgttgtacttgaaagtcagaaaactagatttcaaaactcagctccaacacttcatgtttgcctgaccacaggcaaatctcatttaacctccctgagcctcagtctcctcctttataaagtggccctaatttaagatgatcaaggaagttatgcacaagaaaaggatctataacccataaagcaaattatacagtgttactccaatataaactaaaaaacaatgcaagttctttccttaataagattaaaaattttgactttatattgtgtatttgccaaaatatcactagttaaggtggaaaaaacacctcagcaaaacagtgaaaagactaaagaacattttggaaaaaaaaattctttagaaaacattgtagcatattggttaggataatagattttaaagtcaaattgatgtggattttattcacaatttagccatttatgttgacaaattacttctttgagcctcagtttccatttctatagggtatggagaatatttcctaacatgcagtctttatgcagtcttactgtgagcagtaaattgaatgagacaaagtatttaaagcatttaatacattctgaaacatagtagatattcaataaatgaaaattgtatttctggttagtattttaattcttcataagtatcattgtgtatatggtatgccttttaaatgatatggggccaaactcttaagatgtattaattgactacaactatgctgcataaaactctggtggaaatttcctcaaagaaaatgattctttgattttcaataacttttacttttctgagccttatgatatttagaataggtggtctttgaaacatgcatcaataaaattaaagggttttttgttttcttttttttttttttttgagataggatctcactctgtcgcccaggctggagtcacgatcttgactcactgcaacctctgcctcccaggctcaagcaatcctcccacctcagcctcccaagtaactgggactacaggcatgcaccaccatgtccagctaatttttgtatttttagtagaaacagggtttcaccatgttgtccaggcttgtctcacactcctgagctcaggtgatccgcctacctcagcctcctaaagtgctggaattacaggtgtgagccaccacactcagcctgtaaaattaaagttttaaataccatcatccactcacctaaacctcctgagacctcaaagtatattcggttaaatggagtttaactttccctccacctaggtattcacaggcaaagagcactggcaggggcatgtcaaggacagaacttagagattctttttctaggaaatgtgttgcttgtgaatctgctatgctgtccaggcaaagagttgctcaagtttaaacataaaatctgctgtgtatgttctagaaatgagataaaatgaaagaactgggagaaacttaaatcaggaaggacattgagttggtaatacatactgtcacacaacctaaaaatgctcaagttctgagatttaccatttatagtctaagatataaatgatacattaaaagcccccaatcctttctcatagcgtttcactgagtcattctttagtgactagtctctgaactgaaatttttgtactgaagtgcaaccactggtataccatctttttttttttttttttaagagaagggtcttactatgctgcccaggctagattggaacccctgggctcaagtaagcaatcctcccacctcagcctcctgagcagctgggactacaagtatgacactatgcctggcttgatataccatcttgacaatgtaatttatttatttttaatcagagccttaaggtgacataaataaatacattttaagtgaactacaagccaattggccttttaaaacttaaagttttaaaatatgtgagaatacagatttgaaccaatagcatatgactacttagcataaataggagtttttctactttttaatacccaaggcagtttgttcaccaaaatctaaaactcctaatagtgtttagagagaaaaccctaaaagcgtatgagtaaattccactatatttccagttatatgtgttgatccatagttttcttcaaaataccccaaacagtccttaaaggcatcagtattctcaatcagaggatacttttctgcaaggcatattccattttaaaagataatgccttaatccatttctggatcgtaacccattaggttatataagtgtgtttctaatatcacagacaataaactcatgtggcctgaatagcaagtaacatgcgatgaaggaccaaggaaggtaaatgttaatatttaagctttctacttacttgatctaatattaacaatgcaaaggtttcatgtttctctttagcataacagttataaaatagtcaaagatcaacatttttatataatgttttattgagccttcttgctttgagatcttgaaatttgtatttttacttttctcataagtgaaatacacaatttaaatatgtaagtattcagtaataatgtttcagtcattgtcgaggtaaaaattaaatatgtcattcaggatttttgtttggattcaaattaggtgaaatcatcaataactaagcaaaagctgtttctttacatgaattgtagctatacataagtgagaattctcttagttataaaacatggagtttggagttttcgtaaatacttcttaattatatccttgactatgtattttcttaaatatttttaaggtgtacaatgggataaaatggagctgttaggaataagatggagaaattcttaattgtgtcagctgtatagagggttttagccttttcatgtaagttatgctcgctatacccaatagcaactgagttgattgaagtcctgttattggaacctaagaggtccatataccttaggacaagtataatgaaaatgatgtgttctcattgggtctagtggagggctgtattcctcaggaactattaaattaagtgttctgtgggtttaaagcagttaattaaaaaaaaaaatcttcagatgcaccttggatgttgcttcactgtggtgtttattatgacagcaactctacagctacctcaacccaaaaggaagagtctagtcccaggatggcaagtgaggctgcattctacaagtcacagcccaggaaattgtaaatctgcttgtattgaaggatgaggtgtgacagaggacccttctaacctagaagaaatcagtctttccaaatgaaaaactacagggcaggcttgtttccttttgctttctatgatatgtaaactgtttttaggtgacgaattaggaagataaaccagtttcagctgacaaaaatgtttgttttccaatcatctttttataaacagtgcttcatgtgtataataagtaaatgtatttattttaatgatccaaatataacatagcattacagaaattttggcaaaaacaaaaagaaacatcatccataatttcttcaccctaatgcagctttagcaattttcatgtattccctctcagcatcaatgtgcatattaataatcaaataattgttattaaatattatatgagaaattatccatggtactgacttactttaaatacatttattttcactggttagatacaaatccatggaaggaatagtcccccattgactattactgcttttgcttttttacagttacacatgttactttaatggatgtctttaggtataagacttgttccacatcttacaacattttgttaagttggtccttcaaaagtgggattcaaaagtgggtgcctcaaaagtgggattgtggagtcaacaattttgaactttttcatgacaatagataaatattgctaaattactttcctagagttatgccaatataataatatactatagctctgttttgttcattgtggtaaaaatacttgacatgagatctgccctcttaaatattaaagtgtacgatacaggatcattaaccataggcatcatgttgtacatcctatctctagaacttactcatcttgcataactgaaactttatacccattgaatagcaactccgcattttctcctccccgtggcccatggcaaccaccattttattctctgcttctatgagtttgactgttttagatacatcataagtgaaataatgcagtgtttgtccttctgtgattggcttatttcacatagcataatgtccaatagagatatccatatggcaggatttctttcttttttagaaaaaggctgaataatattctcttgtatgtacatactacctttttccattcacttgtagatgaacaattaatttgtttccatatcttggctattgtacataatgctgcagtaagtatgtgagtgtacatatccctttgaggtcctgattacagttattttagataaatatccagaggtgggattgctgaatcatatggtatttctgtgtttaattttttgaggaacctttatactgtttcccatagtggctgcaccatttttcattctcagtaacagtgtacaagggtaccagttcctccatatcctcaccaacactggccatctttttttgttgttgttgtttgataatagctatcctaacaggtgtgaggtgatagctcatgaggattttaatttggattttcctgatgattagtagtattgagcatcttttcacatacctgttggccatttgtatgttgtcgttggagaaatgtctattcagttcctttgcccatttctaaatttgattatttggttttattgttgttgagttgtaagagttccttaaattttaaatactaacccctcatcagatgatatggtttgcaattattttctccccattttgtaggttgcctttttactctgttgatttctttgctgtgcagaagccttatagtttatgtcctagtggtctatttatgcttttattgtatgtgtttttgatgtcatgctcaagaaatcattgccaagaccactgtcatgaaccttctccctatctttttttctagaagttttacacttttaggcttcacatttaggtgtttaatccattttgagctgatttttgtgtataggtctaatttcttccttaagcatgcggatatctagtttttccagcattatttgttaaagagactgtcctttccccattgtgtatttttggcattcttgttaaagatcagttgaccatatatttgtgggcttatttctgggctccctattctgttccatttgtctatatgtctttattccattaccatactgttgggattactatagctttgtaatctactttgaaatagaaaagtgtgatgcctacaattttgttccttctcctgatcatttgactattcagagtctttggggttccatatgaattataggactgtttttcctatttctgtaaaaaatgccattgagattttgatatggattgaattgaatctgtagattgctttgggtagtgtggacatgttgacaatattaagttttcccatccataaccataggatatctttccatttatttgtatcttttaaaatttctttaatcaacgttttatgatttttcagtatacaagtctttcatcaccttgctaagtttattcctaagtaatttttgatgctattgtagataggattgttttcttagtttcccttttggatagtttgttgatagtatgtagaaatgcaactggtttttgtatgttgatttggtatcctttaacttcactgaattcctttattagtcctaacagtttttctgtggattcttaaaagttttttttacaaataagatcatgtcatctacaaacacattttacttcttccttttcagtgcttatttctttttcttgcctaattgctctggtaaggacttctagctctgtgttgaatagaagtggtgagagtgggcatccttgccttgttccttatcttaaaggtatagtttttcactactgagatgatgtcagctgtgaggtttcatatatggcctttattatcttgaggaaattttcttctattcctagttcattgagagcttttgtcatgaaaggatatcaaattttgtcaatttctttttctgtagctgttgagatggtcatgtgttttttttaatccttcattctgttactatggtgtgtcacatctattaatttgtgtatgttgaaccattcttacatcccagggataaatctcatttgttcccttaatatactgttgaattcagatagctagtattttgttgagtatttttgcatctgtcttcatcagggttattggcctatagtttgcttgtcttgtagtgtcttaggctatggggtaacggtaacaccgcttcgtaatttgagttcaagagtgttccctcttcttcaatttcatggaagagtttgagaaggattggcattaattctttaaatgtttggtggaattcaccagtgaagccatctggtcctgagcttttttggggcaggggatgggggcgggattttttttttttttaattcctgattcaatctctttactatttaaaggtgtgttcagatattttatttcttcatgattcaatgttagtaggttctgtatttctacaaatttttctcctccttttaggttttccagcttgttagcatataattgtttaattgttcatagtagccttttatggtcctttttatttctgtggcatcagttataatatctcctgtttcatctctgatttttttttgtttgagtttttttttagtttagctaaaggtttgtcaattttgtctttaaaaaaaaaactttgtttcattgagtttttttccccagtgtttttatattctccttttttttcctgctctgatcattattacttccttgcactagctttataccctgttcttctttttcttgctctttggtggtataatgttttgtttttatttgaagtatttcttcttcttcttcttcttcttcctcttcttcttcttcttcttcttcttccttcttcttcttcttcttcttcttcttcttcttcttcttcttcttcttcttcttcctcctcctcctcctcctcctccttctcctcttccttcttctcttctttcttctcctcttctttcttcttctttcttctttcttctttcttctttttgagacagggtatcactctgttgcccaggccgaaatgctatagcataatcatggaccactgcagccttgatctcctgggatcaggtgatccttccacctcagccttccaagtagctgggaccacaggtgcatgccaccacacctacctaattttgttattatttgtagagacagggtctccctatgtttcccaggctggtcttgaactactggcctcaagcaattctcccaccttggccttctaaagtgctgggattacagacatgagcaaccatgcctggcctttttctttctttttaatgtaggcatttatagctataaattttcctcatagcactgcttttgctgcatctcgtaagttttggcatgttgtatttttgttttcttatgtctcaagatattttataatttccctataggaaaggcaaaaagtctttttctctactcatttcaggttttccagcttaatctttccaaagacagattaacaggagaaaaacaaacagaagtttattagcatgtgcatcatgtatgtacacttgggagcacacagctatgagtaacctaaatgggtgtttagaatttgagcttaaatactgtcttagactaaaacaaaggagtggaggcttggggctttgtggctgggtaagcaagttatgggaaattgaccaggaaaagtataataaacaggggttgtttagtaaggttttgtatgcacatttaagttgatgtcttctccattgatatgttaggagttatcatatccctactgagttagagggagatatctctacaaatggaaattttctatttaaatataaatttcctttacaaaaagaaaatttgtgccttgattttagagcttcatattgagtctgctgattctcagtggcatttggctcaaaatccattaaataaagattatttggggtaacatattcagacccatttgttggttgttaaagacccattcattggttaagagtatattgtttaatttccacatatttgtgaattatcttgtattctctctgctattgatttctactttaatcctgtggtgctcagaaaaaatacctggtgtcatttcagtcttcttaaattcattaagacttgttttgggacatatcctggaacatagcacttctgctgctctgaggtgaaatattctatatatgtcttttaggtccatttggtctatcgtgtttttcaagtcccctatttcttattgattttctgtctgtttgttctagccattactgaaagtggggaattcagatttcctcctactattgtattgtgtttattgctctctccagttctgtcattgtatgctttatatatttagatgctcagatattgggtgcatatatatttataattattctatcttcctggtgaaatgactcttttatcattatataatattctttataacacttttaatattcacatattgctgtttttacctgtctactactcatatttctagagttttcattgctacatttggaagcacatgtctaatattccttttcagagtacacactagatgaaagatgagggactgtctgaccaaggatccagaaagggatagttcaactataggtgaaggtagttctaaactcatgactatgtactatatagtctttaaggagtagcataagtttaaggcaatttttgtctcctagtgtctcttctcttggccaaatttaacatctcaagtagtcctttggatgaaaggtaactggagatgttttttattttgattttttagacagagtcttggcctatcacccaagcaggtgtgcagtggcatgatcatagctctctgtagtcccgaactcctgagcttaagccatcctcccatatcagcctcccaagtagctgtgagtacaggtgagggtcacctcacctggctaacttttttttaagagatggggtcttgccgtgttgcccaggctgatcttgaactcctgggctcaagtggtcctcccgcctcagcctcccaaaatgctgggatttcaggcgtgagccactgcacctggctgtttgctatttaaaagacattttcaggccaggttcggtggctcatgcctgaaatcccagcactttgggaggctaaggcgtgagggtcgcttgagcccaggagtttgagaccagcctgggtaacatagtaagacccatctctaccaaaaattagctggacatagtgtcacgtgcctgtagtcccagttacttagaaggctggggcgggaggatcgcttgagcccaggcggtcaaggctacagggagttgtgatcacaccactggactgcagcctgggagacagcgtaagaccctgtctcagatagatagatagatagatagatagatagatagatagatagatagatagatcatttaggtagggttaagtcttcatgagcatttaaatccaaattagcattttattctgatgggtttaataggtccaatgatgaatgaattctgatgggtggtagctggctcatcatttgtggaactgagtaaaccctattaaatatctgtttttggaggatttggcagtttgggaagagcctctgagctctatgttcctcggtagacaaggtaccaagtggttgaaatgtaaatatggagatgaggcattgaaaaggaacaactttactgatgtcttgcataattgcaaaactagcaaaaaaaggaaaaaaagcccacctcagaaagactaatttctcttgatgaacacttagatttaaaattaagtggtctgtatttgttgatgtaagtatcagtcataaacagctttggctgaatactatgaagctatttcttcagtgtccaagcaagcactcagttgctttttaaataaaagttcatgttattttaccaaattataacagtaatatttaccaaattaaatcaatattttatccagtacctccatatcaacataaggaagagaaccaaattaaattatcaaaatttgttgggaatcctaatggtaaaaataagcataattacaaaaatttctacctatttgtgtctaatgcaggaagtctctattctgacatgtattctaatgatgagaaaagctcctcactcgttagggaaagtaatcagatagcctgaccactgccacaacccttaaagtcactcactgaacattcactagattgtccggaaagcgtattatgacaaatgcaaataaaagaatttaaagactgtcactgttagctaattaccactgggacagaatcttaagcagtgcatttgaaaattctgaaacagattggatttattataaattaatgacataggatgttcattaattattaagctttgttgaaatacactgaatgttgtacacaggttttacagccaatggctgccatcagaatgttttgaaattatacccacgagaaaaatagaaaggtttttatctccattcatttccagtggcttgttagttttagcatgggggaaaacataacttttcccgagttctcagttggcaagaacacttgtggcaaacttcagattaacaaaagaaaactaacagaagtttattaacatatatacttcacgtattcatgagagatgcctagggaataccaactgaatctccagagtacaggcataccttgtagatactttgggttcagttccagaccactgcaatgaagtgaatttcacaaggcagtcacactaattttttggtttcccagtgcatataaaaattatatttacactatactgtagtctattaaatgtgcatgatgtctgaaaaaacaacatacatattttcattacaaatagtggccgggcatggtggctcatgcctgtaatgccagcactttggaaagacgaggagggcagatcacttgaggtcagcagttcgagaccagcctggccaacatggtgaaaccctatctctactaaaaatacaaaaattagctgagcatggtggtgtgcacctgtaatcatagctactcgggaggctgaggcacgacagtcacttgaacctaggagatggaggttgcagtgagccgagatcgtgccactgcactccagcctggatgacagagcaagactctgtctcaaaaaaaaaaattaaaaaaaaaattattgctaaaaagtgctgatgatcatttgagcctttagagagtcataaacattaagacagcagtgaagttgattgcatcagtagactcttcctttcatttctctgcagcatgcaatgctgtttgatagctttttacctacagtacaactttcaaaattggggtcagttcctctctaagtttgtgtaatattctaaatcccttgtcctttcaacaacattcatagtatcttcaccaggagtagcttccatcttaagaaaccattttctttgttcatccataagaaacaactcctcatccattcaagttttgttttgttttgttttgttttgttttgttttgttttgttttgtttgagacggagtcttgctctgtctcccaggctggagttcagtgacttgatctcggctcactgcaacctctgcctcccaggttcaagcgattctcctgcctcagcctcctgagtagctgggattacaggcatgtgccaccatgcccggctaatttttgtatttttgtagagacagtgttttgccatgttggccaggctggtcttgaacccctgatctcatgatctgcccacctcagcctcccaaagtgctgggattacaggcgtgagccactgcacctggccccattcacattttatcatgagattgcagcaattcagtattcagattttccttctaattctagttctcttgctgtttctgcaacagctgcagttactaacctccactgaagtcttgatcccctcaatcatccatgaggtttggaatcatcttctcaactcctgtaaatgttgacatttttgacctcctgccatgcatcaaaagtattcttaatggcatctagaatggagaattctttccagaaggtttttaatttactttgctcggctccatcaggggaatcactatggcagctatagccttaagaaatttatttcttaaataagacttgagagtcagaattacttctttatccatggtctgcaggatgggatgttgtgatagcaggcgtgaaaacaacattcatctcctggtccatctccatcagatcacttggatgacctgatgcattgtcaatgaacagtaatattttgaaaagaatcttttcttctgaacagcaggtctcaacagtggacttaaaatattgagtaaaccatgctgtcaacagatgtgctgtcatccaggctttcttgttccttttatagagcacaggcagagtagatttagcaaaataccataaagggaagtgcaattaaagagatgcctataaatgtctaggaggtggctttaatacatgtctacagaaacagaggaggcgtagagaaaacctgttatggggaggtgatcaggaaatatctaaacaagggtaaggtttgttgcgcagatttaagtaggtgcctgccccattgataagagtttctagtttagatttagagccatccctttctttctggtacagagatggagacacctttacaaatggagattccctttatggatgtaaatttctcttacaaaagggtaacttgctttatgttttcagagcttttccagtttctgctgtttctcaaaataatccttatgccaaaaaggcatatttggggtacaaatttttgtctcctacagtcatgttttgaggtggaattccctgagccccaccagcagtaaccttcaaaaaacagaacattgacttttatagtatttaatgcctcctcttcacagaaatgtatccactttctttctttttttttttgagatggagttttgctcttgttgcccaggttggagtgcaatggagtggtctcagctcaccacaacctctgcctcccgggttcaggcagttctcccgcctcagccttccgagtagctgggattacaggcgtgagccaccatgcctggctaattttgtatttttaataaagatggggtttctccatgttggtcaggctggtctcgaactcccgacctcaggtgatcagcccgcccttctataaaaagtgtggtatatcttaaaaagtccttttaaagaaatgataatttaatatttgagatagttattttatttggaagtactagattatttgcattttaatattttaatattaaaatttaaatatttaatcaggtagaaatattccatgctgggaattttgtttaaaaattcattttaaaaaaaaatctatgtttatgatattgttagtgggaaattgctatttaaaaacaagtgaagaaatcttggaaataatgtttagattctaatttgttttagtttactttttctacttagaattgtgttggtgaaaaggataaaaggcttatacagaagccaaatggtatttttatttttatttttgagacagagttttgctcttgtcacccaggctggcgtgcagtggcacagtcttggcccactgcagcctctgcctcccgggttcaagctactgcctcagccttctgagtagctgggattacaggcatgcacctccatgctcagctaattttgcatttttagtagagacaaggtttcgccatgttggtctaggctggtctcaaactcctgacctcaggtgatctgcttgctttggcctcccaaagtgctgggattacaggcatgagccaccgccaccgtgcctggcctccaaatggagtttaaaaagttgcatttattcaggttcctttgttgtattccttcaagaactgtgttcttccctctcagagcccttatcccagttgctcatgtaagttcatcagtgcaatcgttggctaatgccttcgtccctatgggcagagcccctgcatacttctgcccccctttaaattaagtttagcctaaagctgactccttacatatttttagtttttcctaaaggtctcctggtacatagtgaactgtgacctaactggatctgtaaacagacattagggagacataatctcccagcaatcaccgagtatcagccaatcacagcagccagctgttcaaatcatgttcaaataaggcaaatgccgggctgtaaccaatcggctgtttctgcacctcatccccattttctgtgcatcactttcctttttattaacataaatctccaaccatatggcagcacggagtcactctgaacttattctggtttggggagctgcacgattctcgaattgttctttgctcagttaaactctgttaaatttaaattgccttacatttttgttttgttttcgtttttgtttgtttgtttgtttgtttgtttgaaggagtcttgctctgtggcccaggctggagtgtagtggtgcgatctctgctcactgcgagctccgcctcctgggttcacgccattctcctgcctcagcctccccagtagctgggactacaggcgcccgccaccatgcccggctaatttttgtatttttagtagagatggggtttcaccgtggtctcgatctcctgacctcgtgatccgcccgcctcggcctcccaaagtgctgggattacgggcttgagccactgtgcctggcttgcttcttttttttttttttttttaacaccactgttgtgtccccagtacctggaacattgtatgtaggcatgctttaagtgggggaacagatgcgctgatggatgggggaagaattcttctagtcattctaacagtgcatgaggctttttcaaagataataaaatattaattgtttttttcccctttcttggcaactgatagaaaagattgctttactgttttctcttctttttcattctggatcttgtatctctcaggcattgctataattccattttgtagaatgggagtcctttataagaattcataggcattgctaggcacggtggccacgcctgtaatcccagcactttggaaggccaaggcgggaagatcacgagatcaggagatcgagaccatcctgcccaacatggtgaaaccctgtctctagtaaaaatacaaaaattaaccaggcgtggtggcgggcgcctgtagtcccagctacttgggaggctgaggcaggagaatcacttgaacccgggaggtggaggttgcagtgagctgagattgcgccactgcactccagcctggacgataagagcaaaaactccgtcttaaaaaaaaaaaaaaatcgtagtcattaaccatagccttttaaaaggcaagactcatgatagaaggattttttgtttgtttgtttgtttaataatcgtgttgccaaaaggaccttattgcaagttaggttcatatgtaatgtttttcccgcacagacaccagagcattgttgcctaattcccagaattgacttattccttcagagtctttaaacagctcagttctttttttttattttttgagacagagtctcgctgtgtcggccaggctggagtgcagtggcgtgatctcggctcactgcaacctccacctctgggattcaagtgattttcctgcctcagcctcctaaatagctgggattacaggcaggtgccaccacgcccagctaatttttttgtatttttagtagagatggggtttcaccatgttgattaggctggtctcaaactcctgacctcgtgatctgcccgcctcagcctcccaaagtgctgggattacaggcgtgagccactgggcccagccttcattttaaattttgaagctgtttggccaaactgcttcttatttccaactgcttgattatgcttgctttttgggaaaagagagtattttaatattatggtattttagcagcacaatgtcatgtgaaagtcattgcttaagaaaagttttaggtgatgactttcaggataagttgatattgatacaagaggtttcttttaactttaccaggttcttgacattattttgaaaaaaacacccagttattcagacaatcattgaggctttaaatttttccttaagtattacagtttaacatgtattttcataaagtataaatcttaattcaaataatattaaaacattttttcctgtttaagtttttaaaaaatttatgatactctccattgttctaaaagtgtttacaagaacagttaaagcataatgcagtaacataaattaggaatgtttgagaaagaaaaaaagataaaccaaaagttggaacataaaatggaacaggaaataataacacctttccaaaggcgagtcctgtgagtggatcacaatctgtccctaagctttcaaactgcagttacaaatgagaagccttgccagatgtttaactcactttgctgaaagagaaagagaattagttatttggaagaaatacaattattctcaatactaacactgaaaagtaatttctctgtagtgttcagatgtgacctcagcagtatataggcaagagacacaacaaatttcgggggggtgatgagttttgtgtttcttagattaaacctcagtagaggttgctgttgttaaaaccatgatacagattgaaaaggatagtctcattgcatatagaacacatcccagtggctgctcatgaagttgtgtaacttacccatggacttatgatgtcaggggagagaaattttatacccagaaatgtttgtgggggagatgttttcattgaaaagaatttggtcattacagtataaatgcttaaatttttttaagtttttgtccttgactgttattctgtgtagaaatgactaataaaacattgaaaacagactgagcctcaatgtatacatcactgactttttcgaatatgggtgtctaatatgccaaagttggtgattacccttaaaagcagattgtaatattgtgaaatatatgtttgttctttgttcccattttctggcatgcaactactgaaatccttggaatctccaaagtgatgtgtctttttgtatgtgaatgagattcctggtggccagcagcccctaagtagcctcaggttggagctggtcataggaaagactaaggcaggattagagggttggggcttttcagcgcccccctgcacctccccaacttctggggaggagagaggggatgaaggttatcaccaatggcaaatgatttaatgagtgatgccttagcagtgaggcttccataaaagctcaaaaggactgggttggggagcttcctgaaagttgaacatgtggaaactcctggatggtggtgtgtcccttctcccatgctgtgccctatccacctctgatgatgatcttctcccatgctgtaccctatccacctctgatgatctgctgtgccctatccacctctgatgatgatcttctcctacgctgcgccctatccacctctgatgatctgtgccctatccacctctgatgacaatcttctcccatgctgtgccctgtccacctctgatgacaatcttctcccatgctgtgccctgtccacctctgatgatcatcagtatcctttgtaatatgctttataatgaatcagtaaatgtatttccctgagttctgtgagctgcactagcaaattaatcgaaccatgaggaggggttgtgggaaccccaatttatagcaggtagtatcagaattgaattgaattagaagatacccagctggtgtcggctgcagaattcattgctggtagggaaaaatccccatgcattttggcgactagaggtcacagtaagtgttgtgtgttgattgtgttgtgagaggacaggagaaactcagtttttgttatatctttatacagattttacagagacaatgttattcattacgcagctgttagtttgacttaatacagggatagattttggaaaatatagatgagtgtgcctcctgtatgtcttccatgaatatggcttcttggaactgagcttttgctggctattgagtgacaacaagttcaagatctctcactccttggcaagttcatggaaaactaataggtggttgtaagaggctaaaagtcacttctacctatgttggtacctaagtgagatctttggctggttctaggaatcaaattaacacaagatagattaacaggagaaaaggatacaggttttataaatttttacacatacatagggagtacaagagagtaaggatgcaaagaaatggccaatgcagataggttttgtactttttggacaaggaataataaatttgtgaagaaatttgacaggacaaggggatctgggctagggacagtaaattctagaagtcactaggagatctatggtgggggtgtgtaaagctagtggaagataagggtttcttcagtaagtttatttgtacaggttcattgcagcagcagtttccaatctctggtgataagggttattttctctccctactggagggaagccgtcctcaaaggaatttttatggcttgccatctgtaagaaaggacagatcagaaaggcctttctgcaactagtttctcaagtactttcagcttgaaataataaatatgccaaattggcataatgtggggtggatcgtccttaacgccttcattgtcagtagtggaatcacatgctttaaccaacagttgaactcgtttcattatatgaaaatggagagacctaacaaaggtgtaggcttgagcagttagtcgacacatctcacctctacagagtagagagtagcagggtcagacctctttcagaataattttaaactgagacatttgctgaagttttaggcatgaaaggcccagaattgaagcttcaagtagcatgattaatgtaagtttagcctgggacatttttaaaaaagcttgaagcacctatggaataccaaatgctttgaactttaacacttgtttctgacaataattagatagcagagccattgtttaaattattagttcatatggtaggaccgtatttttttaaaagggaatatttacctccctgttctattgtgggcttgtttacagcttatccaaaagtggtatcaaattataaggaacaggttaaggaaaacatcactattctataccactgaaaattattaagtgatgcacaaagagatggttcctattgacattgtccatggtcagttcccatcaaattctgaagaagcatcagtgccttgtgttgagtttgtataatttagcttataacaaatgcctatccatagattgaaagataaatatgggtccagaaagtggttgaaacaatagcgtctggaagacttaacagcaaagcagtaaagtagcatagtgcagtggttttcaactttggtgtacatcagattcaagtatgatgcttgtttcaaagtgcaaattcccagacccaaccctagagattcaaatttcatacattgagttggggcataggaatctgcattttaagtaaatacccaaggtgtttctgatgaaggaggctcatagacctccatggctccgaagctcatttctcacaggctttgtgaaatgttggttaggcttcaaacatttttgttttcacataccttagaaaataaatttttaaaatacacagtggacttaaaaagtgaggaaattttgacatggtataacatggaataaagtcgaataatattgtaagtcaaaccatcgtaaggtgcagactttctgtattaatttgtgccctatgacaatgatgcattaatacaaacgagacagaaaccttttcacttgcatgaagcaaggccctgctcccacagtattttttgtgttgctctcaaggggcgcttctacaggagcagtgcattctctcatttctttagtgacacttcagaggttttagcccccttaacaataagccacataatgttcaggatgcataagaagtgtgccttacgaaagtagaagggggccaggcgtggtggctcatgcctgtaatctcagcactttgggaggccaaggtgggcgcatcacttgaggtcaggagtttgaaaccagcctggccaacatggggaaaaacccctctactaaaaatacaaaaattagctaggtctggtggtgtgcacttgtagtcccagctacttaggaggctgaggcagaagaatcgcttgaatccgggagtggaggttgcagtgagccaagattgcaccactgcactccagcctgggtgacagagcaagactccatctcaaaaaaaaaaaaaaaaaaaagtagaaggggaatgtatgtgagaaacaaggtatgaaaggttttaagaaagaatctggaaactgctttataaccctccatgtagacatattcccttaaagtaaggtttttaactccaagcgtttgtaaatttggatgaggaaaataatttcatctttttttccactaacctcacctagaaattgagcatttcctttaattacgacaaacctaaagtagcatgagcatcaacagaagtcagatgttttcttatcatattacagttgtttcaggtatctcaaaaggtggtttgaactgattactttgaaatcatgacagttattagacatccccctagattttactatttactgggttaataaaggagcacatataattctagggtatacatattttaatgtataaaaatgtgcattaaatttttaaccatatttaaatataaccatatttaaatatacttatccttagtatggttatattttcttgctaatgctgtttttgatttatgcatttaaaaatattatcctaagaagggattcagcctgactttaccaggtgctagaggaatccaaagcacaaaaactgttaaaacccttttgtggaaagcccttggatacccttaggagcatatgtatcccagtttgaaggcagatggtctaggggatggctgaagcccatcaacaacacctcttaaaccattagtttagggaacccagaactttcgtgttttgccaagcaatgaaaaatgtgaaaaatcactttagcacctgggagatgattctagtttaaattctgtgagttggtggttctaaaccagagatgtacatcaaaatcctttagggagccattttaaaatacacagctgagcctaatgcctcaggattgcagctcagcgggtctgggtgggacctggaccacgctgtgttaaaagcccaaaggtgattttcatacaaaccctcaagaaccactgttttaaacagaagggctttgaaaccttgttttataagaactattttaagtatgactttttttttttttttttttttggagacagagtcttactctgtcacccaggctggagtgcagtggtgtgatctcagctcactgcaacctctgcctcctgggttcaagcagttctcctgtctcagcctccccggtagctggggttacaggcatgcaccaccatgtccggctaatttttttgtatttttagtagtgacggggtttcaccatgttggccaggctggtctcaaacttctgacctcaagtgatccacctgcctcgtcctcccaaagtgctgcaattacaggcatgagtcaccatgcccagccttaagtatcgctttttaaaagttttatgtttgatccaaaaactcatggcaggaaattgggaagatttactttgtagtttgaaatttgtttgttactgttgttgttgttgagacagggtcttgctgtgtcacccaggctggagtgcagtggcaccatcacagctcacttgcagcctctacctcccaggctcaagcaatcttcccacctcagcctcccaagtaactgagacaacaggcatgcaccaccatgcccaactaattttattttttgtagagacagggtctccctgtgttatccaggctgatctacaattcctgggttcaagaaatcctcccgcctcagccttccaaagtgttgggattacaggttggagccaccacagcctgacctgtagtttggaatttgtaaccactcaaagcatcttctgtcattgggtgctcagggagaggggttcttgaccatctctggggaccataaaactctgaagtttcatgccctggtcttcagcttaaggggctaatagctttcctgagatttgcaaaggtatgcatgatcaaaaaaggggaaggaagaatagctacctatatgctgaaagagcaaaatttaatggcaaaatgaacaaaaagatacaatcattagacatactaaggaaacagttactaaaacaccattaattttatgagagaagtgctgaactgtagctctaattatttgatttcgtgaacattttctgctctattatttcctgaatttgtttttttgcaatgtaaacacagtaccataggtaaatggagttgcatataagtggttttaatggtatatattagggaaaaatgataaaatattaaaatatactgcctcttaatttaaaagcaaaattatctttaagactttaagcttattttatgctgctgggtatatatctgccagaaatgaaatcagcatgcggaagagatctctcaactctgacatttattacagcactattcacaacagccaagatatagaatcaaccggtgttcatcaacagatgaatggataaagaaaatgtcatatttaatacccaatggaatggtattgagctttaaaaaataagaaaatcctgtcatttaggacaacatggatgaacctggaggacattatattaagtgaaatacaccaggcacagagaggtgccgcatgatcttgttgttatgtggagtgtaaaacagttgaactcctaagtagagagtaggatagagattaccaagagattgggaagagaggaagttaggggagggtttttttttttttaagaccttaaatattttatttttaagataaaataatttcatcctaatactgggctctccggcatttgagagtattatatccttggacctccatcctctgctcactgtcataattcttagatcttaattcttactaaagttttattttcatcttctaaaattacaaagcagtaaacatgtaatatacaaaatgtatagtttcctccttgcaacaagtgagaaaaaaatcctattttaacaaaaagcatttttaagtgagtaaagatgcaatttttcatttacaaaataagttaataggttttctagttgggtttataaaaagctgatgcatatcctgttctttttccctatgactgatgacataacttctgcttttgttcatgatgccctctccttggcaaggagtgcctcccacccacatacctactcactctttaggaccagctcagatgtcacctattccaggaagcctcccttacctgtctctgtgttcccgtagagatctctatcacagtacttactacattacgttttaattatgtatttctatgtgtgtctgccttggaagacttcaacctcagtatgattatctttgtattattaatgtctggaacagtgactgctcattaaatattgtgctgagtgattatattcatagtcacccggctcacacctcccacccgtttgtcattgtacttgtctgtgatcatgctacagaattctgttgtgggtgaactcacccagcagcacagctatggtgctttggccttcaagctcctgctctagccaaccaagctaacctgcccagctttggccagcagctcattgtaataaactgagttcaaatggaacccagcactattaaactagccatcagcctaagactacccttcaaagaaggagcgagaccgggcatgaagtgggcccgtgagccagccactccctgtgtaaatctgtacttcagcttctcgctctcttttcactgcagttttattgctgtctcaccaagatttcccttcttccaggcctttactcttaaaggaaaaaaaaaagttgcttatctttgcttaattattaacataatactggcttaattctgaactaggagatctcaaactctttatgacagcccagtgaataaagtgatgaagtgggaaacaaaatgtagagggtcagaaagtgcatttcagtttgtaagatgaaaaaagagggaagggtggtagagctgactcatgtgactgtaattcctagaatataggagcagtgtggcgttattcatctaagcgcgtcctagagattttatacatcatgcacacatttttaggtattgtcttagaccgtttatgctgctaataacaaaaacctgagactagataatgtaaataacataactttattttcttgagttctggggtctgagaagttctagatcaaggtgctagccttcagcgtctggtgagggccttcttactgcatcctcatatagtaaaaggggcaaaaaggacaagaggaccccatgctgtgtcctcatgtgcagaaaatatgggcaagaaaggggcttagctagtacccttgagccctttttataagggtactaatcccagcctcatgacttaatcacctgaaggccccacctcttagcactatcacattgggtcataggttggcagatacatacattcaaaccgtattttggtttgatacatacattcaaaccattttggcggatacacacattcaaaccatagcaggtattaacctatcaatagtgcagttgaacataaaatgaagatctcacttcaatgaaacacaaattaatatgatttaaaacagttgcacattgtaactttctgaacacctgtattctgtagcctgaattttggcagagaaagtggttgaaacatttgtatctactatcaaattaccatgataattgtttattgttctctcttcactttataccttttaattaagctgggggttggggggaagggaggtgagaaagaaaaggaagaaaaatacagtttttgtcgcaagtggattttgtatcattttcctgaaggtcttggttctagaaattctgtagtcttggtgacctgtcagtttttctttataattaactgtgactgtattgtgtattcatcaatattatgaaatattatgaaatagtaaaactcactgtgactgtatgcatgcttgcccacgcgtggctgaacttttacaaagcagtgagggaagttctcctagggtcaggacaggtcatcatgggcacaaggcctctcattactttctctcatcagaaaaaaacaagtgagagaaaaaaaatgcacctacactcaggttcctgaaccccatcttagttcttctccagatagcccagcaagtgagtttgtctaatccctttctcaggaatgagcatgatgaatgaaaaccaagcaaattctggagtcgaaccaggttagattcagaccctttctgaccacttctaatttctgcctctgtgttttcagtgttaaatgtggatgctaattgcctgctttgcaaggtgtctatagaaattagatgtgattatgtaaagcttctagcacaatgcctattacgataaatggttctcacagttgctgatgctgctgttactatgttttttctctacagtagttctgtcttattttcctttgaaagctggagctgtctgtgcttctcctattttatagtatcagttaagggttttcagtggtgttttggtgtggtggagttatttcttttactcagggagcttttcttagggagttaatctgatactatattagagagagtagactctctgtagaccttcctaggcaaagttgaatgagtatttggatgtagcacatacatggacacttctagttagaatatgaagcatgaatttaggtagtcataaaggtttataataatctaaaaccaattactaagatttataaccaacattttgaacattgagtagtattaggatagtttttctagcttttaaaatcagcctaagctttttggtaaagtcaagttttgtaaaatgggtgaagattttttttttcctagtgaaataagaattggcaaacttttaaagctggtttacgataatttccagatgaatagaaactaaaatgtattgtcagctgatgtttcattgtaggctcctatgaaatgactgaattctgtctgtatccctaaaaattgagatgaaactgtcattcttatacataatcttagctaagtgacctcagattgaagtaaatcagatcaatattggtatttttataaccccagcatagatggtgcctgtattgattattgtaagtagcagggcactttcgggagctcctgatggaaccggtgttagctgtaccctagggaaagaattatgcaacacagtgataagtcatctaactaaattcatagcaacaaatctatttggcttctaggcatctctttgaagtgggccaagggcttggggatggaggtaggaaacctgcattggttcctgccggggcttctaccaactctgatgggagagcctcctgggctggctgagatggaattgcttctctagccccttcactggatacaaaataaaggagtgaagctaaagggtggaagaacacttcctggccaccttcacgcctgcttcaaagccaaggtcagggggctgttataccagggagtgctgagaagggcagaaagctgaaactgctccttcctccgatacaagaggcaatgaaaaactggtgaaggtggccgatgatgcccacaggggaagacagcactgactcctgctttgtggactctgcacagatgctatattagaactcaaactgctagtgactttcacatttgtatcatttttaatgtggtcacattaatttgaccattctgcaggccagtgttcatgtattactttagtgtgatttttcttatgatcaaaatcttctaaaatcaatttggtgagctatagaaagagaaggtaaattttccttgtgtgaaatacaactctcagtaataagactgctattagctattctttgaatctttcctgttttcagagatggctttgaggtttaataaatacttgtccacagtgatttcagatgatttttaagaactcatcttttaggatggatgtggtagctcacacctgtaatcgcagtgctttgggaggccaagatgggtggatggcttgaagccaggagttcaagaccagactgggcaacaaagcgagactctatctctacaaaaaataaaaatatcagctggatgttgtggcatgttcctgtagtcccagctacttgggaggctgaggcagaaggatcacttgagcccaggagttcgaggctgcagtaagctatgatcacaccactgcactccagcctgggtaacagagtgagaccccatctttaaaaaaaaaaaaaaatcatcttttagaatatttaaaaaatagaactttttcaggcataagtagttaccttatttttgctgacaaatatttgttacaaagtcaagtttagcctgccagaaaatcttgcctagagaaaattgaatagtttatccaaaagtattaattgaggaacacaggtgtgattatttctaagacattttaaaaatctaaatagttaaccacacatattaaatgaacttcctttcctaactagctctaaaatatgattacctatgatcctttccttatgcctatttgccatactcttatagtgcttgttttttaaaataataattctcaataataaatgggttatgttccagaagttcatatatgaattaggtgtttgaaagctgggacacatttgcacattataaaaatatttcatgtataactgataacccacaaaagcctatttaacctattagatagtaatgttattataaaatccctatgaaaaacatgtgtatagttattcacccaatttgtattaaacatctattctactttaatggtataatgatgtaccttcaaattgctcagattctactatttctaaagcaggttttcttgcttcctcaaatttttctccctaccctgtcctcagccaactataatttttctccttctttcctctacttggaaaccaaactcagtatcaaaacctctccctaccttactatttacagaaagcacacacccttttgaaatttttctaaggttttccacttctgtaaaataaaggacataggataacagaaaaagtgtcatgaagtttagggcatatgcatcatttgtaaactaaaaagaaaacacattgccatgtcacttacttagaatactcctaatgcatctaggaaaagtggcagtttgagggggcactcaaagactgaaatgagatctattcacatttgattagaaagctcagacagttctttagacatcttcctttccgataatgattcctctacaattctggaaacaggactggttatctaggagcaggtgtttcaataaagaagagaatggggagataggccaggcctgtgacagccctttgccccctgggacgcaaggagagtagctgggttcctcccaacctccactcagtaattgttggcttcttttttccttcttctaggagaaggtatccatgtagtttatccattcaatatctctcaacctccttctggcttctcctactattgtaggcaccaacccccaagtggatgttgtaaagtatgaaatggtcacataaaatgcattctaaaagtatttagaagaaaagagcctatttgtcagcttagtgttagctgagctcttcatgacccccaaagggcccatagcttaggcagatttagaatttgtaattggattctcttgtttgaaatggatgtagcatactttaaatgaaaatacttactggacagcaagcatgtaaattgcagtctgtggactctgcagctatgaatgctccctgatgggccactcagtcagcctctcctccgacctgctactgtttgccaggttgtggcgcctgccacatagcacactttgtgcctttgagagttggcagagcttgtaaaaccactcttttgttttggtgtttttcagactgggatcctttccattagtttgttttgtttttgttttgttactacatttagatgttcaataggttccaaaatttgagatcccttatttggggacatattgatgtggcaaattagagattgaacagctcaaaaaaaaaaaaaaattccttgcctagtagaaagatgatttaaaaaaataaaaggaacatgttttaaatctcaattttctttcccacatgagtcagaggaatgctttgtgatttaaatccctttttcctggcctgatatggagtctctgcttgttacgctaagcataccaaagcccttgcttggtcctatttctttgttctccaggatgatagccttaattacttaatagattcaattatattttcagatcacaaattacctgtgaaagtcactagaagtttgagttctttttttttttttttttttgagacggagtcttgctctgttgcccaggctggagtgcagtggtgcgatcttgtctcactgcaacctctgcctcccgggttcaagcggttctcctgcctcagcctcccgagtagctgggtttacaggcgcccaccaccacgcccggctaatctttgtattttttagtagagacggggtttcaccatgttggccaggctggtctcgaactcctgagctcagcgatccactcgccctggcaccccaaagtgctgtggttacaggtgtgagccaccgtgcccagccagtttgtgtagcatctgtgcagagttcacaaggtgggagtcagtgtcgtctgtccctgcagacatcatcagcaccttcaccagtttttcattgtctcttgtatcacagaaggagcagcttcagctttcagctcttctcaggtactccctggcacaacagcttcctgattctggctttgaagtgggcatggagttggccaggaagtgttcttccacccttttgctccactactttattgcctatccagagaaggtgctagagaaggaatacaatttcagcagcccacgatgctttcccatcagagttggcagaagctggggcctggaacccatgcaggttaggcttgcaaaactaagaagggtaggaatggtaaatgtatccatatggaacaaaccttgcttttaagcctctgatccaatccgaatagcgtggcttcttgaaggttttgttcctacttttgttcactgttacgctatgtaccaggaaagcaaagcctccttggagttttccttgtggttatttccttggaagtggctgacttttccagttgagttcagactggcagaagcagagagtgcaagagagtaagttaccaactctgggagcaagggatcaggtgtagatgctgacagaagaaggtaaataatactcagtcaggactgtggtctcacacatcagtgaagatttaatagagcacttatgagaagatgaatctagaatatctaattcctgtagccacatattgaaaatgatgaaattagttgcagttaaagaaagaacttgaaaagtagactaaaatagattactaaatgagaaaagaaaggggcagaagagtaaattgttctgaataaatggaaagcaaatacatatatttatacatagttttttttcagaaaggaagaagggaaaggcttttacctttcactttatagctttttgtacttttttgaatttcctaaccatgtaatagacatttctttcttaaagccagccacagtgactcacacttgtaatcccagccactgaggaggctgaggtgggaggattacttgaggccagaagtttgagaccagcctgagcaacatagtgagaccctatctcttaaataaataaataaaaacacttcctttctaagataaaaagaataaatgggctacctgggtcacagaattatgggctttttagatgttattttcatattctttctgtagtatggaaaatctaataaataaaagtaaaattaggctaaatcaatagataaatttactttctttttataagcaaatgtgcagttgatacctatctagtattaaaggtttatttgtagaacagttgagagagaaggtaatttaacccttctgtaaccaacctgtgagttgcacttcatataggaccttagaatactaagtatttgagaagaattgtggctcaggaattatcaggagctatatgaggttagtgggtttgatcggggaacctttcacattctttttagaattccactggctgctaaggcgtttgaattcctatggaactgatttctattacaaatgttattaaaacttgatgtggcatctctcactcattttttctcctgatattgcttctcccactattttcaaatctaaagctgctctgctttaatataacgaaccaggacctgctttgctttctgacttttggaacagattaggctacataggattcatgatggatcaaataaaagagttactgaataagaaataagacatttggaaggctaagatgcatggactttattctgtagccagtaggatctctgtatcagtttagggattttttttttaatttatgagtacagaatttcttaatgattttaacaaattggggattttcttttctctaacctatcgggaacatagaagtgaagagttgctgatactagaccagcaacttaaagatgtcagggcctgagtctctgttgttccctcagcctttccctcctgatagcctcctggtttccagatagatgctctgccttaagcatcacatcgacattcaaagcaggaagaaaaggagaggtgtagagcaaataaattcacacaccagagtctgctgtgccttaaggaccattcccacaaaccacacctaaccacttcagtcttcaaagttttggccagatctgtgtccagtggccaatgagggttctgttagaaaagaagcatcaaggccgggcacagtggctcacgcctgtaatcccatcactctggaagtccgaggtgcgaggatcacctggggtgaggagttcaagatcagctttaccaagatggtgaaaccccgtctctactaaaaattcaaaaattagccaggcatggtggcacgcgcctgtagtcccagctactcgggaggctaaggcgggagaatcacttgaatccaggaggcagaggttacagtgaatcaagatcacaccactgcactccagcctgggtgacatagcaagactccgtctcaaaaaattaaataaataaataaataaataaataaataaataaagcattaaaaagttgatatttattgggtaaccagcatggaatggaatgatatagccccttccctatgcaaacttgtagtatgcatttccaagagagaaatgttacatcaagtatttcccattatgttttggttttgttttattttaatgtggaacacatttttttgttttgcctctcatgggactcagtatttagaaattttggaagcatacattctgaaaatgatacaagatagaatgaaatcaaatgctaaatagcgtgggacagattgcattggagtgcagtaaaagtcagagaaagaaatgtgatggtggtaggaatagcttaaaaagatttcatgggaaagggacttgagttggactatgatggatcgagttgtactataaatggattgaattctacatgttactacatggtatatacatgtcattatacatttatgaaaaccagtagaaagtgcatcgtcaagcgtggcccctcatgtaaactatggacttcgggtgatgatggcgtgtcagtgtcagcccatcagtggtaaccggtggaccactctggtgtgggatgttgatggtgggataggcggtgggggcgcagggctgcaacagcatatgaaactctgtactttctgctcaattgtgctgtaagcctaaaactgctctaagaaagaaaaagagatgagacgtaaacagttgcaaagatgatgaggctggtgttctagtgagggaaaaaagaacacagtcacagatacagaaatgactgcagcacaggacagcatggggagaatgcgttggcccataattttagacaacctttaagttaaatgttcagtggttacttgagttggaataaacgttcagaacctaccatatcattcctattaaattttacgaagtttacataagaaatttaaaatattttaatattttctacagaggagagatgattaatttttgatattcgacagcagtgtatatgtgtatttatttcactgattaaactcagttaactaatactcataggattaaaattacatgcaaatttatttacaaaactgatatttaaaactgagtcccctgtttagaactatttttaagtattgtacattttctacttagataactgtactttgtaagtatgaaagcttttctatttcatggccaatagtaatcattttgtaaaatactggcattagccattttagttttccttaaagtaaatcattatcctattcaagtaaaaacaccctcttttcagttcgttgttttaattaagcaaagtataataaagttgagttcaattatttttcttttccacattatttaaatagtttcttctaattacacattgattttaattgaattgggtctaatttgataaactccgtttccagcggttaaaatatagatggataactacagtctctgatttaccatttctccgtgtgactggaaaactttaatatggttagactttgccctcccttttgtgtactttgccctgtactttgcttagtcgtaaacattattcatgttgtggggcagggataatgcttgtagagtagctagctagcattgtgactggtggtaagtcaccaacggagatgaaaaagcttgccttttaatctgatttatattaacgcaaggggaaaatatatcattttctcttctatttttagtgttgccatctggctgaaggaaggtttttgttttacttatttacttattttttagataaaagcctttttggttgaatttaaagtgtgtaatgtttattcctgtcagcgcaatgtgtcagaaagcatttgtgatgtgaatcgaggagctgcttttagtggtaaacgaaagagcttagtgggtgattccccccagttcccacaagatatatggaacatgtgcttttctgaaatatccttttcctcatgtttagctagggtggataattatttggctacataacagattatcaaaataaatttattaactgcttgggaaagagttggggtttacaaatttcccaaagttgagatgcttgtctgatgttaccagcagaggctgtaatgttcacatgctttctttcctccatgcagtataagcagtaacagcttgagtgtcccttatctgaaatgtttggaaatggaagggtttcagatttcaggtttttgggttagtgatgctcgacctgtattctgttgtgtttgcagagtgtcactctaattcctgagattctcactgtaggtgagactgagcgctcctttctatgaagtggggtcaaaacatccatttgattttgagtcttgcctaatataatgttgaaatcatcctagattaacatgagatattttttctcttctgatgtgaggtgtttagcacactacccagcacatatgtgacactgaacaaatgcttgatgaaggatgcaagagaggaatggatgtgtgccttgtggaacactgtgacaaaagtccagaaataaaaaatattaatgataagatgattagtaaaaagaaaaagaatacattttcttattttttgatgactgctaagattgtagagaaagggtgacaaaaagagttctcagatcaaggtcacgtctacttcacatcagaagagaaaaaatatctcatgttattctggagattataaggctgaagggcatgacccctgccctgaggttgctctggtcaagtggaaaattatcatagatctgcacctggccagatatcaatgactgaatgccgatgttccatttatttggagactgtttaagctcagaatatgatgactatgactagacatcagctccttgaaggaaaatggcccagtcctatcccttaggaatattttggtaacctattttgatagaattatcttttgctgttatatacatgatctttcctatcacatgttaggttttttatttcagaaaatgttgattgtgtcactattttatttatttatttatttatttattctttgagacagagtcttgctctgtcacccagggtggagtgcagtggcgggatctcggatcactgcaatctccacttcctgggttcaagcgattctcctgcctcagcctcccgagtagctgggattaattacaggcgtgcaccaccacgcctggctaatttttgtatgcttagtagggacgaggtttcaccatgttgaccaggctgatctcaaactcctgacctcaggtgatctgcccacctcagcctcccaaagtgctgggattgcaggtgtgagccaccacgcccagcctatgtcagtattttttataatctcatgtatagaccttgacagttcaatccaactgcctcaacttctctttggaagtggttcaatataaattattaacaaagacctgcgtgtctctgttccattcttcaagtcttagtgcagttatagaaataaggagtgatacctgtggaagattctgtccctatgtgtcatataactatacaccatgttggactgtatttataaagtcaatgtcttttgttgggtttgtactatctctttattgaacaaatttatttccttttggtttaatatcattttctatcatggtcatacatcttaaggttttttccattatgacgagatggagaaatcagaaagtgactttcagtcattgtcattgctgaatgagctactccaaattgtaaagcctccacactcttactatgctctgctgaagtctaccatagccaccaaatcctaactttgtgttctgtatagatgtgtgaaatgcaagaaaaagaagattttaattgaattatttctgtcagcagaatagggagagtgctgtgtataactcaaatatgtatcattatcagatgatcctatttagttttttatgttttgtcaacaagaattgagcaatagagtgaataaatggttcatgattgttatttctgtttcaaaatgtcagtcagattgaatgtggctggatgttgcaccataccatgaaatgggtttattctggtgtgtatagaagagcaaatgagactgcactatttttgacattgacagttacttaaattgccatgacacaatacctgtaggcatgccccatgaagcagctgcttccccattaagtgagggtctacaaaagattaataacatcaatcagtttcccatattttatcttcttcactccctgcaaaatgaccttcaaaaatatgccctacctatttcccaacaggcccatttccttatctggcctgccagctgctcatcctcccaggagtttgtggctggagtcccatttccggtggagggtccctatatagtgctgcgtgagctgtccttggcttcttctagggtgaccacactgactctactcttcccctacttcttgtttcttcagggacagacataagtttcaccatattcatgttactttttaccacgtaatggtcaaatacttatctcttggtacacgatacgggtaagtggaagaacctgactagttactaaattctatagaaggcagagttcttagcatgtctgtttttgtctgatttccttttattgttttctttaagatgagatcctttttaaattcatttccagcaggcttgttagacttcactttccatttacacagaatccactgaagctaaagtagttcacagctggaagttccatgtgatatatacttcagtgactttccattgccttcacgagaaagtccacactctcagaattcaaagagacattgaccttagccagtttctcttgtcatattttcaactgcctcccttcctaaacctgctgttctgaccagacagtcctgattgtctctcctgcctctttgccttggtagttttgctcgtgctccatcccagtgagggaacttctccacattattcttcacttatctggatgctttctggtctgcaagctctttgcccagggactgctgtgccttgtggctccttcttccactccaaattcctgtaacactatctatatcatttatttggttattaaacctctgtgggtttatggattttttagaaaattgaatcggtctattgttgcaatttcatgtatgtgcacactgtctctcctccaaaggatgataagcatcttgaaagcagatagtatgtcatataacctttgtattctcactgcgtagcacagtgtctggcccatggaggtattgtaaatgttgaaaaaattacttaattccttaaaattacttaacatttctgaggctggtggttctgttgattgtgacaaagagactgacattagggggttggcttttttgtgaggacattcaaatgatagcagaaatacatgagcagatattccctagaggttgaagacgggaactttgttgagagcacatatttataaatgcacactcgacagtgactgatgtacagatagtatttcaggccatactaggagatgatttttgaagagaggagatagtattggaggaatcagaagctccagaatacagtgtaacctagaaacataggacaagaaaaggaaaaagaagtggtagaaggagatacattatacccctaataatattacttccagcatcgagctcaagatgtcccatggagtagtgtactgttcgaataaatgcaagtaggaagaaaactgaggtagtgtgggaaatgaaatccaggtttgtcttatgctaactcccataagctttgatcattgctgcccaacttcacttataattatgaggaatttaaactaaggagaaattctccattatgtggaataatcaggaatgtcattaggagtgttgctgttgctttatgtccttcttgttctaatgcaaattttataaatcacattggataaaacacttcatacctatgattcgagtgttacaatactcctggcaggtatatttgaataaataaatgtaaggaataaatatatataaatatatacaaaataataaggacagcagtctcaggcctgatatggtaactcttttctatacagatttatttaaactattagattgaaacataaaagttgttaaattttaaccattttttactacataaaaggctatttcatgtggttcaacctctagttctgtgttctaggtcactcccccaaagctgtgtcctcacaagtctatgtccacaaaggggctgtatgcccacaaagtccagttgaagactgtagccgagaagcatgtatgcagtagttcctccttatccatgatttcgctttttgaggtttcagttacggtcagttgtagtccaaaaatattaaatggaaaacttcagaaataaacagttcataaattttatgctgttctgagtagtgtgatgaaatcttgtgccctcctgctctgtccagcctgagatgtgaatcattcctttgtccagtggatccacactgtagtcgctgcacacctgtcagtcacataggagctgtctcagtagatccaaaaaacatagcgtatgtatggtcagggactacccacaaattcaggcatccacggagggtcttgggaacctagtattcctccatggataagggactatacagagctgggaactgagtttaagcttttgctgtttcacagcccacattccagattttattaaaaagagtgactgaaatacattatccttgtggatgtcaagtccccatattattcagtgagatttaaactcaggatggtgcaaaggttatagtcagacgtgtctcagagcaagtattttgactaaattgacaggtcatttgttggaccagttattctgaacagttgagagaagactgtattggaccatacagccagaagtagaaacaaagccatgagaacaccaaggcctttgtgggaagacgttggaaggaatcagtgagtggcagacgatgtggattgcacaggcacattgcagcacttactggagctgcagaattttcactagatgaaggctccaaatgtctgatgcctctatattttgttttagagtatgttggaaagagagtcccagaccaccagggtgcttgtttgtatccttcctcttgtctttacctcaacactcacatgtgacactaatggaatacagctttcaagctagcaggataatcaataaagatttcataaggctagcaaagacttactgagcatcgtagtatatggcttaattttcttttttttttttttttaaatgaaagaagagagattcaaataaataatactggaaagtcacctagtcattttaatttttttttccatgagaacttttataagggtatatacaatcctatcttctagttaatgaggattttcaggtttttaaattttggaaatcagaaaatgaataaattcctgttgtcattgtgttcttaagtagtgaaatctcctgcactttgtttaaaaaaaacaaaaaactcccagctgggcgtggtggctcacacctgtaatcccagcactttgggaggccgaggcaggcagatcacctgaggttgggagttcgagaccagcctgacaaatatggagaaaccccgtctctattaaaaatacaaaaaaattatccaggcgtggtggcgcatgcctgtaatcccagctacttgggagctgaggcagaagaactgcttgaacccgggaggcgggggttgccggtgagccaagatcatgccattgcactccagcctgggcaacaagagcgaaactgtctcaaaaaacaaaacaaaaaaacaaaaaaaaaaaacacaactccctgttttatttttcccattgttactgaggttttgttttttttttttttaaggctcagatttacttaatataatgaaagacatcacatcttagaaaactgtcatctcccccaaaccctgaatcagaaggactaattacctcttcccaaaccaggccataccctaaacatcatatcaataagttcatcctacctgagagcaccaggaggtataactgtggctgagctgaaaacctctggaaacagcggctgacccagaccttcctgccactttagtcacttgcccccaggaccccgtcaccaagttaacataggtttgctttctctcaaatccctgaggaactagaagcccagtttcctgaagagagctaaaaatactttctaccatttatcgtgccttgctgtgggccaggcaatgaactacctttctgtacgttatctcgtttaatttttacagctctgaaagtagatgttttccccatttacagatggggaaattaagacttagagatgttaagtgacatgctgaggattcagctggtaaatggcagaaccaggtttgctgactccaaaacacactcaaacctgcatgggtgctatgggtatgggatgcccaggactccacagaaaagcatagaagctgggagaaagggccttgaatacttgttaaacaccttctatgtgccaagtcttatggtagatttttaacatgtgtcttctcagttaatctttcaacaattctgtgagttaggcagtattattaccccatgtgacctacttagagaggccaaataactttctcgccactcaactggttatgtaccaagtctcacttttgaacccaggtctgtctgtgtcttttgctgttacaatgttcaccaaagaagtttttgaagaaatacagactcttaaaccattgaagaagaaaaagactgatatgaaagcagagagatggcctgaaaactttagaaatacatccaacctaagagttaggaattagcaatatataatcttagaccaaacagcctgacaattttcaaaaaattatttttattttacgaaatttaacctattactaatccaaatggcttaatggaaaataaaataacataaaataaaattaacctatcaattttatatgagcacagaaaaatttaaaatggattgtatatttgtctcatggtgaatatgactcagaaggtcttctgggatggaaatgaattcccaacatgcagacgataatgaagtgggcagataggcctctgatgttcgcctagaatggatccaataaaagttagatgtagataaattagagttaaagtaaccagaactcctgtttaattgattttttttaatttgaatttcagcataataaagcaaactacagcctccctccagcaccccacccccaaaagcatttatcagggcttattcagaaaagtgacttgtactgaacatacgttgaagtcttttcgatttccatggtctgctgttacataatattcagttagggttgatgtttgttgtcaggacctggggctactgcagagactcagtgaccccaaagaaagattaaatgatgttgaatataccaaagcaagaaagaaattaatacatttgaaatatattctaagccaatggtgctttgtaagaactcagatccaagactttagactccagtcgtgcttccacgtggttgctttatgtgtaaactggtgcagccatgggaaaggcccttcatggccccttgaacatgccacttctataagatgggtcactcaagctgaggttgttgattttttatgtgttcttcctactccttgagggcacaggttgtaactacttcatcttttcatttccttaatctagcctaagaacctggtacataggttaacagtaaatgtcgaatacttaaatgtttctgaagaaattttaagaaactaaatgtgtcttttctcttttgtctcatttctgtagcacccgacagctacaaagtgcaagataagaaaaatgcctccagccgccctgcctctgcaatttcaggacaaaataacaaccactcaggaaataaaccaggtatgatgcattgcattaactgtgggaaaataaaggttatcttttatgccctaaaggcatgctgatgattataaaggtttaatttgtttaaattctagtttccagaaaactcgaatttaggagagcttggtttcagtcctgccaccaaacacacactcctactggattgtatgatattaagtcagagaacctctcaaagccaagccttggttttctctctttaaaatgtagattcaaacacacgacctgcttacctctcagagtcattttgacaatcaatgagatggtgtatgtggatgcactcatttaatgtcaagcagcttaaaggggtaataattttactattctgtttcaaatgataggacacaattttttatacctgtatgtccaacaagcattattgcgtatctcttttgtgactttttcaaaaactatttcaagaaatctttacacatagcaaagcttgtatagaattatggttttgtttcctattccttgcaatgattatatgcctacagagtaatttcatttaataacctctgattcatagtctctttcattcagtgatacaaagaagcaaacagtctgtaaatataatacaaacaattgaaccgacagtgcagttgcttccagttatccaataaccattgcgtggcctgtgggaggaatgaatgtacagtatgataacaggagacaatcaaaggaaaggaaagcaagccgaataccccatgaggttcttggaaacctacttcatgctgcatccaggactgaagtcactcaagcacagtgacacagtgaatcagtgagaataaagatggaaataactgagtctaaccttatagagaacattctagtgtgtttagttttgtgaattttttttttttcatgtggaaaaggtcttgaacacaacagataaatctggtttgtcatttagaggaaagacaataacaagtattgttgaaaatactgcttaagctgccattagtggaaaatgatgtgcagtctcagaggagttttaattaccaagcagagatttccttagtcagtcaacctgccttttcattgagtcatttatccatccatctagccatccaccttccagctaccatctaatgtttactgagttcttctatgccgaagaagcatgagagatgtactgtatgagcaaacaacatgaaccctgtccccacgcagcttattctagtggacctttatttttgtattcaagtgtgtctctatggaagtagaaattctttagcatgaaaatcacatttgttggcagaagtggacctggtagctgagttcccctggcctcctggtgctgcactgaggttatggcccacttcgcggccgggctgggcacgcagggcaagcgggtggtgttggtcacgtcaggcagcaccaaggtccctctggaagcatggccggctcttctgcgatgttttacctggcgcggccctgtcagatttctatgttcctggctctgaaatgcctgaacacaagatccagtcatctgggggcccactgcagataacaatgaagatggtgccaaaaatactttcttctttgattaaagattgtgctcccaaagcatttataatttcctttaagttggagactgacccctccattgtaattaatcgagctcagaaggctttggaagtttatcagcatcaagtggtggtggctaatatccttgagtcacaacagtcctttgcagttattgtaaccagacactcagaaaccaagttatagctatcagaggaagaaatagaaaaatacatagagatagaagagaagatagtggataatcctcagtcttgacacacagctttaatatgtgacaaaaactgaagtaaaaagcccttacaggatcaaaaattgtccagggctcttacagatggtgaaaactttaataaaacttttgctttcctatgaacagagaaaatgaaggaaagggaaaaggcagtggtgcgcaggcaaatatgctttgttattcatcttttaatgacatgtgatacactcacctgaatgtcatcttgattttgaaattgaaccctagaactgtttctcacctttaaaaataagagcttattgggaaatatatattacttaaggtacacatgggggcctgaatatcagccttctttatactataaaaagaggattatggatgcatgaatggtcatgctttggaaatcaaatatttgttgagtgcctactgtgtgtcaggccctgtgctgagccacgaggattaaaaagatgaataaatgtgtttcaaaaaaataaaataaaatcacatttgtaatacaatgagaatttaacatagcttagttgttggtgctgtatttctctggttctccccatccaccactgcttctaatttctaccattcttttactgtgcagtttatacttttatatcctgataactcatttattcatctagtgttagcatcattaaagtactaggaatatattattaaaagacataatctctaccttccagttgacagtatgatggataaaccaatatatgaataggtcattctaacacagaaccaccagtgtgacgagagattgcacacagtgtatagagatcagaagccagaaaaatctcttccacccttattggccatctccttatatatagtcatttgatttatattgctaaagtcaagttaaatagggagacatttcacttctgattgtgtctttttgagcatcctgtgtctgttttcttgtatatacagataagccaagctatataaaaggctcttgatttagtaaccaccatgtcattattttcctgagtctcctcaaaggacaatatgagttatgtgttggagggctggccttgagtaacaccttttaatttttgtgggatacgggtcataggaatgtctgtctaaagcattttgttgattttcattttctagaacttgaaaaaaaaaagttcattatatattttgggatattttaggtattgtcctaaccaggtatgggcatcctgactgaatgatttctgagaatcccttttaatctagtaagttttagctaaatgttctttcctcttttaccttctgatacttaaactcattagaaggctccagaacatctctttgatgtagaacacatttatccacattcaagttgtgacttttatatttaaaacacattatggctggccaggcgccggtggctcacgcctgtaatcccagcaatttgggaggccaaagcgggtggatctcctgaggccaggagttcgagaccaacctggccaacatggtgaaaccctgtctgtaataaaaatacaaaaattagccaggcatggtagtgcgcgcccataaccccagctactcaggaggctgaggcaggagaatcacttgaagccaggaggcagaggttgcagtgagccgagatccgccactatactctagcctgggcaacagagcgagactctgtctcaaaaaacaaacaaacaaacaaacaaaccacattacagaagtccctcgtggtgttttagaactatgagcacactatgttctgtgttatcctggaacgaccattgctctcaaatgtgaatacttgaacccagaccaaaacagacagtttgtaaagttacacatctgtccacgtctgctagttcctgaagaagtgggagatggttcttcagaactccagctgccttcaaatgattaatagtttgacttccttagaaaactgcgtgttttcatggacctgagaaaagcagatacccaaattcattaaaaatccttctgaattcctatccctttgctgccccccaacacaagtctttaaaagagccactgaaactttattctgccttactgtttataagtaatttgccctcatagaggagtgtgtgacttaggagcttccagcccttctctgatgccacacggtgcaattgtaatgactgtagctgccatggtgcgtggatgggcacaggactgagttagaaatcgggttttatgccctcactctgacacatatccgtgctgtcttcattagtcatatctatttctctgagttttttcatttgaaaaagaggcataataactcttcattgaataaataaatgcttggctaactcctagtgttattgggaagaataaagtgataatatgtgaaagtgcttcataaagtacaaattgctgacagaaatacagaagtatttactgtagaaacagtagttgttacatatgagtcaaggcctagtgagttcttgaaaaagccttgtcaactttgagagctctgtagtagcatgaccgtactctcagatgtgtgtaaggcaatccaggtttatgcatgttatcaaacagagaattttaatggcactccctttcacccttaacaatgccccaggttagatgtcaccccacacttgaaacatcataggtaggaggttgaatgtggagtgcaactgcaatcttaattaagcctaagttctattcctcttaaaccctttttccttgtgagaatcagtaacttaattttattctaaccatattagatccattgggaaacaatgtggaatatacattattttattttatttcaagacagggtctcactccgtcgcccaggctggagtgcagtggtgtaatcagggctcactgtagcctagatctcccagcctcaagcgatcctgtcacctcagcctcctgagtagctgggaccacaagcatgtgccatcactcttggctaattttttttatttttggtggagatgaggtctccctttttcaaataggcctgggctggtctcaaactcctggactcaagcaatcctcctgccttggcctcccaaagtgttgggattacaggagtgagccactgtgcctgacctatatataatttttttttttttttgagacgtagtctcgtcctgtcacccatgctggagtgcagtggtgcgatcttggctcagtgcaacctccgcctcccaggttcaagcgattctcctgcctcagcctcccaagtagcttggataacaggcgtgcaccactgtgcctggctaacttttgtatttttagtagagacagggtttcgccatgttgcccaggctggtcttgaactcctgacctcaagtgattcgcctgcctcgtcctcccaaagtgctgggattacaggtgtgagtcaccgcgcctggctgacctatacataattttaaagtattttctatagctaacttttgtttcaggggaaaataagtgggggtggaaacgagaaagaaggcaatgaattataggaaattcactatttactggaattatttaattgtatttttttgaaaacctacctttaaagataaatttttatcagtttttagttattaaaactaaaatttaaacttctagcatttaaatagtttactctgttatcaggtacaagattgttcttagttttccccattggtgcatcttaataaaagtttaaaggctctgagggttagctaaggttgttcgttgtttgttcattcattcattcaacaaatacttattgaatatccttttctaccacatacagcccgaggaattgagaatgcagcagggaagaaaacagacaagtctctgttcctccccagccccatgcacagccatctttaacctgccacaggtgttaatgacattctagcacccaagagactttcatattaatgggaacagagggatagaaacaacctacactaaataactttttcactctacaattcaatattttctaacgccaggtttccaaatcaagcaaaatcatctagtgtatcacaaccactatgcatcttgagcttcaaaaatgttacatttctttacttcctcaaatctgtttccagagagatagtaattatttcagcactaatgttgatggacagccaggaactactgcagtcctaagcattggccttatttacagccttatttttaattgtataaaagtttggttttttacatattatcttaccaaacaggacgcagtttgttacatgcgaagagtataattttcatatgaaatgatagcatagaaatcagagaaaaactagcacttcttcaactattttcagaatatacattcaaaaggcacttcacagggggaagcattacgttgcacaatcgggcattgcctcattactgcaggagcactggttattactatgacttggggctgtcagggttggtgtgggttgtcaggagtggcatgtgtcccatgtgttattaaagccttcttttcaaaattttgtatgaaatttggcatgtacttgaaagtaagctagacatggcacatacttaattgaaatattgtctaacagaatttgtcagtggaattttaaaagtaattaaactgtctattttacagactttccataatgtgctcatatggcttttacaaagttgattttcaacttttataattaaataaaagtttttatgaggctgggtgcggcagtttatgcctgtaatcccagcactgtgggaggctgaggcaggaggattgcttgaagtcaggagttcaagaccaggcttagcaacatagtgagagcccatctctacaaaaaaaatttttttaattagccgagatcgggcatggtggctcacgcttgtaatgccagcactttgggaggctgatggatcatctgaggtcaggagtttgagaccagcctgaccaacatggtgaaaccctgtctgtactaaaaatacaatagctgggcctggtggcgcatgcctgtcatctcagctacttgggaggctgaggcaggagaatcgcttaaacccaggaggcagaggttgcagtgagctgagatcacgccactgcactccagcctgggcagcaagagcaaggaaactctgtctcaaaaaaaaaaaaaaaaaaaattagctgattgtggttgtgcacacctgcagtctcagctacttggtaggctgaggtaagaggatggcttgagccagggagattgaggctgcagtgagccatgatcataccactgcactccagcctgggtgacacagcaagatcctgtttaaaaaaaaaaagtttttcatgagtgagtaaacctcatattatttaaggagtattaaagtgataagtaattgttaaaggtctttcttttaacttcatcttgacttttatcccgagttctttctttaaaatgccattttactacggccaccattttctttcagcaaaacaaatgatagcaagaacttcctgtggatagcccttaataaattgcctgagagggtcgtcatgtccacttccattttcttgtttccaaattaaaccttttagggccaggagccatattttcctacataaaaaatatgtggaagtacataaatgattaggaaatctgaaaaatatttatcattgtgggctattgaggagtccatttaaccaattttttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttttttgtatttttagtagagacggggtttcaccttgttagccaggatggtctcgatctcctgacctcgtgatccgcccgcctcggcctcccaaagtgctgggattacaggcgtgagccaccgcgcccggcccatttaaccaatttttaagaaccatcccctagtcttgttcatcatccacactgcctggtttatgcaggctcctaaggggcgtctttactgtttttattttctttaaatgtacaaattctgtaaagttcaagagacatatggcagcctgggcaacatagcaaaatcctgtctctacaaaaaatacaaaaattagctgggtgtggttgtgccacctgtggtttcagctactcaggagactgaggtgggaggattcacttgaacccaggaggtcaaggctgcagtaagccatgatcgtgccacagcactcctgcctggatgacacgagactctgtctcaaaagtaaaaaataaaaaaaagacatttgggatgcaggcctttacatttgttgccaaagcactgctatttgtctctactgtattttcttttctttttttttttttttctgagacggtgtctcgctctgtctcccaggctggagtgcagtggcatgcagtcttggctcaacgcaacctccacctcccggattcaagcgattctcctgccccagcttcctgagtagctgggactacaggcatgtgccaccacactggctaatttttgtatttttagtagagacagggttttgccatgttggccaggctggtcttgaactcctgacctcaagtgaaccacccacctcccaaagtgctggaattagaggcatgagccactgcacccagcttgtctctactgtattattatagtagattcccatttttaacgcaaggttctaaaaatgtcaatgtcaattcttttttctttttttggagacagagtcttgctctgttgcccaggctggagtgcaatggcgcgatcttggctccctgcatcttctgcctcccaagttcaagccgttctcctgcctcagcctcccaaatggctgggactacaggcgcacgctgccatacctggttaattttttgtatttttttagcagagacggtttcaccgtgttgctcaggctggtctcgaactcctcagctcaggcaatccacccgcctcggcctcccaaagtgctaggattacaggtgtgagccaccgcacctggcctgtcaacgtcaattctactgtcaatttagtaaagagaaaaaccttttaagtgtgattattatgctcatttttattattttgttttaattcggcagcagagtgagcctgtaaacctagccctctgctgcagaacccctcttctccacccatgtctcactcagagtataatgcaaagtcctcaccttaaccatgagccccgtcgcttactcatctcactctgttccagtccctcagatctccctattgtttctggaacacattgggtacttgcaacctcagggcctttgcacttactttctatggaacatcattatcacagtgaggccttccttgggctccatctaaaaatttaaacatccttttcctgacatgtcataatccccttcatttccttgttgtctccttaacctatattctctgtatttttctccttctttcattctatgtatagtacttatttgtcttgtttgtcagattttttcccaagtagaatgtaaatcccatgaaatctcaggtttttgtctttttttggtgactgctgtcttttcagtatacagaacagtgcctagcacacagtagatgttcagtgatttactgggacatacacactacacactctactaacagtcattataataatgagagataggttctattgtatcctcattttacaggtaataaatcaaagtacacctcatagcttgagacttacagaggtgggtaagtaccttggccggcgagtgacggggcagaaactgaatgcgtgtctgtttgactcgagcacttcacctctaactctcaaacatttgtgcagtataaagctacttaaggattttgttggtcattaaggaacagactttttaaagcataaaaataatagaagtttggtagcttaggaacacaaaacatcatttatattgtttgatgaaaatagccaaaaggctatagttacgtcatgattttacatgttttcaaatagaagaaaaatgcttagaaatccttagaaaacttctaataattgagtagatcactgtaactctagtcacatgtacttattgttgtaaagtgcagcaatatattattcttcagatttactggatatttatcaatgtgtgttttttctttttctttttttttttaatccactcttcatctcatgttttttttaatctcgctttcagaccctccgcctgtgttacgtgttgatgaccggcagcggctggcccgggagcgacgtgaggaacgggagaaacagctaggtaccccaggccccgtgtccatggccctgatttgaatggatgtcactataataccgtggtcttttgcatacctttatgaattttacagatggactatgaggcagaatttagtatgtgatgataaaatataaacatagggataagttttaagtgacaataaactctagcctcaggattaaggtcatccttttttgcagtcacagtttaatgtggcactggagggaaagtatatatgagtagagtgatggtacagcttacattttactactgagaaaatgcgaggacagtaaacatattgttcttttttacatgaaaagttatgagattatacactgtcagggcacttaactgacttctctgttaaaataatgctgccattgaacttatagacaggtgctaccaggctgctgccaggaaaagcatgtgctgaggtgtctgatttttctcttattacccaaggcccttgtgacgttagcaactgcaatatttgtcatataatcactggaacctggatcacaggactatcttagcagaagctgagactagagcacttagagattgtacagtcattgtcttctaaaacattgggcaaggaagcaggtgccaacccctcctttactttgatgtccatttatgtaaacttgctaaaacaggatactctcttgaaatatacctgaatgatgtaccttggaaaagattaaatgcctggtcagcatgtgcgtgtacagagtgcctgggtattctgaaactagactgacagggtatcaaaattttcccaggagatgacctgtaacttcttaaagttgttctgcattttgtaagagttaatgtttcaactggggactctgcccctatatctcatccctttattattcttattccaaagcccaaatttgtgaaatgtagtggaagctggttttcaaaagtcttttgctattgtttacattctttcaactcagacttgtttctgtcccttgccataatggccatatgaggtcatttcttttgcttctgaggttttttaggcatagatttcatttgcttactggaagtgaacatgctctgctgtttttctgtgcctagagtttcctccctggcctgatgggttccctgcaggcaggtaggttcttggggagcaggctgtctgtggtcaccagggctctcccttcctcctgtgaatatgctcattgctccctactaaggttgctttgacaagcaaaccagaactgagagaggatgaaggcagagctgctgaaactggaagatgagtaaaaataagaaactgactactgttttagggtggctgttatttacactctgttttcaagtccatgcgtatgtccttttccccctcttccccatcaggtctcacacttgtagatctctttagttatagcgtggattcatatctgcttgaatagaaggagttccataggtcgggagagcattcctttatggtttaaatcacattgtgaattagcttttccatacttaactcacacctttccatttgggtttctttatcttaacaaaacaaagcattagttttttgtggaaagcacgaatatgctgctggtgaaacaaaaatgactttacttatactataaaggtgtaagacttacagctttgagcttgcagttctccctaaaagttgcttacctttgtatattgagtgactagattttttcttaacatgtaatgccatatttcaattcatattgataacacaggacatgactcattagtttatatattcaaacactgtatgtgccatatattgtatttaaaagatgacaaaaagatgaataaaggttgacacccagccctctagggctaggtgtagtctagtgaaaggcagataaacaagtagcaactattaatgtcacagtgcaatgcatccactgtgagtgggtatgcgccaggggcattgagagcctgtagaggtgcctaaaccagcctggctttgccaggtgccacccaagttcccaactaaaggatgaaaggagcctttcaaagggatagaagagcaggcattatacagcaatgtgcaagaacaggtggaaaaaagacatttgctgagagacccaacatgcttttcagattattatatgattatatgttacatatattatatctagatgattgtattattctattattacagcttaacttttttggtgagccaatatatgatatacatagtttctctcttctctctctctttctctgaaatgggatcttgttatgttgcccaggctggactgcaatagctgttcacaggtgtgatcacggtgcgctacagcctcgacctccttggctccagtgatcctcctcagcctctttagtagctggcattacagactcacgtcaccacacctggcatttttctctttattcttacccctgccatgttaaatatcataatttttaaaaattcaatctcatttcttttttcaattgtcagagtcataattttaaggaaaatatatccattctaatttttttctttgcattaattttattttctttacatttcagagcagtgcctttttgcctattttttttttccatttaaaccatcatagttagaactaagtcttgagaggctcccttcaatcttcataaatacaggagtgagcatatatgcaaatatacatgcatatattatatacagttgtaaaagagccgtttaaaaatctaatttcagctgtgccttagagtacgtgaggatgatttctaaaaaatcttcagtaccaaaaaaaatcaaagggcacacctgatcaactgtctatgaactgtgctttatagaagctataacagcagtggaaattttttttaaaagaaaaaaagtttaaaagcagacacttaatattaaggaaatctttggactgtgcttaatttgaaaacaaaaaaaaaatagttggtaatgtcaactcttaccaactttcaaactttaaagttttcaagttaaaaaaaatcggacaccattccacaaatgctggcaaagtaaagtttaaaatgaatagccagggagactggttatttactgttggatgtaggttgaaaataacattgaaatcattaaagattgttttaatccacgtattttaaaaagcaaggtagagagagggagaataaaggtctgattattttgttcttggtgttatggcatatttgtactattttgcaaacaggaaggacttattaataactttctgtgggttaaatctctgagtcatgctttgatgcttttatagtaggattatgtcatgtggcctgctttttctgcattatccttcagtttttcacaaaatcaggcataattcttcatgtatgagattattctgtcgttgggcacttgtactctgaaagctttatttttcttccttaaacgctttatacgtagaaaagtctctaaccaccctattccatctgattctatcccctcaaactctctctcttgacttctgcatgtttttcactctctctcttctaagcttttattttttgttttccaagggtggggtggagaatctcatttgttctcacaggttcactctcctttttaaatattgattccacatttccagctactcggaaggcagtagatgcctgcctgtttcccgaaactctacttctgtacaactaaattgttcattttctttcactccaaaactgactcatcctggtaatttctgtgtcccaattaattgcaccaaatgtttgggtttttttggccccaagacattatttatttccgtcatttttgatgcttctgctagagaccctaggttctttctgactagtagcttagctattagatcttttgcagaataaaacattctcccttccttggctggcccaatactgtccactgactggtctccatcctggcatattgggccacttgtagctacccagtggtcagtctggactcagcctagttctctaactggagcttcaactatctactatcaactagcccagtaggtaggtagaagttgacatactctaaccctgaatccatttagtcagaaatctagcagactcttatttcaggtaagagtctatgccattgtattggctgcctctgccattatcctagttcaggctaatacatttactgccctgttgttctttatactcctagcactgtatcacaattagtgccagtccttctgttttaaaggcttcctagaaaatctccttttagaaatttatcatcctttcactatatactatatcttgcataactatcacgttttagttcacattctactgctgttttatacactactgaatttttatctatttagactttctatctctggtttgtatctctggtgtgtattttaagcttccaaagaatatgactgtggtctctaattttttgtatcccaacacatggcacagtgctaagtgtaaaacacataataaatatttgctgattttgcttactctacaatcttcagtgaaataatagcaataatgataaacagtatttattgagcactaactatgggccaggcagtgttctaaacacttcactatgtataatcccatttagtaacaaattagcacagtggttgtactttttattgtgtgggcgtgccataattggcaaggtaagttttttaatagaatgtcacttactttatttttaaaatacattgtgatgagttagccaaaggaagtaactgagaggatctcagaaaaatggaatcgttaatacacccttttgtttttctgccctattacccttttgttgttgttgttgttttgtttgtttttgtttttgttttatacagtcttgctctgtcacttaggcaggagtgcagtggcatgatctcagctcactgcaacctccaccttccaggttcaagcaattctcgtgcctcagcctcccgagtagctgggattacaggcatgtgctaccacgcccagctaatttttgtatttttagtagagatgggattttgccacgttggtgaggctggtctgattttcctggcctcaagggatttgcccgccttgacctcccaaagtcctggggttacagacgtgagccaccacacccagcccctattagctttttaagcatgattttagtatgtacaggatcaccacagtccatgttaaaattcttccactagtagtgatgctgttaagtagagagagatccttgtgctttgtttatgggtgatagaattttcagaagttttaggagttggacaggtatccagttgtcatggagaaagagttattctccttcctcatagatgtattcataagatgcataggtgctatgttgactcccattcgacagtggttaaaatgtaagtgttggagcagattctgagatctgctttgagaaaactttatggcattgatcagttaccatcctttgagtccattaagagtaattctgtctttatgaacttagaatcgatcctggttaccgatttctcttcagaaaccattactagaaccagagtatatagaatttatgcaacaacataaattttttattcagagagcttaaaatagaaccccctctcttttaagctattttgtgtgattttatgtattcattcaataatatttaaagcgtagatagtattgagccagggatgctggagtattgaagtgaaaagaataaatttcataacctcctggaatttatattccaagaagggagtaagataataaaaaatcaaacaagattacctagcatcttagctgaaatttcccacacatcccataaccaatccatcagcaaatactctttgctgtaccctcaaaacatacccagaaagtaactacttctcacaaccaccactgctgccaccttggcccaagacagctagatctttcacccggattctgcaataggctcccaaccggtgtcctcatttcctcctcctcccacagagtctgttaacacagcagccagagtgacccacttgcaatatggcctgccaggcctgcctctgctccagacctttcaagtctttacatttcatgcagagtagaagtcagaacccttaccatggctcagccctgctacctgctaatgtcctctcctttgccctctcctccagccatgctggttccttgctgtttcttaaacactacagccaaatgcactccacctagagtgtttttcctgagaaatccacatagttcattccctctcctccttcaggtttcatttaaatgccaccttctcagcgaggccttctcctaccatcttactcaaattttcagctccctcaaaccagaccttctttatttttctccctagctctgtcaacatctaagcatgtagatattttacttatttgttgattatctgttggccccctgccccggaacataagctctggaagggaagggatttatgtctttttttcatttctgtagcttagtatctagaacagcttggcacgtaatcaatgtccagcaactgtttgtttaatgttaagtggagatgaatgcaggaggtattgcatattagttaaaacgttaccaaagtatcatgtaatacctgcccttatgatagttcagtcaaacaggtattaaattcttattagtaatcattttctcaggtgaacaagaatacagaaataatctattaggatagtccttaaattttcctatggatctatcctattatctatggataatctattaggatatgccttaaattttcctcttcatatattataaaactaatagttctacaatatgtcgacaagaaagttcaagagaatatttaaggactgtgtagcacacaaacagtactctacgcttgagcagacacagagcttccctttttcaagataataacaagtaagtttggagtattgattgtgtttaagttttgtttaagtgccttggaacatactaggcactcagtaaacatgtaattatttagtctttttctgaaaccaaaatttttatatgaagagtcaaattcctaattggtactttcggggattctataaaatcatgaaagagaatgtatgatggactgacatagctcttgaagaaaaatgtcaacttacaaatctataatttcattcatattgagttttgtagctaagttcaaagctaagatatatcataaagcaatattttagaaagaataagacaatataaaaagttttaacctttgaacaaactttggttaaattatatgtgaggggctttttttttttttcctagataatttcatcgggcttcctttgccttctaatcatagctttcttgctgtgcttctttttttttctctctcatctcagtgtgttgtcaactcagtgagtgacggcagtactaataagagtgtggtcaagagataaatggtcatttcaacctggtttagaatgttcatcccaaaaatgctgatagcaagttagtaataattagtaaataataatgctgtactcctggttagaattgggagtgaaactccccctgatttcatacttcacgttatttgattcagatggctgttggttttaacaagagactttcctctttagagactgtccaggaaaaaaaaaggggtcagaggaggctttagggaagtaatctttctaatccaaatatctaatggataaacttcggcatatctgttaccagtctcagcatctgcatctcctaaaattgtcacttagtgaatatagtgtacaaaagctcatgaggctgtcaggcaggttaacagctgagggacctaaatgcatcttagtgagaggaatatggatgttagcacataacagagcagctgtatcatgagtcaggctcaggactggaaagaataattgctgcttgctgcatggattaggtaagcagaagctgaagcctgaacataaaatgagtcattatgacaaagcagccattatttttttctccccaaattactttgcctttaagagtgaagataaaaaatcttaaaacctgaaaagtaaggggtcttgtaaacagatgacggtagaggctaagagtggcattggaagatcaggaccttcacatttggatgcccagctctttcttgctagtacagagaaggagctgtggtctttggaaggtgttccaattcatgccttttagcataatggctcattgtttgcttctagagtcagacaatccagagtttgaatgccaacttcatcacttatttgttgtgagacatcgggcaggttacttcactcctctgtatctcagacttctcataataaaataagtttaatggcagtgtctgcctcatagagtggctgcaaagacaatgcctataaatcacttgcgtcagcatgaagcaagagctgacgacatctcaccatgatgatgacggtgataaagatgaggatggcaggtcatatgattccacaaatactgacttagattcctggaattagagaagcctaaggcgtagcagagagaggtgggggatgtctgtgcctcctcatccattagggtggggctaagtaggacagccccaggtgaagagaatggctacattctttgaggagtgaaagtacttagggttaaggctgtaacagaaagattccaaggacaaccattgccctgtttagcaaaactccattattttagtgaaggctaacattcctttaggcctagccctgagatagtaagtcctttctttttctttttctttcttttttttttttttttttttttttttttttttttttgagacagagtcttgctctttcgcccaggccggagtgcagtggcgctatctcggctcactgcaagctccgcctcccaggttcacgccattctcctgcctcagcctcccgagtagctgggactacaggcgcccgccaccgcacccggctaattttttgtatttttagtagagacggggtttcaccgtgttagccaggatggtctcgatctcctgacctcgtgatccgccggcctcggcctcccaaagtgctgggattacaggcgtgagccaccgtgcccggcagtaagtcctttcttatttgaaaaatcattcagcctacatataagaaaagctcttgatctccacctatgtaactactattctagcacctcaaccccattagcccaccactgtgtgcagtgacagggtgaaatgggaaggaccctctgtgcaggagcaccgtgttgtggggatcctccaaggtcacacttcttatcaggcagctctccactgaatgcttttaatgacaagttgagaaggctttgagttgtcaccaaagcccagtgtgaatcactatgcttggagatcactctgtcctttaactctttagttcatttattcaagcatattttaaccatctgctagactagacattgtgtgtatagggaagaattcacaaacacataaaagcagagtagctaccgtctggagtgtaagtgctatgagggagtctgaatccagctagcagatggggctcctgtgctgtggtcatcaggaaaggctcctcagaggaaggagcttctgagctaggacttgaaagacagaagtttgccagggggaaggaggtgtgtgtgaagatgcatgatcctatggccagtccaaggggttggacagggaacagtaggagaactaacaggttttcaagcacgacaatgacttcaggtctgtttcttgaggaagatatctctgagacgactaatgtgtaggatggatttgaagtggttaaagactagaaatgaggcatgagaaaggaatgagagtttaaagtagtggtaaaaagattggagaggctacagcagattcaagcgatcattctgtgtttttctgtttttttacattagagacagggtttctttttttttttttaattatactttaagttcttgggtacatgtgcacaacgttcaagtttgttacatatgtatacatgtgccacgttggtgtgctgcacccattaactcatcatttacattaggtatatctcctaatgctatccctctcccctcctcccaccccacgacaggcccaggtgtgtgatgttccctatcctgtgtccaagtgttctcattgttcagttcccacctatgagtgagaacatgcggtgtttggttttctgtccttgcgatagtttgctcagaatgatggtttccagctttatccatgtccctacaaaggacaagaactcatccttttttatggctgcatagtattccatagtgtatatgtgccacattttcttaatcgagtctatcattgatggacatttgggttggttccaagtctttgctattgtgaatagtgcctcaataaacatgtcacccaggatggagtgcagtggtgcaatcatagctcactgcatcctcaaactcttgggctgaagggacccttctgcctcagcctcccaagtacctgggactacaggcatgtgccaacaagtccagataatttttctttcttttttgtggagatgggggtcttgctatgttgcccatgctagtctcaaactcctgagctcaagcagtcttcccaccttggcctcccaaagtgttaggattacaggtgtgagccactgcacccagctgagagatcattctgatacaacaattgatgggaccaattatatggatgtgttgagttagggtgcaccatgcatgagggaaacattgtggaagacttgaagtgactaactttatagaccatttggtctcaggaatctgctatcagaatacggaagacaaagaaagttccagtttggagcagggaagaatgtgcagataatgaataagattatatgatggatctgactgagaaattcaggtggaaattagaagcatgcagaagtgaatatagaggcaatattgtagagtgactgagtacaagctttcgagtcagagctgaatgaaaatcccagctgttttcttttagaccatgtgctgatcttggaagcatcatttcacttctttgggtctttttcctcatttgatcttcagttctattttttctggtagcaatagtcccacagttattacatttttgttttcatttgcctgatagccatttgctcattattttagtgttatttgacgctttgttttagttttgtttcttttaaacaacatagctaggtgtttttgtttttaacccattctaaaagtcttaataggcttgattttagtccatctggctttttttaaaaaatgttgtttcccccaactcttttttttttttttttgagacagagtctcgccctgttgcccaggctggagtgcagtagcgcaatcttggctcactgcaacctccgcctcccaggttcaagtgattctcctgcctcagcctccctagtagttgggactacaggcgcccaccaccacgcctggctaattttttgtattttcagtagagacagggtttcactgtgttagccaggatggtctcgatctcctgacctcgtgatctgcccgcctcagcctcccaaagtgctgggattacaggcgtgagccaccacacccagcctattttcccctttttttaaaaaagaaaaaaaaacttttttgtaggaggggcagggctggtggtgtagaggtaggggttggtttgatgtaagtaccattcattccatggttatctttaataatttgaaaggtgtgctaaacttttccattctattaatgattacattttcattcctgtttcttgactattaaatgaaactaattagtatttcccacacaaatgctctaagacctacaaaatatttttacttttccatctttagatgttcttattattttattctacaactcccttctaaaattgatgagcataggttaagccattagattcctttttaaaaagaattattattcagcacatatatcagtcagcatataatatgaaaatgacatgtatttgaatataagtaatcacaacaattattgagataaagcataaaggttaaaattttaacattcaaaatgaaaacaaaaggaaactggaccaggcacagtggctcatgcctataatcccagcactttgggaggccaaggcaggaggattgcttgagcccaggagtttgaggccagcctggacaacacagcaagactctgtctctacaaggaataataataaaaaaaaaaacgagccagacatggtggcatgtgcctgtagtctcagctactcaggagctgaggccagaggatcacttgagactgggaggtcgaggatgcagtgagccattactatcccattgtacttcagcctgagttacagagcaaaaccctgtctcaccaaaaaagaaaaagaaaaggaatctaattgtaatcccacacatgtcctcaaaggtaaaaacaaaaaaatcaagtcatgggagttagttggaagagatcttggagatcattttgtatactctttctaatgtagaagtagaagagtttggctagttttcccaagatcacacagaattagtagcagactcaagacccaaactcagatgttctcatcacttttcactttctgactcttcattatattactggctactctggtagccagtgttacccaaaatccttctatatcttagtatgaaactgagacaacaagtctgaatatttcagaggttaagtgatgatatttctctagtctctgaatgtcaccttttcttttctctcatacagcagtaaaatatatgctcccctgatacagaagtaagcctgttcagagggaccaggctggactctagattgctgaatgtgatgacaggggcatgtggagtgttgcacacaacccatgagtgcactgagttcactgttctacctgagtttcttcctgttagctgcatgctgtgtgtattagtccattttcccactgctggtaaagacatacctgagactgggaagaaaaagaggtttaattggacttaaagttccacgtggctgaggagacctcagaatcgtagcaggaggcaaagggcaattcctacatggtggtggcaagagcaaatgaggaagatgaaaaagtggaaactcctgataaaaccttcagatctcttgagacttattcactaccacaaaaacaatatgggggaaactactcccacaattcaaattatgtcccacggggtccctcccacaacatgtgggaattatgggagtacaattcaagatgagatttgggtgggaacacagagccaaaccatatcactctacgtggcaataggacaggaattattgattatcgtaaaggctgtcattatctgcatttattgaatccctgcaatgtacatggcactatgctaagtgcttcatatgttactgtgagccacaaagcagccctgtcaggaagttggtgccatagtaacttgggggaacaaggccacagaagtcattacttgttcagtggcacatagcttgtaagtggcaagactgggggtgggcccaagttcatatgaagccagaaactgtcctctatccaccacagtaccctgcttttcatttttaattcctttttgtacagcatcactgtgtatttctacatggagtctagattgatagtggatttctcctttgtatggtactgatatattgttacagtgtcattaaaatatcttggtgtcagcaggtcagggatgggactgactcgttagtgtccagtatttcacaggctacagtggattttcacttcattttataatgtgatcccataggccagggataaattgtgacttcagaagagtaaaggttaatattaatcacagttcattttttggacatactgttcttttacggagctgcctctttatgaaattaagtggttgttaatgatttaaatactgaatgagttgtattcatctactagggatgccataacaaaataccatagactgggtagcttaaacaacagaaatttattttctcacagctctggaggccgtgcagtccaagatcaagttcagcttctgttgagggctctcttcctggcttccagtgggccactttgtcctcacatggtatttcctctgaatctgttaggttagggtgccatctttatgacctcatttagtcttaattacctcctaaaggtcctattttcaaatgtatttaccttgggggttagggcttcagcatatgaacttggtgggggtgggggcaaggtgggcggggaacaattcagtcaataacagttgctgaattttttcgtgtattcaaaattatcatttcttaatgagaaaatacataacctcaacattatccatagggaatattttaacctattctgaaattcttaaacctaataggcttgattttacaccttctagcttattttttaaactttgtttttttccctttaaaaaaaaactttttgtggaagggccgggtattaaagtattaaatctcttataataaattaactttttatttttattaaaatattgaaatactttgttatccttccatttaaaatattgcatgacctatatttagcaataagtttgcactcactagcatgctctgcaattggcaagtgttgtttaatttgcctatttgctgtgtgactgtttaaagaaggcactgcattaggatctgcacttcctggtagaaagtagtagtggaattcaataacagttggatagacaaagaaatattcttcctttaaaagattatttggggtaaaactaattattgttgcaataatgtctagctctactgtgatttatagcacaaccttaagaactacctttaattttctaaactgaaattataatgattatgacgacaaaaacaacaatagctaatatttactgaatgtttactacattgcagaaaagtattctaaccatattatgtgtaattattttgttaatctttatggtaaatttatgagaaagatcctctttttacccacaccttgacctgacaaaactgaggaatagggaggttaagcaatttacccaggaccaaacagttatgggtgaatgaatcaggaagtagttcccaatgaattataaaataattattaagacccttggatatgttcaagttctgaaaggcactatggagagcacacacaaaaagattctagccagagcaattaggcaagagaaagaaataaagaccatctaaattggaaaggaggaagtaaaattgtccctgcttgcagacaacatggtcttatatataaaaacccctaaaagcttcgccaaaaatctctaagtatggataaattaattcagtaaaattgcaaggtacaaaattaacataaaaaatcagtgtttctgtaactcagtgacaaaccagtggaaaaagaaatcaagaaagcaatcccatttacggtagctataaaaataaaataaaatacttaggaataaatgtaacgaaggaggtaaaagtttgctacaaggaaaactgaaaacactgatgaaaaaaattgaaaagctcacaaaaaagtgcaagacatctcatgttcatgaattggaacaattaatattgtgaaaatgaccatacttaaagtgatctacagattcaatgcaattcctaccaaaataccaatgacattcttcacaaaaacagaaaaaaaaaatctttatgtggaaccacagaagaccccaaatagtcaaagcaatcctgagcaaaaagaacaaagctggaggcatcgtacgacctgacttcaaaatattaagctctggttacacaactatagtaaccaaaacagcatagtactgccataaaaacagacacatagaccaatggaacagaatagagaactcggaaataaatgcatgtatttacagccaactgattttcaacaaaggtaccaagaacattcggtggggaaaggacagtctcttcaataaatggtgctgggaaaactggataatccatatgcagaaaaatgatactagacccctatctctcaccatatgcaaaaatcaactcaaaatggattaaagactacaatgtaacctgaaactatgaaactactagaagaaagcattggggaaatgcttcaggacattggtctgaacaaagagttttggggtaagacctcaaaagcaaagacaacgaaagcaaaaatagacaaataggattacatgaagccaaaaaccttctgcacagcaaaggaaacaacagaagagacagtgaatagaatgggagaaaatatatgcaaactatttattcgacaaagcattaacaaccagaatatgtaaggaactcaatagtgcaaaaaaaaaaaaaaaaaaaaatccaaattaaaaatgggcaaatgatctgaatagcatttctcaaaagaagacatagaaataaccaacaggcatctgcaaaaagctcaacatcactaattatcagggaaatgcaaatcaaaatcacaatgagacatagcaccccagttagaatggctattatcaaaaagacaaaaaatagcaggtactgatgaagacgcagagaaaggggaacaccagtacactgctataggaatgtaaattagtgtagccgctatggaagacagtatggaagctcctcaaaaaactaaaaatagaactgcaggatgacccagcaatcccactactggatatatagcccaaagaaaggaaatcagaatatccaacagactattcacgatagccaagatatagaagtaacctaagtgtccatcagtggatgaatggataaggaaaatgtgatatatatatatatatatatatatatatatatatatatatgatggaatattattcaaccataaaaaagaatgaaacactgtcatctacaacaacatggataaaactgcaggtcactgtcttagaagtaagacaggcacagaaagacaaatattgcatgttctcactcatatatgggaactaaagaaaagtgatctcatggaggtagtgagtcgagtggtgcttgccaggggctgggaacagaaaggtgggggggaggttaaagaggtttgttaatggttacaaaatacagctagatagaaggaataaattctagtattcaatagcacaataggatgactgttaacaataatttattacatatatgatatatctataagagaagatttgaaatgttcccaacacaaagaagtaataaatgtctgaggtgataggtatcctagataccctgatttgattactacatactgtatgcatatatcaaaatatcatatgtaccctataaatagcacagttattctacgtcaataaaaaacataaaaaaaaattaaacctatcaataggtaactggttataaaaaataatgtgcatagacagtgaaataccatacagccactaaaaagctttaaaaagaggctcaataaaaatcagtcacctgcaggtggaaaggttttctttaaaaaaatttcctggccgggcgcggtggctcacgcctgtaatcctagcactttcagaggccgaggtgggtggatcacgaggtcaggagatcgagaccatcttggctaacacggtgaaaccccgtctctattaaaaataccaaaaattagctgggtatggtggcacgcgcctgtagtcccagccactcgggaggctgaggcaggagaatcgtttgaacctgggaggcggaggttgcagtgagccaagattgcactaccggactctagcctgggcaacagagtgagactctgtctcaaaaaaaaaaaaaaaaaaaaaaatacctttgctgcagagatatcagaacataagaaatgctaggccaggcgttggggctcaggcctgtaatcccagcactcagggggctgagacaggagcatctcttgaagctaggagtttgagaccagcctggtcaatgtagtgagaccctatctctaaaaaaaaaaaaaaaaaaaaaaaaattttgctgaatgtggtagcatgtacctgtagtccctttaggaggctgaggcaggaggattgcttgagttcaggagtttgaggttgcaatgagctgtgatgacaccactgcactccagccgaggtgacagagcaagaccctggctctaaaataaatagatagatacatagatagaagaaaagaaatgctaaagtttgtggttgatgtcacaagatcagcagtgagctctggaagagatggcacttctgtggaagaccttagagtacagcgtttctccaaatgccatccatgggtcacttgtctcaactacctgtgagatttatccaaaatcaagttaccgggcctcatcctagaattagcacctctaaatacgagaggtggagctctggaatctgcgtttgaactagacattttccccttccccccacacagttccaacagtaattctgacatattacaattatgagtatgccttctcaaaacatggatctgcttggataaaaaatgatgacagctttcccaacaggacaataacaaaggcaaagatctgggagaagcatggtttgatgggaggtgcattaaggagatgggatctaattagaatgcagaggctattttggagagcagtggggaggaaggccaaataaggatattaaagccaaaataggactgtacaaatcagaggagtttaaatttagtgaagaaatagagccacgtattaataagtcagaaagcctgatgaaaacattatttaagaaaaattgatttgtgaattaactcttattttacaaatttatcttaccagctttcaaatatattcttaatattttataaacatctttatttcttattttctcttgttggcttctggatctcttataggagaggaaaatattatgttcataaatgtcctcagagaatttgaaattttcctcaaaatggggtataaaactcaaagactatgtagtttgaaggctaaaagttaaaaagtagatttatcatactgcatatctcaaggtacacatctgattcttctgcctatgaccatcatacactgttggtgggtatataaattggtatgacctccacagaggacagtatgacaatatctatcaaaattttaaatgtatgttccctttgattcagctattctacatggacatgctcacacatctacatagggatttacgacagcacattgttactgctcagggtctgaattcttaaaatactggaaataacttagataacctatcactcagtaggtaactggttatataaaataaggtatagtatatagacaataaaatactatatagccattaaaaagactcttagattcatgtttcatgtgttgatatagaaaagtctctaagatacattttaagtaaaaaaaaaaaaaaaaaaaaaagcaagatgcaggctgggtgcggtggctcctgcctgtaatcccagaacttcgggaggccaagacaggtggatcccttgagctgaggaggtcaagaccagcctgggcaatatggcaaaaccttatctctactaaaaatacaaaaaattagccgggcatagtggtgcacgcctgtagtcccagctacccaggtggctgagatgggaggatcacctgagcctgggaggtcaaagctgcagtgagccctgattgtgccactacactccagcctgggcaacagagtgagaccctgcctcaaaaagagcaagatgcagagcagtaagtgtactttggtacaaggtgcatggtgtacgttgtcaaaaagttggaggtggaatataacagaatctcaggttagaggaagacagttgttttaccgtttattattttgtgttgtttaagctttgacaaaagctatcactgtcaaaatttatccacctttttaagtgatttaaaatgtttaatgtcattaaaagccttccagtaaggtattcccatgtagaaaatccaaaagatattatgtgcacgagtgtgcgtgagcaaagtaagtgcatcttaagaaagtatcagaattatgttctacttctcttaacttttaaagtgtgttctcacagtggtatttattttttcagtcattcagtaaatacttattgtgtatactatatgcttttttttttttgaataatagtttttattttttattttttgagagattatatgatttaatgcatataaagcattttaaacagtgcctgacatgtggtttggttgttgttgttgttgttgttgttgttgttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcagtgtttggttttttgttcttgcgatagtttactgagaatgatggtttccagtttcatccatgtccctacaaaggatatgaactcatcattttttatggctgcatagtattccatggtgtatatgtgccacattttcttaatccagtctatcattgttgtttattgcggcactattcacaatagcaaagacttggaaccaacccaaatgtccaacaatgatactatatgctttttattgaagtgaatttttaacttgagcttgagaatttccttagaacaatgagctttgaaaattggtaggaaccttgaagaccagtgtcctcattttaagcaaaagaaagctaaaatccaaatgaacatgtctgagatctcagcaccagttagtagcctagctgctaggagaaccagtcccagttcactccacaaaccaccctgaatgatgccaggagaacaaactcaccttgaatttgtccttctccttttcttcacctaaaataaagtcagttccgatcactttcagtagatttagtcctcaaatgactaactttggaaagatttaatggtatcagaaatgcattctttaatattaaacatttagaggaaaccaaaatatttctaaatttatgttttttcttttatttgtttgtttgtttgtttgtttttgagacagagtctcactctgtcgtccaaggctggagtgcagtggcacaatcttggcttgctgcaacatccgcctcccaagttcaagtgattcttgcacctcagcctcccgagtagctgggactacaggcacgtgccaccacaccttcctaatttttatatttttagtagagatgttgtttcactatgttggccagactggtctcaaactcctgactgccagtgatctgcccccctcagcctcccaaagtgctgggattacaggcatgagccactgcacctggcctgttttttcttttaaaaagtaacattttaatttgtatgccatgtagtgtcctcaagatttactctttgaatgttgtttgaattttttccttttgcctacagtattaataactcatagatatttttagttattaccgctgaaggaagcagcatattgaaatagctttgagggggcatatcttttcctaaaatgaggaaagaacctgtattatataaagaagaaaaaatgcatcctattgttgaacgataattttggattgtatttttcatccagcttttgatatggttaactcttatctaactaaattgtgagctcctcagacacaaggccacctgcttgttcggtccttcccatccctgagctgactcaatgtgatagacctgtaaggcacttcagacatctttcatcaactaattattttctcccaaatccttttaatactcagaaccaatgccatgttggaaaaaatgtagtcatagactggaggatatcacattgttttataataaaaaaaagagacagatggtactattgattttcaggattgagactagagcatgtggttaataatgccttattctacctacaaactagagggctgcttgcgttcccaaagagtggaattcagtacattttcaacctcattgctaacatattaaattatgctaaaaattaacagtaatacatttttcttggaaatttgagggaagcaaaggccatgcttggttaatacaaaactaaagaacccatatttgttcattgtagaccacttaatacagccctaactattcaagtttgcaacctgcctatatttgatttccctctttttttttttttttaaccctccccaaagctgcaagagaaatagtgtggttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagtgagccgccccccgggaagaatatgagtggctcctctagttcagacatgcagcaaactttctgtgaaactttgcagtcaggtgcagggtgcaaagcaaaatggtttcagagtgatcagctttacagatggctacagtttctagggagttcagggtatgagaggtagcgaatgggctgatgattattattgccacagaaagtttaaaagcccatttctctggtccaaacctataacttattgaagtgcaattcatctgtactgagtattaagaccactccaagtaattgagtttctgtagtctttaccatttgcaaacatttacacatagattatctcatttaacccttactcaatcctttagcatgcattatatgtcagtttgtataaaaatagaaatttagactcagagtgggtaaggtacacaaggtcatacaactcaataagtcatggggtcagggttacccatgttctcagattctgaactgttttttaaatatggtatcgtatggtaaatatggtatcgtataagcatcagttgaagctaagatctgcactaccatgcttacgtgtgttcatgaaagcatcacgcacaccctagtagtaagggtcgtttatttgaatgcctgttgttcgccaagggctttatgaactgggacctaatgactaaagtgaccctcccagattgacactagtctcaccttatggtatagaagttcagctagagatcaagaatagtagagtgggaattgaagtagtactcctcactccattctgccttaaattgaagaagcttcaaacaaccagctggaatctaatcctcagctcttctattccatctaaggaacgccacgaagctgttgtacggcgcacaatggaaaggagccagaagccaaaacagaagcataaccgttggtcgtggggaggctctctccatgggagccctagcatccacagtgcaggtaaacagtgaccactttgaaaattagtctttattttcctgaaagtaacagggtgtttccttctttcttctaaatctatgtttgcgaaacaaaaatcctgctgaaataattaaacaacaatgaaatgaatctttcactatttgaggataagagggtgatggagataagaagtaagggcctctttcccttaacacaggccaattttctcatgttacaaaattccttaaagggagaaatctatgtagtgtttctaaataaacatgctagcttcaacactacattattttagtcttctatttgcattagggtttcaggattatggaataagttaactagttttatctttttctctggaaggattatagttatattgactgaccagaatcaatactatgagcttatgtattctgaccctaaagtatatgcaacactaatgctctgtaagaaaatatataggtttattgagctagaaatagtaaatgactaagctatttcctcctttctgaatggacataaaatcatattgaaatttggatttactgaaaggctttatttttgtactgtaaattcaatacccctggaattttacatagtgtgtcagtttttatttttttatttgtgtgaatctgataaccttttttttttaaatttgctttgaaaaatcattgttttacattctgtctccaggtggttttgttgaatcatcattctcctctctggatttagcaggcctggaccaccacttcataacttttggtggtactagaaaagctggtacagacatccctgtgattgccaattgcctgacctgtagctagcacctcagacctagggccgatgcatcaatagctgaagcatcaccaccttagtcatcaacgcatgcctaataccctagcgcatagacgtagatctgggattggaacagtgtttcttaagtgtgataatatgactcaggtgacttaaaggtgttgaaataaagtaattacatgtggaatgtttgctttccctttaaacaatcattttggttttctatttatgttttttatttcttttttcaatgtcaggattaaacctttaaaaaatgttttttagctaaaaaaattacctgggatcaaagtacttccagtttagcttttttccccgtcaatcattactgctgttgccacttttagttttaagctaaataactgtggacctctttttgtttgcttattctgttctctttcattgttaacattctatagatctcttataactgctttattaaaattaaaaatctaggatcaggtgcagtacctcacgcctgtaatcctagtgctttgggaggccaaggcaggaggatcccttgaggccaggagttcaagaccagcctgggcaacatagaccccatctctacaaaaaattcttttaaaaaattagacaggcatggtggcatgttcctataatcccacctacttaggaggctgaggcaggaggatcacttgaggccaggaatttgaggatacagtgagctaagagtctgcctttgcactccagcctagaggacagagtgagaacctgattcagaaatgtaatttaaaaaattaaaaatttgtttaagtccaaggaatatcaccacaacttactttcttatgacagtgaaccaaatatgaaagcacttctgttttcttggttgttcatgacccagcagtagctggtgggatacatattaaatctgttatacagatcatttacatatgagattttgttgatgggatattttttatatacctttcatacagtaaacctggcagggtatatatttttataatcatatatttgttttacctgacttcctgctttacatgtatatggcagatatacactgttagatcatcagacatttttgaggagatggtaagctgcctagcttaattttttgcctccacactcaaagcttaatatatgacatttatttctgccactcagaacaagagaaaccagtgttgcattcgcaagctgttgggtaaaattcattttaatacgggttgtgaattataataaattgttcctatactggaacagagaagtttgccagaaaataaatgggatttgccaagttctcaaagaccagaaaatgatttgctatgatcttgagaacagcaaccaggtcttattcattttgaataccctttacttgacaacaatacctgatgtatgatgggtactctatcatggtttgctgaccaacaaacacatcatagaaactgtctacattaaaattcctgtcttggccagctgctggccatcgactagcactggtctgtaaaacttgatacgatcagcagggtgcggtggctcacacctgtaatcccagcactttgggaggctgaggcgggtggattacctgaggtcaggagttcgagaccagcctggtcaacatggagaaatcatatctctactaaaaatacaaaaactagccggctatggtggcacatgcctgtaatcccagctattcaggaggttgaggcaggagaattgcttgagcccaggagatggaggttgcagtgagctgagattgtgccactgcactccagcctggctggcagaatgagactctgtctcaaaaataaaacaaaaacttgatacattaaaaacttattcttttgtgtgttttgttcggtgagaaaaagaaatgaataacaactgtcttatatattaagtaataaacaaattcatggtgtgcctccataattttaacaatttatggcagatttagatgctttactactaatgatactttttaggatacaaggatccactgtaactcattttttccacttactctgaagcagaattaaatgtttttaataacctgttgagaatctgcctgaggataggcctgcgtgtggacacaattttcccccaactaaagcataacatataaagcaatatcagaaaatgtactgctataaaatcacctggaaatgactttcgtattcctcttcctaccctgtacctcacatgtcatcactaggatgttccttttgatgtttgaccctaaatcctttctttatgtttggattgccctaagagtccatcagctaagtataaatttgaggcacagaagtggttttttttttaataataaaattgcttcagccattaaaatgaatcccagctgaagatagaaatgactgatgttaatcaaagacttgcttattaccagtgtgctataaatagtagtcaaaaatacacagggaaaagtttgcagcaattttttcttactgccaaggttagaccaacgggtactgagttttggaagcatctcccacaaggagtatttttgttttagttttagaagcaggtaacaacagaaaaataaaacaaaatacagcaaaaacccctttcactttggctactgtagatcagaacatccacctgcctcctggataaattaggaataagactttttagactttcattacatgcagtgttatttgaggaacaccgtttatcctaatgagcatgattataacctgggtctactataccaacagcaggctgctaattcttgccttttgtatgcttatttcccttctgatttgaacttaagaattctaaaattatgccaggcacagtggctcatgcctgtaatcccaacactttgggaagtcaaggtggagtatcacttgaggccaggaatttgagaccagcctgggcaacgtaatgagaaccccacctctacaaaaaaattaaaatattagctgggcgtagtgatgcctgcctagagtcttagctacttgggaggctgaggtgggaggatcacttgagcccaggagatcgaggctgcagtgagctatgatcatgccagcctggccaacagagcaataccctgtctccccaaaaaaaaaaaaaagaaattttaaaattacttgactataggatgaacaatgctattgttcatgaatgtgtgtgctaattctacatttgtagccacactaactcataagcacagagctgtggctcttagatttttaataaaggaacgtttcttaaaaatcctttccacacttagaatgtttcttttactttttctttttttttatttaaacaacaacaacaacaacgagccttcttctataatgaactttaatgccctgggtaaaatgactctgtaagcaaagttatcagcaattacacagaacctggtgttctttttatcccagtgtttgcgttctatgttaccagcatgttaccactccattgttccttcttttggagatttcaaaggcattcgcttttatggtcctcttttgcttcatagtgtgcctccactattttagaagcccttcactggccttccttttgtcttcatccacttgtatccttgaatttccatggctgacaagctggtgaaataaatatttattttatcctttaagagaaatgaattttatttctaagcctttaagttacctttaaaatgtccacttagaaaactgtgttattatgacagatctagaaatagagcagaaagcatccaatcctagtttttccttccatcagtgaactaggaaattgcaatcctacatgttggctgtcaattagcattatctccatttgttttagatccagacaggcggtcagtttccaccatgaatctttcgaaatatgttgatcccgtcattagcaagcggctctcctcttcatctgcaactttactaaattctccagatagaggtacagtccaaaggaaaacaaaaaagtgtctgttatttacttaatgcttttttttctggatgtttacagataaaaataagcatctgaagttgctttccctacgtttcttaaataggaagaaaaaaacttcagagtaaaaaagcaataaacggctgagcagcattttccttgcgacaagaacatttctcattttagaacttggctgagtgattgcatttagcagtgacgaaagcggtgcttctctcaactttttagtaaatgagtttacagctccagaaatcacccacttatccaccaaaatgcaaataatctttgttatgaacatttcttttacttcaatcatactgtctttggcttttcatctatctgtactttgggaattccaggctctgactttctttaaaaactttttaaatgattcagattggtagattttattttgccaatttacttctcatttaaccaaattatttcttactgcatttcttatgtgtgctgttggttttttggtgtccattcattaactcttgagggatctggcctaacttcaagaaatcatcataattacagcctcctgaaacatttaatattcatagtcctttattaacatcttgtttgaattttgagttttattcatcccatggatttacagtacatgaatgttgagttatttataaagcaaaagttttgttttacatagatcatagaatgaaaaaaatcaagcttttaagataagctgcttgtttttacataactaagatgattttaaataaaaccaaagaattgttgtgcaatatgaagcccatactctttaaaagtaaaaaattgtggttactttgagtgctttattaagaaactgattgggaaagtttcagtgtttataatctttaaaaaatgtaatgtgtgcatgttctgtatgtgtgtatgtatatttatatattttgtattgtataaaagttatggtgtcattgtaatgtacaatattctgtgactgttggtgttattttataactaatctcttaaaatagtaaatgtttgaacaactttccattcttgtcttttagccaaaactctttccttttgtttttttaacctaatttgcctaaaccatcaatattagacttgtagtcaaattaggggcctttcataaatattgtgaatttaaatttctttcatattctttattttcaaacctattccctaaatataagacaaaatatagcatgtgaatgttactcttacagttgtctattcatcttttctttgcagttggtcacttagcactttagtttcatacttttgtgaacctggatctgagacaaactacaattagtattttacacttctttaaaactttattatcttctacaatcccatagctgaaattagggtaagggtgggagtagggagctagacaacaaacttggcaatatcctgtccatgctgtggaatgacattgaattgtctgtatcaattagaaagatgtattctagactctctgcacgatagaccttcttaaggcagtagaatcttggaactgaaaaagatctactggatagatcacctactctagttggggtgatagagtccctaagaggttgcgagcctctctttaatgtcctacaggctaattattgcagaagggtgactcctcacccgtgtgaccgccacactgcatcctcagttctcaccttcatgggtgtcctttcttagattgactctgactccatgcattctctctctctctctctgtgtgtgtgtgtgtgtgtgtgtgtgtgtgtgtgtgtgtgtgtaaggttagaagtggtaaggagtagagaattaggacataggacatcagcgttaagggaagttcaataaccagttcatagagggggccagaaaactgccctatgaatcatggtagaggcccagaaaatagaatactaagcagaaataataggacaagagggagaacgctagatttgagagttctgcttctctgcctccttaccaaagaactgtcaatcagttcctggtctagcaggccaggtcagcctgaaggggctcccatatattgtctaggaaggaatttttttctttttaacttaagcaaagccctcagtagaaccctgaaaggcttaggccttttattatagtgagaattttaaaacttcttctgaatttaaatttctctaatttagaaatttaaggccaggcacagtggctcacacctgtatttccagcactttgggaggccaaagtgggtgaatcatttgagccccaggaatttgagaccagcctgggcaccatcgcgaaaccccatctctactaaaaatacaaaaattagccaagcgtgatggtgtgcacctgtagtcctagttactcgggggctgaggcagggggatcacctaagccttgggaggtcaagactgtggtgagctatgattgtaccactgtactccagcctgggcaatagagtgagatcgtatctcaaaaagaaaataattaaaaataaataaaagaaatttaagtaattccattagttctttcctgctatttttaaaagttagttatactttattatctcattagaaagcattcttaccagattgttaaattagaggaccttatagacaaatgggtcaagcaggtatatacatcattattagattgtttgagctttctcagtcctaaggcataggccttaaagctgagattaaattgaggctccgataccatcagggctcatgttctgctgtaatatatccaaagagctctactagttattaaaaatactgaaatatttccatatcacttttccaagatgtgcttccccgggccctccaaagccaagggaagccagtcattagtgtagtgtctgtgccttgtcagtttttaaatattttaattattacacctgaatatggtgttacatggactgataagattactttggttaaaagaaacctctgattatgaaaggtttctgtaattgctggaacagaatgttgccactggaaatttttacattaaaagtatatattattatctttaagctatctgcttaaccaactttttctcaagaaagaatattaggaagttggaaaagagtaagaaaaattgcctactttttgcttaaaatccatcaatacattttttccccagaatcttcatcataggactcagaggtagacctcgaaataaattctgctcacaggcttgttctgttttacctgagcagtgttgtttgttcttgttttaattagaattaattgccaacacttaaaatatagaatacttcatgtaacatttcagttttctacttctaaagaaaaaatcaggacctggcaacatgtgtctaatttcttcctggcacctattacctgaaatggaatagtgatgtcacgcttatgggaggaagtggtaaggcaggtatccataaagtttgtttagccccgatcatttatttatgttaacttgcatggcccccagaggcctttgagtttgcctctcttcatctgggtggcctataatggaaattgtcaatatctcaattttaagtgcttaaataggatcgatgccatagcgttgttccatgagagttaatatctctcccttcggtttggtaatcttaaaatcaggcccctctaggggaaaaaaacaaactaacaaaacaaaaaacaacaacaacaacaatgcaccaattctcctttattaacctttactaaaaagttatcttacggacgctctgtctccatcttggtcaaggcatagttatgaatgtggtggaagtggaaacatgtttctcctagcaatatgtttagttcagagtatcaggagatatgaaacagatctctctggatttgctttaccacaggttacaatgggtttttaatcatttgagataaattttttggtcgatgccttcagactcatggaaataaagtaactgaacttcttaatggagaaaggagacttatcttttccatgacaacccatctctgcagttgtaagccacagtcatcgtacagtttttctaagaaaaggaagagtttaactttcttccctttctcatctcttgaaaatagttctgtggaagattttcagttagtcctaatcaccttttccccactgattttaccctgtacatgtattctaattttagattgtattctattctgttgttacactgctgcacatagcttatgatagtacttagcccgtggtgctttctaattgtaactattgcagtagtttttataacatctttttaattaatcttaatgtcagataatatttaatttaaccatgaagactcttctagtaaacagactctaacaaacaattcactaattcttaaattcaccagagcctgatcaaaatatttactcttttaaattagtcacatagttaaggtacttattggaaattgatacttcattccaaatggaagcaactatttttaagacaatgtttagcagtatatggcttttattaattaaaactaatttcctagcatttaaatgccattcacttaaaatatgatatatttaagatagttatatagaacactgctccagaggcaaaggagactttgccacctgctgtttgtggagtggaacagaagcagccttttcaggtgtagacagttttaaagacttttaatccagtcacagtggcatgcacctgtaaacccagctacttgggaggctgaggaaggattgcttgagcccaggagttcaaaatcagcctgagcaacatggcaagatccctgtcttaaacaaaaacacaaacaaaacttttaaaagtgacaggaatgtgttctaaaacaaagatatgtaatcacttcagtgatatttgtagaattttgcaagctttactgatatttttggaaaatagcttctatcttttcatgagccatcactggaaactaaccatataagcaaagtaattaatttataattggcatacatgtcctgactatggccttgctaagctccaatataatttgggaccatacatcattgcgttattttaaatttgttttctagacttcttaggcatccactagcaatctctaggattatgtttatattggattttggcttttctgtttaattttatcttgcttcagccttagccttgtccttggccaaattttttatattgttgccaaaaagggacctgaaagaacttggcttgccaagtgaaaaggtcaaaaggattcccatacagaactttgcacgaatcttctttcattttattatatctaattcccacacacatactcccattgcccaagtagcaattcatggagatctagcataatttattgggtcccctttctgtcttttatttaactcgtctttcattaacctgccagtgcctctattggggtttattattcaaggtacttaggaagccttttgactaaggtatgtgccatcagtctactgcccatcccaatgcccatcagacagtaccactctggagttatagatatacaccaaaacaatagctgaaatggtattttttgtttattgctagttgactagtaaaagagggtggttagcaaaatttgcatctgtaaaactaatttagagcttgctacaaacttaacatcttgaagaaaagcaacctggtggaataactgctccctctggacaggggtcctgttgccctgactcttggccaaccatcctccctgcagagcctggtcctgtgaaggcccagcgtatggaagcaataggtacgatgtattatgccctcttgactctgaaaagaatgcttctaacatcttgcttatgtggtgacgtttagctcgccgcctgcagctcagcccatgggagagcagcgttgttaacagactcctgacgcccacacattcgttcctggccagaagtaaaagcacagctgccttgtctggagaagcaggtaaaactgtccaggtggaactttccccatgaggtcaagtcctccctttgaagcatattcgtctaatcacatctcactttttcctaaaatgcgcttctctcttcccccggtggaaatgtctgtcggtgttggtttcatacccctgtcattgtttcctctgggcatctgccttagcatcttatctggacaccagacgccaggcaggctgatgaagcctctccccgggctccgatggcttcagaggcttctgtctgttcataacattacccgaagaaagtattccttccctgcctttccttctgcctctgtctctgagcagataatccaaggtagaaataatttaacatttaatgctaatatatggacttgggaataaaatcaaagcgcaagtctgttatttcagcatatagtttcataatgtggctgtggcatagctactacttctccctgtgccattcttttatatgtaatctaggaattgtacccttccagaactctcagagttgtggagtaggctaattgtaatatgcttatttgttacattctttgaaattatatgaaacatgcttagtaccagttatgatgattggttataactcctacttttttgaaatgcaaaacatacctgaattagccagttaatttaatgagaagttagtgtggagcctacatctagtcggtaagcctacatctagtcggtaagcctacatccagttggtaagaaaggctttgggtaacggatctctcctggtgagttgatttaggttttcccaaatatctttggggacaattggtgtatttatataaacagtctactagccctcatctttggcactttaaaagtgctttgcccttgcaagcctctccatgttcattagcctgcttttaagtaataattgttggtggttttatggtgtctttcatctgcagtgcccaatgagcgaataaatctcagtcctaaatctcatagtacccctgggagacagtcacgaaggcaagcgtgggcattcccacaaccttcttatgaaaaccaagtgcagcgacaataagtgacttacaccaaagccacttagaaaatgggcagacaggatcataaatgtgctttcccctccatcctcaatgccctgaatgatgctttatgtgcaaatgtgcagtcaactagctgaaccacagtgttctgtgttctctgtaaagtcacactcctgtcagagccatcacattgcatctgaggttttcctggaggaggagaaagtacagcttatttcaatattttttcttatgcctatgaatttcacacttttctacaagtcatgagtttttctttagctaattgaaaagcttttaaaccacttttcaggccgggcgtggtggctcacgcctgtaatcccagcactttgggaggccgaggtgggcagatcgttgaggtcaggaaatcgagaccatcctggctaacacggtgaaaccccgtctctactaaaaatacaaaaaattagccgggcgtggtggcgggcgcctgtagtcccagctactgtggaggctgaggcaggagaatggcatgaacctgggaggcggagcttgcagtgagctgagatcacaccactgcactccagcctgggggatagagcgagactccgtctcaaaaaaaaaaaaccgcttttcagtcctattttctagcatttagctggtttatggctgtcatgcttctgaatctccccttgtatgctgtgttgtgctaaaggactgcctcacagctgggaaattgtctttactatttttgtcatcactaactcttgtcacttctttcactctccctctagtcttttccaatactgtttcctcattttccacccattctacttgcccatcttctccccttctttgttgttatgctcaaccaaggtgcttttttatctgcaaaccggctctttattttgacacatttccattctccttttcacaagttgatatgtttctgtaatttattttagtgtgaaagagtgcatagcctttacttgagctgcctgttttgtcaatacattgcctgcttcattgtcaccagtttcatcgatacagcttatgtttaatgaaccaaaattcctggggttttttaaaattttcatttagaagtatatatgcaaacatctcttccgattatcttgtcaaaaccacattttccatcatttttatttttcatctattgtccttgattattctttcatgttttcccattttagtgttgtccctcaacctcatcatattcctaattgccattggcaagaaggtaacctataatatgtcctgtactgggttacatcagcagattaaacagctacttttagccctgggatatagagtgattgcaaactccctgcacaaacaatacagtagttgagaactggaactcccagtctcacacctctcatttgcagccactgctttgggttgacttttctatactttttttccccgggacattcaaaatacaagtgattattagagctcaggattaaataatgtatatgcaatgcttagactagtacctgcacatagtaggccctcagtaaatgctagtaccgtattaccatattatgccatttttctttttgctatgctacatttcaactacttgacctgcattatcttttctctgcacccattatttcgtatagaaaatcctgaacgagttcaattaatgcatacttaccaccaagagtaggatcaaatacatatattgtgggagactttcttaaagacattttcgtgagacagtgttcatgtttaattaactatttgggatatgaagtgtactctgggaaaaaataactatatattgttattatttcttaagaagggcaagattattcaaataattgatttgaagatttcaggtttttcagtacttgctattcagtgcagcaatgaattccatgaaatctaatatccttacaagaaacttaggtttattttagccaaaagatgttctttggactaaatttgaggatgtttttctatggactatactagctaggtttaaggatattttcaacccatatttagtatcatgtcaacattaaaataaagaataaaccagaggcctggtgatattggcttacatccatgatagcttcaggaaatgctccatagatacttcatgaaattgttattttccacttgagagaaaaatcatatttctgtacttcattcctttttcagtgtcagacccatggcctccaagcagagctgttttctagggtttcttgatccttgagcaaggtgaatggcctccggctgtgccctgagcagtgcgtgcctctgcccccggttattaatccccagaagtgccttgtgccaggatgttatttcttaaatgcatttgattggcttggaagaattttgcattagtgaactcttgtctagaaaatgcaaatgccttgttgtggcgcttgagaaaagattattttcaaagagtttttcctgtgatcccaggcaaaatgacaaagagattcccttccttcacaatacaaatccttccttctccattaaggttggaagtaaagctttatgtcagtttccaattaagacgtacatatattattttaaggaaaactgaagaaatgaaaaagtgttttagtttgtcctgaagaaacagaattctgttttcaaatgatgggaaaagagaccggtttccaatctattcactgtcaaggctgcagtgagccgagatgagatcgtgccactgcacctcagcctgggcaacagagtgagatcctgtctcaaagcagaacaaaaccatgcagtgatagccagaagatactgccaggcatttaatgaaagagtgcattaataaagatgcaatctgattgactttctgtctgtaaattaaacccaaatagcaaatcttttttcaactctataatcctgaagttaagatcaccccaagtttgtcttgtgaacttttgagttaagttattaatcctcttacattcagctggcatagtggtttctttaaagggttgctacaaagactacagttgagaagtccttttataaccatgtccaaatacatagtattctctatacttgtgtttaattgtcttatttttgctaggaaataaaatttctgaatgagatctgaaaatggaccttagaacctgaatactcacacttttgatacctatgcagtgttatatgaatttccttaaacccactgttgtttgcaataagttgattcatgacagtgttccttggaaggtaatggtcagaagctatgtagtttttcataaaatattccatcttgagtaaaactgtaaaggttcttcacggttcaaccttacatttggcagatctaacatatttctgttctattcaacattttaaatagatatagctaatctccccatatgctctaatgctgcttcttatgaactatcaaatgccttggcttttgggaaaacccggaagcatgcatttggtttgcctataaataaataagacatgtacagaatattttcctggaaaagtattacttatcctcgtgacaagtcttaacacctggtaagacttgttcacttaacattttttaagtttggttgcttttttcccctgctggctgttgaatttgaatcctgaaacagttgtagtatatcttgcttgcctgcttgcacgcttcctctctttccaccttttgttccatcttaaagctaatttaggaaaagtctggttataaactagtctttatataaaaattatcttttatcactaatgtagttttttttccagaaccatcagctaataggaatataagaccattgctctccataattactggattacttctacatctttcattagtatttaaagagccaaagagctaacaatatattccagattttttacgtggacatgccttccttttggactcatcataaattcataggactgtaaggacagttgagtatgatggttctgggcacctttaggtaataacatcttcttcctacttttctctctatctctgctttgctccttttcctgaacctgcttttggctttcttcaactgctcctctggcactcttgtgtgtaaaaccaatcacctgcaccctagttatccccatttgtcctcgttcagcatcttgcagccccatcatcatgccctacaaagctgcacactctagaaattcgatggatcgaccaaaactctttgtaacaccacctgagggctcttctcgcaggaggatcattcatggcacagcggtgagtagctgttgggagcagctgggcaagtctgggagccagtgctgttcctgtgcagactgtacatgaccctgagctgtggtgtgggcgtaagagggggagaccgtgacatccaccatcccatctttcccattgatcatgaatctggctagctgggcagtagtgtcccctcacttcctcttcacttggggattttgctctccctaaacatttgaatttgaagatgaaagctgttctttgttcaagcatgtatgagtggacgccctaccctcctggagcgtccatacacataagtacaatgccagaatactttcatttttgaaagtaggaaaaccaaatggcctttgaaggggaagtgggcttggactgctgccttggcattttatttcaaccatatccagaagctggctgaactctaaatgtggttcactcaaaagcaagataaagaatttttatcctgcttggctaatccctgtcaaggccctgtcaagggatcttaaaatttagtcaaaaaagtattttgaaaacattagtcatttgctatatcactaattcgtaaaaggctgttaggctgtgctataaattctgattttgtaagtgaaaaatataatttgtacttattattacgggctgaggtaatgttaattttcaccatgctataaatgcaatgaggtaatttgtatgtctccaggaatcttcttctttgttttaaatcttgtgtttatttggtgtcagttgaaagatataaaccttgttctgtggtctttagacattgtactttagtcttaaaggactcaccagtgaactagaagatctcattgcctctctccaggataacagtatgacccttttgatgaaaggctgaaacagtttcttaaaatcgtaacttcccagagcaattcagatttataaacctgatggacacttaaaaggattttgcttaaaggataattcagggttgtgagagcttgatggctttgcctacagcctgtttttctttcaagctccatcggcctttctggaatcagtgtttgattcatgattgagtcaggcctccaaccctctaagccacaggtgaaacaatctttgatgtctggaaagttttaatttattagagtgttggtgtttcagagatcctccttagctgtagacagaaagccgtagttaaacagaacaggttggccccaaagttgggtactcactgggcaggggaaaagagcatttaccatggaaaaactatcttgttctgggtaaaaacaaaaattaacactccttgagagaaggttgagggccacctgtggctgacaggttaaatgagagatttgtcatcacatgatccagagccttgttttgttttgtttttattaccttcctctttctctatttaatcacatagctgtctttttacctctttacaaccaagtatttaggcaaatactaacagaaaacgactcagagtcatttataccctggagctgcactgtggaattcagtagtgactggccacagtgagcacttggaaagtggctactgaaactgacaagctaaattttaagtttttaaaaaatatttagttgtgttaaaaaaaaaaaaaagcatgtaacgtaaaatttaccattttaatcattctaaagttcagcagtgttaagtatattcatattgaagtgcaaccaatgtccagaactttttaagtcctgcaaaactcaaactctatacccattaaacaactccccatttccccctccccccaggccctggcagccactgttttaatttctgttcctatgaatttagctactttatagaccacataaaagtgaaatcatgcagtgtttgaatttttgtgcctggcttatttcacttagcataatgtcctcaaggttcattcttattatagcatatgtcagaatttccttcctttttagggctgaattatattccattatatttgtataccacattttgtttatcagttcatgtgttggtgaacatttgggttgctttcacctcgtggctattgtgaataacgctgctatgaacatgggaatatagatatctctagagattgttctttcaatttcacttgatatatagggattgctggatcatatagtaatcctattttcaattttttgaggagcctccatgccattttccacagcagctgtaccattttacattcccactaacagtgcacaaagatttctgtatctccacattctcgccaacaatcgtgatcttgttttttgataacagccaccttaaggaatgtgaggtgatgtcttgtagttttggtttgcatttctttaatgatcagtgatggtgaacatattttcatatgcttgttggcttttcatgtgtcatcgttagaaaaatggcaattccagtctttgctcactttttaatggggttattttgtttttgttgaattgtagagttatttatatattctagtagtaaccccttattaaatatatgacttacagatactttcttctattccataggttgcctttttactctactgattgtttcctttgatatatagaagtgtttaagtttgatgttgtcccatttgtttattgttaatttattgacactttattgcctacgcttttagtgttatatccaagaaatcagtaccaaacacagtgtcatgaagcttttcacttatgttttcttctagaggttttatagtgttaagtcttacatttaagtctttaatccattttgagttaacttttgtatattttagaaggtaagagtccaacttcattcttttgcatttggatatccagttttccctgcatcatttgttgaagagaatgtccttgtttcattgagtggtgttagcttttgaccatatacacaagggtttgtttctgggctctggattctattccattggtctatatatcttttttttttttgagacagtctcactctgtcacccatgctggagtacaatggcacaatctcagctcactgcaacctctgcctcccaggctcaagcaattctcatgtccagccttctgagtagctgggaatacaggcatgtgctaccacgcccatctaatttttgtatttttagtagagagagggtttcgccatgtaggccaggctggtcttgaactcctgacctcaagcgatccacccatctcggcctccccaaatgctgggattgcagacatgagtcgtagtgcccagccccatatatctatatctgtcttgataccattaccacacagtactgatcactgtagcttttcaccaattgagtatctctaattcaaaaatacagaatgctccaaaatgtgaaactttttgaataccaacatgacactcaaaggagatgctcattggagcatttcacatttccagttatatggattaaggctgctaaagcagtaagtgttaatgcaagtattccagaatctgaaatctgcacactgtaatcccaatcattttggataagggatactcaacctgtaatatgttgtgaaatcaggaaatgtaagaattccaactttgttctttttcaagattattttggttcttcaggatcctttgaaattttctgtgaattttgggttgaatttttatatttctgcaaaaataaaaaattatattgggatttcaatagggaatgcatggaatctgtggatcccttttggtagtagtgacatcctaacagtattaaatcttctaatccctgcacacaggacttccttccatttatttgtgttgcctttaatttctttcagcactatcttctagttttcagtatgcagatctttagcctcctttgttaagttcattcctaagtactttattcctttggatgctataggaaatagagttgtttttcaaatttccttttctattttacttaatttgaattaatttagatttaaattcaaataggcaaatgtggttagtggctaaatttagaacatcttcatcatatcagaaagttctattaaacagcactgcgttaaagtatctgtcagtgaatcgtctctgttggaggatatttatactgtattctaaacctaccttaattataaaattaaagtccttttcctgctgatatgttgcccagaccattgacttgctgagtatgtgttccccctcagcattgtggaaactattaataggaaagatgattgtatagatggtgggctattaactcagatcaggatgagaattgggagtgcctttacatgtgtggtacccaaatgggtggttggatataagagtaacaaaaggactgaaaggtttaaaaaagaaagaaaaaaaaaaactccctggttgggagggtgttaagtatcgagtgtttttccaaaccattcctcctctgctcacctacccctaggtgattaaaggagataacttttaaaaaagaaagaattggctcaaaggtactgtaattctaggattatatacctttatataggttcattccctgatccctgtattatcaaggcacagataataataatccccaaccacccccacgccacatcaaaaattgtccctcttgagtctttttcccatttacatcacccattgatctgatttcagccaaatcaaaatgttttgagaaaaagaaaaaaaaagaagggctacttgaggtacttaaccccagtctcccctgggaaaagacctgggcatgccaccctgtacaccagccaggagtgccccatatggtggctgcagcttttgatacccaaagcccacagcagctctgtgaggccccacctcctacttttggggacctaaaatgggagaaatggtggttgagcagctggaaatgatgcagagctggcacacaccttgtgaagctcttctctgcctctttcttcattttttctgtttagaaatcccagggagacaatgagcattatttgacacttaaatgtttttgctcctctgataacccagaccatcaactaggatgctgctaaggaaaatggagggaagcaattaaaagggacactgaggggaacaaaagggaaaggaaggaaaagaggagtcgatgcttgagccaggcagaaaaggagagaagaaaaggtacagtactagttcatgtgacctggggctagataatactctgccccttcccatgtacgcttgcagtctgccctcctgacaggtgttcacataggtgcctccagcacgtgcccctcccacctgagggcattgtcaggtttcagatacttggaatgggtctgttttgctctgtacaatttttgtttgtttgttttggtcttcattgactttagagtagtggaacacttctctgggcttccctttgcccattttgacttaggaaagtgtcatctctcaagctgaattcctagttggcaatcagggaggggtgatgttttggcccaccttcagatttcagtttattcctggtaaggaagagcaaaaaaataaatagctgaaattcctcactttaaacctgacttttcttcaaaatcacctattgtatcagttatctattgctgcaagaggacagtaggtgaagaaggacttgattccattatacaacatcaatataaaagaaaaaaatgagtttatgtctaatatagcaggcatataatttttttaaagactgagatatagtgtgtttggggggaaaatgttgaagaattaaaaagaaaaagatgtgttttaattaaaattttttaaaaaatgaaagtaacatttgacatttgtgggggataaaccagaatgggacgttttgcttcaggtaattaattttagacacaaagtataggtgctttctaaaagtatgtacacacatatgctttttgacaaatatgactccaacacatccggaatcaccttattagtgtcacattgtgttaattcagttatactgttcagtgttaagctaacaagggccttttgttgagatggaatgggtatatgtgacatagctaagaaaatttcttaaaagtcattcaatggtttctagctccactgttgagtattgtgagtgtgtttgcctcgcttgtggaaaaatctaactattgagtttctctgaacttagagctataaaaaagaaagagagagagaaaatgtactcttcctcacatctggcacccgaagggctgtatctccatctaatcccaaagcaagacaaccagctcgctcccgactttggtaagtgaaatataagtggctggctgggttgtttcatgttagagaattagtagctctctcctctgaaagtgaactgttcttctcatgctgtttggctttgacttagggaatagcattcttcccaaaaggaaagaaaaaagagaaattggaatggttccctaaagcaactctatttctgtatctaccacataaaaaacaaatacacggagctaaatatctgcattctcttccatcgagtcgtgttctaggttctggcaagcctgttctcatgtgtccccttttgtctgccttgtttgtttgtggcccaggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctggtaagagcaaactcacctgtggtctgggtgctctctctttttctcccgcactgttttgatgaagctttttttgttttccttttcttcttttattggagacttggaaattttactctaaggttaagtttaatacctttccttaagtataatattttaacttcgcattgcttaaaaatagttttttacttagcaacgctaagtaaaaaattacctggcaacactattcctgtgcatactggagtttaaggacccctggcgtagcctgtgtgcttgatagaagtcagaattttttccagaagacccactggttttcacctctgccagggtaaccagatgctacttagaaatgtaaaaccacctggagcttgaagttcaatatctctagttgaaaactgtcttcattccaaagttttctacttaagacttaatttgaagatagagggtggggcaagaaagaggagatgattcaagacaggtgaaaatggtagagaaaggaggagtccagtgtttgcttccatggaaaaagaaagaaaggaaaggagggtcatagaacatcataatagccatgaaaaaaatctgtggaagcagaagtagaaatgtaaatctcaaatcatacatccaaaagcctattgatagagccacaaacacgtgaattcaggtgtaggttctcagtgcttttattggctgagtccatttcacaaaatgtgttcagagcacctgcatcaaaatcacctgttgtattcattatctattgctgcataatgaattagcagcatgaaacaacaacaaacatttatcatatcacatggattcttgggtcaggaatttggcagcagcacagctgggtggtccctgctcaggaccgctcatgagattgcagtcaagctgtccactagagctccagtcatctcaagactcaaccagatctgaaaggtggcttacatacaaggccgggggcgggtggcctcagcttctccacacatggaccgctccatattattgctgaatgtcctcatctatctgcttgctctgctggcttctgccagagtgagtgacctggaagagagaatgaggaggaatgtacaatgtattttatgacccagtctcagaagtcgcacaccaatgtttctgccacattctgttaagtagaagcaagtcactaggtggaactcacactcaaggagaaacatagtctccaacttttgaagagagagttttcaaagaattttttttaagagttcagctttttattgaacttgttacaaaagaggtttagtcaaaaagaccaaagcccatatcctccttggactcctcagactctcttttctttgcttctatttcttctcctcagctggaacagcattggtggagggggcaggaccttctgctggtgcaggtccacgagctcctccattgcagatgaggctccccatgtcaacattggccaaggcttttgcaaacaagccagtccaaaaaggttcaacatttacaccagctgctttaatgagggcattgatcttatcctccttgacggtcacctcaccctcatgcagaatgagggccgagccttatgcagaatgcaggcgagctcagaaacagaggccatggtgtgagcaagtgtggggctggcactgccaggcaaggtgctagttgccagatgaagtgagggttccacttcaatgtggccctacattcctcagagggaccgagtgcagcttggcagcagctgaggaaaactggaaatatttttaaaccaccacatctataatgttttgacatacagacccttggtttttacctcagacttactaagtcagaatatgtagtggtggatatgaggactctgaaagatactaagcttgtcagttgattcctaaacatggttgccagatagaacacagggtggccagttaaatctggcaatgctattcctgtgcatactggagtttaaggacccctggtatagcctgtgtgcttgatagaagtcagaatttttttccagaaggcccactggttctcacctctgccaggctagccagatgctatttagaaatttaaaaccacctggagctgtgaattcaatatttctagttgagaattgtcttcattcaaaagacttaatttgaagatagagggtggggcaaagaaagaagagatgattcaaaacaggttaaaatgttagaaaaaggaggagtccagtatttgtttccatggaaaaaggaaggaaagaagggctagagcatcatgatggccgagaaaagtctgtggaagcagaagtagaaatgtgactctcaaaaggaggggctggagcagccaggggccagagcttgcacttgctggtgccttgctcactgtggtgcagaattgtgagcatcagtgtggggcttctggggcaccagctctctaggtcatcttcctaaatccgagtaaggccagagaacttctgctcccatcttgcatcttggcagcttgggatatataagcagaatgagcaccagctcccaaagaggccccgagctcctcccatctcagacctagagacagctctggggagacaaaagggtcctcttcatagggtatcatcttcccaggctgaatctggactcatggcatggatgctgaggatgctgctctagtaatgaatggttaccgaagagtaggaattttcaaatgcaataaaagacaaatggatgatctcatcttctttttgctcagtgtataactccccacagactctaacatgaggctttgtacacattcaatatatgttaactgatttaactggtataaaaataagacttggtgacagagtgtcagctttgttggatgtcttacttacacatactgattttttttatctgttgcttggttacagatagaacatagtgaaaccgtgagaacacacagtaataaacattcccttttctttcataatggtaaattctaggccttggatgtggggaatgctagttttggttttgttctttggattttgtttccaactggttttctccttgtacctatttgtgcagctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaaggtaaatgggagacattgctccacaccatggtgtcagtgatactttggattaactcatcacccctctgagagggaggaggtgataatactgatgaaagtgaatggattagttctttcaggattactcttacctaattttcctatgactactaagcagtttgttttttaaatcacatcttcttcttttttttaaatagaaatggggtctcactatattgcccaggctggtctcaaactcttgggctcaagggatcctcccacctgaacctcccaaagtgttgagattgcagacatgagccaccatgcccagccatgttttcttattttaatgacagtgcaacaacattgatggagaaagctttaaagaaaaaaaaaatccataatcataccaattttcagtaatagtgtacattttgggtggtcctttctagtctctcaacagtatgggagtgtgtgtgtatatatacatacatatacatatttacataattataaccacagcagaggtacaattgtacagtctgcttttttacttaacacatctccaatctccaggtttccgttttatctttgtaattatcacattaaggctgcataataagggttcatgttttctcctttccagataaaactcctctcggagggtagccaggtgggatctttacatgccccatgattgcctgccaggcagtattccagaaacagtttgtttaattggtcatcttctgggcctaataagacgaatgtcaatataattgttcttcaaacgaacacaactgtaccctggggaaggatctcatgcactcgctggaccgccatcttggccatgcctttcccttggctccaacagggagcttacatggctgtcttcctcctgtcctgtgacagaacactgtgacccttatttatttacaaagattccctttggctggggtgcttcaaattcattactaagaagtcacattatttgaattaaacaagtcagagcctttaaaaaatagttaaattccttccaaaaagccagctctccccaagatattggtggttacacgttgcttctatttagcacggacagcaatgcagctggcaaggcgggaggaagtctaagggtggcttcgcgctttgtcccttagcagtggtgaaggcatccagtggggatttttctactggacgcctaaaggaaccgccctacagaaccaccgacggaggcctctcttcaaagatttctcctcaggtgtctttggttttggttttgttctgtctttttccagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcaggtgcggccgcaccccaccctggccccggccccagtcccgcagggagacgccccagcccagcagaggagggtgcggactggactgctggtgctcccgctttccacaccttctccatccgccacctcgcccccacctctgggcaccccctgggagacccgggcagcccgcctgtttgtcagaggcagacgccgaccttctgttttcagaaagaagaagaagctcgcgttcgtgaagaagcagagagggtccggcaggaacgagagaagcatttccagagagaagagcaagagcgcctggagagaaagaaggtagctgcgtcttagtagagaggcccgggacgcgaacttgcacctctaagacccagagactagccctggccgtcagaaaacgcgtgttctacccttgccacataaactagtagccccctcagtgataacaatctcctgcaaagaaatctctctcggtgttttagccgtcaccaaaaaacacttacttccacttcatgtagcttaaggcagttccaactttcttgaataaccccagttaagacaaagcagcactgctgggccgggtggctcatgcctgtaatcccagcactttgggaggccacggcaggtagatcaccgaagtcaggagttcgagaccagcctggccaacatggtgaaaccctgtctttactaaaaatgtaaaaattagctgggcgtggtggcgggcgcctgtaatcccagctacctgggagactgaggcagcttgcgcccaggaggcagaggctacagtgaactgagagcttgccacacggcactccagcctgcgtgacagggcaagactccatctcaaaaaaaaaaaaaaaagtgcatattgtatttttccaaaataacagaccattttaaataatctatttcatcagttaaatatgccaggctggctttttttctgtgtctaatcttcttgctcaattcttcctttcctatagcgacttgaggagattatgaaaagaaccaggagaacagaagctacagataaggtattgacatggccgttttctaactacttttgtatgcttttatctttttcattttcacttgtaactctaatttttaaaagtcctctttttttcttcttcgtagaaaaccagtgatcagagaaacggtgatatagccaagggagctctcactggaggaacaggtatttctgtcaatgaactcaaaccaatttatatataaaatgtttaaattgactctccaggggtgaagatattcaggaattgatggagggaaaaaagatccagtgcttacagactcacagaagcttaggggtctgtcatcgagtccttccttcctcttatgtaaaactgtctagtgtttctaccagttacttttcacgtttgtttatactctaatgggttgcttgatattttaaatcatcttatgtaatatgtatttatgcatatatgtatatatacttatacatatatgtgtatacatatacttttagaagaatttcttttgagtttataaaactaaatttcatttatcacatactgtctgctcaagtagtgtatatttatatttcctcttaagaaaggactttaaatttacacattggacaacttgtattatagaagttctcagaaaaatgatttaaatgttatttatcttagatctgacttcaaaataaagttaaaaatttgttgaaattcttatttttttaattgacaaataatagttgtacatattcttggggtccagagtgatatttccatacatataatgtacagtgatcttgaaatttcattagagttactgatatgccatcggctttggaaagagattattgatttttttttggagattataagtcaaatgtatttaaaataaaagtgaaattagccttaatactcagattaaattaatattaagtgccctttttgtatcaggtacatctttcatacataattcctactgctgccttgtgaagtggtttgctttgtctttgagtcaacaagcatttttgaagctcttctatgtgccaggccgtgttatagggctgggattcagtgtgaacaaataggcaaagtccctctacccacaggggcactcaggtccaatgacaggccaggcttacgcagctggggccccggtcccccagctcctgattctgctccttcagtgatccttcgtggtcttcatgattgtacatgcaggtggttagtagatagctcatcattgtcttcctctttcctcatgtgtgatatcaatatgaaaagaaaagaccagaggtactgcagttttctttttctgtttacaaacaaaagcaaaggctggaataccttttgctcaaagatcaaatccaacggtttatgtgacagaacattgcctataaacattaagggttttcaaatgtaaagtattattggtattttgggacttggttttatttccatagaagctattttggtttctgtatgtcataattcctttatagtggagttttcatgctcttttaaagatgctctaatgtatgtatgtgtatgtttggagaatagtcttaatggttgtatattataaccccattgcatttttagcatactgtcttcaagaatattgtaatagacacaggctgtaagtaggcatagtacccagtgagttgtcagagtgatcaatttaagctgtaaattgcaccagctcaagattatttgaggggctaatgctgtagtttgtgcctgtccagtctccttgttggtttgtttgcattttcccccttcctgccctttccttatctgttctttcagtattctttataaatcaatccaagaatgaacaaaggcaagagggaaggtgaaacttgctgtttggcatagctgtgtttatcaacactcatgtaaatttgatttgagttaaaactgctaaaaggaggcttgaggattagctgtgcctaacaaatattccccttctcccagtcccacatctgattgcgggctgactggtgttaccagtgctacaaagagaattctaaggtgggtatgcaggcaggcgagtttacagacctatcatatgttttctcaggggctgcctgtcaccagctttgcaaatttgggcagatttgaaattatcacttacctttctgccttagttatcagatctcttgtacctctggcagctttattgaatttgtgccaggttgtaaaataacattgtcttgaaattatttcagaccaggtgaggtagctcatgcctataatcccaacactttgggaggctgaggcaggaggatcacttgagctcaggagttcaagactgggcaacatagcaagaccctgtctctacaaataatttttttttaattagctgggcatgttggcatgtacttgtggttccagctacttgagaggctgaagcaggaggattgcctaagcccaggaggtcgaggctgtagtgagccgtgatcacaccactgcactgcagcctgggtgacagaatgagaccctgtctcaaaaaaaagcagggggcaagggggtgaggggtaggaattatttcagttattctctcacatcaagctgaaaccataatctaccacagatatatctgaaactctggcctatataaaggtttataagtaaccctgtcctgtattttagaggcagtcatcaatattgtcagcttaaagtgggctgcaacattgagctttgaataatgaggtggaatggtgaggtacagtacactgctttccattcgtgaaatcctcattgttctaagtgtgcataggactaaactgagttttcaaaaatatttttaatacttatggtgttccttggtgatttgctctgaatcctttgtaaagatattcagtgtcagcttgatcaagtcagcttactgctatctttatcagttgctttggtttcaatattatatacttcatgtaactttagtgcaaggaaaaataataatactttgcccttccaacatgccaaacactgttctaagtcctttacatgtattaatattaatacatttaattctaacaatctatgaagtaggtactattactaatgaggaaactaaggcacagagagtttaggtgatgtgcccaaggtctcacatcacttaagtagcagaaccagcacataaatcaaggcattctggctcttggaggttaggtctaagaaaagaatattagtaaccctgtgttctgtctcctttactatgcccagaggtgtctgcacttccatgtacaacaaacgctccgggaaatggaaagccagttggcagcccacatgtggttacctcacaccagtcaaaagtgacagtggagaggtgagttttcactgacattcattaaagtaaaacattactgtttttacccaccagctccaccagaatttcaaagtcttaacattaggatttattatttggggggggcctcattgatttttggttgagctagtaattctgtactccaagaaagtggaaatatcttttttctcaagtcattaaatgtaatggtgaggatttagtgtgactgttccaagaatattacaagtggccaagtgcagggctcactcctgtaatcccaacactttgggaggctgaggagggaggattacttaaggctgagagttctagaccagcctgggcaacatagcaaagcaccatctctacaaaaaaaaatagcaaaactagcagacgtgatagtgtgtgcttgtagtcccaccttgggaggctgaggtaggaagattgcatgagcccaggaggtcaaggatgcagtgagccaaactcctgccactgcagtccagcctgggtgacagagtgagaccctgtctcaaaaaacaaaacaaaaaacaagtgataatctgttagttttctttgtgtatatttagcctgatatggaccatatccacattctttaatggtatataacaattgcattttagccatgcataatattacagtgacttacatgtttgttccatataaaagtcatgtagatgtcagtatttcttatattattaataacagggcttcttattgaagaaccagacagttgctaacaacagcctagaaaacagtctggatttcagaaagattgcctttctcttttcttgtaattatatcaacagcatcatatgaacattttcaaaaacgaaaaataagggtaatcatagcctgtgcctaaaaatccaatcatagagaacttgcagaaatatttttaataatgttcaaaaaaatttagctatgactttttaaatttgggaaatctacttaatgtatgagtcttcctgtctttaatgccagtctttgctaccaacagacatctgaaagtcctcaaattattttcttaatctaaaaacacataattgtttctcggcttttggccaggataagtacagacacacagacactacattttataatgtaattttataatgtaattttataatgtaatgtaacattttataatgtaatgggcagcagttaaaaggtaagtccctactattgtgttgatatctttctgagactgtggaatttttatttatttattttttgcctactataataccaaagagaataccctgagagatcttaataattcatttccaattatgttgaataactttattgttgtaattacctaagatctatattaaatggtatttttttcttagttttaattagattttttaaattcattccctaaaacttattatgttcaattcattgacttcagagatttcttttttaaaaaaaaaagaataaaagataccacagagagaatcccattattatggggaacagacaatgcctaccatagtttcttttattattattttttttgagacagactctcactctgttgcccaagctggatgcagtggtgttatcttggctcactgcaacctccacctcctgggttcaaggagacacacccagctaatttttgtatttttagtagagatgggtttcatcatattaaccaggctggtcttgacctgctgacctcaagtgatccacccatcttggcctcccaaagtgctgggattacaggcatgagccatcacacccagcctaccatagcttcttaagccactgattatgttatctgatctataaagttaatttatgcataatttgactctcttcagtagtaatatcaccaagcaattaatcattatataagaacctgaaaaataattttactatatttgatacagataataaaattctgttatattttagccttttccacacacagaaaagcaacaatttgtaatgaaaccaaaatgaacttactggtgtcatccatctttacccaacaaataaattatcctttgtcatatatgtaagataatccctgtcaaaccattagaagaaacataagcatagcctttttctactttcacctgacaatacaggcaggtccagatgagcatcagacataaacatcagaatataagaataagcctaatatgaaatccattggccatctactccagtgtctctcctttaaaggaaatatatatatgtatatatatctactatatatatttttatatatatctactatatatatatatctactatatatatttttatatatatctactatatatatatatctactatatatatttttatatatatctactatatatatatttcctttaaaggaaatatatatttataggaatttaaaggaatttatataaaggaaatttatttttatatatagtagatatatatttcctttaaaggaaatttatatatatttataggaatttaaaagaatttatataaaggaaatttatatatagtagatatatatatttttatatatagtagatacatatttttatatatagtagatgtatatattttatatatataatatatatatatatatagtagattcccagagttacttgtattatttttacaaatataaatttaggtttaaaatttctatagcccttgttcatttataaagccaaaacagcagatcacaaatttacataaataataaaactactttcaaccttcccccacagtgttacccttctatcccttgatttccatttctagggcacccccactgaccaagtccctggatgtttgcagtagccacctaaatgcttttgcccctcaaatactaaataccagccgggcatggtggcttacgcctgtaatcccagcactctgggaggccaaggtgggaagatcacttgagttcaggagtttaagactagcctggggaacatggtgaaaccccttttctaaaaaaatacaaaaattagccaggcatggtggcacacaactgtagtcccagctacttggggggctgaggtgggaagatcactagagcccaggaggtcaaagctgcagtgagccttgatcagaactctgcactccaacctgagtgacagagcgagaccctgtctcaaaaaaataaataaagctgtaaaatcaagaacagtgaaattattgtgaagaatgatgtttttctgaaattaagtgggtaatatacatatggtactgattgatcccttttgcattagggataaccatgattcatttcactcactgcttctctctgtttgaactgctttaaaacccctaacctctttttaatacagagtgccatgatgatacttggcttttacatggcactagcatatttatttagcagttcagctggttcatgtcattagcccttgtcaaataagctggtgctacctgatatcagtatgctttgaaatacacctgaaaatggagcactgaaattatgtagcaaaactcagctttgtgataatcagtcagacagatgatcagactgtacattatttttttaagttacctgggtgaaaacataaatttttaaaaatcatgtaaagaacaggaccccagtttgagaaacagtgcatttctgaatgacactgacctgtaggaaatgtttaatgtgatgttaagtttggtccccattatatgacacacagtttgtgatatgtagcctaagaaattctgcttcccttaattattttgaaatttgtcatccttgaattcatccagatcgatcttgaaacaatctgtatttttgccttgtattacctcttatagcaacaagtacaagaaaagaagggcataaagaagtacttttatttatcttatagctgctctttgcagtttcaaggttaggacccatagttatcataaactaggttttagagaatgtcattgtttgtagtttccatacccttcatagttttatgggtcttatttctattccctgtctacacttattttataagctgaatcctcctattatgtttactgtatcagtcggggtctaatcagaaggaaaaaaacatagatttaaaccggagaaaatttaaagaataactatcattcggattggagtaaataggatggagtaactatgattttggtttggcttataagaaataaagagcacttgtgggaatgatagggaaaaaaggaaaaaagaaagagaattctaaagaatttaggggcctggtgtggtggctcacacctgtgatcccagccctttgagaggctgaggcaggtggatcacttgagcccagttggagaccagcctgagtaacatggcaaaaccccatctctactaaaaatacaaaaagttagccaggcccagtggcgtacacctatcgtcccatctactcaggagactgaggtgggaggatggcgtgagctcaggaggtcgaggctgcagtgagccttgatcatgcccctgcactccaccctgggcaacagagtgggaccctgttaaaaaaaaaaaaaaaaatacgaatagcagatacaaggagcagtcacataccctagtgttgcacccaagaagaaagatcccttaccctgcaggtctgtaatccagaccttgttagagaggatataactgtttgtattggatgccagagaagttgctatgttttcttgccagcagaacttgccagagatccaccctctagagtgcctaggaaagctgttcactgtctccccagaagcactctaccatgaatctgccccagtgggggtgctggggggaggctgctggccactgtgcactgcaggagccaggcactgggaaaagcacgtgtatgctaaagaagcctgctgagcaagcacacaccgaccagaaagcaaaactctgctgcagtgtctctccagcagtggcaaaggataattatttaacaggtctggatccagtttcacagaacaggaatgatgggtgaatttggagctgagaggcagtaaatcaataactgacatatttaccttatctctaaaagactccttcagctgtttgaatattttattcatatttcttcagagattcttcagcatgaatatggggttgaggaaaaagagcttcagaaccaaaagttccaggctggatccctagttttacctttgagaagttcagcaactgtggggttaacctacttaattaaaccttagttttctcatctggacatggagatactttccacacaaagtattgggaggttcagtgaaatgctatctgtgaaggagttccaaaaactgttgtactatatgaatgttacatatcattatctttatcctcctaaaatgaatgcagtgtccagaaaacacacagtacactaggtgtagctgcagtgtgatgtaaaataatgcttttggtttgttcctggtatcccatcttctcctgcctagcattttattggcttttttttgttttttcgtttttttttttttttttaccatcaaaacacaaggagtcagtatcaccaaggaacagtttgcagtgatcccaagatgtcttaacctccattgtgactgatcattcactgtcttttaaggatagctcagctgacagttttctaaacccactgcttttacagactgcctgccttgtcactcatttcatgattttccctgttttctcgaggggctatttttatgacttgcatttccaagaataaacattatctgcatacttaaattttatcctgcttgtcttccgattattataaaactaaacctagcactgatccctggggctctctgccacttaaactcttccatctagagaagggcttgcttattcctgtctttattttgttttatttttattttataaaacagagtcttgctctgtcaccaagcctggagtgcagtggtacgagcatggctcactgcagcctctacctcctggctcaaatgatcctcccaccccagcctcctgagtagctgggactacaggtgcgagccaccacacccagctaatttaaaacatatatatttttatagagattaggtctccctgtgttgcccaggctagtctcaaactcttggcctctggccttaagcagtcatcccaccttggcctcctgaagtgttgggattacaggcgtgagtcaccacgcccagcctattcttgtctttaaaatccatccccaaaacagcttcccattcatgaataaacattccctttgatgcagtggaaactcaggtttttaaacagttttacatctgaaattctgttaaaaactttaaatgacaaatcacatccataaatatttcctttcactcctagtttcaaatcaaccttaaaatgcttataaaatctttggttttcatctcagtgcattatttttagtgaggcattccatgatccttgtgatcagtcagtatctttattaaataccctactttgcacctcaagtagagttatagatccctccagcttgcccactgtgaattaaatcactgattaatggaaatgctcggggtccctgccaaagaacatggtgtgcctgatactccatgaaaatccatcatgacagatcatgcaagtatagtggtagaatttatttttgctagaaaactccactgctcagaatgactatcttttcattcaaattgagagagaagtatcacttttcctaatgtctttagtacctaatatattcgtaaataaatgaatgctgtgaactaaattacatttgctcctccccaccttgagatatttcagcaaactgtctagcagcaccccaggaggatggcgaccccctaacattacttttcctagcagctaggactgagaccctttgttatagaacaactctgtaccagaagtatcctgaaccctactcctcaccttactcctgagtgagacgcctggcccctttgccccaaagccatttttcttgcccatctcttttccccctgacaggttccccactgacattagttagaatggaagagggtttgagttatcacaattctggccagattttaaaggtatacagaaatatgtgaatatgccaagtgtggtggctcacgcctgtaatcccagcactttagcaggtctaggcaagcagatcacttgagcccaggagttcaagaccagctagcaacatggcaagatcccgtctctacaaaaaatacaaagatcagccgagggcagtggcatgcatctgtagtcccagatacgcgggaggctgaggcgggaggatcgcctgagcccagggaattgaagctgcagtaagccgtgattgcaccactgcactccagcttgggcaacagagtgagaccctgtctcaaagaaatatatgaatatatattaataacatatatggattttataaaattttataaatgaatatatacattttcctatgtaagatatacgacgtttataaaatacttgaaatatatctttatgaaatatatgaatattatatatgcccttgagctgatcattcttactcaaaagccatgtttggttcttaagagagagtacttgtggagggatgttccacaggaattgaggaaaatatttgtccatggataggaaacttgctttggaacaggaaacaaaggatacggatccatatgaatacaagtcggggaggacaggggtgaatatcagaatgggaacagaggaagttatctgcagtttctcaggtcattctgagatgttcttctacccctagctgagaatctctagtccagaggctaagaagctctgctgcctatacagatactgccttaccctcctaatactccagaagacatttcatgtttgttcattgccgtaggggagctgtcttttcgtagaatgttcgtctttttttttaaataagaagtttttggtaattttggtgtttgacccattcattttccctccaaatcttgagttcatcattgctcttagtttggcctgaaggaaaagtaacattcccaggcccctattgttcacacaggaagagatgtatcccttttaatttaaaagttacttgttttaacataattaataaatatcaagagaaaataaggttctggcttccataagctgtgtggactgcagattcttgccaaggtcccaacccctgcctgtacacattttggactggagcaaagcgtgcggtcttcaaaagtcttacatcagtcttcaaacttcagaaggtaactgaaggcagggaattcagaagctggtgctcttattctgagtggacacacggatccatactccttaaccccagtacttcagtttcagttttatagtttctaccagtcccgatgtcccctgaacatttcatgacttgtcatccaatgcatatggcacaattatccctctgattgccagcaggtagaatgggcaggtggaggggaaatgaaatctgatactggctcaagtctggggttagccattgccattatgacttgttagtacatgcaggcctggaaggtgacaggttaaggttgccaaggaaagggggctctggagatacgttcctgttctttatcctttgccaggacttctacttaaattctctctgtattaagaaccaaaattgtttccctagttacagaaaggctgttggtgttaggcaagaacaggaagatgggtgtggcagcccaggcacttagaacagtagatgttaggcatgtgtgtgcacacgtgacttgggggggggggcatgtgcacatgtgtgtgactgtactcttgtggagacttataatgcctagtggcattcccttcccttcttagtaaaatagcagaaaagcatcatcacactgtataatatttcagattattttacaaataatgttttcagtgtattctgcaatgccttgtgagacacttaggacaggcatcttcattttttccgtaaaaaaggaaggtttaataattttaaaaatacacaaatattcaaatcagaaatgctttagtatgtgttccaaagtcaatacttctcactcagtagagaaagtaaactattttgactgggcgtggtggctcatggctgtaatcccagcactttgggaggccgatgggggcagatcactcgaggccaggagttcgagaccatcctggccaacacgaagaaaccctttctctactaaaaatacaaaaattagctaggcatggtggcttgcccctgtagtcccagctatttgggaggctgagactcaggaaccactttaacccaggaggcagaagttggagtgagctgagactgtaccactgcactccagcctgggcaacagagtgagacccttctcaaaaaaggaaaaagaaagtaaactatttattcaatcaggcaaaaaaaaagcaaagtgttaaaaagcaatagaaaggttggatttacattagcattgttttacaatttgagaagacaaactgacttgctaacaatgttcaagcagttggtattactgagactaaggttaatttgttgagcattgaacaagttttgaagcttgcacacatatgtatatgctgcaatgaaataaaatgaatggtaaaattagtttagcactcatttgatgcataggcattatttggctacattgtaaagcataataataagcctataacagagagtggtaatctaagacaaaccatagaagattaagtatttggggccaattaagtatatctcaaaaataaatccaagatattaagcatgaattcataaggatcaagatgaggtcagaggcagatttaaggggcaaagataagaagatcggtcttcaaaaatttacatatgaaattatgcaagggctttaggaggctggaatatctagaaagtgtgcgaaatggcttaatgagaaaaacacaggaccagagattaagagatcgtgcatttagcctcaactatctctcagtagttgtgtgactttgtgcaaatcatttactcccccctccaaattataatcccctcatctttgaggcaaaggtcctcataagtggtactctatcagatgaatataaaaatgcctgcagcagaaatcattaaatgtgtagaactgctgctgatgatgatttatttctattaatgatgatctgttgtaattgataaattgttctatttgataattttcataacaaaatgacagatttaaaatttttttgttgttgtttagagacagggtcttactccatagcccaggctggaatgcagtggtgccatcatagctcactgaagcctcaaactcctgagctcaagtgatcctcccacctcgactgccagagtagcttggactactggtgcgtgccaccacacacagctaatttttttcttttgtagagacgggggtcttgctatgtttaccaggctagtcttgaactcctggccttgagcagtcctcccatctcggcctcccaaagcgctaggattacaggcatgagccactgtgcctgacctagattttttaaaataagaatttaaggtacaaatacaccacaatttattatttttgttagtaatgatgtgactcaccagtctgatttttttaattgtagatttataaaattattcattataaaacattttggttttcctaataatgtgttttccagttttaagactaacttatttctatttttatttttcaaattccttagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcaggtaagcttgcctccaactcccttctgtagtcatcagaaatatctgacacccaggaggacacgaactgctgccttctacagtatgattgtggtaacactttgttcttcaaaggaccaagtaagccacagtggaagagattgtgcctggctcatagaaattgaattttgagttggattggacaacttctaaggcctctcctattctctcagtcagtgcagaagtccagtccgcagcacccagtgggtgtctgtcagcctctctgcacagagcagcacccattacccgacatcatgcatgctcagaatatgctttgtagaaagacagggctgtctccccataattttggaccatccggcctagtgctgcccactagagaaagatctgagttttttccatctttctgaggtcttcatgtatttgaagactgccatcatgttctcccaccatttttctcttatttgggtttggcaacctgggtaataaattattgtcctttcaaaatgtgacatgatggatagttacgatttaggtgatgaaaccagtactcacactgagtctaaagatcttaacttgttaaatgattttgttgctgttgaaactgcctgtgactttcttatacaatgtctctttgacccacacttgacctgaagtctttgtgcaaaaagaacaatcaggacccaaagaaagaagacataatatcaaatattactaactcagtggtcatagcagctcagcaacgcaatcccatcagtctcaggaattagcaagataatctgtgctccctgtctcttcaaacctgtttcaattttgttgacttctcttccctgaagatgactgtcatgtattgaccagcatctctttatatttctacaaaaagaactggccaaattcaggataactaaatggagacaatacagaattatttgtgggcaaattgttttgccttctagattcaatcagtgaatctgtaataaatcaacttttaattcggtgtgataaccaatgtgagccacccatccaaatgaagctactcttcttttctcctctagtgtactgaccttggaagtggaacctcactttagtgaactccacttttctaggatttgaagggaggttgtaagggccctcccctgtctgactttctgattcttaagcctttgggaacaatccgactaatggtatgttgatggaaacatgcccagtgcagcttcctactcatgttacagatttacaggaagggaaagaacttccagatgatttatcaacatttatttaacctccaacatatgtttagaaccctaagcatcagatactgaggatacaagagaaatgaatgtttaaacccctaaccgagaaaagtacaatctgtgtatgccacttggaaaaatgaaggctgtggcctaagctgatgtaaagaaaagaacatatgtttcctatgagtaacagaattcacttaaatataagactgtgaatcctaacagaattgcctattcttatataagtgtatataacagtatagtaagttttagaaatttaaggtattactatggtattcttgaaataagattttagataaatgtcatattaatcttgttctttttctgtctcttcatgtagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttaccttttataatacttgaaaaataagtacctctttgttctacaagtagaatgaataggagaagagtttaagcctgtttttttaaaatattattgcaaagagctctatttgtagaagcaaattataggcagattaccaggttcttataaatacagcttgtacatggacattctgcaaacccagctgtcacatttttcttgcaactccttttgcaaaagcagactaaaatgttttaaaatgtgaaaaaacattattttttcaaagcaagaaaataatttactgccctcttacataatgtatttataaagtttttccagataaactaatcaaataaattagaataatgtgacaacattacaaatttaatttgttagctgcattccttctgatgttaccacgatagaatgttactgatgattcagggctatttctgaagtctgtatgttgctgctgtccccagtgatggtggacttatctttgccttacctgatcacaaattatgttggggaaaataaagatttaatatttctttaaatagaaaaagaatttggttttgctcgtttaagagcaatgagaaaatgatggaatgttgactgtgtttggcacacaggacacggaccttcatggaagtccttgctctgcgtggcatctgtcagcttttcacctttcattcttattcttcacttttgctgctgagcctagctgtacaaacttgcactttcatttgctaatataaattcagttttattttaccattttagagactactaatgattaaatgtagaaggagagggtgcacatgtttttatgtggagtgtttaaaagataaatttataccactgtaatgtgcagcttttattaaaagagaaattggttgaactgctaggttgaatgagagacttcatctattggactattttttttaatccaggcatatggtctttagtaatggcttgtaatttgtgaaaacattaatttgggggttttccctgttttcagttgtccatgtacacatagtcattatattagaaaagaaatctgttcaacaaacttgtttaatttgtttaaatcaacatagcatgaaacaccaaataaaatgtttgacatagtttt

SEQ ID NO: 36277 - DNA, 207924 bp, Homo sapiens; identical to SEQ ID NO: 36276

SEQ ID NO: 36278 - DNA, 243277 bp, Homo sapiens
agtccccagcctgccggccggtactcaccgctacccggagttcgctcagacggtgagatttggggcgggtccgaggcagcggcgggacgctacctgcgaccgggaccatgaggagctgccagacccgtggggccggtaacgagagcagtcgcggcacctgctgagaggaaagagggagcggtccggcgcggctggggcgcggcagaggcttgcccgatcctcggccatgtcactgctctgcgtgcgcggtgagtgcgcggactgaggcggggaggcggggtgtcggcgtagaggtccccgcacccttccagtggacgtccggtgaccgtctcacccaaactttacatcccgtccgtgctttgggggtctattattttggcaatcacttaacaatcacttgagttctttccactttcttgttttcccccaagctcctgcaagggacgattagctctccattctggtagccatgtgacaatgttgttggactgcaggctcagatcctattaaacagtgactggggttctctagtgagagtggacgagttagaagaccgcggatggttggtgcctgtgaatggtgggcagcctctcattcttttcctcctcctcgcaccgtaacgctacagtatgcttagtagcaggttctttttatcacactttgaatgcgttagtggtacagctgtcacatcccttctattgcttgtcttgtcccctgccacttccctgaacactaaccggtagtataggctaagattattcttctgttccacttgggaggatgtggtgactgcttttgaggataagaggtatgatttatttttatttttattttagcttgcctcacagtaactcaaggtgaagggccattattgcttttcccctgaggacacttgacccatctaagaagatatcttaaagcaagagctttggggtttaagatgaggcatggtacgcgaactaagttctatgtgggtagagactgtttcttattagtttttgtattcctggtgtctgacgtagtagaagcttaatgctggttttgaatgaatgcaagtactgtgacttcagagagattatctgatcaggaaaacacagggtttggattagccattgaatttgatctcgggaaattcaggttacagcctatcatatctgatgtgtcttgattatgaatgagagagcatttatcaactagagcctttacctgatatcttttactggagagttcatatttcttttggctctacagattagaagcattgttgttgtttgtgatttctccaataacgatgtttcccccagctactggcagatgaaactgctttgctctgttctcttccactattttgttgaatctgcattaaccaaaatggatttggccatttcccgggattatgagatatacagtttttcttctttcatggttgatttttcattaatgagaattttgctttgcttttagtaagacattttctctcagcagctgggaatctatttattcctttagatccctgctgctgagtagcaggatttgggagaggttggactttgctgtgtctcttggacagtttaattctctacggccacactgtattacagagctggtccttatgaaagactctttaggcaggagcactcgtgaatcagaaattcctatttaactgaatttatataactactggtgttttcatttgttttaatagcaggcaggtttcattgtctagaaattctgctatttagctaacttctttcctttttaatgttactttagtgaagtttcttcttttttgaatctggagaaacgagatcagcaggccattgtctttttgaatagagatctagaagattttaaatactgaaacaaacaggtaccttatatgcagatattcatattgaatggcaaagtattcattttgggaaaacttacagaaatgaattgaaatacatctttatttttatttctttttctttttttgagacagagtctcattctgtcacccaggctggagtgcagtgctgcgatcttggctcactgcaacctccacctcctgggttcaagtgattctcatgcctcagcctcccgagcagctggaattacaggagtgaaccaccaggcccggctaatttttgtattttttgtagagacagagtttcactgtgttggctaggctggtcttgaacttctgacctcaagtgatccatctgccttggccttccaaagtgctgggattagaggcataatccactgcacccagcacaaaatacatctttctaaaatgacattccttgcgttgtattttggcagtaggaatgttgtattctgaaagcagtctatatagtgatatttattacaactcaatttcaattcatcttggagtagaatcaattagaaacttcctatgcagagttcaaaaagtagttaacttgatgtagaaattggcaaactggtattgaattaatcattcctaaacatttcattcaagaagtcagttattttgtcttgccctttaatcatgccttattgcctgcaggtttaaggctctcaatactctgactccagacttgtggccttctattcttgcctatccttatgcagactttgctctagcactaactttgtttattcctgcctctgctctgttctgcacttgtgccccctgaaatactcgttccatattttctgcctatctaaaatgtattcttactttcccagctaacagtctactttttttgttgttgaaaacttcttcaggtccccagtccacagtgatctctttttcctttaaatcctcggagcacttgtggtctgaacagtgccactagtttggaaatgaatcatatgctgcctgcaactggtcttgtattgtggtgcttatggtgacccagacaaaggaagtaattgcactggtcagatcagatctggaattttgtgttcagctgtggtatttccttctaagaagcatattgagaagctaggttatcttaagaggggagtgattagaataatgaaacatgtaggaaccgaaccatttgaagaatatgggaaatttagttgtagaagatttaagaggaagaggatcacgatagtacatgaagactgtttaaaaaactgtcttgtagaagttatgtcaccttttttgttgtcattccagaggacagaactgggacaagtgtggatcagtggttgaaaatgacaggaaattagattttagcttaacataaagaagaacagttgggttgttcagaacaaatggaatgggctatgtagattttttgacactaaacagaaattgaatgagtggtaaggattctaaaggggatattgaccattcagcgggtgattgacttgaatttttttttttttttttttttaattttttgagatggagtctctgttgcccaggctggagtgcagtggcatgatctcagctcactgcaacttctgcctcccaggttcaagcgattctcctgccttagcctctggggtagctgggattacaggcgcctgccaccatgcctggctaattttttgtatttttagtagagacggggtttcaccatgttggccaggctggtctcaaactcctgacctcgtgatctgcccacctcggcctcccaaagtgctgggattacaggcgtgagccactgcgcccggcctagacttgaatttttaagaaaccactcttttatagaattcacttagtctttctttaaatatttccataagtataaagaaatataagtctttaacatgttttggcacagctttacttataatacggatactttttttgggcttccatagggaccagtgccacatgaacaactgcagtaaactaaattaaggattttgtttgacttttattgtcttggtattcacgaccaagtttctccaagcaattataagcatttttagaatcagacctttccataatatttctctgtaattcccagtgtttataacatagttattcccagtgtttataacatagttagataatttaactatggatttttttcccccaaaagtaataaatgcaggccagtcgtggtggctcttgcctgtaatcccagcactttggaaggctgagacaggtggatcacttgaggacatgagtttgagaccagcctggccaacgtggtgaaaccccatctctactaaaaatacaaaaattagccaggtgtggtggtgctcacctgtaatcctagctacttgggaggctgaggcatgagaattgcttgaacccaggaggcaaggttgcagtgagccaagatcatgccactgtactccagcttgggtgacgaagtgagaccctgtctcaaaaaaaatatgtgtatggtaatacattgctaattatagaaaatttaaaaaatgcagaaaagtacaaaaaaagaaaaaaatttccatgggcctaccacctgccaataccattgctaactttttttttaaatttaattttttttttaaagatgggatctcactatgttgcctaggctggatttgaactcctgggctcaagtgactgtcttttctcagcatcacgagtagctgggactacaaggaacacaccaccacacccaactattgttaactttttaattcattgttttcattttgtttttattataaggtgataaatatacagataagaagttgaaacagtttagagtgtaaagtagaaggaaaagttctcttgtccccattcggtattcttacttcccagaggtaactactgtttactgtctcttacctatccttctggaaattttcattgcagatgagtatataggttctgcagttgaatgtacatagcattcttcagctttttttgttttttaacctcaatgatctattttcctgtcaggtcatctgagtctaaaccaagcttgtccagcctgtggcatgtgagctgcatgtggcccaagacggctttgaatgtggcccaacacaaatttgtaaactttcttaaaacattatgagatttgtcagctatcattagtgttagtgtattttttttattttatttttattttttgagacagtctcgctgtgtcgcccaggctggagtgcagtggcgcgatctcagctcactgcaacccctgcctcctgggttcaagcgattctcctgtcagcctcccaagtagctgggattacaggcgcccatcaccacgcctggctaattttttgtatttttagtagagacagggtttcaccttgttagccaggatggtctcgatcaccttacttcatgatccgcctgccttggccttgcaaagtgctgagattacaggcatgagcgcctggccagtgttaatgtattttatgcatggcccgagataattcttcttccactgtggcccagggtagccaaaaggttggacaccctggtctataccattcttttgaatggctgcagagtattctgttatataagcatacataatttaaacagttttatattgatgatattcaggatatttttcttttcactattacaaacagtgctacaatgaacatctttgtaggtttttttttttttttttttgagatggagtctcacactgttgctcaggctggagtgcagtggcgccctctctgctcactgcaacctctgcctcctgggttcaagcaattatcctgcctcagcctcttgagtagctgggattacaggtgcctgccaccatgcctggctaatttttttttttttttttttttgtatttttagtagagaagggggtttcactatgttggccaggctggtgttgaactcctgaccttgtgatctgccctcctcggccccccagagtgctgggattacaggcgtgagccaccacgtccagcctgtagatggtttttaaacatttgtttttatttttgagacagggtcttgcattgtcacccaggctggagtgcagtagtacgatcgtggctcactgcatcctcaaactcctgggctcaatctgtcctcccatctcagtctcctgagtagctgggactacaagtgcatgccaccatgcctgactaatttttctactttttgtaggatggaattgccctattttgcccaggctggtcttgaacttctggactcaagtgatctgcccaccttggcctcccaaaatgctaggattacaggtgtgagccactgcacctgaccagtttttttattattaatttttttctttccaacttttaagttcaaggggtacatatgcaggtttgttacatgggtaaattgcatattgccatattgcaggggtttcatatacagataattttgtcacccaggtaatcagcataatacccaaataggtagttttcagtccttaccctcctcccactccatagatggtttttgttatatgtttggagatctccaattagctttccacctggactttatgtgtaattttctcattgctgttttctttggcatataattatactcagttggaccaaatgcctcggtgtctcagatcaacatcctcaattagaggcagatccttcagcagcaggtaatatttttctatgcctgttgaaaagaccaaagactctgctcttgtaagtaagtttgacctgtgatttccatgtacttttctttcttatttgtattttattttccatatgaacatgtattacttgcttttttttttttttttgatacagggtctcactctgttgcccaggctggggtgcagtggcatgatcacggctcactgcagtcttgacctccctgggctcaggtgatgctctcaccttagactcctgagtagctggaactacaggctttcttgtagagacagggttttgctatgtttcccagggtggtcttgaactcctgggctcaagcaatctgcctgtctcagtctcctaaagtgttgggattaacaggtgtgagccactgtgcccgactgcatttttaaaacagaacaaaacaatgtcactggtgaatggtaacaggaccaagttgatttatattatgatttgccctttaaaaaactcgttactggacaggtgaggtggctcatgcctgtaatcccagtactttgggaggctgaggcaagagaatcacttgcatccaggagtttgagaccagcctgggcaacatagcaagaccccattcctactaaaaaaatatttaaaaattagctgtgcgtgttgacgcatgccggtagtctcagctacttgggaggcgaggcaggaggatggcttgagtccaagagattgagggtgtagtgagccatgttcatgccactgcattctagcctgggtaacagagccatctcaaaaagttcatggcttatcattaatcatccatctaactagacacgttgattgtgcattgattctactctagggaaagtccaaaaatatatttcggtttacagccattgtggaaagtaggaatggtaatgatattagagttttcagacataggtataggttggtcagatacttctcatctccttcccccatcctgccaccccctgctgaatgttattgtcatctgcctcagctaactcctttttgctgggcttccatcgatcgtggttctagtagtccctgcccttagagcagagctgtggctgtgttcctttcacttagggcctcaggaagttgattgtgctttgtgtgagccaggcagtgatgggggaaaggaccaatttgctctgctatgctattgttataaactgttctgttccttataagtagcgtattctgtaatttagtttctaaaaatggggtttctgaaagttgggctctttaggccaataagcttaatttttatcctatttacctgtgctgtgtatttcagactttgagtttgtttaaagtttgggctgtgtatcattagtaaatatttgttggatactttctctgtgcatgtttatgacacaaatctgtattgtagataagaggccacggaatctagataggttttaaaatgtctgttatacagtgttcttatataaactcaaataatccattaggattattaggtctgatttggaataagcagaataaattaagttcttccttgagtagggaaataactgcactgtcttgttttaacatttattttcacattgttattattactgttttttttttgttttgtttttgagatggagtctcgttctgttgcccaggttggagtgcagtggtgcaatctcagcttactgcaacctctgcctcccaggttcaagcgattctcctgactcagtctcctgagtagctgggactacaggtgtccaccaccacgcctagctaatttttgtatttttagtagagatggggtttcaccatgttggccaggctggtctctaactcctgacctcaagtgatctgcccactgcggcctcccaaagtgttgggattacagatgtgagccaccacgcccagccttattttatgattagttttttgagactggatcttgctctgttgcccaggctggagtgcaatggtgcgaacatggctctctgcagcctcgacctcctgggatcaagtgatatgctcatttcagccttctgagtacctgggactacaggtgtgaactaccatgcttggctaattaaaaaaaaattttttttagagatggggtcttgctatgttgcccaggctggtcttgaactcttgggctcaagcaatccttctgcctcagcctcctaaaatgctgggattatagtcatgagccactgtgcatttaaagcaagagtctttgagtttgggggtattttatatataccttctctttttttttgagacaggttcttattctgttgcttaggctagagtgccatggtgctaatcagggctcactgcagcctcaatcttgccaagctcaggtgattcttccacctcagcctcctgagtagctgggactgtatgcttgtgcaaccatacatggctaatttttgtattttttgtagagacagggttttgtcactttacccaggctaatcttcaacctgtggagtcaagtggtctgcccgcctcagcctcccaaagtgctgggattacaggcatgaaccactgtgcctggctcctttttttttgagatggagtctcattcttttaccccggctggaatgcagtggctcaatcttggcccactgtaacctccatctcccaggttcaagagattctcctgcctcagcctcccaagtaggtgggactacaggtgcccgccaccacgcccagctaatttttgtattttcagtagagacagggtttcaccatgttggccaggctggtctcaaactcctgacctcaggtgacccacccgccttggcctcccaaagtgttgggattacaggtgtgagccaccatgcctggtctcaagtatagttttttaaagaaagaagtctcactctgttgcccagactggagtgcagtgatgtgatcatagctcactgtagcctcaaactcctgggctcaagagatcctcccgtctccgtctcctaagtagttgggactacaagcatgtgccaccacacctggctaatttttgaaaatttttttgtagagatgggtctccctatgttgcccaggctggtgtcgaactcctggcttcaagcagtccttctctctgggactcccaaagttctgaggtgacatgcatgagccactgttccctaccccaggctagtttattttgattaacatgtttgtcagattcttccacttgatgtgtgtggcagttagttcattgattttcgttgctatgtagtatcttgttagatgcatatactgttgtttatttatttaatgtatttcttaatctcatgacagtgtagattagattatgtggggagaaattggaggcacttgaattatagcaggagtgatttagattaaacataaattaaaatttcttgatgaaatttgaactgccacagaaaagctgtgaaatttatttttctatggctcttcaaaaataagccctatttccttcatttaaaattttatttattaatttttttttgtagagatggggtctcactatgctgtccaggcaggtctcaggtctcaaactcctgggctcaaggcctcctcctgcctccgcctcccaaagtgctgagattacaggtgtgagctaccatgcctggcccctttgttttttttttttaaattgatatgtcatagatgtatgtgttttggggatatgtgtcatatttagataaattcatataatgtgttaatgatcaattcagggcaattaggatatctgtcacctcaaacatctttcatactgggaacactggaattctcttctggctatttggaaatctacaatagattttcattaactgtaatcatcttactgaactatcgaatactagatcttattccatttatccaactgtatttttgtactctttaatcaacctttcttaatcctccctctcctgtttcctttcatatactatattaggtgtaactgctctggatgaggaaggttagataaccagctttgcatttcctgttttgttgcagtcttttctttgattactgggaaatggaataaaaatgtaagcatatggttaaaatgttgtgttcacctttataaagtacattaaaaaattcttttgttatctttagtaaaaatgaaatgtactttctcaagtgtgatgtccagaaataattatccactgggtgtgtgagaaaggccaatagaatcaaaggaaaaagaatcatgaaatcttttttttttgtgctgatgaatcctttggtgataaaatatgtggtaaaaatgtgacaggaggaagtttgtgctaaggtgtaaggtctatttttatcctgtaagtagggagaagcaattcttagtcattaggaaatataggtttccaaaaagaagagtgttgttttcctgctgctgcttggttctctcttttgctatagtaagtgcttctttagagctgtagaagacaggcctgtggattgtgttgggctgtcaattttctcttgcaactgtttgctttattgatttctatagcgtttcattgtaaatgatgttgagaagaggttagagggcagggagggagatctgcctagcaaccaataaggggctggcagttggacagtgggaagataattgcttttatataattagagttggggcaaagatgattcgaaaggctagattacttacatgagccaaattagttatgaagcaaattttagagactttgtctgcaaaaggatagaggaaatctgcttgccaaggaaaggggggtaaatgatagatataaacctgtatgtctacctcacttcagccctccattcccacaattacaccagagagcatgtcactctttggaatggtgctctccttttgtaatcttaatcttcataatctatctttttttttttttttggggacagagtctcactttgtagctcaggctggagtgcggtggtgctatctcggctcactgaaacctccacctccctggttcaagcgattcttgtgcctcagcctcgcgagtagttgggattacaggccctcaccaccatgcccggctaatttttttatttttggtagagatggggtttcaccgtgttgcccaggctggtctcaaactcttgagctcatgtaatccgcccgcctcagcctcccaaagtgttaggattacaggcgtgagccactgtgcctggccagaatctatctgattgtattctttagcccatttttacagcttatactcttgctatgctttaaccactgtgatataaggtagatgttaaaagctttggttttagacagacatggcttggtgaatatatcagctccaacgctgtgagttgtctgcctttccatatgttacctcatctcattaaaccttaatttccacatctttaaaattcatatatttgttagggtagtagtaccagtgatggtgaaaatacctatagcaaagtattgctgacataattgttgtgaaagtgattagtactgtcccaggcatagaatgagtacttattttaatataaaaacagtattaatattcttcatccagctttatgatatctattcatctaagacagggagctgaaagtcttcctagacctctctctctctctctttttttgagacagaatctcaccttttttgagatagtctcactctgtttcccaggctggagtgcagtgatttgatcccagctcactgcagcctcaacttccagggctcaggtgattctcctaccttagcctcctgagtagctggaactacaggtgtgtgccaccacacccagctaattttttttttttttgtcggggggcagggtctccctctgtcctccaggctgtagtgcagagtgcgatctcggctcactgcaacctctgcctcctgggttcaagcgattctcttgcctcagactcccaagtaactgggactacaggtgtgcgccaccatgcttggctaatttcttgtatttttagtagagatggggttttgccgtgctggccaggctagtcttgaactcctttttttttttttgagacagagtctcactctgttgcccaggctggagtgcagtggcacgatcttggctcactgcaagctctgcgtcccgggttcacgccattcttctgcctcagcctcccgagtagctgggactacaggcgcccgccaccacgcctggctaattttttttgtacttttagtagagacggggttccactgtgttagccaggatagtctcaatctcctggttccaccgtgttagccaggatagtctcaatctcctgacctcgtgatctgcctgcctcagcctcccaaagtgctgggattacaggcatgagccaccgcgcccggccacgtcttgaactcctgaccttaggtgatccacacgcctcagcctcccaaagtgctgggattacaggcatgagccaccgtgccctgccatttgtgtagagacaaggttttgccatgtggctgaggcttgtctcgaactcctgggactcaagtgatctgtctgcttcagcctcccaaagtgctgggattacaggcgtgagcccctgtgtccagcctagacttctcagttgaggaagaaaatacaaagagagggaggaaagttgggttccgttgagtttgtgggatctgtgagataagttacatgtgagatatattgaattgaatgtatcagtctcattgcagatgatccttgaaaatggtaacccaaatgtaggtttgtagcttagtagagaaatctgttagagataaatatatggaagttgcaggtatttggtaataaagacattagcttgaattaaaatacttatggagggtcagaaaggagaaaaaggggctgatgctgccgccaaggaactccagtgtataggaatgggcagaagaggagttgatagatgtggtcagaactgtaggaaaatggagagtgttgtgttagggtctgtagcctagagtacagcgagtttcaagaaggaatgatcagatgatagaggtgaaggagacttgttgaggtttaggaaaaaatgaagagatcattggatttgaaaacaaggacagtttcatttgggtaatgtgagggcaggcagtgtattatagtagctgatgagtatttgggcagtaaagaagtggaatgagcaagtgtaggctacacattcagaagttctgcagtgaagagtagggttaagagtagtcttaaaggccaggcgtggtggctcacgcctgtaatcccagcactttgggaggccaaggtgggtggatcacttgaggtcaggagttcgagaccagtctggccaacatggtgaaaccccgtctctactaaaaatatataaaaaaaaaaaattagccagacattgtgctgcatgcctataatcccacttatttgggaggccaaggcaggagaaatgcttgaacccagaaagcagaggttgcggtgagctgagatcacaccattgcactccagcctggttgacaaagtaagactctgtctcaaaaaaaaaaaaaaaaaaaagagtagtcttaagaagaaatttgagtattttgtagcttgaagggaaggaatctgtaagaaggggaaagtcaagatgagatggggaagggagagatgataactgatttcttttgtaaagtaggatgcaaaattatcagctgatagtgaggtggtggggatgatttagagagcttgaggagagtgcaaagggttcattcatttattctttcaacaactattgggccgggtgtggtggctcatgtctataatcccagcattttgggaggctgaggcgggtagatcacttgagatcaggagtttgagaccagcctggccaacatgacaaaaccccgtctctactaaaaataaaaaaattagctgggcgtggtggcaggcgcctgtaatcccagctactcgggactctgaggcatgagaatcgcttgaacccaggaggcagagattgcagtgagctgaaatcgcaccactgcactccagcctgggagacagagcaagagtttgtctcaaacaaacaaaccaacaaacaaaaacaaaaaaaccccacaactgttgtgctaggcacttggggaggaatggtgaggaaaaaacccctttccttcttggaagtttatatagactagtaggactacggaggagttagacattaaacaaggaagaatcatacaaattaatataaaattacgagtaggaaaaaatacaactgatttgtgctataaacgagagtacatgttattataagaacatgtgttaaggaaagttacctacacagatcagagaagtcctccctaatgaagtgaagactgaactgagatctagaagaagaggacactatcgagagaaggagaagaatattctaggcagaggaaatagtatgtgcaaaggccttgcagtgggagaaggatctgagagaaggcaagtatagccaatattccaagagaaagggaaaatatggattaagatgaagctggggctcctgacctcaggtgatccacccgcctcggcctcccaaagtgctaggattacaggcatgagccacagcgcagcctggccaacatgacgaaaccccatctctatttaaaaaaaattaaaaaaaaattagtcgggcgtggtggccggtgcctataatcccagctactcaggatcctgctgagacaggagaatctcttcaacccaggggcggagatttcagtgagccaagagtgcgccatctcactccagcctgggtgaaagagcgaaactccatctcagagaaacaaaaaacaaaactatagggccttgtaggcaacataaggtggaaagttagcgggaataagaccgaggaaggggcagaagtatagaagtttataaactgaaagcactgggtttctactttgatttgtttgaatcctttttctaccagtgaaagcttttggcaagcctcttgactaccaagccacaattttaaaatggaagtgttaacatctgccccatgtaccttcataaagttgatgagaattacactcttaagatcatgtgtttgaaattctattgtatagtaacttttactctcagtcctttttatatcttgtttgtagagacttaactgttttgaaacttataaacaaacaggatatgatcagttccataaacatttattgagcacttaactatgggtgaggcattgaacttgtcaccctgggtatataaaaatgaggaagaagtgggccttgccctcaagaaattgagggcaaagaaagggtgacagccatgtgtacagctaagcatgatgcaagacacaaatggataatttctaaaacagaaaaaatataatggattgtagaaattccaactgagggacagggaagaattgtagaaaaagtcaagttttccattatggtgtcactcattaattgggatacgaagcatagaaagaaagaataacaacttctggggagatgatttgggtgttggatatgttgaatttgaagagttggcagtccacgtgttaaggttggaaatgttactcaggagatcagggttagagtagatttggtctgttctttgtggatctgttgtgtggaggcacggtgacagggtaaacatatactcagcatcatcattataatatactccatttcatccactataagatgccatagattgtaagaggcatcattattttatgtattatttgaaaaatactattgctgggcacagtggctcatgcctgtaatctcagcattattgggaggccaagacgggtagatcacttgagtccaggggttcaagactagtctgggcaacatggcaaaaccccatctctacaaaaattaggcatggtggcacatgcctgtagtccctaatacttgggaggctgaggtgggaggattgcttaaacccaggaggcggaggttgcagtgagctgagatccgccactgcactccagtctggaggacagagtgagaccctgtttcaaaaaaaaaaagaacaaacaaaaaaacacatacacacacacatacaattgattgctctatgacatgtcattgattgtaagattcatttcaatttcagagtggttacatatgagaaaataggccagtggctcacacatgtaatcccagcactttgggaggccgaggcgggtggatcacttgaggttaggagtttgagaccagcgtggccaacatggtgaaaccccgtctctgctaaaaatactaaaattaactgggtgtggtgcacgcctggattcccaactactctggaggctgaggcagaagaattgcttgaccttgggaggcggaggttgcagtgagctgagatcgcaccactgcactccagactgggtgacagagtgagacagcctcaaaaaaaaaaaaaaaaaaaaaaaagacaatgtctcaccatcttagaatcaatgaaatactgaagctaacatttaatgagtctttactctttgccaataagtaggtaagggttaatcatttaattcttgtaataaccttgttatcctcattttacaaatgagggcactggcctactgaagtttgtccttttccatactgaaaagctgaatttactttttttgctttactcttaactatacaatacaataccaaattaattatacagggtagtgctttggaacatgaataaaatctatttttaataaaagtatttagggaaagatggctgttatgcattgttggctgtgaatcagagtctcactatagctgtggtttctgtttgcttaggatatattcgtggacagcattatagcaggtgtttcatagactggagagttcattatggctctagtttaatattttcataaaaaataaaaggagtttaataaaatccctttttttcttgggagggagtgtggtataatggaaaatttgggattctagagaactcttgaatctcgctaggtagtgactaaaactgtatctataagtaagtttcttaacttcactaagaatcatcttctggccaggtgcagtggctcgctcctgtaatcccagcactttggaaggctgaggcatgtgcatagcttgagcacaggattttgagaccagcctgggcaacgtgacaaaaccctatctctacaaaaaatataaaaattagctgggtgtggtggtgcatgcctgcagtcccagctttttggaaggctgaggtgggaggatcacttgagcctgggagattgaggctgcagtgagccatgatcacaccactgtgccctagcccagcctgggtgacagagtaagactctgtttcaaaaaagacaaaaaaatagagagagatgatactttagtggttttagttttaggtaaagttaaagcattaagttcagttaattgggtaacatcctaatttttctttacagttcactttagactgtaagagtcagttgcctaatgtaggaattaggtagatggatggctagaatgaccttgtcctgtgtgtgtataatcaaacttgggttatttctgataaacagtaaccatagaaatctgattgtgtattaatgtaaactctattccaactgaggtttatttatttagaaaacatttagaaagatacacttgaacacttgtacatgctcaattataaccttaactgtgtttactttataattagtcattggttttgttagttgaggtttgacgtaagtacttgtttgtcttttggtttgagagagaccttatagagagtaaattttattgatttttggagaaattaatttttttttcaaggacagggtagcatatttatatatatttcatctgtattctttttaagttgtgataagtcgctatgaagtaaagtggaagcctagcagtgatatctaagacttttgagaaatgtttgtgaatgaatgaaactaaagatatatggctgctttgcaagtttagttttgcttattattctatccataccatcagattttaatacaatttattcttttttttttacttgcttcatgtgagcataaattggagcattagctatttcagtcggtgtgaatttggtatcagtactgcagggagagggctgtggacttcaaaaattatgggcttttgaatctgtttcaattttatactgcattgtttaattaagtcagacttggggtacttagcctttctgagttttaatctgtaaattgtaaattacatactctacaacagtgttttttaaaattgtagcagtgtttgtttttgtttttgcttttgttcattagttctgaaatcaattaagtgggtgaccagcgttaggggaaaaagatacagagttttggccaggcagagtggtttacgcctgtaatcccagcactctgggaagccaaggtgggattgcttgaacccaggagttccagaccagcctagtaaacacagtgagaccctgtctttaaaaaaaaaaaaaaaatgctggatctgtttcagcaggtacctgtagtcccaggtactcaggaggctgactgagatgggaggatcacttgagcctgggaagtgaaggctacactgaggcttgatcacacctctgcactccagcctgggcaacagaatgagacgctgtttcaaaaaacaaacaaaaaaacaaaaacaaaacaatggcatttctttccatattagtgtcctgagtttttctcttttattttcattcaaaaaattttctctagtgccttgatagggacccttatttttcttatttcacagatgtaactaattttaaaatcctttatctttgtttttctatgtttcatgattttaagcaagtctcttagagcaagttgttggattctgttttctaaaaaaaattcactgaatgtcttttggtattgctgtgtctcagtgatctagaagctgtgttttattgacatatagtaactgagatatgacctgaaatttatttaatctatttctcatgtttctcacctataaaatggagataatattagtacctatacggtactaattataggcatgagccaccattcctggcctggacaactttttatatcaatgaagatcgatctggccaggtgcggtggctcatgcctgtaataccggcactttgggaggccggagtgggtggaccactcgaggtcaggagtttgagaccagcctggccaacatggtgaaaccctgtctttactaaaaatataaaaattagcctggcatggtggtgcgggcctgtagttccagctactcgggaggctgaggcagtagaattgcttgaacccaggaggtggaggttgcagtgaggccagatcagccactgcacttcagcgtgggtgacagagactctgtctcaaaaaaacaaataaataaatacataaaaaataaaaattaagatagatctgcccaccaaactatccttgaaaaaccctaaattctgagtctttggagagattgatttgagtaataactccatctcctgtgtggatggctggacctgcatcagttaaactctttactgcagtgccatggtcttggtgaactggttttgtttgtgcagtgggcaggaagaagctgtggagtgattataggattaccagccctactggactttatttttgaatactacttcttttacatttgttcctatatcatcttcagtaactccaatatctgtgtgttagagctctttatatcttcctacttctcacctttaaaaattataaaaccatcagttttcttgaaagttgactcctctattgctgcttctagtgcatttttatactttttctcatgtttaacttaatattctttctcattgagcttccttttgatttttatctgcctctcagcagtcttcctcagtcttctgcttttcatcttttgcttctgtgaccccccctttttaaaatttagaaactgtgaaaccaatgctgattaaaatttatttttttaacacaaaattttattttattttatttttatttatttttatttttattttttttagtatttattgatcattcttgggtgtttctcagagagggggatgtggcagggtcatagggtaatagtggagagaaggtcagcagataaacacgtgaacaaaggtctctggttttcctaggcagaggtccctgtggccttctgtagtgtttgtgtccctgggtacttgagattagggagtggtgatgactcttaacgagcatgctgccttcaagcatctgtttaacaaagcacatcttgcaccgcccttaatccatttaactctgagttgacacagcacatgtttcagagagcactgggttgggggtaaggttatagattaacagcatcccaaggcagaataatttttcttagtacagaacaaaatggagtctcctatgtctacttctttctacacagacacagtaacaatctgatctctctttcttttccccacatttcccccttttcttttcgacaaaaccgccatcgtcatcatggcccgttcttgatggtcgctgtctcttcagagctgttgggtacacttcccagatggggcggcctggcagaggcgctcctcacttcccagatggggcggccgggcagaggcgctcctcacctcccagacggggcggcctggcagaggtgctcctcacctcccagacggggtggccgggcagaggcgctccccacctcccagatggggcggccgggcagaggtgctcctcacctcccagacgatgggcggtcgggcagaggcgctccccacctcccagacgaagggcggccgggcagaggagcccctcacctcccaggcggggtggccgggcagaggcgcccctcacctcccaggcggggcagccgggcagaggcgcccctcacctcccaggcggggcggccgggcagaggcgctcctcacctcccagacggggcggccgggcagaggctcccccaacctcccagatgaagggcggccgggcagaggagcccctcacctcccaggcagggcggccgggcagaggcgctcctcacctcccagacggggcggccgggcagaggctcccccaacctcccagatgaagggcggccaggcagaggcgcccctcacctcccaggcagggcggctgggcagaggcgctcctcacctcccagacggggcggccgggcagaggcactcctcacatcccagacgatgggcggccgggcagaggcgctcctcacttcccagacggggcagctgggcagaggcgctcctcacttcccagacggggcagccgggcagaggcgctcctcacatcccagacgatgggcggccaggcagaggcgctcctcacatcccagacgatgggcggccgggcagaggcgctcctcgcctcccagacggggcggccgggcagaggcgctccttgcctcccagacggggtggtggccgggcagagacgctcctcgcctccaagacggggtggcggcagggcataggtgctcctcaccacccagacggggcggcggggcagaggcgctcctcacctcccagacggggcagccaggcagaggcgctcctcacttcccggacgtggcggtcaggcagaggcgctcctcacatcccagacgatgggcggccgagcagaggcactcctcacatcccagacgatgggcagccaggcagagacactcctcacttcgcagacagggtggcggccaggcagaggcgcccctcacttcccagacagggcggccgggcagaggcgctcctcacttcccagacggggcggctgggcagagggcctccccacatcccagacgatgggcggccaggcagagacgctgcccacttcccagacggggtggtggccgggcagaggctgtaatcttagcactttgggaggccaaggcaggcggctggaaggtggaggttgtggcgagccgagatcaagccactgcactccagcctgggcaacactgagcattgagtgagcgagactccgtctgcaatcccagcaccccgggaggccgaggcgggcagatcactcgaggtcaggagtgggagaccagcccggtcaacagggcgaaaccccgtctcctccaaacatacaaaaaccagtcaggcgtggcagcgcacgcctgcaatcccaggcactcggcaggctgaggcaggagaaccacgggagcccggggcagggaggctacagggagccaagaccaccgcagtacagtccagcctcgacaacagagggagactgaagaaagaaagaaagaaagaaaggggagagagggagacgaaagaaagaaagaaagaaaggaaggaaggaaggaaggaaggagaaagaaagagaaagaagcggggggggggggggagagagagagagagagaggagaaagaaagaaagaaaagaaagaaagaaaggggagagggagagagcacaaaattttaaaaatgtttctttacctttgagtcctatgttcttacattgttttataatcttttttcttggtcttcaaaacaataaaatattttttcctcccaagaataatgagatattcattcgtatgggggttcccttcctcccacctcaaacatattgagtattcttagatgatctcactttctgtttcctattagaagcctcctcttagattttatttatttacttttcctaaggtacttttgttatagcaagaaggctcctcttggattttaacaaaaagggctcagattgccagttaagtgcctcaggacagtgaggaggaagtcctggctacaaatcacccttttagagaaacttctctttgtggaggatattatttgtagttggctaagatgctatgtcaagttaagatctggtgtggccacattgttgccttgcactagaatagtcctgcttcctcctagagtatatgtcagctctgtgtagcttcctttggtacactagaaaatggtctgccactagtacaaccaactactatgtcctatgtcttgcaggacagttctcaaattctgccaagttgttctctgggtgctgcacctcattgcatccaaagagaatccccctgatttatttagcaagaatgttcttccaaccccgagcttcactctgggctcttgctacagcttttctcaaatcccgctagtttgcagctgttaaaagaactctctataatccgaaaataaaattctaggctgggcatgctggctcatgcctgtaatcccagcactttgggaggccgaggtgggcggatcacttgaggccaggagttcgagaccagtctggcctaacatgatgaaaccccatctctattaaaatacaaaaaaaaaaaaaatggtggcacatgtctgtattcccagatacttgggaggctgaggagggaggatttcttgagctctagatgtagagactgcagtgagccgagatcatgccactgcagtccagcctgggcgacagagcgagactctacctcaaaaaaagaaaaaagaaaaaaaaaaaacaacacagtaaaataaaactctaagccctccagctggctgaatggacctccccccttggccaagggaaacccaaagaaacctgaaaaactacttcagggcataaggagaaggggcatctgatatgcctcatcatacagtgttccctttggagtttagacacaactgaccagcattaacattaaaacagagatgttaagactgacaaaacatgactcttcatagcaccctactaggtgtagaccctactagatctgacatctcttaaggtctgataagagacattcaccacctattctctctgaagcctgctacctggaggtttcatctacatgatgaaaatcttggctttcacggctcccttatctaaactcaagcattttctttatgctgaattcaactcttcaggcagggcttaacttccaaccatttggcaaccaggaaatctttcaatccacttatgacctggaaggtcctcccacccgctgtcccactttgagatgttgaagaatctgtgttgtctgcggtaaatacctggggtttgtcatcttgcaccaggaaaatttaggacacagatacacatgaggagtttaggagcagaatttaataggcaaaagaaagagaaacaaagagaaaggaaaacagttctctctctagtgagagagaggggacttccaagaggaaaaagctgactggtggcagatgtgtcagattttatagtcagtcttgagaaggcggtgtctgatttacatagggctcacagattggttcaatcaagtatgatgtttacatagcacatggggaaggctggccacctcaccctaatcttattatgcaaatgaactttccccttgtctggtgccatcttgtctgctccttactgtacatgtggctggcagagaaaggaacaccgcgcccggccacgagatgcttccttatataaaaatttcttccctttataaccttctttgtatagccagggtgtgacatattaccaaacccaataagaagttcttgcagactcagtgatagtaaaactatcatgcttccttttcgttgggaaccattatctctgctattaggataataattaagcaaaatactacagcaatggaaattctctgtccgatattccggttagaaggtgctaccatctataggtcttactgcaaatagtaaagtgagtatagcaattcctgcaagtgtggtacagtagataatttccatgtaaaattttacttgccaagatatagaatctccctttggggatctatgaagtttcttggttttattttcccaaacagaaacatctgggttatgggcaccctattcactttcattacctggcagatgttgcaggataattgcccagaactagcatattgatccagctttttacattgcccattcctttctgtttcttccaggcttcaggagatcaccacttgattcacaggaataagcgggattagtctaaaatgtagtcaaaaaaacttaaaaacaatcattgagactagaatttagtgacaaatggatgataagctttggagcataatttttctctctccagtctttattttaggtaaaaacaaattatgataggattgtgttgtttgtataataaactttagtcttatacttggcctgattatttgcataaggtgcagaaagaatgatttctacataggccttttgaattggctttgatggaactctgatccacaaggaattttagataaaacctcttagagctgaacccagccatgggtttatatcctcaaatacctgtgagttgggtgatcccctcctcttaaggtcccaagataaacttggagctcctggatctgttagaaagtggcattctttactgactacaggtcagaaaccctggacggggactgtgtaggtaagggtatgaggccagttcttctcatggggcttttattggctctgcaagtctagattgactccttaaatagtttccaaattctagaggaactaggcagagagaaacaaacatactccaaattttgttcacaagagtataacttactcaattattaaaggccataagtagttcaaaataagtttcattgactctgaaaaacaaaacaaggatcagcaatattccaagcaaaagtcagaaagtttgctttagctttgtgagtgcagtccatttagttaactcttattttgcttgatatacatgagcattttagttcttcatagtcctgtactttttttctttattccgtgttacaatctttaaagctattaaaaaaactcacatttgagaacacctgttaaagtcctgtagcttgattataaaccatcttttgagaaagaacaaagcaagacaacaattgtctgcgaatgacaaaatttccaaggtagttatagttaaaagcaagactgacaaataagtttagttatctctgtgatttacaataactttaaccttaattataattgatagcatatacttagacattagaattttagaagtcacatgcaattttggaacatatattagtattcaccaaaatataacttaaagaatatcggacatcattttggcaatcttatgtgacaaaacatgccaaataatactgtgtacctcttctctggatttttcaggggcctctgaaccatccagaaagccaggcatcaggaaagacaattttgaaacttgaagtttgattttgggacacctgttaaatgtcagaggtttaaaatacttgatgttatgaaatagaatttcagatcgccataaattgcttattttgccaaaatgactcaaaaggcaaaaaccttctattaacctttactattacatgaaaatcctattcaaagtcaaaatttacccttgcattagttaattaatgttagccccagtttgttgaaatgaaaccttatagatgattccatctaattttaaccaatttgaccatgaggtgcaatctttacaaaccttttataaccctttttactaaagggcagattagcatctttagacaaccttgctatacttttatttcaatactcaatttatgagaagaccgtataatgcccttttggatttaatgtttacacattgtttgcaagattaatttttacaatctttctgtaacttgcttaaacctctagctttatcttatcaaatttaagataatccctcatacctgggcaaaatttacatttccatgcattcttataatcttttactaaaaaacgcattttactgtttttatacgccttgcatgtaaaactgtttagtgacctcaaatacatgtggcactgttaactcttagcaacttttacttttggtgaaaaacctgtttagtaagtgtttttaattatgtaccaggtgtggagcctaggacccagacagaagtgcagataaggtctgaccctcttcagcatctaactttcacgtgtcccaggccttacctatctgtaaagcaggcaatttggaacatttagcaaacctagtatctaagctgtatgatttagaccacctatttgcattttgacgacacttgcattttaccaattcttcagactatttttatttcttaaagattacagtcatgtgaactaaaaaatatttaagtgcttatttttctttaacccaattagagctctttttatagacattacacacaacacacatatagcaacacaaatagaagattcagcacttgtaacatttttcatttgccagtttctttttttctgttttttgagacagagtttcactcttgttgtccaggctggagtgcaaaggcgtgatcccggctcaccgcaacctccgcctcccaggttcaagcgattctcctgcctcagcctcctgagtagctgggattacaagcatgcaccaccacacccggataattttttatatttttagtagagatggggtttttccatgttggtcaggatggtcttgagctcccaacctcaggtgatccgcccacctcggcctcccaaagtgctgagattacagacgtgagccaccatgcccgacctgccagtttcttaattggattactcgtttcaggatggagcccttggaggaacagggccaggatagcatgccttttagggcctaagaagcaggcacagctgaaggcaaagaaagatccgcaaaattaacggcgccattttatactggatcttggatcccccaaaggtgggagatactgtggaagaagagagtgcagtgcttctactgtgcatttcatttcaaggcaacccaaagccaattggcttattttgtaatcggcccatccctcatgggagtcttatctctcaatagggggtggggatgtttccatatcttataggtggccaagagcatgcttctctgactcaaatgtgcagagttaagtatccctccataactactattagccattccttaaagtatatctcctacctagttattacacaccaaagctctctcataatgtgaagtaatttgatatccccaaaactcaaaactatcagataacacaatgcaaaacagaactgagcctttgattttgagagggaatgatctgcttttaattcctggggtttcatgaggaaaacagtttttttttcttccccccctcccccaaaacagggtctgtagtgcctcctctgtttttcccaaggagtccccggctaccggaagttatcttagggcctgtcatatgtgcattaagagtggcaagacaaaaaatggagaaaaataattcagtcgactaaaaagaaaaaagactttttccagaaaaacatgatccaagaagagaaaaacataatagccttttaagtatatctataactgggatatccacttttaattaagctgagcactctttcagaaaatccttttaaatcccttgttactaaactttagccacaccaagcagttaagattttcagcttttgaatgtcacaaaaagtaacctcacaggtgagaccaacaagccttaattagtttatgacttaacctccagtgtacaaggtattttcttttttctttttttttgagacagagtctcgctctgtcgcccaggctggagtgcagtggcgccatctcagctcaccgcaactcccatctcccgggttccaatgattctcctgcctcagcctcccaaatacctgggattacaggtgccagccaccacacccagctaatttttgtagttttagtacagatggggtttcaccatgttggtcaggctggtctcaaactcctgacctcaggtgatctctgcctcccaaagtgcagggattacaagcgtgagccaccgtgccctgccaggtatcaggtattttcaaaggggtgataagtaacttttgaaactctcattgcaaaattgtgactgagacagtgaaagagatcagacccaaccaactccattttgtttttagcccctaagctgtccttgctcatcactgggcataggctgaaccaactttgggaggtgtctggtttacagtgtatagtctaaaacaaaggtggtaacagccccttcctaagatatacttccctcttgcctggggaccagaccaagaaactagccacaaaatgagaaaccatggcttaggagtcacgcagctggaggctacaagattttatcctcccttaactgcccaagatcagtatttaagatattttgtaaactctgcccttgatggatcagctggctctgcctagattgataaactggcttatctgatttttggcccttccccgggaactaacttagcacaagacacccaccgttgtaaaatggcagagactaaaacaaagtattgccacgtggttacacgtcatgtttccaagtacatgaaacaagatggaggcctgtagccaagtttgttactgaccattttgttggactggcttgaacagcaggcttatagggtcctgggtctgcatcttaacctaaggtaccctttctttccacaggaccatacagaaagatacacgaagcacaccagattggctacagtttaagaccaacctcacaaatcccttttcattaattaaaacttaaccacaaatataaacaataatccttatcccttttgccagtttggatagggagagagaagccaaaagcctgactggtaagaaaattttacccttttgcccacatgtcaggcttctagttccttttccccagctcaactctaagccaagcatttttaaggtttggaaaattaacttttcccaggttgaaagaacattataaaagcatataggagccattttaagctgtaaaagaaggaaaaataccatagaaaagtctgggggttccagttagagttgttaagaggtattgcttcccttcctatcgacaatgatgtttcctctatttcttgatcttctctattttctcttttccctttttgcttattataggagacatattgtacatttccaaaattctctgccttctgcagaactgcctgtttttcagctgtagtttggggtttggcttagaagcagcataacatcccttcatgagaggttaaacacctgagttaaatttcagaaagcttctatatacctatcagggtcattggagaattggcctaagtctccctttatttgcctaaggtactgtaatgagaagggaacttgaggggcccctgaataagggggatccttagattgttcccctggaagttacttctctaactttggtgaatcatttgctattggcctgcctgatatgactactaaaagagctgggttgattttgtaacacctgcaaaggtctagtaaggccatgcccttgtgcaaaagaaaatgagttgatttttctttaaattattagagtcaaaggagtccttgtgcttcagaatgtactccagaggggtgcaagctgaagatgatctgttacccatctagagagagaagtgacaaaaaggcatctcttttttcaccttccttttggtgtgacccagggtggagaggaaaacagtggggacgtccctcctgctgttttccctctgcggtttctgggtcctggcaccttgtttaatgtgccacccatggttgcaggtgtgacccccagccatggaaccagaggaactaagtgattgggattagtcacactgattcatgcaactcaagtcctctgcctgtgatttcctttgacttcctagacttgtgtgacctgcctggctccctgaaaaatggatcttgggagagactatgcgacagttgcatttgggcaattgttgcacttccctccttaatggaggaagtgtgctggtttgagctctatatcctgctattacagtccatgctaaagtgtttacccttagagaatggttctggttaacttctgaacttaaaatccccttactaattaagtaccattctgattggaggcagaataggtgccttaaaagatcataggggctgagtgtggtggctcatgcctgtaatcccagcactttggtaggccgagacaggtggatcatgaggtcaggagttcgagaccagcctgaccaacatggtgaaaccccgtctctactaaaaatacaaaaattagctgggcatggtggcatgtaatccacctgtgcctgtaatcccagctactcaggaggctgaggcaggagaatctcttgaacccaggaggtggaggttgcattgagccgagactgcacaattgcactccagcctgggtgacagagcaagactccgtctcaaaaaaaaaaaaaaaaaaaaaagattgtagggactaaatggctgttttcctgttgatggagcagtatcaagaataaaatttggttttggaggatgttttattcctagttgttgaagccagaattttcccatttacagaagcagcatgaagcctggtttgtagtagagaggctcaaaaagggaagagaattgggaagctaggctgtttttggtaaaggactgacaatgtgcctcatgaagaggatccctgtttcactagatggtgctgttgaccttgaaatgccatgtgctttccagaccaagggcagagtgaccttgacacgccatgtgctctccagtcctaggtcagagagagacctggaaatgccacgtgctctccagaccaagggcagagtgacctggaagttccgtttgctctccagaccaagggcagggagagacctgcaaatgctatatactcttcagaccaagggcagagagtgatgctcactgtcggggggagccttctgtttctagaaaatctcaaagacgccttcccttgagctatatcccctacaacgtttcctgatcttgccaaacaaaataactgaactgtaaaacttcgctcacatagcatacacagagagaataggagatatgacagtcgcagacaggaaaggaggaaattatgatagaaaagttggagatcctgttgccaacaccccatcaggtggtcagagactgggatcagtccagaagcctttggataacacctgaaggtagccccagccagaaatcctcagttgctctagaacctcttacagccccgcacaatggctaagtcctccatgaaaggaagctggttcaaacatggccaacatgcccagcaacccatgggtgctgggggattctccattttcttcccagtaaatctcacatctgagtctttaagaatggcagccacgctaaccgtgtttttaactggctgacagatgcccattattgatttgatttagttctaaagtggaggccaacagccccaaaatgaaaggacagagttggattccactcctctactcaccgttttgatgagcgttgtaccttggtatcctgagtgagcaccctgacatgattggctatgttgtctggggtaaatacccagcgtctgtcatctcgtgccagaaaaatttaggacacggacacatacgaggagtttaggaatggaggtttaataggcaagagaaagagaaacaaaaagaaaggaaaacagctctctctctagtgtgagaggggaattctgagagcaaaaggtggactggcggcggatgtgccggattttatagtcttaaggaggcagtgtctgatttacatagggctcacaaattggttcaatcaggtgtgagctttacatagtactcagggaaggctggccaccccaccctaatctttttaatgcaaatggaactttccccttggctgatgccatcttgtctgctccttactatacacatggctgacagagaagggaagatggagccactattttgaacatgattggcacacctgccagcatgtatgtctgcagcttgattttacaggctgctctttgttagaaaatgatttggggctgcttcttattaaaaggaaaaccttaccaaggacttctgtacccttattatctgcctaagtgagttcttcttaactcctgtatcagtgtgccccctttccacgccaaaccaatgtatacttaacatgtatcaacttttgtctttgccttaaaatgtataaaaccagtctgtaacccaaaaaccttgggcacatgttctcaggacctcctgaggctgtgtcacaagccatgggtccttaaccttggcaaaagtaacctctaaattgattgagatctgtctcagatacttttttgtttacatcctcatagctgttttgttaaatcttgtccctgattttagccttttttaccttatttctgattttagccttttccttccaagaaaagggtgttcataaggtctcaaataccctttttcataattctcagagggccatactggccctgaaaaatactttttaaagttagtcctgaggattctgttttaaaaagctagatctgtctgcacagacagaatattcagctttgttagagttgttttttttcctccccctccttcacaaacatcttgctagccagtcagaacagctgagtcaactgtggtcagttggctgagagatgtcacggtccatctttatgtccaaatatttgacaaatgtaaaaatatagctgaatatgcaaattaattattgtaaccatgctaatacacatacacatatacatgcatacatatatatacagggcagtgggattatatactattcctatcttttgttttttcatttctatcatttaaaatgttaagttttaaataagaaatggtggttattgtatttttgtttttcatgtctatcttttaaaatgttaagttttaaataagaaatggtggttattgtatttttgtttttcatgtctatcttttaaaatgttaagttttaaataagaaatggtggttattgtatttgggaggtgatacacctttttacttctagattctgaaatagatgggttacaaacaagggaactagtgccacaatgtttggaaattgttccatgcatagaactggctagaacaaggcaagttagccattccctgtgcctgaggaaccaggtcactggctgcagagtcagtgtgaataggattatttcccataatcccttgtggctttggttctatatcaaggtcagagagactcaggagcggaagttacatgtttttttgagggttaggtacagttcttatatattctcctatttctgcctttacttgtaaagatcttggggaggatgctctgcccaggcattttctctttatcccggacttccagggttttcatattggctggagttttataagaacctcagtgttttgtaatgaatatttcttttccacacatcttttctgtttttacatattgtagtagtaatatggatgaggcaggaattgtgtgctgaagtacctcccagctttgactctgaaaatactactttttaaaaatctatttatttatttattttctttttttgaggcatggtcttgctctgttgctcaggctggagtgcagtagtacgatcatggctgactgcatccttgacctcctaggctcaagcaatcctcccacctcagcctccagagaagctgagactgcaggcatgtgccaccatgcccagctaatttttaatttttttgtagagacaggatctccctatgttgcccaggctggtcttgagctcctgtgctcaagcattcctcctgcttcaatctcccaaaacgttgggatgacaggcttgacctactgaacctggcctaaatatttattttaaattagcttcataattagatgaatatcaagtttattcaatctggtattttttaacagtcttgaggaagtagttgatattgattgagcaatatagtgctttcttatttaaatatttaatgttttccttttttcttttttttgagacagagtctcgctctctcaccgaggctggggggcagtggtgtgatcttggcttactacagcctccgccttccaggttcaagcaatcctcccacctcagtctcctgagtagctgggactacaggtgtgtgcccccacacccggctagtttttgtatttttaggagagatggggtttcaccatgttggccaggctggtcttgaactcctggcctcaagtgatctgcctgcctcagcctcccaaagtgttgggattacaggccagagccactacacccagccatttttcaaaacccctgtttgttttaatatgtgatatgttttcagaacacctgcttattttaatatgtgatacggtttggatttgtgtccccactcaaatctcatgtcgaattgtattgtaatccctaacgttggaggaggggcctggtgggaggtgatgggccatgggggcggacttcccccttgctgttcttgtgacagtgagttcgttctcatgagatcttgttgtttaaatttgtagtacctctcccaccttctctccctcctgctccaaccgggtaagatgtgcctgcttcccctttgccttccgccatgatcctaagtttcctgaggcatcccttgccatgcttcctgtacagcctgtggaactgtgaaccaatgaaacctcttttttaaataaattacccagtctcagatagttctttatagcaatgtgagaacagactaatacaatatgcgaaccattaggagatatataaggatttaaaaactttaaaaaacatatctacacatctgtttaaatcttatcagttaaggtaataatgttaacaccccacttggtgtatatctttccatacttatcttcctattcataacatgtgttcaagcatattgataggatttggatctatgtctctaccaaatctcacgtcgaattgtaatccccagttttggaggtggagcctggtggtaggtgatggatcatgggagcggagttctcatgaataggtcagcaccatctgcttggtgcttttctcctgtgagtgagtaagttctcttgagatgtgatttttttaaggtgtgtggtatcttctccctctctctgttccttttgctctggccatgtaatatgcgcctgcttctccttggccttctgccatgatcatacgtttcctgaagcagatgctgtgatgcttcctgtacagcctacagaactgtgggctaattaaatattaaatctcttttctttatacagtatgtagtctcaggtatttctttatagcagtacgagaacagactaatacagaaaattggtatcaaggagtgaagcattgctataaagatacctgaaaatgtgaaagtgacttgggaactgggtaatgggcagaggttggacgagtgtggagggctcagaagaagatagaaggatgagggaaaaattggactgtcttagagacttgttaaattgttgtgaccaaaatgttgatagtgatatggacagtgaaggccaggctgaggagttttcagatggagatgaggaacttactgggaactggagcaaagtcagttttgttatgtgttagcaaagaggttggaggcattatgtctctgccctggggacctagggactgtttttattattattattatactttaagttctagggtacatgtgcacaacgtgcaggtttgttacatatgtatacatgtgccatgttggtgtgctgcgcccgttaactcatcatttacattacgtataactcctaatgctatccctccccgctccccctactgcacgacaggccccagtgtgtgatgttccccaccctgtgtccattcccacctatgagtgagaacatgcggtgtttggttttctgtcctcgggatagtttgctcagaatggtggtttccagcttcattcatgtccctacaaaggacatgaactcatccttttttatggcttcatagtattccacggtgtatatgtgccacattttcttaatccgatctatcactgatggacatttaggttggttgcaagtctttgctattgtgaatagtgctgcaataaacatacgtgtgcctgtgtctttatagcagcatgatttataatcctttgggtatatgccgagtaatgggatgactgagtcaaatggtatttctagttctagatccttgaggaatcgccacactgtcttccacaatggttgaactagtttacagtcccaccaacagtgtaaaagcattcctatttctccatatcctctccagcacctgttgtttcctgactttttaatgattgccattctaactggtgtgagatggtatgtcattgtggttttgatttgcatttctctgatggccagtgatgatgagcattttttcatgtgtctgttggctgcataaatgtcttttgagaagtgtctgttcatatcctttgcccattttttgatggggttgtttgattttttcttgtaaatttgtttaggttctttgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagtcatgaagtccttgcccatgcctatgtcctgaatggtattgcctaggttttcttctagggtttttatgattttaggtctaacatgtaagtctttcatccatctcgaattaatttttgtataaggtgtaaggaagggatccagtttcagctttctacatatggctagccagttttcccagcaccatttattaaatagggaatccttttcccatttcttgtttttgtcaggtttgtcaaagatcagatggttgtagatgtgtggtattatttctgagggttctgttccattggtctatatctctgttttgataccagtaccatgctgttttggttattgtagccttgtagtatagtttgaagtcaggtagcatgatgcctccagctttgttcttttggcttaggattgtcttggcaatgcaggctcttttttggttccatatgaactttaaagtagttttttccaattctgtgaagaaagtcattggtagcttgatggggatggcattgaatctataaattaccttgggcagtatggccattttcacaatattcattcttcctatccatgagcatggaatgttcttccattgtttgtgtcctcttttattttgttgagcagtggtttgtagttctccttgaagaggtccttcacatcccttgtaagttggattcctaggtattttattctctttgaagcaattgtgaatgggagttctctcatgatttggcttactgtttgtctgttattggtgtataggaatgcttgtgatttttgcacattgattttgtatcctgagactttcctgaagttgcttatcagcttaaggagattttgggctgagatgatggggttttctagatatacaatcatgtcatttgcaaacagggacaatttgacatcctcttttcctaattgaataccctttatttctttctcttgcctgattgccctggccagaacttccaacactatgttgaataggagtggtgagagagggcatccctgtcttgtgccagttttcaaagggaaggcttccagtttttgcccattcagtatgatattggctgtgggtttgtcatagatagctcttattattttgagatatgtcccatcagtacctaatttattgagagtttttagcatgacgggctgttgaattttgtcgaaggccttttctgcatctattgagataatcatgtggtttttgtctttggttctgtttgtatgatggattacgtttattgatttgtgtatgttgaaccagtcttgcatcccagggatgaagcccacttgatcatggtggataagcttttagatgtgctgctggattcggtttgccagtattttattgaggatttttgcattgatgttcatcaggatattggtctaaaattctctgtttttgttgtgtctctgccaggctttggtatcaggatgatgctggcctcataaaatgagttagggaggattccctctttttctattgattggaatagtttcagaaggaatggtaccagcttctctttgtacctctggtagaattcagctgtgaatccatctggtcctggactttttttggttggtaggctattaattagtgcctcaatttcagagcctgttattggtctattcagggattcaacttcttcctggtttagtcttgggagagtgtatgtgtcgaggaatttatccttttcctctagattttctagtttatttgcatagaggtgtttatattattctctgatggtagtttgtatttctgtgggatcggtggtgatatcccctttatcattttttactgcgtctatttgattcttctctcttttcttctttattagtcttgctagcggtctatcaattttgttgatcttttcaaaaaaccagctcctggattcattgatttttttttgaagggttttttgtgtctctatctccttcagttctgctctgatcttagttatttcttgccttctgctagcttttgaatgtgtttgctcttgcttctctagttcttttcattgtgacgttagggtgtgaattttagatctttcctgctttctcttgtgggcatttagtgctataaatttccgtctacacattgctttaaatgtgtaccagagattctggtatgttgtgtctttgttccattggtttcaaagaacatttttatttttgccttcattttgttatgcatccagtagtcattcaggagcaggttgttgagtttccatgtagttgagcggttttgagtgagtttcttaatcctgagttctagtttgattgcactgtagtctgagagacagtttgttataatttctgttcttttacatttgctgaggagtgctttacttccaaacatgtggtcacttttggaataagtatgatgtggtgctgaaaataatgtatgttctgttgatttgaggtggagaattctgtagacgtctattaggtccgcttggtgcagagttcaattcttggtgagttcaattcctggatatccttgttaactttctgtctcattgagctgtctaacgttgacagtggggtgttaaagtctccccttattattgtgtaggagtctaagtctctttgtaggtctctaaggacttgctttatgaatctgggtgctcctgtattggatgcatatatatttaggatagttagctcttcttgttgaattgatccctttaccattatgtaatggccttctttgtctcttttgatctttgttggtttaaagtctgttttgtcagagactaggattgcaacctttgcttttttttgttttccatttgcttggtagatcttcctccatccctttattttgagcctatatgtgtctctgcctgtcagatgggtctcctgaatacagcacactgatgggtcttgactttttttttttttttttgagacagagtctcgctctgtcacccagggtggagtgcagtggcgtgatctcagctcactgcaagctctgcctcccaggttcacgccattctcctgcctcagcctcctgagtagctgggacaacaggcgcctgccaacgtgcccggctaattttttgtatttttagtagagacgggttttcaccatgttagccaggatggtctcgatctcctgacctcgtgatccacccaccttggcctcccaaagtgctgggattacaggtgtgagccaccatgcccggccgggtcttgactcttatccaatttgccagtctgtgtcttttaattggaatatttagcccatttacatttaaggttaatattgttatgtgtgaatttggtcctgtcattatgatgttagctggttgttttgcttgttagttgatgcagtttcttcctagcatcgatggtctttacaatttggcatgtttttgcagtggctggtactggttgttcctttccatgtttagtgcttccttcaggagctcttataaggcaggcctggtggtgacaaaatctctcagcatttgtttgtctgtaaaggattttatttctccttcacttatgaagcttagtttggctggatatgaaattctgggttgaaaattcttttctttacgaatgttgaatattggccccccactctcttctggcttgtagagtttctgccaagagatctgctgttagtctgatgggcttccctttgagggtaacccgacctttctctctggctcccttaacattttttccttcatttcaacaggatctgtggaaatttgaacttgaaagtgatgatttagggtatgtggtggaagaaatttccaaccagcagagtattcaagatgtggcctggctgcttctaacagcctgcattcatatgcatgagcaaggaaatgacctgaaactggaacttatttaaaagggaagcagagcatgaaagtttgggaaatttgtagcctagccatgtggtagaaaagaaaaaccccattttcagtggaggaattcaatcaggctgcagaaatctgcctaagtaaagagcagccaagtgctaatttttcaagacaacgaggaaaagaccttgaaggcgtttcagagaactttgtggcagcctctcccatcacaggcccagaggcctaggaaggaagaatgattttcttggctaggcccagggccttgctgcactgcacagctccatgcatcctggagcactgctctgtgcatcctggcatctctagcaccagctgggctcagaagggcccaggtatagcttgggctgctgcttcagagagtgtaaactgtaagccttggtggtttacacttggtgttaagcctgtggatgcacagagtgcaggagttgaggcttgggagcctccatctagatttcagaggatgtatggaaaagcctggatgtccaggctgaagcctagtgcagggtttgagccctcatggagaacctctactagtgcagtgcagaggggaaatgtggggtgggagcccccccacagagtccacactggggcactgcctagtggagctgtgagaagagggccactgtctttgagaacctagaatggtagatccattggcaacttgcacactgtgcctggaaaagccacaggcactcaacgccagcctgtgagagcaactctgaaggctgaatcctggaaagatttggaactttccaaggccttgggagcccactccttgcatcagtgtgccctggatgtgagacatggagtcaaaggagattattttggagctttacgatttaatgactgcctactgggtttgggacttgcgtggggcctatgacccctttcttttgcccaatttctcctttcaaagtggagtatttacccaatgcctgtacccccattatatcttcaaagtagctaatgtgtttgattttacagtctcatagctggaaggggcttgccttgtctcagatgtcactttggattttggacctttgagttaatgctggaatgtgttaagactttggaggactgttgggaaggcatgattatattttgtagtgtgagaaggacatgagatttggagaggccaggggcagaatgatatggtttgcctctgtgcctcccacaaatctcatgttgaattgtaatccccagtgttggaggtggggcttaatgggaggtgatggataatggggtggagttctcatgaatgggttaacaccatcccttggtgctattcttgttatagttctcatgagatctggttatttaaaagtgtatagcacctcacccctcactcttttcctcctgctctggccatgtgaagtgctatatctcccttcaccttataccttgattgtaagcttcctgaggcttccccagccgtgcttcctgtatagcctgtggaactgtgagccaattaaacctcttttttaaataaatcaccacgtttcaggtatttatggcaatacaagaacagactaatacacacacacaaacacacacacatatatacatgcccttttggtttactttaaaaaaaatagctttattgaggtgtagtttgcataccatgcaattcatccctttaaagtataaatccagtggtttttaatgtattcacagagttgtgtaactgtcaccacaataaattttagaatattattatcactgtaagaaagaaacctcttagccattagcaatcatttccattttctccaacctcccactagggaggttcctccaactgggaaaccacgaatctactttctgtctttgtagaattactcattctggacattttatgtgaatggaataatataatatgtagtcttttgtagctgctttctttcacttaacatcatttttttaggttcatccaagttgtagtgtgtatcagtacattgttcctttttatgcctgaataatattccattatatgggtatactataatttgtttattcattcatcagttgatggacattgcattgtttccacttttggactgtaatgagtaatgctggtatgaacatttgtgtataaaattttgtgtggattttttaaaacttgaggtgaggctgggcacagtggctcatgcttgtaatctcagtactttgggaggctgaggtggatggattgcttgagcccaggagtttgagaccaggttgggcaacatgatgtaaccccatctctaaaaaaaatgcaaaaattagctgggcatagtggcacatgcctctagtcccagctacttggaggctgggaggtaggaggatcactaagcctgggaggcagaggttgtagtgagctgagattgtgccactccctctgttgtccaggctggagtgagcagcagagggagaccctgtctcaaaaataaaaattaaaaaaaattaaaaattgaggtgatagtcacataacatacaattaactatttgaaagtgtgcaattcagtggcttttagtatgttcacagtgtcatgcaattattgtgtctctctacttccaaaattttttcatcatcccaagaaaaatacccatacacattaaataatcactccctttccctctatcccctggtaaccactaatctgtcttctgtctctatggattttgcagttctggttatgtcatctaaaaggtatcatataatttatggtccttgtgactggcttttttaacttagcataattttttagggttcatccatatggtggtttgtatcagcatgtcattctttttaatgattgaataataccatagtgtaggccgggtgtggcacagtggctcacacctgtaatcccagcactttgggagaccaaggcaggtggatcacgaggtcaagagatcgagaccatcctggccaacatggtgaaatcccatctctactaaaagtgcaataattagctgggtgtggtgtcgcacacctgtagtcccagctactcgggaggctgaagcaggggaatcacttgaactgaggaggcggagtttgcagtgagctgagatcgcgccactgcactccagcctggtgacagagtgagactccatctcaaaaaaaaaaaaaaaaaacacacacacaaaaactctagtgtatggatattaccacagtttgtttacccattcattagttcatggacatttgggttgtttctgctgtttggatgttatgtataatgctgctagatacacttgtgtacatgttcctgtgtggcatatttctgtgtgcactatttttcaaagtggctgtatcattgtggattcccaccagcagtatatgatggttccaccttttccacattcaagctcaaagttactattatctgtcttttaagtcatcctaatgggtgtgaaatgatatcttactgtggttttgatttacatttccctaatgactagtggttgttatgcatattttcatgtatttattgaccatttatttatttttatttattttttgacatggagtcttattctgtaactcaggctggaatgcagtggttggatcatagctcactgcaaccttgaacttctgggctcaagcagtactcccactccagtctcctgagtagctgggactacaggtgtgcaccaccaccacgcttggctaattaaaaaaaaatatttttttctatgaactctgcagagaagaaattaatttttatttatttatttatttatttatttatttatttagtagagatggggatctccctgtgttacccaggctagtcacgaactcctgggcccaagtgatcctcccacctaggccacccaaagtgctgggcttacaggtgtaagccactatgcctggcctcattggccatttgtatatcttctttggggaaatatttattcagatcctttgcccatttaaaaattggattatttgtctttttattgaattgtatgtgttctttatgtatatgctagatacaaaactcttattagatatattacttgcaaacattgtctcccattctgtgcttttcgctttcttaatagtatcctttaaagtgcaaaagttttaattttgatgaagactaatttatctacatattttttctttggttgcttgtgctttgggcattatagctaagaaaccattgcaagagtttgtatactttcagctattatagtcagatctttgatacatttttaagttaatttttgtatgtcatgtgaggtttttggtttgcttttacaaaatgtattatgtatttttacttaaaatacatcttggatatctctatcagccagtagataactgtcatttttaagtctgtggataaaagagcgtgttactttgccaacttgtaaactcccctttctggaacgatacctctgcaagtctacctgccatccctgctgtttgttccttattctgtagaccctgttcaaagcagaactctagaccaattgctttcagatttgctttcccttttaataaggcacccatctaattttgagatgaaataatacccttcttggaacattcagtgactccttggaattcatataataaaatgcaattagggagggggcacaatctgaaatagatctgccctttcatactctttagactattactctgtattagtctgttctcgtactgctataaagaaatacctgagactgggtaatttataaagaagaggtttaattggctcacagttctgcaggctgtacaggaagcatggtggcacttctgcttctggggaagccccaggaaacctacaatcatggtggaaggcgaaagggaggcagagacatcttacatggcagaagcaagagcaagagtggggaggtgctacacacttttaaaacaaccagatttcataactcctcattcacttgccatcaccagaacagcacaaagaggatggtgctaaaggctaaagctttcatgagaactccacccccatgatccagtcacctcccaccaggccccacctccaacactggggattgcaattcaacatgagatttgggtggggacacaaatcgaaaccatatcactctgatagtttcaaggaatatttttgttgcttttcattgactttccaatttatgatccttactgactttactacttggaattctcttacaaaatctgtttttcactgtttatccaccttgcaattaataaaagtgtcctgtttcacaaaatgattaaaattatctataattttctcacttaacaatatgtctccctcacattatgctttcctttccactttgtttgtttgtttgtttgcttatttgagacagggtcttgctgtgtcacccagggtggagtacagtggcacaatcacggctcactgcagtctccgcctcacgagttcaagcgattctcctgcttcagcctcctgagtagctgggattacaggcatataccaccgcaccggctaatttttgtatttttagtagagatggggttttaccatgttggccaggctagtcttgatctcctgacctcaagtgatctgcctgcctcagtctcccaaagtgctgggattagaggcatgagctaccacgcccagcctcccttccactttagttattattattatttttaaaatagagtcttgctctgtcacccaggctgaagtgcagtggcatgactttggctcactgcaacctccacctcccagattcaagcaattctcctgcctcagcctcctaagcagctggagttacaagtgcgcaccaccacacccagctaatttttgcatttttagtagagatggggtttcaacatgttggcccggctggtctcaaactcctgacctcaagtgatccgcccacctcggcctcccaaagtgctgggattttaggcatgggccacacgcccagccaaatgaggaatcttgagaaaacttggcaatgatatagttctatacattgctgctgtttttcattcccttttctacccccttcttttccctacatcattcttcattctatttccattttacatgacaaattttgttacttatttaattattcccagactgacatttgagataacagtaagaaaaccttatttttagtgttatgtttcccttctagtggactaatactttccttaggtgccttacccttcttttaagcacacggcaataagaacagttttctcagccagtcatgttggctcatgcttgtaatctcaccactttgggaggccaaggtgggtggatcgcttgagcccaggagttcaagaccagcctggacaacaaaataatacccagttactaaaaaaaaaatttttttttccttctagaaagcatttaagttaccttatgcatttcaagaacaaataattcctaataaatgttttaaattgaccttattccatattttgagcgattgatttctatccatgcacacctgcttaccatttcctccactcaatttgtatatagcttcctgtccagtatagttttcactagctacatgtgggtatttaaatgtaaatttgttaaaattaaatgaatttaaaaattcattttctcagttacactaaccacatttcacatactcattagccacataaagctgatgggtactacagttgacagtgcagacacagaattccttcatcatcacagaaagttttatttactggcactgctacactgtttgacttattcctacttgcggggctgacatttgaaattattgtaaaccattccctgtttaataaacttattttttttttttgagacagagtctcacttagtcacccaggctggagtgcagtggcacgatcttagctcactgcagcctccgcctcctgggttcaagcgagtctcattcctcagcctcccgagtagctgggactacaggcatgtgccaccatgcccggctaatttttgtatttttagtagagatggggtttcaccatgttggccaggctggtcttgaactcctgacctcaagtgatctgcccacaccgtcctcccaaagtgctgggattacaggtgtgagccactgcatctggcctataaacttatctttgatggactcttgttagtggtcattgttgcagaaatcttgcaatgccccatagaagtgttttgtatttttgtttgttttaaagagatgggggtctctctatgttgcttaggctgtactaactcctgggctcaatgaatcctcctgcctcagccttccaagtagctgggactacaggagtgcaatactgtgcttgggagaagttttaaaattgtttttggcagttttgtgtggcaaatataaaagtcattttaagctgaaatattttaagtcagcatcctatttatgttttaaacacataatatattcacatgataattttaagtaagaataaagaatatacggtgaaaagtaaatcttctcatgtcttcctctcagttgtccttggagagaggcatgtactaaaacaaggttctttgtgtgttcttctagattttttatcttataagcatatgtgtgcctgtcttcacttttgaaaatgtaagtggtagcatcctatgcatactttttatcgtgtgtgtgtgtgtcaggtcttaagtctagatgatttgtgtttttacattcatgtattttggaaattattccatgtgggtacccgtaaatctgccttatttttattgcatagtatttcattatataggtgtattttaacttatctactcatcttctattgaacatttaggctgattctaacattttactattgccaaatagattacaatgagtatctttatttttgcaaatgtgcaagtatagcaatatgagtagtagtactgggagagcacaggtctgtgctttttaagactttgatagattctgccaaattgccctccctaaagactgttccaaattacacatttacctacagtgtatgagaatgtctgtttctctgtccctcatcattacggcttatcataaaactcattgtagagcagtattattaaagattgtaataaaaagtttattttattaaattttggctgggtgtggtagtgcatgtctgtagtcctagctaccccggaggctgaggcgggaggatggcttgagcctgggaggttgaggctgcactatgttgcccaggctggccttgaactcctgggctcaagtgatccttctgcctcggcctctgaaagtgtggggattacaggcatcagccactgcacccacccggtaatgtactttctataatggaaataaattaagagctttgagtgtagctattctgagttgcaaacttatctgtatactttggataaaaatatctgagctaacatgtactaagaaacctgagcttacttggaagactgcttcacttttgcatgaagttagaccctaaggtaatcagagcaatctataagaataacttttctatgcattagtaataagttgtcacaaaaagtaagagaaaaaatatcccatccacagtagcacagaggtataaaatatctaagaataggccaggcgcactggctcatgcctgtaatcccaggactttgggaggccgagattagtggatcgcttgaggctaggagttggagaccagcctggccaacatggcgaaaacctgtctccactaaaaatacaaaaattagccaagcacagtggcgtgtgcctgtagtcccagccactcaggaggctaaggcacaagaatcgcttcaacccaggaggtggagattgcagtgagctgagattgtgccactgcactccatcctgggtgacagagtgagactctgtctcaaaaaaataaaatatttaagaataaagccacatgagatatgaaagcatgaaaggcagaatattataaactacatgacctcaaacccttgtactgcaaaagcttagaaatactgaccaaatataacaaatatcccattaaggatataatttagctcccaagaaagtaaggcggctctcccttgggctaaaatggaaaacaatttaaaaaccagagtagaaagtagaactaatgctttaagaacatgagagttggtggaggagcagttgttaatgacgtgttactcctagtggaatagcctcccaccccctaataaatagcccagctaatttatgccattacatacacctagattttagttccagaccttgagctgtgggaccttgggcaaggcctctttgaattccaggtttctcacctgcaaaatggggaaacaatagtacccaccttttctggtggctgtataggttaagttaaatggaaataacacacaatatattgagtgctaactgtgttccagggcagtgccctaagtggtatgtataaattcacttctcttcataaggtggactgaattgtgatgccctccaccaaatccctatgttgaaaccccagctcccaatgtgatggtatttgtagatgaggccttttggaggtcatttggtttagataaggtcatgagggtagggccttcatgatggggttagtacccttataagaacagcaccaggcagtttgtactcctttcccggtctcccctgcatctggtatcaggacacagtgagagcgcagccatctgcaagccaggaagtatgagcccttactgaggaacaaaatcggctggcatcttgatcttggactttacagcctccagaactgtgagaaataaattattgttgtttaagccattcaatctatggtgtcttattaaggcagcctgacctaatacataaggcagcaaaggcattcttaccataaaggcataggttataatggcttcctggtgacaagagacaaggtgatgagtcaggtagctggaaataagatccttgcttccataaagctaggattctcaaagggtcatatgctcagttaaagcctggcctagaaaatattcacaggaagatgaaaagcaagtttattcatcttagtctgagttctgggtggatgggggaaaaagtgtctgacttgagtattcataaccagaggcttgtgctcatgaaagtctgagattcaaatttgtttaatttacatggttcagcaatccctaagccagtaagctaccccaaaaagacagtccaaagctagaaaacaactttgggccacactctcacatcaggttacacaaatttctgtggatacagctacactttacatgagttcataatgcaaaattataaaacctacaaaaaaaatagccaaccagagtgtcatgatacatgacgtagaacataatcagaccttcattaactggtgatagcagactgagtataaatcaaaatgagtatgaaatgattatagacatttaaaaaggaatcgaaaaagaaagggatactatatttagaaaaaagaccaggctgggcatggtggctcacgcatataatcccagcactttgggaggtggagatgagtggatcacctgaggtcaggagttggtgaccatcctgactaacacaataaaaccccttttctactaaaaatacaaaaatagctgggtgtagtggtgcatgcctgtaatcccagctactgagtaggctgaggcaggagaatcacttgaaccctggaggcagaggttgcagtgagtggagatcgcaccactgtattccagcctaggcaacagaacaagactctgtctcaaaaacaaacaaacaatcaacaacaacaacaagaacaaaacaaaagaaactaggtatatttgaaaaagaaccaaaaagaaaaactcaagggaaaagttaaacaagtgaagagtattattgaatttttgaatgtatactagaaagaaattacccattatgtaacagagggagaaagagagaggctgagtgacattgcagataaaatgagaaagtccaacatagttaatagaagttctctaggggggaaaaaggagaggagaggagaggcaatatttaatgagaaatggctggacttcatgaagttaattggaagaaaagacagattatctacaaaggaatgacagattaagaccgtaatagtaacaatagagatcctgagagaaattactatctagaatttttttactagctaaattattcaaaattgaaagtaaaatagacatttcagacaaaaatgtgagaatgtaagctcagtgatgaaagggatttttctttctccactgctgtatctctactaacttgaacaatccttggcacatagtaggcatttagtaagtatttgttgaataagtgaaaaattgaacagtctctcacagttgcttctggaagagggaaattgaaatgagaaggaaggattgagatacaagaaagactattgagtagaacagttgttaaacatgagtaaatgtaaataaatatactttagtggtggctcatgcctatcatcccaacactttggaaggctggggtgggaggatcacttgaggtcaagagtttgagaccagcctgggcaacatagaccctgtttctacaaaaaatttaaaaaattagctaggtgtggtggcacacgcctgtaatcccagctactggggagtctgaggtgggaggattatttgagcccaggaggtcaaggcggcagtcagccatgatctcaccactgtactccagcctgggtgacagagtgagactgtctcaaaaacaaaccaaaaataaataaatatactttataaaactactataattttaattatgtctaatatgttacagttttacaaacaagatggaaataaagttcctgacaacaataggatgtaaagcagaaagtagagattgtagttaaagtagtctaaggttgtgttttttttctgggaagaatttagagatgtggtttagttaaaattcagatgtaataaatttcaaggatagggtttttattttctggaatgtgataaactagttttctgaggaaactattctcattctagtacacctgaatatgctattgacagggacaaaatgagcaatttttttcctacatagttgaattattggaaggccagaaacaataagaaaacatgagcaggtgctaaagccagcatttgcctgttagtatcttctgattcctggtgtctctgagccggagttttaatcgtaatagagggaactttccctaacttactttatgatgatagtaatttaatattactatcaccagacaataacatttttgtaaataaatactaaggccattttcaagcctaaataaaggaccaaaagtcctaaagacattgttaaaatgtatttagcttcatataaaccaataatacagcattatcaagttaagttgattttaggaataaaagagtggtttatcatctgaaaatatgttaatgtattgtatctgttaatcatctaaaatctgtagcattaacagactaaagaggaaacatccttggatcatctcaacagatgcagaaaaagcatttgataaaattcagtaagcattcatgataaaaattcatggtaaattcaaaagggacctttcttttctggaccaggatggattgttctgtattgctcctgctaagtatagctcaaaaccctggacactgtatgtaaaacaaacataggaagaatttgaaaggtaaagagaagacgacagaccagctaggggtttcacgacccatggaatgacatagcagtgagttccctggacttgcttgattgtttatttgcctcatataacgtaagtgttggatcaactggcaacttagtcagaaatggcaatgggaacatacaccccaagaaagccaaaaacagccttttctctttaaaagatggtgaaagaggaaacatagcaagacagaaacttttggacaataaccacgctactctagccacatgccatggaaagaccatggctcctccccttcgctaactcctgttaacccctgttaatgatagataaaaggtgtagaaatttgaaaaatatttaatccacaggaaggcaggaaaaagaaaacggaaaatagaaaataaaatgtcagacttaagccctaacattttaataattacgttaaatgtaaatagtctaaacacacaaatttaaagacagttggcatattggatataaaaacataatccaactatgtgagtgatacattcaacaacttggcattatgctgagtggaaaaaaaacaatctcataaggtcatattctgtgtgattctctgggtataacattctgcaaatgacaaaatgatggagatggagagcagattaatggttccaatggtttgggatgatgagggagggtgtagatatgactataaagtggtagcaagagggagatcttcgtgttgatggaatagttttatatcttgattgtggcaatagtaacatgggtctacatatgtgataaatagcacagaactacgcacacacatcaggttttttctttttgatattgtactatagttatgtaagatttaactattgttgggaactaggtgaagggtacataggacctctctactatttttgcaactccctctgattatttcaaaataagctttaaagaaacctatagcaaacatcatactcaaaattgatttattaaaagtattttctttaaagtcaggaacaatacaaggatgcctactatcatttcttgtttgtttgttttttttgttttttttttttttgagacagagtctctgtcacccaggctggagtgcagtggcgtgatctcagctcactgcaagctccgcctcctgggttcacgccattgtcctgcctcagcctcccgagtagctgggactacaggggcgtgccaccacgtccggctaatttttttgtatttttagtagagacggggtttcactgtgttagccaggatggtctcgatctcctgacctcgtgatccgcccgcctcggcctcccaaagtgctgggattacaggcgtgagccactgtgcccggcgcctactatcatttcttacattcaatagtttacaggcagtcctattctatgcaataagatcagaaaataattaaggctgggtgcggtggcttacacctataatcccagcactttcagaggctgaggagggaggaccacttgagcttgaaagtttgagaccagcctgagcaatataatgagaccttgtctctataaaaaataaaaaaattagccaggcgtggtggcaggtacctagtcttagctactcaggagcctgagccctggaggtggaggctgcagtgagctgtgtttgcaccactgcacttcagcctggatgacacagcaaaaccctcaaaaaaaaaagattttaggcgtggaaagagaaaaaattataacctgtaagggagtctaggcaatgagtacctggcatttttactttctattatatattgtgagataggctctttctctcaccaggttttctctgaaactgatgatttctaatcctaagagccaagggaaaagagtaacaaaaacaataacatgtccacacactggaaaacttatcagtgaaaaatatacttcatgggatggcaagaagcaacataggattgtagttgacatgcagctactattattatattattatgattattaattttactcttcaagactcttatttggtgtgagtctagatctgttagaaggtcactgatgaaaaaggatgtgtgggtgtccaagctgatctgattcatacagctcaatatatttatttattaattttgagacagggtctggctctgtcacccagactagagtgcagtggcatgatcaaggctcacggcaacctctgcctcccaggctccatttttatttattattattatttttaattaattaattaattttttgtagagacagagcctcaccgtgtttcccaggctcatctcaggctcctggcctgaaggagttctcccaccttgaccttgaaaagtattgggattatagccgtgagccaccgcgtctggttaagtggttaatttagaaatgtgcagagttaatgttcgtgtttttctttttcttttctcttttttctttttgagatggagtttcgctcttgttgcccaggctggagtgcaatggtgcaatcttggctcactgcagcctctgcttcccgggttcaagtgattctcctgcctcagcctcctgagtagctgggattacaggcatgcaccaccacgcctggctaattttgtatttttagtagagatggggtttctccatgttggtcaggctggccttgaactcccaacctcgggtgatctgcctgcctcggcctcccaaagtgctgggattacaggcgtgagccactgtgcccggccagtgttcgtgtttatttttcatagcgttaaggaactgggtgagaatcaaaatctggaggagagtttagagttttcttcatggttaaatttaaaaaattctatagaacaaatatatttagtgtgtgtaggccgatggcgttagatttccatacactcaacattggggagaaacctcattggcagtggagtggctggtggtaccagctgggggtcccttctttggtcctttgagtgcagagtctttgccctggttgttccctgctttcactattaggagaagccacttgactcatggctggcagatagcacaccagtttcagtaccttgctaaatttatagaaaaccagtgtattaaacagcgaggtatagatagaaactgttttccaacagtgggtatttgaatattaagtagtagtaaattagccaggtgtggtggcacacacctgtggtcctagctacttgggaggctaaggcaggaggattgcttgaaccctggaggtcaaggctgcagtgagccatgattataccactgcactccagcctgggtgacagagcaagaccctgtgtccaaaaaaaaaaaaaaaaaagtaaagacattgttttctttaaattttcaaacttctaaaaaagaacagagaataatatattgcatacccatgtagttgccaccttaatttaacaaatgttaatgatttgttacattagtcaagattaaaaaaatggtgtacagtggataaagttgaaattttctttactgtctcaatctctctttcccaagctgtagtcactctcaaagttggtgtgcattccttccttttagggttattattattctaaaatgtgtgcatatgtctatttgtctatcatgcagatattcattctcttatttttttctgaacgttttaaagctttagtgtcacatttagatgtttaatccatttataattcataattgtgttagcatgaggtaagggcttaattttgtctttttgtatgaataactcatcattactagttttgtctttagcagagtttgtttatgcaggtataagcaaatatgaatatatatttttatttgttccccttattttgtattctttaatttttaattttggggtatataatacatgtatatacttatagggtacatgagatattttgttaaaggcatacagtgcttaatcacattagggtaaatggggtatctatcacctcaaccatttatcctttatttgtttaacaatctaattatatactcttagttattttaaaatgtacaataaattattattgactgtagtccccctgttgtgctatcacatactagatcttatttattctaactatatttttatacccattaatcatccccacttcccccccaactactctttctagtagcttctgttattggtagttctactgtttccatgagttcaattgttttaatttttagctcccacaaataagcgagagcatgtgaagtttgtctttctgtgcctggtatagttcacataacacaatgacctccagttccatccatgttgttgcaagtgacaggatgtcattcttttttgtggctgaatagtactccattgtgtatatgtagcacatttttgttatgatgaacacttaagttgcttccaaatcttggctattgtgaaatggtgcttcaataaatgtgggagtgcagatttactgatttccttttttggggtatatacctagcattgggattgcaggatcatatcgtagctctatttttagtcttttgagaaacctccaaactgttctctatagtgactctaataattatattcctgccaacagtgtacaagggttccctttctccacatctttgccagcatttcttattgcttgtcttttggataaaagccattttaactggggtgagatgatacctcatagtagttttgatttgcattttgctgatgatcattgatgtttaacaccttttcatgtacttgtttgccatttgtgtgtctgtcttttaaatttttatttatttatttattttgagacgttatctcactctgtcacccaggctggagtgcggtggagcaaattcagctcactgcgaactctgcctcccgatcttaagtgatcctcccacctcagcttcctgagtagctgggaccacaggtgcatgccactatacccagctgattttgtgtatttttggtaaagacgagttttcaccatgttgcccaggctggtctggaattcctgagctcaagcaatccaccttccttggcctctcatagtgctgggattacatgcgtgagccaccatgcccggcctgtccgtcttgttttgacaaatatctattcaggtcttttgcctgtttttaaattggattattagactttttcctattgacttgtctgagctccttatatattctggttattaatcacttgtcagaagaatagtttgcaaattactttttctcattctgtcggttgtctcttcactttgttgattgttttctttgctgtgctgaagatatttaacttgatgtgatcctatttgtccatttttggtttgattgtcatggggtattcagatcatagcacattcaaatcatagcacttgtttgtacattttttttcttttaaacttcatgcattttgcatacaatttaagaaatctaacccagggtcactaagattttctcctatgttttcttccagatatttcatagttttatctctcacatttagttctattcctgactcatttcaagttttgcatattgtgtacagtaaggataaaataagcaaatatgtatatgcacttgcatatgaatatcgaatttttcagtaccattgttaaaaagattatcttttccctcaattgaattgccttggcaattttgttgaaaatcagttgacccatatgtgtgtgggtctgtttctgaactttctaattttttccattgatcattatgtctttttatgccaataccacactgtcttgattcctgtatctttataatataacttgagatcaggtagtataattactccaacaccctttttcccccaaaatgttttttggctcttctgatcctttgcgttttcatataaattttaaaaccagcttgtcagtatctaaaaaaaaatgcctgctagaattttgattgggtttgtcttgaatatgtagattaatatggggaaaattgtcattttaacaatagtgagtcttccaaacattgaccatggtatatctcttcatttagttacttctttgatttctctcctcagtgtttatagtttttaacttacaggccttacatttcttttgttaaatctattctaagaatttaatattttggggggatgctgttgtacatagcattttttaaacaggaagaaatacatataaattttattattacatgcacatgtgcgcatgggagtcaagcaagatataaatattcagagaaagataagatggttcatgcttgtataccatcttttgggggccagatgggaaggccattttttggatacataataactgtacgtatttatgaggtacatgtgatatttctgtacatgcatacaatgtgtaatgatcaacccagggtatttaggatatccatcacctaaaatatttatcacttctttgtgttgggaacatttcaaatcttttcttctagctattttgaaatatgcaaattattgataactataatcaccccagtctgtgatcacacactacaacgtattccttcaatataactgtatgtatgcattaaccagcctctcttcaccacccttctcccccttcccagcatctggtagccatcattctactctctgcctccaggagatctcctttattttagctctcacatgagtgagaacatgcaaaatttatctttctgtgcctagcttatttcacttaacatgatgctatccagttccatccatgttgctgcaaatgacagggtttcattctttttatggctgaatagtattccattgtatatatataccacattttcttcatttatttgttgattgacacttaggttgattctataccttggctatcatgaatagtgctgcagtaaacatggggatgctaatatccctttgacatactgacatcctttcctttggataaatacccagtaatgggattgctggatcatgtggtagttctgtttttggttttttgggaaacccccatactgttttccataagggctgtactaattcacgttcctgtccacagtgtatatgagttctcttttctctccatccaggccagcatctgttatattttgtggttttggtgatagccattctaactggggtgagatgatagctcactgtggttttgattttaattttcctgatgattagtactcttgagcatttttttcatatacatgttggccattcttttgagaaatgtctattcagatcctttgtccactttttaatgggatttttttttttgctcttgatttgagttccttatatattctggatattagtcccttgttggatgaatagtttgcaaatattgtctcccattctgtagtttgtctctttattgattgttacttttgcggtgcaaaggctttttagttttatagggtcccatttgtctatttttatttatttctatgcatttgaagtcttagccataaaatctttgactagactaatgtcctgaagtgttttcttctagtagttttaaagttttgggtcttatatttaactcttgaattcattttgagttgatttttgtgataggtgcccagtttcattcttctgtaatatggatattcagttttcccaacaccatttattgaagatattatactttcctctgtgtttttctggtacgtttgttgaaaaatcaattggctgtaaatacatggatttatttctgggttctctattctattccattggcttgtgtctcagtttttataccagtagtaacctgctttggttactatagctttatggtgtattttgaagtcagatagcatgataccttcagctttgtccattttgctcagcattgctttgactatccagggtcttttgtggtttatatgaattttaggattgttgtttctatttctctgatgaatagcattggtattttgatagggattgcatttaatctctagattgctttggataatacagtcattttaacaatattcttagagcctatttgcatagtacgtttttccatttgtttgtgttctcttcaatttctctcatcagtgttttgtcatttttgttgtagaggtctttcacccttggttaaatttattcccaggtattgaatattttttgtagtaattgtaaatgtgattactttttaaatttctttttcagctagtttattattactgatttttgtagttgattttgtattatgcaactttactgaatatattgatcagatctagagttaaaaacaaacagtggagtctttaggtttttctatatataagatcatgtcatgtgcaaagagggacaatttggcttcctcttttccagtgtggttgccttggatttctttctcttgcctgattgctctggctaggactcccagtactaagttgaatgagagttgtgaaagtggggcattgtctactaagccagacaatggcagaacaaaaaaataaaactacaggcaaatactcctgataaacacagatgcaaaaatcgtcaacaaaatactagcaaaccaaatcaagtaatatatcaaaaagataatataccatgatcaagggggatttatcccagggatgcaatgatggttccacatatgcaaatcaataaatgcgatacatcacatcaacagaatgaagaacaaaaactgttaagatcatctcaatagacatagaaaaggcgtttgataaaattcaacatcccttcatcataaaaaaaaaaactctcaaaaaattacacattaaaggaacatacctcaacacagtagaggtcgtatgtgacaaacccatagcttacatcctactgaatggggaaaagttgaaagcctttcctctaagaactggaaaaacacaagaacccatatttattgtgttcttgtttgttgttgttgttattttgagacagggtctcactctgtcacccccgctggagtgtggtggtgctatctcagctcacttcaacctctgcctcccaggctcaagcgagtctcccaccccagccccccgagtagctaggatgacaggcatgtgccactacacccagctaatttttgtatttttagtagagatggggtttcccatgttggccaagctggtctcgaattccttaagtgatccacccactttggcctcccaaagtgctgggattacaggtgtgagccaccatgcccggctgaatgtttcttttcttcttatattgatatttgtgtatgtgttataacaattccttcttttaatgttatggagtggcttttttagggaaagactttttttctgtagatgtatctatattgttgctggggaaaggtgttttggctttgattctgggtgggtgcagtagtgtagtctccgtatgatttcttcacctttactcggactagtttcttggcttctcagtggtgtaggctataattgttggcggaggctgtgacaagactttgctggggactgatatgccagatgggctggtcctctggaatcagtagtagcagtggcattctaggaatgccagtctttgggctcccttgggcctccaggtggtatgcttgggtgctggcagtgccagtggctgaccaagtgggtgggtccttggatccccgcggtgacgtgtgaggagttgacagtggtggcagcagtggtgcgccagtccttgcaccactcagcagcatgtgtggcttttagtggtgggagcaggcttgataagctagtccctagacctccaggaggcatgcagtgatgggtggcactggtggtaggataggctaggttttgctctggagaactgtcctgcatactgtagaatgtttaccagcatccctgttctttagccagtaaatgccagtaacatcacatgggaacttgttagaaatacagtttcacaggccctgctgcactgcactgagtctagaaactaaggtgatgtggcccagcattctgtgctttaacagccctcaggtgattctaatgtatgctcaagcttgaaattccactgccttggtagattgcaaggttccccctgcccccagaaagaacctgtattagtcaaggttctctaaagggacagaactgatagggtgtgtgtgtgtgtgtgtatgtgtgtgtgtgagtgcacatatacatatatgcacacacacacatatctatatatgagagtttattaggagaattgactcatatcatcacaaggtgaagtcccacactaggccatctgcaaactgcggagctgggaagccagtccgagtcccaaaacctcagaagtagggaagccgacagtgcagccttcagtctgtggtcaaaggcccgagagcccctggcaaagcacaggtgtaagaccaagagtccaaaagctgaagaacttggatgttcaagggcaggaatcatccagcatgggagaaagatggaggccagaggactcaggtctgtcttctccttccgcgttcctctgcctgcttttatcctagttgtgctgtcagctgattaaatggtacccacccaggttgagggtgggtctgtctctcccagtccactgactgaaacattaatctcctttggcaacacccttacagacacagccaggaacaatactttgcatccttcacatgcaatcaagtggcactcaatagagtgtcacattacagaaccattattatcactatatcgttgactagcataatggcaaatttatgcttattgaccaattagtaattgcagagcttaatctttttaaggtagctttagccaggctattcagagagatgtgtatgtactttctacacatttgtgaaaaagaacaccagttgggaagaggatttgaactgaaatgggactacaaaaggtagtctccagtgagagacagactttgtttcaataaaaagaatagattttagtaaaatcctgtctgaaaatggagaggacgtgtgaaaggtacagaatgacccatctcttagaagtattaagcaggacttggatgttagttaaggtgaagctttcagtagtaatgcaggataaggagaatggcagacgtatactcttaagcatcctttccaggttttgtgttttagggttttcttcacctttttttttctcctgtggcacgtagctctaatcttctttgatagctacttggtgctttctgagatttagcagttttcctgcatgtatggtctttgacctttcccaggagttggcatgtgcactccagtgtgggattctttcctgtgtagttctctactgcctttggaaacagcgctttgtgattacattgacaggagctcctcttactatctgcttattttcagaaagaagttatttctcattcttgttttaaaggttattatctagatctggcctgttatgctcttcttttggtgtgaacagaatagaggggatttctatgctaggttttaaataaggaacatttgtaacttaaactttcagaagatatctcacatgaaactggctgcctgccacaggagtaacttagatctctccaccttgttgtcaggagcctggaacagagatttttgcattggatatgagatcagattgacttttaaggtctcgtctgactctttgcctttcaagttttgatcagaagtctcagctttttttctccaggtttagatttaacaatctaaacctagttctaacattggtatgtagtgcctaataaatgttgcttaagtaaaatgaacttggaaacattcttcatggtatcctcttttttctcttgcagttaaaagggccaaattccagggttcaccaggtaaggccagctttctattatgtcttttcctcttgtatttgctgttatttcaaagcaatttaaaaaaattattaattcattgatcaaattcagtaatttgattcattacttcactaaattaattcatgaaatcattaatctagtgaaaaattagttttcttacctcttggctaacccaattctacttctcaataataactatatatttagaggttttgatataccttttccgactttttctcagaaaaaagtctgaaatagtgtaaaaggataaatattgacaattagtggaaacaatttttttttttttactttaagttctagggtacatgtgcacaacgtgcaggtttgttacataggtatacatgtgccatgttggtttgctgcacccattaactcgtcatttacattaggtatttctcctaatgctatccctccccccgtcccccaccccacgacaggccccagtgtgtagtggataaatattgaaatatcagtgtatcatgtcttgcagttcatgaacctgtttcagcttgagagtgtgtgtatatgtatctattgggtcatatataaaatttcttaaaatttaaaatattcaaatagaccatgtgaaacatatcttatgcaacctgcttttcccccagcaacacatcatgaaagtgtgtgtgtgtgtgtgtgtgtgtgtgtgtgtgtgtgtgtgtgtgtatgtgtgtgtctggttcgttcttttaaggtgctgtacagaattttgttgtagatttgtaccctgattaataggtccctgattgattaatacttgattaatatttaggttcccaagtttttgctattacaaataataaatgttcttgtgcacttctcattgcttgcttttgcaaatgtgtctatgtactagattcagaagtagaattgctgggtcaaaagtgtatatatatttttaaaaatttggtaactcctgccaaattgttctcttgcaagtttttactatatataccgagaccaaaagtttatgaacatttattttcccaaatccttatcaacatttgatatgaaactttaaaatctctgtccatctgaagattaaaaatggtatttccttattttaatgtgcatttcctcaattttgattgtcacattaggaagacttcctctggttactgctggggaaggagggaggggagctggagggttactggaaatatatgaatacgcttgagaacccaggaaaacctgaaaaactggaccttgggtgcaacagtaatgaaagcagtttctgagcagtttcttgttttaaaggttattatctttttgtctctgctggctctttttttctgagaatctgctctgttgtttctctcccagctggttttctatgcttacccatcttgtacccataatagctgcctcagtggaatttataccccttccttttagcttcagcaccaaccaccaattgtcaatatttatctttttaccctatttaaaatcttttgagagggaatcaggtttgtttcagcttttggccagctcatggattggctgctcttgggttatttactcttggtctggtcagctatgtgtgattggatgttggggtggagtacaaaataatgtaatataaaacatagctcagtggcctactgcactactactactactggatatggatggagattccccttgtatgggcttttatcctcatatatctttaatataattataaattttccatgttgataagtataaaaccacaccattttaaatgatatttaaaagaaagacttaccttcagctgaaagtgtatgacgggttccattttctcatatcttctgtaacattaggtaatcatgttaagcaatgtttgccaatttgatgagtcaaagtgatagtttgctattttttcattgtataacattaggattaatttcttacatagaaaagcaaaccctcaattcagtgcccctaatcatggctgatgtggatgtagtgaggtgagtgccaaatgtgctgtaataagaattaggtgagacacctgagtttgaagtttcaggccaccacctttgtttagtaatcaacttgtttagtactcaactctcaggttagagaatttccttttctcaactctgtgataatatttctttttttggctgggcctggtggctcatgcttgtaatcccagcacttttggaggccaagatgggtagatcacttgaggtcaggcatttgagaccgcctggccaacgtggtgaaaccccatctctactaaaaatacaaaagttagctgggcatggtggcgcacacctataatcccagctacttgggtagctgaggcatgagaattgcttgaacctggtaggtagaggttgcagtgagccaagatcatgccactgcaccctggtctgggtgacacagcaagactctgtctcaaaaaaaaaaaaaaaaaaaaaagatttctttttatgtaacttgtgctttaggccaaactgagtagatcgagcttgaaatctattttctttgtgaagatttttccttaatttttgtccctgttaacagctcagctctgcagttctttatcactttttcttttttccttctggtatgtatctctttctacattttattaaatttacgtaccttatctttcctagtaggtcaattagatttggatttttccccccagatggcaagtgggctatataattaacatagtaggttaggattaacattgtaatagattaaataaattagaacaggaaatatcaatgtatcatatcttggcattcatgaatctgtttcagtttgagtgtgtgtgtatgcatatctgttgggtcatatataaaatttcttaaaattaaaaaaatagtattttagattatgctcttgaagatagcacgtagttttataatttcggcaactctgctatgtcttgaatgaggctatgttgtacaatatagcttaattttttcctgcacatgtaatactttaatttctatattgcttaattccaagggctttgtgagatgggtaacaatctgagcactaagtattatgtctccattttgtattttttcaaagataaatttaacacatatgtgaccctgaaagtacagaatgtgaagagcacaactgtagcagttcgtggtgatcagccttcctgggaacaggatttcatgttgtaagtattttgcagcagcagtgtgcctacatattttataatctttttaagggaattgcattggatgaaacaattagaagattttgtgtatttttgagatttataaaatgtactggcactgttaaatactgttttgaaaactgtggagttatagaaataagtgaggttcatggtacatgaagcacaactgcagttttgttttctcatggattcgtaatttgttcttagagatgaatgataatgcaggtaaactcccaattgatttgtgttggtgaaaaactacataggcagattttctcagtggtcagaattagaatacagtacaacagacttagcatgacattaaacataacttcatctttctttgattctgagaaggctctttgaaggaatgtggccatgcatgtgagagactgtatcttcatgtgtacctcagtcatctgttttagaggctgaagatttctgtgcttataatccttttgctttatggagtaaaatgtcctatattcaattaattaaaatgaataaatattagtagaatttctcgtgtatgacaaagtttagtatattatgattttaattaaactttggctttaaaaacttgttatttctttcttttgtccctttagtttcaggatttttttgttcctgttctacaaaaggggagaaaagtatagaatatattgaaggactgggcaaatcatttagcttcatagggcactagtttccttatctgtaaaggtcttcctttctcagaagattatgcttgttttttctgggagttggaggtgggcatgaaggggctgaatgagaaaacgtactgaaatttgctgtgaaatttgaaactgaactgaaatcgatttgcatgttttatagtgcagctcagagggacatagggatggttattatttttaaggggagacatttccaatcctctgggctcttggtatattgctgctttttttttttttttttttttgaggcaggatctcactctctcacccatcctagagtgtggtggtatgatcatagtttactgcagcctctaactcctgggcttgagcgatcttcttgccttagcctcctgagtaatggaaactacaagcatgtaccatcacaccttggctaatgtttttattttttgtaaagatggggtttcactatgttgcccaggctgatctcaaactcctgggctcaagcaatcttcccgccttggcctcccaaagctgtgggattacaggtgttagccactgcacccagcttatattgcttcctataggaccattattgtgatagttaaaggcaaagattataaggttttgggctaggacaatagcagaagacgtagaaaaggatgaatagaaggtattcaggaagtagaaccaaaacattttcttggaagatgggttgggtggtatgccattcagtaggatagggattaatatcagttatggacaatcttatatttgagattcttataggacagataggaaggatgagaggtacagaagatagttagaaacctaaagctggcactcagggaagaagtctgctttggagaaatattttggtcagttgaagccataggtgaagatgagaaagcttagggagagaatgtgtatggtgagaaaagggactggagtagaagctggagagtggcagcatttaatgaggggacagagggaactaaaaaggattgaacagagaggtaggagagccaggagataatggtgtcttggaagctgagggagaactgggcttcaaagagaaggaggccaatggtgtcatgtttctttctcactggttgcttctctctcaagattatataagcctcatttattccctctctcagtgacagtgatatgagaccgagagcacctgtttccttctttacacatgcagtgtacagagtcagctacaaatggtttatgcaagtctctttccataccagtatgttagccatagtcctggctatggtttataaacctagcacttccagttggctataaccataatttccagttataactcttcccatcatatgaggcacagtgatcttctgcagcctctcatcagcatagccagcattattcttatgtgtttattttccaatttcccatagcacttccccttttgaccctgctgtgatatgtgtgaattttcttcctgtctctcccacgttgagatgctgtgtgaattttgccctcttcttttacacgtgggttttattagctactttctctacttttctgctcttcctactccttattcctcctatcctgtcctattttagttatttacttattttttttggttcactccttgcagaacttagtctactaccctgtccttttgtcaccggaatctccagtgctggtttcctatctcccgttctcctttttccttctccatgatgtattatgtggcagtatctaatattcgttttggtatttcttatattatttgtttttaatattttcatatcttgtttttaggattagattgttcatttcttaagggtaaggtgggcatcttcactatttgtgtgcatttgtgtagcccagagtctgctatacacgtgtttatgtatattgttgattgaattaacagaaaagaaacttccctagggtcctgggtatgaagcataaacagagctctcagacctctcttagctggacctgctgagcaaatgtaggtgagatgagaagcttcttatagaatatatactcattgtttgggccttctccctagagagttctctgaagagcagattttcttctttatctgttcaagtcaagctgttgaagacctctggctatttcttctgtctgttggcttgagatgctatttgggagttgatttgggaatattatatatgtatccccaagcaaatttctttttttctttattttgtgggacagggtctcactctgttgcccaggctggagtgcagtggcagcatcttggctcactgcagccttgatctcctgggctcaaatgattttcctgcctcagcctcctgagtaactgggactacagatgcatgccaccatgtctagctaattaaaaaaaatttttctgggagacactaggttttgccatgttgtccaggctggtctcaaactcctgggctccagtgatcttcccacctcagcctcccaacatactgagattacaggcatgagccattgcacctggcccaagcaatttttcgattccatattcaaatgatggataagtccaatggatttgaggatgtcacatatcttttccaagactaattggttaattaggctgaattaaattatgtgacaaaaagcttagtttctccactgtgaacactgtaacttagtggctaggcttattcatctactttgtggctctgaacagctctccagatagcttagaagtttttggacacaaaaactgagtcctatattatgtttctactccaaagcactaagtcatatgtcttgtaagtgctcaggaaatgctaattaaatgaataaattaactcagtacattctatgctgtattatatttatataaaagggacaaattttctttgctttattcattttcaacacctgacatgaattctgtggctgtcattctatatctcaaacttgtgaatctgagaacatttattttatagcacaacagggaacccaagctttctctaaagtacagacttgaagcttctacttgtgataaatagctgttgttttcctgagaatgcctttctgctttctctgctggaattggtcttttctcatctttcttggattacccctcaagtaaccttgtgtttcaataagagctttctggagaacgtttttagcattaacacaggtactatttgcgtattctagtttaatactgggattatgtttgagttagtccttccaagcagatattcaaccatgtatgatactgcttttaaatagtgcttatctggctctttatggaatgatttcttttcgaattttttcccctggttattattataggaaaatcattgtatttatcattatcccatggtaataattttgcttataagtgacagtgcctagcttaataatgattaatgagtctccagggactgagtggtgtgaactagcacactctagagcccctcacttgcctgtgaccacatgttcctatcaaacttatatgttctcagggaccctacttctacctggactccctttcataaatcccccccgccccgccccggcttttttggtggggatggagtctggctctgtcactcaggctggagtgcagtggcgtgatcttggctctgcctcctgggttcaagtgattcttgtgcctcagcctcccaagtagctgggattacaggtgtgcaccaccatgcccagctaatttttgtatttttagtagagacagggttttgcaacgttggccaagctggtctcaaactcctgacctcaggtgatctgtgcacctcccaaagtgctgggattacaggcttgagccaccatgcccagcctgataaatcttgtaaagtagacttacctttcctaaaagtttcctgtatacgatgtgtagtttaagttgaagcagtgttagttaacaataaaacatataaaactgttgcctatgggtggaaattggcaggcaggcctggcaataatgtccttattacttggcctcatattgtgtgaaactgcattagtctaattatgattgtatctccaaagcggaaagaatggatagacaaaggcatttttctttcttttcccgccccccctccccactgaggtttaattgggatataagaaactgtacataattaatgtatacaatttagacatttatatacttgtgttaccatcaccataatcaaggtagtaaatatatttatcacctctaaaagtttacttgtgtctccttttttttgttgtatgtgtgtgttaagagcatttaatatgaaatctaccctcttaaattttgaggtgcacaataccttattgctaactggaggcactatgtggtatagcagcaggtctctggaacttatttaactgtaacaaaggcagttttctatggatacctattataggtttcttggagcctaaaaatggtcgtggcattctgggaaattttgatttttcctgaagacaggatcctggtgagaaagcattcaaagtttagcaaaacaggagatgtagttgtttctttcatattgtctagctttcctcaaagggctttcctctttcccttagtgagattagtcgcctggacctgggtctaagtgtggaggtatggaacaaaggactgatctgggacaccatggtggggactgtgtggattgcgctgaagactattcgtcagtcggatgaggtcagtcattgcattttctgtttggaagtatggttcccagcccatgcttctccccatgctagctccactttagctaatattcatccatgcatcttggattattcttccccctttctaattagagggcatgcaacctgcctgttcctaacttcacctgaaggttcagatgattttatttatgtctggcctaccctgtgtcctgtgacaactcacaggctccagagcacctcttcagccttatcaggtagatagccccttctgaggtatgtgtgtgtcggtgtgtgtgtttacttagggtacttgtggtttctgtgttctcttctaagtcactgccctgggaggagtcccattaaacttccttagccagctggctggctattctctgctttgtttctttgagttaccaatctccaaggaactagttttcagtgcccttcttctgcatgtaagcctgacagagtttaaggaactaccaggcttggcaatttgtattcacactgtctctatacgttatttctaggattgaactcttgcctcactttcctagactagaccataactcagcatcatttccccactttggacctggacaaaatctgttatattcctgtttggtgttaacatggaccatgagttttctctgggagtggggaagttgaaattgcctgtattttctgtatttcttttagttctagctaagtctctactccccaggcagatgggcagttcattttcattgctgccccagttcaatcctatttagccagcaatgttagtagctttttactgactagaaacagtgacacagtcattaagaactgtgcaggttaaatattgatccacagaggtacttagttttagagtatggtactccagacattctgtcctcgttagacctgcagagctgagcacagtgaaagctgctctccccaccaaagagggaaaacagaagccacatgcagtggaggcaggtggtgatagtggtgtgtttgccttatcaggatgtgaatggccctcagaagctcaaacaaggaacttcagagaaaaaaacctgactcttgaactaagagggagccaagaaagattaaactttaatcttagatctttgtttcctaggaagggcctggggaatggtccacattagaggcagagacgttaatgaaagacgatgagatctgtggaactagaaacccaactcctcataaaattttgcttgatacaagatttgagttgccttttggtgagtaaaattttaaaactatttaataatttttaccatattgtttggaattgtttgctagttgtttcattaatgtatattttgtcacctcagccatctcctttgaggatattttgtcttcattcactctctttctcataacacttcacccagggaatggtgcaaagtagaatatagaatagtgctcattaaagaatctacactaaaaagcattctcttcaactcatttaattttctgtgactatttattataatgacttatgaaatatttgcttgttagatttattattttgaaaataaacatttattgtcttgaagtgactatatataccttctgatttgttaatttaagtattaaatagcactgataaatagaataataatttaaaatgtaaattaaatcacaatacatgctcatgataaaaattcaaatagtaaggaaatgtacatggataaagttaaaagtttattttcccagttcctttaatcttctctgcattctccagtgtgaaaccactgttaacattcttgtattttggtttagacacatgatatttattttccaaaaacttattttggcaaaatttggatcataccctatgtaatatttatttgctgatatatagtgttttacaaactgcttagacatttatcctgaacatcgctccatgttatactttaagatctgtcttattcatctgaacagatgcctctaccataatttatcttttttttttttttcctttttttgagatggagtcttgctctgcccaggctttagggcagtggcatgatcttggctcactgcaacctctgcctcctgggttcaagtaattctcatgtctcagcctcctgagtcactgagattacaggcttgtgctaccacacctggctaattttttgtaatttttagtagagacagggtttcaccatgttggtcaggctggtcttgaactcctgacctcaaacgatccgcccacctctgcttcctaaagtgctggaattacaagcgtgagccaccatgcctggcctaccataatttatttaagtaatcctttattgattgacaggtgggttttttcatttttttttttttttgatgttatataccgcaaactaataactctgtatatctttgcccattttgagtctagaataaatttcttaaagtagaattgctggatcaaagtataagtacatcattactttttatggaatctactaagttccttgtccaaaaggttataccaatttatactcttataaattatatctggggagtgcctgtttctgcacatccttggcagtcttttgtgtttcccaatggttaatctttatttgattattttgtatgatatcttatcaggggaaattcagcccccgatatttcacgtgggtccttttccatttttcctaagtgttggccggtctaagaaataaagggaaagagtacaaaagagggaaattttaaagctgggtgtccaggggagacgtcacatgtcggcaggttctgtgatgccccccaagccacaaaaccagcaagtttttattggtgattctcaaaagaggagggagtgtacgaatagggtgtgggtcacagagatcacatgcttcacaaggtaataaaatatcacaaggtaaatggaggcagagcgagatcacaggactggggcgaaattaaaattgctaatgaagtttcgggcatgcattgtcattgataacattttatcaggagacaggctttgagagcagacaactggtctgaccaaaatttattaggcaggaatttccttgtcctaataagcctgggagcactacaggagaccagggcttatttcatcccttatctacaaccgtaaaagacagacgtccccaaagcagccatttcagaggcctccccttagggacacattctctttctcagggatgttccttgctgagaaaaagaattcagcaatatttctcctgtttgcttttgaaagaagagaaatatggctctgttccgcccggcccacaggcagccagacttcaaggttatctctctttttccctgaacatcgctgttatcctgttcttttttcaaggtgcccagatttcatattatttaaacaatttgtgcagttaacacaatcctcacagggtcctgaggccacattcaacctcagcttacaaagatgacgggattaagagattaaagtaaagacaggcataggaaatctcgagtattgattggggaagtgataagtgtccatgaaatcttcacaatttatgttcagagattgcagtaaagacaggcttaagaaattataaaagtattaatttggggaactaataaatgtccatgaaatcttcacaatttatgttcttctgccatggcttcagcctgtccctctgttcagggtccctgacttcccgcaacagtatcttgttttagtttagttgatttctattagttttattttaattttttactgttcatattattgatatttgcatattctattgttattgctgtcattttatgatctcagtgtatttgtatcttgtatcctatggtgatttaagcaaaaatgacatgattttccagctagctcagaaagaactaaactcagaacaactattatttcagaaaaatagaaaggaagtctttcttgtgggactgtagaccaagctgcaagtgaagggaaaatcaattggagggagtgggtcttggttcaaataccacagatattgaccattttcaccaaattttagtagatattcttgaataaatgttttttcttttgctgtatgcacttagaaccatttccagagactttaaatcgttgtttttttaatgttgtattactttttgactgatttcactcactaattacatagttacaaatgttatataaaatagacattattcttctacttttagtagttgattttatttaaaaatcagggcctggcatggtggctcacacctgtaatcccagcattttgggaggctgaggtgggtggatcatgaggtcaggagttcaagaccagcctgaccaacatggtgaaaccccatttctactaaaaatacaaaaaattagctgggcaaggtgtcgtgcgcctgtaatctcagctacttaggaggctgaggcaggagaatcacttgaacccaggaggcatggaggttgcagtgagctgagattccaccactgctctccagcctaggtgatagagcaagactctgtctcaaaaaaaaaaaaaaaatcagtaataacaaagtaacatttatggtgaattattgtgtgttggtgggcatgtcactaagtatttacatatgttagctcagtaatcctcatttcagtcctttgaggcaggcccaactattattccccactttagagataagcaaactatggcagagagtatttaagtattttggccatggtctgactctagagcctgggcttttaattttaactatttgtataatacatttaaccacttcctgttgggtattttgattgtttgaagtttgtactgttataaatagcactgcaataaacatgcttgtatctctctgtatttttttcttcttaaaactatttttgtggaatgaggcaggaataaattaataatggtttaaaaagttatccagtgaaaagtcccttcagaaatccattttcttcctataggctaccactattaatactttcttgtgtatctttccagagtcagtttctgaatataagcacacacacacacacacacacacacacacacacacacaccaccatcttctttttaaaacgcaaatagtagcatattctaacacattccctgtgccttgctgttttgcacttagtatatcttggtgaatcatcccacatcagagcatatagacctgcagcagcagcagctcctctgccaccttgcacttcccactctccttctttgtaacaggtgcatagtataccattttatgggtgtaccatatggatgagaaagcactatacaaattacgttgtagactatttgaaggtgtgtgtaagtgtttttaaataagactttgaaatattgctaccagttgttaaagagctagttgaagggaaggagctgaagttttggacaggtggaaccaaggagaaaggaaagggctatatttgctttattcatgtggctactagaaagtgtatctgttgaaatgtctctgaagttgatatgatccatatattgcctgagtgtttctcttcagtgctggttagatggtcatacttgatgtttttaaaaggtgagttttggggagaagttgttatagtcaatgtaaaatgtttaggaatgaggatataccattataccattattttttaagaattcaaatattttcacttagagactcacttaacaaatatttgagcatctaatattttccaggcataaaacctgtgagtattttttaatagcttcttttaaaaaatttttaattgtggtaagagacataactgaaaatttagcatcttaaccatttttaagtgtacagttcactagtgttaagtacattcacattgttgtgcaacagatatccagaactttttcaccttgcaaaactaaaactctgtctccatcaaacaacttctcatttccccctccccacagccactggcaacgaccattctttcttttctgtgaatttgactactttagttaccttagagaagtgaaatcatacagtatttgtcttttttgtgatggactcatttcatttagtgtaatgtcctcaaagtttatccatgttatggcatgtggcaggattttcttccttttaaggctgaataatgctccgttgtatgtaaatctctcattttgttaatcctttcatccattagtggacacttgggttgcttcaactcttggctattgtgaataatgctactaggaacttgggtgtgcacatatctctttgagatcctgctttcacctctttcgtatatataatccaaagtgggagaactatgtcacatggtaattctacttttaatttttttgggagaaaacctttgaattttgagcatctcaatatctcagcatataacttttcttttaagctaatcctttggatggttttggtcttgctgaggggaaggtagtatggttacatagaaagaatgtagtttttggaatcatacaaaccatggtttgaatcatggctcatctctttataaactgtgaccctgaccagattattttagctctctgagcttcagcttcttcatctacaaaataacaatgggaataacagtacattgtattggtttttgtgaagagtaaagataatgttcatgacaagaaccaaaccatcagttaaaacttgtgcatcactaccaccttctgacttcagtcattagacagagtaaagtgttatctgctgatgatttattacctgctgatgtgatttcttttctttttcttcttttttttatggtagatatcccagaggaggaagccagatattggacctacaaatgggagcaaatcaatgccttgggagctgacaatgaggtaggagcagccttatttgcagtatagagagatgggggaaaatctccaatgctctttataggttgcccagggaggggcccaagagcatgttgtcctgagaatgaaatcacttaaattgcattgaagaaaaaaggcagctagaagattgcctgaaatgtcactagaaggttccatctccaatttattctgttcttcccactctcccatactgtggtactagtctggctgtagactcttagagagggagcttgtaccagggaatctgtcctcttttgttacacctgtgagttggaggcatttcttttgcttctactgtctctcagttttttggatattattcttatttgtgtcctgtttttgaggatgtttagactattgcattgtttgttcttgctggtcctaacttacctccagagatgaggctggtgtgtataagagaatgcattcagctcaacctggggcatcaggattggagaatgtttttgttattgctgatggagggaaaagatgataaatttgtttattttggacatgtgggctactaaaaaatgggtctgattataagatatactttgagtgccagaggatatttcagcagaaattgttgataaacaatttcatgagataatttgaagttgaggtttgaatgggtagggagctgtaggcatagagcttcattaatatattagtaacaattgaagtcataggaatggaaaaacttgctcaggtagagcgtatggagacagtattaaagaacaggaacaaaatcttgggaaaccttagacatagaattctgagaaacaaaggagactgagaaagggcaaccttaaagagagagaataagataaccaggaaagattaatggaacaaagaaaaaaagagattcaaggcagaaattcttgacagtatcacatgttaaatcaagtgaattatgaaatagagctattggatttggtgattgatgacgagtatacatccatagactagtacagaaagccaaaatgcagtggtttgatgactgtatttgtttcctacagctgccatcacaaagtaccacaaactaggtggcttacagcaaccaaaatttgttttcacacagttctgtagactggaagtctgaaattaggctgtcagcaggatcagttcagctccgtctagaggctctgaaggaggaagcatcctgtactcttctgcctctgatggttgctggcagtccttgctgttccttagcttgtagatgtatcattctaatctctgcctctgttgtaatgtgcctccctgtgtgtctgtctgtgtcttcacaatgcattctcctgtctctgtgtgtctgtgtctaaatttccatttttcttgtaagaacaacagtcattgaattaatttgattatatctgcagagaccttgtttccaaataaggtcatattcacagatacttagggttagaagtctaacatatcttttaggacatagttcaacccacagtgagttaaatgaaagatgaagaaatggcatttgggacaagcaacatctactcttttcagggttttccgttacctcctttattcttggtaggctttctgttattaagctgtataactcttctcatgtccacaccaacatcctaacttttcttcattgttgaaagctccagtcctctttctccacttagtaactctgagcatttgtgctatctttgcatgtactttactttgtgttttcgttcttcccaagcctggctgtggagtggtattcagcctttcagactgccatcatctttgttttcctagtaaagaagcatgttgtacttttcgttttataggctttgctctgtgtcattatacagaatcagaagaagggattaaaacaatttaaaaaccaaatataacttatacaaaaattgtggaattttataagttctaataataatggttcttggtctgtggttcccaactgcatatcagatttttgctttctgttttttttttttaattttattatttttatactttaagttttagggtacatgtgcacaatgtgcaggtttgttacatatgtatacatgtgccatgttggtgtgctgcacccattaactcgtcatttacattaggtatatctcctaatgctatccctccccccctccccccaccccacaacaggccccagtgtgtgatgttccccttcctgtgtccaagtgttctcattgttcaattcccacctgtgagtgagaacatgcgatgtttggttttttgtccttggtgatagtttgctgagaatgatggtttccagcttcatccatgtccctacaaaggacatgaactcatcattttttatggctgtatagtattccatggtgtatatgtgccacattttcttaatccagtctatcattgttggacatttgggttggttccaggtctttgctattgtgaatagtgccgcaataaacatacgcatgcatgtgtctttatagcagcatgatttataatcctttgggtctatacccagtaatgggatggctgagtcagatggtatttctagttctagatccctgaggaatcgccacactgtattccacaatggttgaaccagtttccagtcccaccaacagtgtaaaagtgttcctatttctccacatcctctccagcacctgttgtttcctgactttttaatgatcgccattctaactggtgtgagatggtatgtcattgtggttttgatttgcatttctctgatggccagtgatgatgagcattttttcatgtgtctgttggctgcataaatgtcttcttttgagaagtgcctgttcatgtcctttgcccacttgttgatggggttgttttttttttcttgtaaatttgtttgagttcattgtagattctggatattagccctttgtcagaggagtagattgcaaaaattttctcccattctgtaggttgcctgttgactctgatggtagtttcttttgctgtgcagaagctctttagtttaattagatcccatttgtcaattttggcttttgttgctattgcttttggtgttttagtcatgaagtccttgcccatgcctatgtcctgaatggtatcgcctaggttttcttctagggtttttatgattttaggtctaacatttaagtctttaatccatcttgaattaatttttgtataaggtgtaaggaagggatccagtttcagctttctacatatggctagccagttttcccagcaccatttgttgaatagggaatccttttcccatttcttgtgtttgtcaggtttgtcaaagatcagatggttgtagatgtgtggtattacttctgagggctctgttttgttccattgatctatatctctgttttggtaccagtaccatgctgttttaattaccgtagccttgtaatatagtttgaagtcaggtagcatgatgcctccagctttgttcttttggcttaggattgacttggcaatgtgggctcttttttggttccatatgaactttaaagtagttttttccaattctgtgaagaaagtcattggtagcttgatggggggatggcattgaatctataaattaccttgggcagtatggccattttcatgatattgattcttcctattcatgagcatggaatgttcttccatttgtttatatccttttttattttgttgagcagtggtttgtagttctccttgaagaggtccttcacatcccttgtaagttggattcctaggtattttattctctttgaagcaactgtgaatgggagttcactcatgatttggctctctgtttgtctgttattggtgtacaggaatgcttgtgatttttgcacattgattttgtatcctgagactttgctgaagttgcttatcagcttaaggagattttgggctgagacagtggggttttctagatatacaatcatgtcatctgcaaacagggacaatttgatttcctctttttctaattgaataccctttatttctttgtcctgcctgattgccctggccagaacttccaacgctatgttgaataggagtggtgagagagggcatccctgtcttgtgccagttttcaaagggaatgcttccagtttttgcccattcagtatgatattggctgtgggtttgtcatagatagctcttattattttgagatacgtcccatcagtacctaatttattgagagtttttagcatgaagggctgttcaattttgtcaaagaccttttctgcatctattgagataatcatgtggtttttgtctttggttctgtttatatgctgaattagatttattgatttgtgtatgttgaaccagtcttgcatcccagggatgaagcccacttaatcatggtggataagctttttgatgtgctgctggattcagtttgtcagtattttattaaggatttttgcgtcaatgttcatcagggatattggtctaaaattctctctttttgttgtgtctctgccaggctttggtatcaggatgatgctggcctcataaaatgagttagggaggattccctctttttctattgattggaatagtttcagaaggaatggtaccagctcctccttgtacctctggtagaattcggctgtgaatctgtctggtcctggactttttttggttggtaagctattaattattgcctcaatttcaaagcctgttattggtctattcagagattcaacttcttcctggttcattcttggaatggtgtatgtgtcgaggaatttatccttttcttctagattttctagtttatttgcgtagaggtgtttatagtattctctgatggtagtttgtatttctgtgggatcagtggtgatatctcctttatcattttttactgtgtctatttgattcttctctcttttcttctttattagtcttgctagcagtctatcaattttgttgattttttcaaaaaaccagctcctggattcattgatttttttgaagggttttttgtgtctctatgtccttcagttctgctctgttcttagttatttcttgccttctgctagcttttgaatgtgtttgctcttgcttctctagtccttttaattgtgatgttagggtgtgaattttagatctttcctgctttctcttgtggccatttagtgctataaatttccctctacacattgctttgaatgtgtcccagagattctggttcgttgtgtctttgttctcgttggtttcaaagaacatctttatttctgccttcatttcattatgtacccagtagtcattcaggagcaggttgttgagtttccatgtagttgagcggttttgaatgagtttattactcctgagttctagtttgattgcactgtggtctgagagacagtttgttataatttctgttcttttacatttgctgaggaatgctttacttccaactatgtggtcaattttagagtaagtgcggtgtggtgctgaggagaatgtatattctgttgatttggggtggagagttctgtagatgtctattagatctgcttggtgcagagctgagttcaattcctggatatccttgttaactttctgtctcgttgagctgtctattgttgacagtgggtgttaaagtctcccattattattgtgtaggagtctaagtctctttgtaggtctctaaggacttgctttatgaatctgggtgctcctgtattgggtgcatgtatatttaagatagttagctcttcttgttgaattgatccctttcccattatgtaatggccttctttgtctcttttgatctttgttggtttaaagtctgttttatcagagactaggattgcaacccctgcctttttttgttttccttttgcttggtagatcttcctccatccctttattttgagtctatgtgtgtctctgcacatgcgacgggcttcctgagtacagcacattgatgagtcttgactctttatccaatttgccagtctgtgtcttttaattggagcatttagcccatttacatttaaggttaatattgttacttgtgaatttgatcctgtcattatgatgttagctggttagtttgctcgttagttgatgcagtttcttcctagcatcgatggtccttacaatttagcatgtttttgcagtggctggtaccggttgttcctttccatgtttagtgcttccttcaggagctcttgtagggcatgcctggtggtgacaaaatctctcagcatttgcttgtctgtaaagtattttatttctccttcacttatgaagcttagtttggctggatatgaaattctggttgaaaattcttttctttaagaatgttgaatattggcccccactctcttctggcttgcagagtttctgccgagagatccactgttagtctgatgggcttccctttgtgggtaacccgacctttctctctggctgcccttaacattatttccttcatttcaactttggtgaatctgacaattatgtgtcttggagttgctcttctcgaggagtatctttgttgctttctgtttttattctagggtatggcactcactacattttcatctttcatcctctcttccactgtgctgtttatctttttagcagttttattgaaatataatttttatatactgtacagttcactcatctaaagcttacaattcggtggctttcagtatcttcatagttgtgccctatggatatcaccacaactccaaatcagatttttgccttctgtttttattctagggtatggcattcactaagtttttatctttcgtctttcttccactgtgctgtttatctttttagcagctttgttgaaatataatttatatataccatacagttcactcatttaaagcttacaattcagtggcttttactagcttcatagttgtgcccatggatatcaccacaattttgaatattttcattgccccgtaaagaaaccctgtgcccttagtcatcagtctccattcttccctatcctcctcagccctatacaaccactaatcaaccttctgtctctatggacctattctgtgcatttcatataaatgaaattatataacatgtggtcctttgttttctttcacttagcataatgttttcaaggtttcattcttgttttaccatgtaaataaattcctttttattgccaaataacattccattgtatggatgtagtacattttaaattcattcattagttgatggacagttgggttgtttctctgcttgttagctgttatggataatgctgcttcgaatgtttatatacaaaatgttgtgtggacatatgttttcacttctcttgcgtatgacttgggagtggaattgctagatcacatggtaactctgcatttaactgatagactgccagcctattttccaaagtggctatgacattttatactcctaccagcagtgtataagggtttcaatttcttcatattcttgtcaacacttgttattatcttttttattatatccattcttcgattcttagcatgtatgaagtggtctctcattttggttgctattccatttaaaaacttttttattatggaaattttgaagcatgaaaaaatgtagagttactcttcctttttttttttttttttttttttgagaaggaatctcactctgttgcccaggctggagtgcagtggcgcgatctctgctcactgcaagctccacctcccgggttcatgccattctcctgcctcagcctccggagtagctgggactactggcacccgccaccgcacccggctaatttttttgtatcttttagtagagacagggtttcaccgtgttagccaggacggtctcgatcctctgacctcgtgatccgcccgcctcggcctcccaaagtgctgggattacaggcgtgagtcaccgcgcccggcctactcttccattttttgctggagtattttaaaaccaatccagccgggtgtgttggctcatgccagtaatcccagcactctgggggggccgaggtggtcagaccacttgaggtcaggatttcaagaccagcctgaccaacatggtgaaaacccgtctctactaaaaatacaaaaattagcttggcgtggtggtgggaacctgtattcccacctacttgggaggctgaggcaggagaatcacttgaacctaggaggcagaggctacagtgagccgagatcacatcactgcactccaggctgagtgacagagcgagattccctatcaaaaacaaaaaacaatcctaggtattatcttgtctcacccataaatatatcaatatagatctctaacagataatacttttttttaaaaaaaaaccacaatgccattatcacactgaacttaataatttcttagtgtcatccaatacctagtcttttcaattttctttattatctagaagatgtgttttcatagttgattttttcatttcaagagccagataagatgtgcccatttggctgtcatgtctcttaaatcattttactttattttatttttgtattttttgtagagatggtgtttcaccatttgcccaggctggtcgcaaacttctgggctcaagcgatctgcccgccttggcctcccaaagtgctgagtttacaagcatgggacaccaagctcagctccttgaatcatcttagctgtaaaatcattcactttccctcatctgttttgtagacttctgcacattctggattttgctgattgtgtccccaggttttatttaccatgttcctttatctctcttatttcctttaaactgaaaagtgcatctattagtttgaagattaggttatagttcatttttgtgatagaggtgatgttaaaattcaacagtggattcaagtattgtcagcccatttcattcattatgatgttttcccatcagcctttcatctaatggttttagctgcaaataataatgactattttattagagtctgaaaaatgattttctttctttcttttatttatttatttttatttgagacagtcttactttgtcacccaggctggcgtgcagtggtgctgcagtctccgcctcctgagttcctcagcctcctgagtagctgagattacaggcgtgcactaccatgcctggctaatttttgtattttttttatagtgacagggtttcaccttgttgcccaggctggtctcaaactcctggcctcaagtgatctgcccacctcggcctcccaaagtgctgggatttcaggcggaagccactgtggctggtctgatagtctaattatattatcccttcagcatttattagctatgatttgtctataaaaaaaattttctcaatcccagcactttgggaggccgagacgggcggatcacgaggtcaggagatcgagaccatcctggctaacacagtgaaaccccgtctctactaaaaatacaaaaaattagccgggcgtgttggcaggtgcctgtagtcccagctacttgggaggctgaggcaggagattggcgtgaacccaggaggcggagcttgcagtgagctgagattgcaccactgccctccagcctgggcaacagagcgagactctgtctcaaaagaaaaaaaaaattttttttctgttaccagctattcagttcacagaaatatagtctgtataagaaaaacattctcttttatatttttagaataatgaactgttgcctcagcaacttctcaaggtgaccagtaagttattttcttttttaaatggaatattactatgtatttataaatttgggtatatttgataatgtatttcagcccattgcaatcattcttttttggagacagggtcttgctctgttgtccaggctggagtgcaatggcacaatcatagctcactacatcctggaatatctaggttcaagtgatcctcccagttcagcttcccaagtagcagagactacaggcacacatcaccgcacctagctagtttttaatttttttgtggaggtggggtcttgctatgttgcccaggctggacattctttttgatactaaaatgatctcatctttggttaatgggagtttcttcaagttggcttttttctcttctctttttctatttttatcatgaaaaaaatttaagtatacatacaaatacaggaataataaaaggaaacccatgtgtatacctacccctaagattcactaattattaagatttcatcatacttgctgcaaaatcattttaaaaatacaatatagagtctaacttttttattctacagtgtgtaacgtttcccatacacctcgtgggcctagaagtgctaatcaagactgatttgggcacctaccactttacagagttggattgtaccacactgtattacttttcctactcatgggcaattaggttttcactattataaatgcgtgctgcagtgaacatttctggacctgtttctctatgcttgtatttgacagagtctctgggtgtatatctggaaggatagttgcttggttgtaggatatgctctgttcaaccttagtagatattactaaattgctttctgaagtgattgtgccaatttacatttacccttttcctgtttcactgtttccttactgatacttgatgttatcagattttaaatttttgttaatctaacaagtatagaaattgttttaatttgtattttcctgtttattggtgagatttattcatttattcaccaaatcagttattacgcatcaggtaccatgcactattctgtgtttaatatacatcagtggttgaagatccctaccctcatggatcacataggcagaatcagacagtaagcaagaaatataataaatatagttgagtattagaaggtgagaagtgctataggggatttcttagtctatttggattgctataacaatgcaaactggatagcttataaacaacagagacttatttcttatagttctggaggatgggaagtctaaaatcaaggcactggcacattcattgtctggtgagggcccatttcctggttcatagacagcaccctgctgtgttctcatgtgatggaagcatgctctctggagcctcttttgtaagggtgcttatgccattcatgaagtctccacccttatgacctaatcatctcccaaaggccctacctcctagtaccatcacacaggtgaatttttggtgggggcaggggtggtgggatacaaacattcagactatagcagaggggtgtatattttttctccatgtaggtattatactacttttgttagatttttttccctaattgttgcaaatggtacattctaaaaattacattttctagttggttatcacattactattataagtaaatgctttgctgctcatctttttaaagtattgatcttactcatcaactcttattattaatagttctgatactttaaagattcccttagattttctgtgcgactaggttttgcatctttaaattacagtttttattctcctagtccttacgctttttctaagtgttgaattgtttatacattatttatatatattatatataatatacgtatataatatataatatacatatataatataatatatattaatatatgtatataatataatatattatattatatattaatatatgtatatattatattatattatatattaatatatgtatatataatataatatatattatatataatataatatatattatgtataatataatatatatattatatatatattatatatattttttcttagacagattcttactctttcacccaggctggagtgcagtggcactccagtgatccgcctgccttggactcccaaagtgctgggattacaggcgtgagccattgtgctgggcctgtttacgcatatatttttattaacagacttcattttttagacgttttagatttatagaaatattgagcagatatttatcccctcccccaccccatcttatagtttcccttattattaacatcttacattagtgtaactgcccaacgggttcaccttgtgtgctgcctattcagagctgatttatgaagacaggggaactgcagaggagaaagagtaattcactcagagccagctgtgcaggagactgcagttttattattactcaaatcagtctcctggagcattcgggcatcagagtttttaaagataatttgacaggtaggggtttgggaagtggggaatgctgattggttaggtcggagatggaatcatagcaggtagaagtgagtttttcttgctatcttctgttcctgggtgggatggcagaactggttgggccagatgggtggtgtcagctgattgatctagtgcagggtctgcaaaatatctcaagcacggatcttaggttttataatagtgatgttattcccagaagcaatttggggaggttcagactcttggagccagaggctgcatgacccctaaagtgatttctaatcttgtagctaatttgttagtcctgcaaaggcagactggtccccgggcaagaagggggtctttttggaaaatagctattatcaattttgtttcagagtcaaaaccatgaactgaattccttcccgaagttagttcagcctatgcccaggaatgaacaaggacagcttaatggttagaagcaagatggaactggttaggtctgatttctttcactgtcatactttccttagttatgatttttgcaaaggcagttttgttagtgtgatacatttgttacagttaatgaactaatattggtacattattattaactaaagagtattttttatttattttattaactaaaaaataaagctaaaattccatagtttattcagatttcctcagtttttaccttgagtcttttttgttatttcaggatctcatccaggatattgcattacacttagttgtcatgtctccttaggcttctcttggttgtagtattttctcagacttttcttgtttctcatgaccttttatttaaaacattcaatgcctaagacatctagtataatttttaacattgtaagagtggagagccttgtctgtcttctgactgtaaggggactgctttataagttttaaagtatgctgtttgccatggattttggtagatactctttatcagattaaggaaattctattttctttcttattttttaagcatttttgtcatgaaaaagtatggggttttatcacatctttttctgcatctgtttgatcacatagtttttctcttttgatctgtttaatatggtgaattatatgagtagattttcagatattgaactggcctagcatttaatacccacctggacaggctatatgtacatttatatgctaacacacatatgtgtgcacacatatacatacatattcacatatgaatattacacacacttatttaatatgatagatttggcctagtaatctattaattaggatttttgtctctatattcataaatgaaattggcctgtaattttcctttcttctactatccctgtctgttttttgtagacagattttgtagcttttttcttagctgtcttaacattattaattatactctagttggacttaagctttctgttttgggcctgggagagattcattaaatatagcttctgaaaatatctactctgatctcttaggtctgcattcttcttaatacttaaaattttgggattcctcatggttatgtctatgtactgtctacaaaaatcataattatttgtagtggctattatttataaccaagtccttttgttactttggagtggatctttgaccttcaagatgttttgaacctggctgggtgcagtggctcacacctgtaatcccagcactttgggaggctgaggcgggtggatcacctgaggtcaggagttcaaaaccagcctggccaacgtggtgaaacccccattttttatatttataaaaaatataaatatttataaaaatatttatataaatatttataaaaatatttatataaatatttataaaatatttatataaatatttataaaaatatttatataaatatttataaaaaatataaatattagccatgtttggtggctcacgcctgtaatcccagctactcgggaggctgaagcacaagaattgtttgaacccaggaggcgaaggttgcagtgagccgaaatagctccactgcactccagcctgggagaaagagtgagaatctgtatcaaaaaaaaaaaaaaaaaaaaaaaaaaaaaagatgttttgaacatttttgtgattggcaattttgctagtgctatcatattgtttacattgtacttgacttttcttattctccatggaaattagtaataacagtatctacctctgacatttgtaccatattctattgcttataaagtatattttatatacaaaaagtgttttgtattttggatcccaaccatttgaaatgctcttcaccactgatactcataagagtgttacgtacaacaccatcaacttttgtctggattattgcaataattatttaccctcatgttccctacagttcatctcatacagcagccagattgatcttttaaaagtataatcaaatcataattctctcatgcttaaaaccctaaagggcttctaagtacactagaaaagttcgaattcttaccatgatttacaaattctgttttgccagtgcctagaacaaggccttgcacgtagtggatactcaatcaatatttgttgagttaataagtaactcattcattggcagttttagagaagcattgacttgcctcagatctcatagcttatgaataagtgaccacgtcaggatgagaactccaaatctcatgtttgcaagttgcctggctgagttacatttttctaattatccaatggaccctgaaccagactattctcactgtcttccagactctgtgtacccctgttaatttgtttgtgcctttctctttctgttttgccttctaaatcgggcccatcctcaagatttggacataattcttttccttttatggaacattgtcttatgtcttcagtaccgtgtacttgtttttgtggtggttgtggtgggtgggatggcggaggttacagtgctagtgggagaggaactcttataaataccagatattgcaccacatgcttaggtaagcagttccacttatttcccatgtgaccttatgagcaaagaagcactattacttaaaaatgagaaaacagccccagacaggttttcacttgcatcacctgaatggggaaatcttctatacattagccccaggaaaactcagagggctgtgaaatattctaaggattctaaggccaaaccttctccagctgcctggcagagctaggtgggtgcccaggtgcccttggtcaggacagttcttcattatcctgctttatttagcctgtctcacttggccagggccataaccaatagtctggcctatatgtcaacatcacacagagaaaataggagcaggatgttctgtttctgttcaataaaaattttgtttccaaacactaaacctttttataggtagttgtgatttttttccctgtctttacttgggcttctgattgtatttatttatttattttctcctttctgcttctagtattctagtcaagaagaaagccagaggaagccattgcccactgctgccgcccagtgttgtaagtgagaaacttgtctatgaatctcttttaattgtagctttctgtcgcttctctgaacatgggttattctgagctggggagggtggagatgtcatgtgtgtaagcagaagatattcctgaagcacatctgttcaggcgcctttctctgatggctgtctatctattagctttagggagacgtttttcggttttgtatggggggagtagggctcatctttttttctacatttgttagcttctacccctggaggaatgatttaaccccctctatccctgtttacctgttattattctttaaggctcagtttaaatatcatcacttctgggtaatctttgtgctgttttctccttctcccaagtctaacttaggtctctcctgtgtgcttccattttactgtgtgcacatccatcatatgacatatatatatttctttgacatgaacacaaagttttaaaagacatagacattgttccattttatattctttgcatttggctcaacacctatgcatagtatacctcaataaaatttgataaatgattgacttatttctcctgagattgatttgtcaagatcacacagattaattattgaaatgagccatacgtttttggtatattgttaccctctccccagtttccctcaaaacagcttgagacactaaaggactgacttagagtctgatctatttcgctttttcaacctgtgatatgtgtgtgtgtgtgtgtgtgtagggggatgcgggggggggggattttgatacttttgtgttgctctgttttttctgaatctcatgccaaactccatcaactacaagttgaagatgatggtaatgattgtagcatttgttgttgtaatattagtaataataagaactgtaggctgggcatggttcccagcactttggaaggctgaggcaggaggatttcttgagcccaggagtctgagaccagtttgggcaacaaacagatacctcatttctacaaaaaaaaaaaaaaaaaaaaaaaaaaccaagtgtgatggcatgtgcctgtagtcccagatacttgggaggctgaggtgggaggatggcttgagcctgggaaatcgaggctgtagtgagctatgattgtgccactgcactgcagcctgggcaacagagcaagaccctgtttcaaaacaaacaaacaaacaaacaaacaaaccatagcagctaacactattgaggtcttacagtatgccagatgccattctgagactttaagtattctaatttatttaaacttcacaacaaccctaagacagattttactgttgttcccatttttgagagcaggaaactgaagcataaatagattgagtaattcgccacaaatcacatagctagtaactggtgaagtaaatattcaaacacagaaaatctgacttagtagctcctacctctgtgtgaaccactgtgttatattgattccttcatattgtttctgaaaaggaaaacctttgtccatggtttgtgaatctgttggttgccttcaatttggtacattctataggcccactttcctgataaaagtaaaggccaatggtagaggtgaacttttttttctttatttaaagaaaacctatttttcatatgatttattactaacttttgttttttgctgtttaggaccgaacatttaaggtcataggaggtcagaagaatctgaatccaaaaccaggttttcaggtttacaggtccttttcaaaactcattgtaatgagttcattgtgattgatttaatcttttaaacctttttccacgactgctaatgagaagcaaaatgtaaagattgagattttacttcctactccttcctggtctcattgatgaaatataattgaagcgattaaagcgcaaatgccaagagggcaggaggaaataaaaaaccttaaataatcaagcaactttattcccatacatttttcatatgtttacaggctattttatttttctgtgaataagccattcttgtcttttgcctgctccctcgtatatttttattttgagaaatgttaaacctatagaaaagttgaaagaacagtaccaagagtgctcattaccctttactaggttcagtgacaagcattttgccagatttgctctttccctcatccccctcttatttttctctcatgtttctttatctctgtctccatacatacatacacaaaaatacaagtattttctgaatcatttgaatataagctgcacatgctataacacatcagcgtgtttctgctaagagctaggaaagtcaacataactgaaataccatgatcacaatcaagaaatttaagactgatacagtaatattgtctataatacagtctatattaagaactccctaattgtccccaaaaatattttgaaagctttttttatattttaaaaaattttatttattttttaatttttatgggtacatagtaggtatttatggaatacatgagtattttgatacgggcatacaatatgtaataatcacatcaaggtaaatggggtatccatcacctcaagcatttatcatttctttgtgttacaaatattccagttatactcttttagttatttaaaaatgtgtaataaattattgttgaccatagtcaccctattgtgctagcaaatactagatcttactcattctagataactatttttgtacgcattaaccgtccctaatctcctcttacccctaactccccttcccagcctctgttaatcatccttctattctctgtctccatgaattcaattgttttaatttttagctcccacaaacgagtgagaacatgtgaagtttgtctttctgtgcctggcttatttcacacaacataatgtcctccagtttcatccatattgttgcaaatgacaggatctcattctttttttttatggataaatagtactacattgtgtttatgtactacattttccttttccattcatctgttgatggaagcttaggctgctttcaaatcttgcctattgcgaacattgctgcaacaaacataggagtgcagatatctctttgatatactttcatagccttcccccgccatgatctaatcaataaccatacatttcatttattgtcctgtctctttaacctaccttctttccttcattccttttcttttctttgttcttttctttctctctccttccttctttcctttcccttcctttcctttccttttccttttcctttcttttccttttctcttttcacttttctcttttttctttctttcctttcttgagaaggagtcttgctccatcatccaggctggagtgcagtggcatgatcttggctggctgtaagctttgcctcctgggttcaaccaattctcctgcctcagcctcctgagtagctagaactacaggccatgctaccactcccagctaatttttttgtatttttagtagagacagggtttcactatgttggccaggctgttcttgaactcctgacctccagtgatccgcccacctcagcctccaaaagtgctgggattacagacatgaaccaccgcacttggcctagtcttctttaatataataaaaaaaaatctggccacgcactgtggctcacacctgtaatcccaggactctgcaaggtggagacgggtggatcacttgagcccaggagttctagaccaatccgggcaacatggcaaaacatcatctctataaaaaaatacaaaaattagtcaggcatagtggtgcatacctgtagtcccagctacttgggagactgagccaggaggatcacctgagcctggggagattgaggctgcagtgagccgtgatcatgccactgcaccccagcctgggtaacagagtgagaccctgtctcaaaaaaaaccaaaccaaaccaatacaaaaacaaaactttgcctttttggtcatttatgatattgatctttttttatttacaaaaatagtttattctaattataatctctattcatatgggggtataccttcttacaggtttctgggaagcagtttagcaatatgtaccaagtctttgaataggaataggctttgactcagcagctgaatttctggaaatttatcctcagtcatcacagcagacaaagatatatgtgcaaagatgttcactgcagaattatttaagtagcaaaatttgaaaatgacttaatagttaaacagcagtaaaaaataatagtccttaagatagaatattatgcatttattaaaaatcatgctttgaataataggaacattttcatggaacttggtaaaaaaaaaaaaaagtattacagttatccctcagtatacttgggggattgcttccaggacccctgcacgtaccaaaatccgtgcatactcaaattcctcacttggccctgaggaacccacctatatgaaaacttggccctctgtatatgcaggtttcacatcctgcattttctatctgtctcattgaaaaagatccataagaggactcatgcagttcaagcttatgttatttaagggtcaacttaaaaccctcagtgtgtgtgtgtgtttatgtatatatatacataagcaatttaagacttattgctgagaacttaattgtgtctaccccccatttatatattgaagcctcaacactcaatattattatatttggagacagggcctgtgaggaggtgataaaggttaagtgaggtcataatctgatagggctggtgccctcataagaagaagagatagcagagctccatccctaccaagtgaggacacagtaagaaggtagccatctgtaagccaggaagaaagccctcaccaggaattgaatcagctagccagccccttgatcttggactttctagcctccagaactgtgagaaataaatttctgttacttaagacacccagtctaagtgatttcgttaaggcaatccaagaagactactgcagattttggtactaagaggtggattgttgctgaaacaaataccaaaaaatttgcaagtagctttggaactgggtgatgggtagaggctggaagagttttgaggtgcatgctagaaaaaactgagatttccatgaaggggttattgttagaaatatggacatgaaaggtgattctggtgagggcttagaaagaaaagaggagagctacagagaaaacttccatcttagagaatgtgtaattaatcatgatcagaatgttggtatgagtgtagatattaaaggcaatttttgtgagatctcagatagaagcagttaataataataataaggaaataactggaagaaggatgatccttgttataaggtggcaaagaacttggctgaattgtgttctagtgttttgtagaaggtagaacctgagagcaattaaattgcatatttagcagaagaaatttctaagcaatgttttgaagatgtgatgtggctttcccttactgcttgtagtaaaatgcaagaggacagaaatgaatgaagaaagactgttggacttcttaggttctagaagactggaccatagagctatttgactgtgaatctgtgctattttccagggaaaggaaagaattaccctcaaaggtgacagaggtcatcagggctgcccccctcaccacagacctgggggcaaggtcatttacttcattatgtaagagggcaggcttatcacagtgaggcagctcctgaaaagccaaggaggcagatatatcaagccaaagagaattattcttgagtcttagatctaatggaattcaccttggtaggctttggacttgcttaggacctgtcaccccttcctttcttccctgtttctctcttttggaatgggaatgtctagcctatgtctgccctacgattgtattttggaagcacataacttgtctggtttcgcaggtttatagctggaaatgcatttcgctttaggatgactctttactcaagatcactcgtcttatttagatgataattagataagacttgggactttagactttgaagtggaaattgaatgagttaagacttggggctgttgggatggaatgaatgtatcttgtgtggataaagacatgaattatggggggctggggcagaattgtatgaacttgattgtgtcccctccaaattcatatgttgaagccctagtccccagtttgactgtatttggacataggacctgtgaggaagtgataaaagttaaatgaggtcataaggatggagccctaatctgacagggctggggcccatttaagaagaagagacaccagagcttgctctctccaccatgtgaggacacagcaaaaaggtgaccatctgcaagccaggaagagactgttcaccagaaaccaaaccttatgggaacattgaccttgggctttccagcctcagactgtgagaaaataaattgttgttgtttaagctccccagcctatggtattttgttatggcagcctgagcagatgtatacactatgtaaatgcatctatacaattataagaaaaattactaggaaaagaatgatcaaaatattaaccaaatttgtctctaggatatgggattgtggccttaaattttttttaatagttaaaagttattattggccaggcacagtggctcatgcttgtaatttcagcattttgggaggctgcagcgggaggatggcttaaggctgaagttcaagactagtccaagcaacatagtgagacccccatctctacaattaaaaacaaagttattattaagaaaagtaattgagttcttgttcattctttttcctttttttgcgatggagtctctctcactctgtcacccagactggagtgcagtgacacgatcttggctcacggcaacctccgtctccctggttcaagtgattctcctgcctcagcctccgagtagctgggaccacagtcatgtgtcatcacacccggctaatttttgtatttttgttggccaggctggtcttgaactcctgacctcaagtgatctgcctggcttggtctccaaaagtgctgggattataggcgttgagccaccaagcccagttgagtccttgttcttaacctgggtttgctgctctctctctgtgactttggaagtcatcccactgttaacttcagtttcttgaagtaataaatggaggtggtgttctagatgatctctaggacttttccagctgtagcacatcatatgactctattacttcctagtcctcagattccttcatgtggatggcccctccactacccagtgtgttaggatcaatcctctgcggccatttataagatgtttccaaagtattttcagaaatcactgggctactgctctaaagaaactctccctttgatacaagagttactgtggctggaagtggtggctcatgcctgtaatcccagcactttgggaggccaaggcaggagaatcacttgaggccagcagtttgaaaccagcctgggcaacatagcgagaccctgtctctatttaaaaataaataagtttaaaaagtaaaaaaataaaaggagttactctagccccagttatttggatatactcttaaaggtgatgggattctttaaaagtattgaggcaaactatctgcttttcccctttgtctcaggtcaagcctttctcttttagcattcagtaacaacattctgcattcacttttatcctgtgaagtttttgtctcatttggtaactgatatatttattttaaaatgttgtagggtaattattgtgatttattatgtccatctgttttttatcccccattttattaccatttctagcatttaggctgacttgtgcccatttcttgaaagaaaggtaaggcagagagcagaagaagtgatctttgtggttttaacttcccaaagcctaagattttaggagagtatgcaaagtgttctggacaaatattatgagagggagcagagtttcacctgaatctcccaatttctaagaagagcttcttttgacttgaatgagaggagagaaatgcaagagaatgaggagagaaagaaagaaagtgaccaggggagatacattgggaccttgtgtctgctttctgtgttagggcactggtgaagcagcaggagtcaaagaggggatggctaggtgttgtgtcttaggcagatggaccatcacaaagagattcctatgctccaagttgcacttgctccaaaatgagtcttgggctttctagaagtgggaaagtgagcctctggtcctattggaaccacttgggcaggaataagaaatgtctctctcagaagtgttctctgtgtccgagtgactaaggactggaggagacctggactatcttgatgaatgccagttcacaaagacacatccatgccatgggcagtcacttcactgcagtgtctttttaaaaattattatgctttaagttctgggttacatgtgcagaaacactgcagtatcttattcacatgctgtgtcagtattcagagcagtcttcatgggacaggggcaagacttaggttgagactgaaggatgaatatgtcttctaagagtgataacattagttttcctaggagacatattgatctctttgttggtggttgttgcctctctggctgatattgcttggttgttcctgccctctgaggtgtaggtgagtgctggctttctcaatggggtgcaggtgtgagtctccaaaggttacttttggggactccctggggtcttatgtgagtgattgctctggttcaacttcttttgtcctgctattgactactaccaaaagatgtacttagcttgttgctgctggtatcctgttacttagaggcttcttgaatggggaaatatcaagataactgggactcacccacattccacagaattcacatgacccatgggaactcaattattcttgccctgagaaacaaaggatataggcaagcagttccattctcttctctgtctcccagctctgcctcctctgttctttttggctgcttagaaaagtacacagttcacatcagcaagtctcctgtccaagcagacatccaacctgtctggctccactcccattcttgtaggcatccctaacctttgtgaattatgaagctcctcctcacttggattcagagcagaaaaacattcgtttttcccctccccaggaggtggagaggggaaggagtgacctctcttcaccaacaattgctctcccaaaggttgctgggtcccacattgacatagacattctacaagacagctgacaaggatctagttaaattgtcttaacaaaatttcctggttgggcacagtggctcacgcctgtaatcccagcactttgggaggctgaggcaggcagatcatgaggtcaagagatcgagaccatcctggctaacacagtgaaaccccatctatactaaaaatacaaaaaattagccaggtgtggtggcgggcacctgtaatcctagctactcgggaggctgaggcagaagaattgcttgaacccgtgagacggaggttgcggtgagccaagattgcaccactgtactccagcctgggcgacagagcgagactctgtctcggaaaaaatttcctaaaatctggatttgtctgattatttcctcgtaattagattcaggttactgcacagctgatgtcaatttgtccctttatttgtgatgctgatgttaattattagttcagatgatgttttccagatctctttgttgcaaagatatttttctcctttgtaactaagtgtgtagtggcagtgatactttgagactgtgtgtatactgcttttatttaaataaacttccatgcattagttttaggatgtattatgatcattgcctaaatttattattacactgtggttgcaaaatgatgattttctaattctgtcattcttttttaaaaggaaaaaatggtttctctatacttgcacaattctgacaccaagtatgttttccataccaagcaattctctgctaacatcaactgagtgtctcatgacttaattctgacactagagatgtggagttagtgcagaccctacaggttaagggctcagtcccacaagactgcctcccactttagagaccaatcataaatcccaggttactgcctgaacttctgaccaactggctataaactggagttcccacaagcccctcctcaggttcaataatttgctaggatggctcacagaacccaggaaaacagttaatttggtattaccgattgattaaaaggatattttaaaggatacaaacaaatagccagatgaaatgatacattggaggaagtccagaagggtctgagcacaggaacttctgtccctgtggagttttgggtgcactactctccctgtgggtgcatttttgttcaccagtgtggaaactctctaaacccctttggctggggttttcacggacacatcattatgtaagtatgattggttaaatcattgatcattgatgattaattggctcaaccttcagcccctcttttctccctggagtttgtggggtgggactgaaagttctaaccctctaatcacaaagttggttcttttggcaactagcctccatcctccaggagttatcacattagcattaactcaggtatgattgaaaggggcttactatgaataacaaaagacagtcttatccctatcactcaaggagttaaaagggttttagaagctctgtgccaagaactgcaggcagagaccaaatatttatttcttattgtgtcacactgttattatactgaacagttgtcagtcttttgtaaagaagagctttccttcttcgcatacccccacccctcttttaaaatgagtatcactatggacacatgatttttttttttgaacccagtgttttgtaatcctgttctgccattttctttgatgctcaaattgtcctgaatttggcctatgggtgttccttttaactagatcctgtgtccttttgacatggccctatcattctttgaccacttccttccttccttagtacaaaatattccaagctcatcttgtactttgccttctcagtcctagaataagtcatttctccaatgaggctggttatttttagtggggaatggtatttaaaaatcaagatcttggcactagttttgctcgttgctacaggagggctcttgcttcttggctctttggatggaactagggaacacactatgttcttcatactggtatcaccaattaacaccctcatcacaaggttttcctggtctcctttcatatattctctctctctctatgtatatatatgtgtgtgtgtgtgtgtgtgtgtatgtatgtgtttgtgtattatgcacatatatatacacatatatacacacatgtgtatatacacacacatatacatgtatatcttccagtgagaacctctgttcccaagaacatcaaattatttattcatttgctgtgtcctgtaatgtacacaaacaaattttaggattaatatacccagtgctattatcaacaataagacaacagtctttaagattcttgaaagtttttttttaaccttagaatataaactcacataagattacaaaaccaccagcacaccaaaaatttaacaaaattttataatgtcatcagtatctatcctatattcaaatatccccagttttcccccaaactttcttgtcctttttgcaccattgtagaagttaatcaaggttcacacattgcatttgtatgtggtgtgatttgagtgaagatcgtctttttgcatgtggatttccagttgtcctaagaccatttgttaaaaaggcattttcggccaggcacggtggctcatgcctgtaatcccagcactctgggaggccgaggcaggtggatcacgaggtcaggagatcgagaccatcctggccaacatggtgaaaccccatctctactaaaaatacaaaagttagctgggtgtggtggtgtacacctgtagtctcagctactcaggaggctgagacaggagaatggcttgaacctgggaggtggaggttttagtgagccgagattgcgccactgcactccagcctggatgacagagtgagactccatttcaaaaaaaaaaaaaaaaaaaaggacatttctccccccattaaattgcctctgcatctttgttaaaatcattcttactaccaccacatgttcccattactttccttccttttagcagattagattttatatattcacattagaaagtggatatactttcttttaggatatgttcttcagatgtggcctcagctgggagttggtagcagatgccaggagacgcatgtggctttttgcatgcttgagcctcagtacatcatgtttacttttgcaggtcttattgctcctcaatttatagagctgttctgaggctgtgcaatctgatttgcatatttgatacaaatcttgcaacaaatggtatcagtataatataaacatttagccacaaggctaaatggtcagaagttgagctagagggataaactggtctgttccttttccaaacatacctaaagtttctaaggtatttacacttcactcttcaataaggataatatttctacctatatcttgtcaaagaatgtagcaacacaccatgttgccataccagtctgactactactaaattcaacaactttctgctcttttcaatttttatacatgtctgccttgcccacccactgtattaatgacagtatcactggctacaattgagaattgaatcaaaagtgatttagcatgtgacgaaggtttggtgagatgactacttacatcaaaaccatcctggccaacgtggtgaaactgctagggtgtgtaaattagtacaacctttctaactcagtgattttacttctaggaagtattcaaggaaaataactagaggttcaaaggaagatttatgtataggttttatttataatagtgaaaaattacaaagaaaggaagaatggataattatggtatttccatatgatggaattgtatacttttacataaatttttaagatagaggaaatatttatgtgtataagttctaaaaaataggatcctaacctgattaagatgatctcagttatctaagaaataaattatatacatatgtacgtagaaaaaccacaaggaaatataatttttttgtttttttttttggttgtttcattttgttttttttgtttttttttgtttttgttttttttttttgagatggagtctcactctgtcgtccaggctggagtgcagtggcagaatcttgggtcactgcaacctttgcctcctaggttcaagcaattctcctgcctcagcctctcgagtagctgggattacaggcacctaccaccacacgtggctaatttttgtatttttagtagagacagggtttcaccatgttggccaggctggcctcgaactcctgacctcaagtgatctacccacctcggcctcccaaagtgttgggattacaggcgtgagccaccacgcccggcctgttttattttttctttatactttattgtactttccagatttcctccaaagaacatgcatttgttttataataattttaaaagggataaatattttaaaataacccaagcctgacaatacagaagcaagttattgtagattcacttttttagtttgaatttgagacttagttgaatgataatttattgttgagattgacatagtttagttcaacaataccagtgattccttcactgaaaattccacgtagcttttagagttgcagtgtaccttttattaatgatatccctaaagcctcccttaactacttaccgtgtctgaaacaaaaagcttctggggtctatgttatttctatatgtattatgatctaaaagatagcttgaacttttgcttgagatatagcccaccttggagtttcaaagagatttttctggttatctattaagggtttgtttcactggttttcttacagtattgcctataattagtgatctatacaaatcataaaccaaaatgtcctgagtacgaatcattcttttaaattagtaaaacggcataacccaacatattgtttaaaaattttcttgaagaatgaatcagttcagaacagttggatgtgagtcatatcatgaataacaagtgaccaaacattcagaagcattgtcagtaatatactgcttagttgctgggttgtgacaaattatttgaccaccacaaacttcagaagaatttcttttaccagcatatccaaaagaggcatgtttaataaaattacttacctttcctcattttcaactcttactgtcaaatgtcctggtcctagtgtccattgcgttgatatttgttgattcttagatggcaagcagtaggttttcaatgctttccactagttttcagccattagacctgatattcatattcctagtgtgcaccatattcaaatactcctcttatagcctcttattattcttggtctccatctaaaactgttcactgccactctattacctgtcttatttctaatattctacctgttaggggaggcagagaaatgggtcattctgtatatgtaactaggtattccccacttggacgattaggttcctgcctgctctacaagtgatgatggtataatccccaactaaaatcaaccacaaaaaaaacgctaggcaggtactgccagtgcttctcttagtctcattttcacacctaccagaaacaagactagctttaggcctgtgggctgtgttggccgcctctcaatggaggctaggacttgctttcgtagttgggtcttatagactttaagtagaacaggaaatgttgtccactcgtttttggtccaggatacctttcttttattctggacccaccacagccagagggagctgacccaagtggcaattactgtgtcaaagcttgatcatgtagagtatgggactatcactccaccatttcatgccagagaacaccatcttgagaggatctagtgcttcctgaccatcagacctaactacctcgcacagctccaagtaaaaaagaagcctggttagaaatctggatctgtattacttattttccgtatgacagtagccaccatactgataacccctgcctatcaggagatatatctcttagagagctttgtggcctcgcactctcaactagtactagcattcttttcttttctttttttgtagaaatgggggtctcactatgttgcccaggctggtctcaaactcctggcctcaagctatcctctgccttagcctcccaaactgctgtgattacaggtgtgagccaccacacccagtcaagaatttgcatgtcttacagattcaagagcatatagtagattaatccatgttcctaataatgccttaaagagaaccagaatctctcaccataattgaattttgaagggacagaactcagaaaatctgtcctctgtatccccttataatgacatgttcttattctgtggcaggccctttgaagacattaggatggcctgctaggacttctgacagccttcataaagaatgccccacaatgaaatttgggggacaaatgccaaagataatcctgggagacctgagagattattgaactctctcctgatgcccaggttcctctgggacattgctaccttgggtttaattataaatgtatccacttcttgaagccataatataatatgtatgctgttcacttaaattcagggccctgtgagtgggctatttagtccctacaccagctggcctttggctgcatccaaattgcagtgctcccccataaaagagatgtccagctccataactttcccaatcattttttgtcatactgtgaaatcatacttcaatagatatcatgggtttggagctttttgttcagtgtcctctaggttaaaattctgcactctcaaagtcatttgtgatttaaagttgtagaatgtattggttttcttgttagttttgaattctttttttttcttttctttaccttggctggataaagttatgaattcttgatggccactttgcatggtattgtgaagagcagctcagagtctttttttctcccaagtctcccaaccagttatctttttctgcatcacttgtttctaggaaatgggtaaactagagttaaaactttggtcagcttgactcaaatgtctgtgttctttccgctataccaccaccctgtggtggcaaaaatctcatgggatataatttgccattcagaaatatgtgcttttcttacgtggctactgccctttgttttaattaaaattaattcatttattgaataggtaatatactttgtataggagttttaaaatattaaagggagtatagtaaaaagtctccctcctgttcctattccccagccacttgggtcttctccccagaggtaatcatcgttagcattttcttgtgaatcattcaagaggttttactgctgttcgaatatacaggtatatacattagagagatcttttgattattctttccatcctttgaattggttttatttactcattcatttattctgagatggagtctcgctttgttgcccaggttggagcgtagtggtgtgatctcggctcactgtgacctccgcctcctgggtttaagtgattccccttcctcaacctcctgagtagctgggattacaggcgcctgcaaccacacctggctaatttttgtagttttaatagagacagcgtttcacaatgttgactaggctggtcttgaactcctgacatcaaatgatctgcctgcctcagcctcccaaaatgctgggattacagtgagccactgtgcccggcctgaattggttttagagtaccaaatactacaataaaatgtccacagctaacttatagttgagatttgaatacttcttgatcagtgtcttttttgggttctcactctgttctaaggatttatttaaaagccacaggggctaggtgcaatggcttgtgcctgtaatcccagcactttgggaggctgaagtgggcaggttgtttgagctcaggagttcgagaccagcctgagcaacatgatgaaacccgatctctacaaaaaatacaaaaattagcctggtgtggtggtgtgtgcctgtagtcccagctacatgggaggctgaagcgggaggatcacttcagcccaggaagttgagactgcaatgagccaagattatgccactgcactccagcctgggtgacagagtgagagcctgtctcaaaaaaaaaaaaaaaaaaaggcatagggaatagatggtttattttattttccctgttgctttccatagcaaagatctgtttcccaaaatcctggccttgagtacaatagaaatgtttcctctgtctgcactcaccctcctagaatgactttcacacatttattcctgggtcaagaacttctgcagtttatgtccatagaatatgttagtttcctcactaattttgaattcgttgtggtcactttttgtggtgttgtgaagagttatttttttcctcttccaacatactgagtccctttcttattttaaactttgtaaaaaatagaaatacgtaacatgggtactataaaagtcttcaaatgattcagaaatgtgtaatatagaaagtgaaagtactcttcaatttccccctctattccactccgggataactagtcttcacagtttcgtgtatattcccccaacattttaatttttatttttaaaaaatgagtcaaaaatttaattatgcggtgtctttcaatgataattgttttccctcccacaaaggccaaattgttctttttgtctgaattacaaaagaataaatgtaaaatacaaaagttttagagcataataatgaaactaatacccattagcctaccactcatcattatcctttagtatagtttagtaatgtactcagaagtttttcttagatttatcatgctccctgagtgacagtgttttccttcatatgggactggtgaattgcaagtgtagggacatagtctttggtttcttagttttgctgtctgatatgttaggtactcagggagtgacgcttggttgtttgcccctgagggacctcatcccatccaggttttagggaaagacaatttaacctttagaggaaaaaaaacaatgatcattgaataagagtgtaatttgcagtattttctggaagatggcatcctttttctttgggttggaaatttactttctccagagcttgtagattgctagaaagcttctgtaattgtgactactagactcatattcaggcgattgagacatgagtttggcaatagctaaagctttgttggctatattgtaaggtaatttataagcattagaatgctcaggggtatccctagtagaaatgacattgaagcagatgccagacagagaactgtcatacttttcctaatttttcctgtgaagctttgagacttcagcattacagaaaagaaatccagagccctgaagtacaaaggagcttatccattatagagcttttcattttctcctttgcaaaggcttttatattttctcggggggttcttgttcttagtgagtagctatgtaaaccagggagtatatttgcagaggctaggaaagaattaatgggagaatgcaaaaacaatcaaaagatctgaatcacaacctagactcaagtccgaagaggtaaatatacaaagacagcaacttgaatatgtaatttataattacatattcacattgtgtacacagtaataccatggaaagtaccctcaatgggtacacagtaataccatggaaagtaccctcaatgggtacacagtaataccatggaaagaaggaaagtcccgaggtggcaaaggaataaataaatggttaagaatggcataaagtttgttcaagaaggctttccagaaacatatgtttagaaattacttttgaaagaactaatcgagatgtgttcattgaaatgagagattgttcacagtagtataaatgaaaagaatgaggagaggattacaaagatgcaggacacactggcttagagtacagtgatgtcatagttgtacttgctaatctgccagaggaaatgaatcctcttgttgttgttggccttcaaaaagccaagatgtacagggctcgcccagtttggcagattcatttctttgggagccttttctttcttttactccagatacgtagagtcctcattatcatctatcaccttctctctgtttaaatgtgtcgtagaattgaaagttttgagccgcttaagattttggtggctaaaattttgttgctgtgatggaagacctgtttctgtgaacactggaagcagaagagccttatgattactttttacttatttacccaggaccacatgccctgcaggaaaataggattgcatgaccagctggcctccactctgcagattcatccacttcttcaatgtcctctatttctccttctcatttttaaaatcccagaaggcataggtccccaggtcatatacttcttttgccaccttcttctacctttttgccactttttttttttgtctgagccttctatattggctcttgcattaaagcatcctaatcattctggagttccataggtagctgattcttgtttatcttataagtaggatattttccccattttattttattttttgaaaggaaacatgtgcataaggtacaaaattcgatgtaaaaatgtatgctatgaaaaacagctttttttctgtaccctgtcctttagccatacagtttctacccagaggtaaccactactgccatttactgtggatttctctagaaagagtttatgcattcacaaacatataaatatatattcccccacccccatgaatggtagtatgctatgaactgtgtttagtgtcttgctttttatcatataatatgtatgactacatgtagggaacaggttcataataatggacattttaaaaattgaggtgaaactcatgtagcataaaataaaccattttaaatatataatttagtgacatttagtacattcataaattgtagaaccattacctgtctagttccaaaacatttttatccccctcaaaggagacctcatacccattaaacggtcactctccattctctccacccctcaccgctggcaaccactgatctactttctgtctctatggatttacccattctcgatatttcacataaatggaatcatatagtattaggccttttgtgactggtttatttagcagcataatgtttttgaggtgcattcaccattgtggcatgtatcagtcctttatcccatcttatggctgaatactaattcattgtacagatataccatattttgtttatccattcatagttgatgaaatatgtttttttttaaaccacttttggctattgtgaatagtgctgctatgaacaacagtgtacaagtatttgaatagctgttttcagttcttttgggtatatactaggattagaatggctattaatgtacatttaagttgcttccagtatttgcagttacaatactgaaattgatattttatatacataattttatacatgtgtgaatatatctgttggatgaatagctaaaagtgcgattgctgggccaaagcattgtacatttaacaatgcatttgaattttgaaatatgttacagaattgcccactatggaggctgtactatttatattcccacttacaaagtatgagagtgcttcatctttccttagcttttaggaatagtcacccttcctacaaaattatattgcagagatggcacactgaggatagccataggcaaacagttcctgtgccatgattcactgagtctcctttctgcttgcctgcttatcctgtctttttctcctctaccatctgggccgtctgattttctgattccccaaaaagaggtcttgataactgggccttttgtttagtgtcctggtcaaagttcttcctctggtttaacttctgtctttctgcttacatgttaattttgggtaatcctttgatttcattttcaataataatattgtggaagtagagaggaaagtgctgaggtgacagaagaagaagcaaatggttgagaatggtataaagtttgttcaggaaggcattctagaaaagatgagtttcgagatgacttttgaagaagttatttgcaatgtaaagtttgaaaggagagattattcctagtaggataaatgaaaagtaggaagaaagggttcaaaaggtaacatactccatctcaccccactccccatgtcctggtcaaggtatctcttactggctggaacattctttttcctattaccttatcccattggggagtgggaagtaaaggatcagacagggtatagcttctggtacctccagtctaggactaagactctgagagacacgaaaatatactagttatggactccttagagtgagtgcacagggagtattattttagtggtaaggcagtgcaatgggtctaggactgtcagtaagggtgggtgatgagttttacactagatatgtggtatcagtggaagcagctgatattgatgctaattataggtgctggcaaactaaaaagaaaagagagaaactattacaatatggtttggctgataaaaataatgttaattgtagtcttctgactcatttatttatttctatcctggcttcctctaaaaagaaatttgaggtggttaattgcagtcattacatcaacttattataatttatgttcagttacaattatacacaattaaccatgttaaaaatgtcagattaatgtatcaaagtttcatttgctagcaacacttaggtgtctatgctgagtacagtgtgtgttgtatatgcataaaggtcagttattaccataaaagcgtggtcatctgatggcttcttgttataggtttcattgggaggctgaggcgggtggatcacgaggtcaggagatcgagaccatcctgaccaacatggtgaaaccctgtctctactaaaaaatacaaaaaattagctgggcgtggtggcatgcgcctgtagtcccagctactcaggaggctgaggcaggggaattgcttgaacctgggagacggaggttgcagtgagccgagatcacgccactgcactccagcctggtgacagagcaagactctatctcaaaaaaaaaaaaaaaaaattagctgggcatggtggcactttcctgtaatcgcagctactcgagaggcagaggtaggagaattgcttgaacgctaggggcagatgttgcagtgagctgagatcacaccactgcactcgagcctgggagtgagagactgtctcaaaaaaaaaaaaaagagagagagaggaatgaaagtccctgacctcagggagctcaagtccagagaggaagaaacataagtagtaccatttgataagtgaatgggaacgtaagtacttgatattcaaggaatacagagaaagagaatgtaatacaaatttgggatggttaggaactgcttcccagaggaaatgatatctcaaacaaagtctgtagtttacgttatggttctctctttgtattgtacattctatggattttgacaaatgtgtgatgacacatatccacccttatagtatagaatagttacgctgccctaaaaatcttctgtagtttacctattcatttctacctctccccagatccttggcataaattgagtcttaaaggatgagtagcagacagttaagtgaagaaggagaaaagagttcatagtacaaggacactaagatgaaaaagcatgacttaaggtaccttggggtactgcaagttgaaaattcttgatggcttcggtggagggaataagaagagtggggaagggtcagatgaggccagagagacacagagaactcatatcacaaagggcttgaatgccatagcaagctgtttatattttatcttgaaggcaagggggaacctttgatgactttatgcagaggaatgaaacaattagatagcagtgattatagtgatgtgagcagtttgctgcattaaaaatctttttaatggtagaatataacacagatatatagacaactttataaaacaaatgtttaaatgtattagtataaggtaggtaaaagatagacctttgccaaccaccccagaaagcctccatatgcctcttcccaatcacaaccccctcttccctaaaagtacctactatcccaacttttataataattactctcttcttgttctttatatgttgtcacccaagtatgtatctttaaacactagagtttgtttttgcttgttttcttgttttctctttttgatatgtcttacaattttttttgtttgttttgttttgttttgtttttgggatagtctcactctgtcacccaggctggagtgcagtggctgtgatctcggctcactgcaacctctgcctcctgggatcaagagattctcctgctttagcctcctgagtagctaggactacaggcacatgccaccacacccggataattttttttgtatttttagtagagatgggatttcaccatgttggccaggctggtctcgaactcctgacctcaggtgatctgcctgcctcagtctcccaaagtgatgggattacaggtgtgagccaccatgcctgatcatgtcttacaattattttttattctatgggttccccctccgtctcttgcttttttttccttacaatttgtttattgaagaaatcaggccatttgactatatggttttgtttgacttacagagttttttacattcccgattttgctcaaaacattcctataagtttagcttaacacactcttctgtcctttgtatttcctgtaaattgtagttgcacattgaagattgatgatattgatgccaggcatattccatagtttgagtatactataatttaaaattttttccccaatttgtagacatttggattgttccccagtttttgctgctaaaacacaatactatagtgagcaactttatacacttttttttgtaaacatgttcaaatgaatctcccatcctctattacacagtatgtatttttcctctatggcactttctcagtttgtatgattatttgattaatatttgttcccttctttaggccatacatttcatgagtatacccattgttcataggtattttcctttgatttattaatatgcttatctgtgtatccatagtacctttgcccaataaatattagttgaataaatgcatttctataagtggaatcattgggttaaagaatatatacatttataattttgttagacactatcaaattgtataaaaatattttacctatttatatttctgctgctggtacttattttcacatttagcctcactggcccactcaacaacaccgtgccccccacccacctcttcaccccctctcctcttttccttttgttactttcttctacaaacatttttttgacacttacattccaggttttgttctaggtgtttaggatatatcagagagcaaaacaaagatcctgggtgggaagaaatagacaattaacataataaggaaataatataggatgttagagagtgaaccaataaaagagtgaaaggcagttggtaatgctagaattggagttgagttgcaattttaaataaaattctgagtattggccacatgagaaggtgacatttcaatagagttgaaataggtgagggaattaacgtggctctctggggaaagagtgtgataggcagcgtgaacagctagttcaaaagctggtagctactgaaaaggagtaggaagagttttgctgggtcctgggaatgctgtttcttgatctgtgtgctggttacctgagtgtgttcacagtattcattgagcagtacaggccgggcgtggtgtttcacgcctgtaatcccagaactttgggaggctgaggccgggggatcacttgaggtcaggagtttgagacaagcctggccaacatggtgaaatcccatctctactaaaaatacaaaaattagccaggcgtggtggcatgcgactgtagcctgtagtccagctacttgggaggctgaggcaggagaattgcctgaacccgggaggcagaggttacagtgagctgagatcatgtcactgcactccagcctggttgacagagcaagattctgtttcaaaaaaaccaaaaaaacaaaaacgttgagcagtacggttatgatttgtatatttttctctatcttatacttcagtagagcttgcatatttaaaaatattagtggatgttgaacatttcaaaatgcattaatagtacttaaccaattcatggatatttttctttgacttattaatataatgaatgcattaatcagtttctattaataaatcatctttgcctttctaaaatataacctacttggttatggtgaattattcttttactataatgctaggcttgatttgcttgtatttcattttggatttttctatctatatcacaagtaacgttggtgaatagttttttgttattctcctatgttagatttgaagtgttttccttaattataggttctttactactgtcttccgtagaaagagaagttctacagtacttaccgaatcaactgtctagaaaaagggaagagaataatttctagtgtttgagtttatggtccttatgagatacctggtaattactacaatttagtagttgataggtgagttcctgtcattgcctagacagatggctgttcacatggagtctggggcttaagtattccatcattttaatgtcatggaaacattagccagtactggactactaatgggtggtgtaacagttgcctgggggtgttttgtttgataattgtagaccttactttttaatgtgactatttctgatttcttacattttccactagaaacaagataaaatgtgcagaagaagcagcctgtgagtgtgttgctgtagcctagtcagccagcctaggggatggggataagtgcagaggtttaccttctaggaaagaggatgtactttcgtcttagaactgctagaattttttcactgtatgatgacattgaacttttcttcaggctcagtaggatagtgggtctggctgccttcttcctccattagcacaggagtattattcttctgtctgggagactgtggctttttcatataggaaattctatagctgtgtttttcgcaatgtaattcaagaatcattggcatgagagtcaccaagtttcttgttgaaaagccctttgaattagaatctctgtgagtagagtttaaaatttacattctaaacaagagcctcaagtaattattaaaattaaaagatggccaggcacatggttcactcctgtaatcccagcactttgggagcctgaggcaggtggattgcttgagcttgggagtttgagaccagcctgggcaacatggtgagaccccatctctacagaaaacaaaaattagtcgagtgtgatggcacgtgcctgtagtcccagcttctcaggaggctagggtaggaggattggttgaggcagcaatgagccatgattgtcactgcactccagcatgggtgacagggcaagacctggtttctaaaaacaaatttttaaaaagtccagtcaaatatctgtaataattcagaataattctgtaatctctaataattcataaggtaataagtttcttgataaggatagttaaatcttcaaggaaagcacaaaaggaaggagatttcagcagaattaactactaagtttgttgactgattggacatgggaaataaagaggaattttaagaatggtcctgtggtttctgatttcaaagtattgggagtttggtggttttggacatgaggtgtacttgctatactcccgtatttctagagaatttttaacactgtaaatacaatgccattaccactgggggctgtgatactgtgattttataataagaaacatatattttggtctttgtccctggttcctgacacagagctcctaatctcttagaattttatggatactaggaatgtctgttgttctaatgagggactcttgatgggcttccacataggaaccagttatcagacagaccaagccatgtttggaagcttggaactttttttttttttttttttttttgagatggagtttcactctgtcacccaggctggagtgcagtggctgtgatcttggctcactgcaacctccacctcccaagttcaagtgattctcctgccttagcctcccaagtagctgggattacaggtgcctgccaccatgcttggctaatttttgtatttttagtagagaagaggtttcactatgttggccaggctggtctcgaactcctgacctcaaatgatccacccaccttggcctcccaagaagcctggaaattttagccccattccctttccttcaggaaagggagaggaactggagattgagttaataattgatcatgccaggtcaggcacagtggctcctgtctgtaatcccagcactttgggaggctgaagcagtaggatgactccagaagcttgagaccagcctggacaacatagtgaggccctgtttctacaaaaaaataataccactaatactacttataatagattgtgtctatatgataaagcctccataaaaatcccaaaactgtggatttttggagcctctgtgttggcaaacacatccgtgtgctgggagggtggtgcatcgcaaatccacagggcagaagctcctgtgcccaggactcttccagaccttgttctgtgtatttcttcatgtggctgttcaactatgtcctttgtaatatcctctaccgtagacgggtaaacataagtaaaatgtttcgttgaattctgtgagttgtcctgcctcagcctcccatgtagctgggaccacaagcctgcaccaccatgcccagctaactttttggttttgcctgtttttgaacttgttataagttatcataaattatctttcctttagagttagtttcatttctttttctttctttctttctttcttttttttttttgagttggagtcttaatctgttgcctaggctggagtgcattggcatgatcacggctcactgcaacaaccagctcctgggttcaagtgattctcctgcctcagtctcccgagtagctgggattacaggtgcccatcgccatgcctggctaatttttgtatttttagtagagacaggtttcaccatgttggccaggctagtctcgaactcctgacctcaggtgatctgcccacctcaacctcccaaagtgctgggattacaggcaagagccaccatgcccgacttcactgtgcattctcgctaacaatgtacaagagttccagttgctccacagcctcactgacgctttggattgtcaattgttcctcttcctcctcctccttctcttcctctttttcttcttctttttaaaatttctgtctgctttttaaatgtgattgttccttagggttcccccacttcatatagtctttttttcttggcctgcactctgccttagtgtttttatttacttgcatttttatttatactcatttgtaaatattggttgaacttttacattgtgccatgcattatcaggtgctgaggatacagcaaaagaacaaagcagaaaaatccctgcccttattggaacatatagtctgaaaacttccaagtctgttccacatctctttcctgagctccacacccgtatatctggctgtctactggccatgttcatttgagatgttccatagatatctcagagtcaatatacctaaccctgaattaatcatcttcttcagcctgcccccatgttgtatttttttctcggtgaatgatgtcacattcatccagtagctcaagctaaaaacctaagcaatattatttaatcctcctttccacattttatttactcattaaatgctattgattttccctccagaatatcttatgaatctatccccttctctctacccactctgccacttccctagtccaggctatcaacagatgagtgcaccattctccttacgagcctccctgacacctcctccctatgaatcaccagtcctttctacccaaccaaccaccattggccacactgttccactgttctctttctaaaatgccaaatctgatcctgtctttcccctcttaaaagctctgatagctctgtgttgccctccaggtaattccaaatccttaatattacttgatttctaaacattacctaagacccatagtcattaggttctttcataactctgtagcctctcactctagatattctggaactattttcagctcactgaacatgcctttgcatgcataatttccttttcctgggacattttccccttccttttctcagtactaatgcctagcaaaacctaactatcctcagtaattgttctgctggctagttatgtgttttaatgcatttttgggatagggaaggaaacttgcttatttaaaccggtgtaatttatcttatgacggttctgagctaaagtggtgagaatatggagctggcttgtcagagaacatgacttgttttttcatgcgttagagatgggcccagtagatgggatcagattattcattcaatttattagtacagtagatatttactgagaacttttatgtataagaaactgctgtggggtgctcaaagatgaggggcagtgtcctgcccagaaaggcttctttgggctcacaattgtggtgagaaacagcattgtcacttgcctggagcaatctaagttgatagacatattctgaggttctatgtgattttttttttccattttctttttaaaagaaatgaagtaattaccctctagcagttgctatggcaactgttctacaggagggttttttttttttgcctcccctccccccatggttagaaagtgaaataaattattacaattttaaaatggcacactaagccaacatatcctttctgagaggtgagaagaagagacataggtggtcggaataaagtaagtgcctaggaagaaaattggctgtcagggtatcactaaattaaagtctgtgattgattagtagtcccgtatgcccaggattgaggattagctcaagtactgaaaacagcctgggttggcatcatatgatgttcctagaatttcgagtcttactgtagactttcaagggagtcacacactcagaaccagtttgtgggccttgtggaccccacattgaagattccttagcagaccttgggactgtcagagggtgcaattctaggagttgtgtctttttttctgcttcttatttattaggactctgtaaggcaagcaaaaacctggtaacgtgacaaaataacaacaaatgctagttgctcaccatcttccagggactgtgcctagcattttacatattttttcctgtatgatctttacagtaacccagtgacacttgtgttattgttattctcatattacagatgaggaaatatctgtaataactttctcaagatcatatagctagtaaatcgcagagccagaagaactgaatgttgactttaaaacccatattcttggctgagcatggtggctcactcctgtaatcccagcactttgggaggctgaggcgggtggatcactggaggttaggagttcgaggccagcctggccaacatggtgaaaccctgtctctactgaaaatacaaaaattagccaggcgtgttggtaggcgcctgtaatcccagcttcttgggagcctgaggcatgagaatcacttgaacctggggacagaggttgcagtgagccgagatcgtgtcaccgcactccaacctgggtgacagagtgagactctgtctcaaaaaataaaaaacccatattcttaattatgaagctatttacttcttgtttcttgagattaaaggcctatttttaatgatttctttatcacaattagtttcttgaaattcaatttgggtgtgggataggacttaattaatagtggatttttgattttgaaaaatgaataaaaaatattttcaattttctcctgtccttcaaagcttctgtgttttagtggattttattaaaaatttataggtaattcagaagaagtggctctctttaaggacccaataggctagagtggtttattacatattgttttaagcccctttctgatctaggtctctctcagaacaccatcatttaggagctcatatgtctttcctttgtcaaaataagaaaaattagatctctgtctctaagaaacccttccttgtctctgcgttcaccaaacctgagcctatcacaataaatctatgagaagctaagccctgataccatgggtaagggagtctgggagcttaattagaagattaatttcttaagagataaacattgccattctttgaccttttaactttcagtagagaacagcaaaattgactatcttcgctcccagacaagggaattactcccttacccatggtatcagggcttagcttctcatagatttattgtgatgggctcaggtttggtgaacacagagataaggaagggtttcttagagacagagatctaatttttcttattttgacaaaggaaagacatgagctcctaaatgatggtgttctgagagagacctagaccagaagggggcttaaaacaatatggaagaagtaattttttgttgttgttgttctgtgggttttttgggttgttgttagtctctctctatagtgaaaggcagagaacaagaatactttgtagatttgtctcacatttggtagaaggcagaaactctatgttatgtaaagttagtagaatacaagtgaggtaggcttaagtaaggtaaggcacataataattgctgagatggggaaatgacttttgaattccttcaaaaaagtattttcaaaaattatctgctgcttctttgtggttttcttaggtcactggacctatttgggctggggagaacaacagagtacgtaagaattgaaattccttatcattttcttgatcttacccacaaagtacatactccctctgaactgtgaagctggatattcatgcatagacttccatttccctctcctctcctacttaaatatcgggagacaatgacctgtggtggaatgttatatcctttcaggctggtttcttgacgactttgtgtgtgtttatgtgtgttacaaatttcaaaccaaagtcccagtcataatcctgacaagatctcctaatttttattccccagaggcaagtagtagcatcagccccctagtgtggccttctcctttggtccctttggctaaggagtgcagtgaccagaaggagaaggttcattctaggatgaactagagtcaaggtgattggtgtgcattctgatttggctgattttcttgactaggaggatatgcagaacagactgctgtcttgggtttattggtctagcaaattgtgaatgccatttcagccaaaaacctgcttttgttaaggaaacaagaggctgaggatatggcttggctttccctgaagcagcccagctaaggccacctttgttctagagcttagagagtgggcagccagttctttgtggcaaaacatgtagccctaggctgacattactggttgtgttacccatcttacaggatctggttgagtctcagtgattaggtatccagtaggtactaagacgggccaaagtttgtcctgtcactggaatttctcatgaagtctgtgctttctgtgatttgaatcctgagtacttctgctattaggaaagtactcaaaagcagcttgacccatttatgcctagtgttccattattggaactctaagcatgtgggagttatttatatcctactgctcaaggtcatcgccaagcagtaggtgacctcaagcataaattgcaacctcaggcataaatgggttaacagagctcaggtaagttaaggttttcaagtagaaaaagcaactaagccatgaaaaaaatgtgaatgaattttctttcctttctttggttgctgaagttctattaataggtgtgctgtggatttaaagaccaatccaagactcaatccaggaataccacatactagagggcctcatttttctgtatttcactggattttgtttgagtgcctgctgtgtgcttggaggcccatctttgtttgccccaggttagatgaccttcccagcctacttttgcaggtttttaattttccataatttcctctatgtctttttatttacctatcaaatgaactacaaaatggtttctcaaaaatatatagcctttcctaccactgggcctttcatcatgccactgcttttatccaaattctagaagatatttcccttctgcctccaatcttcacctattaaaaatgaaccaattcttcaaagccatctcctccttaaagcttccttagttaccctatcaggaagtgattttacttttaattcatagcacttggtttgtactaactgccttgcatagcaattcaatatttgtgtctatatattctgtctcctattagactgactctatattctgagtcttctgtgttgtttagctttggatatgtaggcagtcagtgaatatttgagtgagtaggtgttcccagccttttaattttccatctttcaaatagactttaccaggggcttttcaactgttaccctcaaactggctctctagttccttcttaggctgagccaaccaaacctgcactcagtttctctctgcaaagccagggcttttctcgtctagccgacatggtgctgtgggatagattatggaggcagtaagagatcgtcagtgacacattaaaaacacagttatttaattcaaattgaagtgttacatattttcctgaatttccctttttagtttctaatcaggcttggtgccaggaggtttactttttaggaaaactggaggtgattgcctctcactacttttttctgtttctctcctttgtctcactttattccttagtatattctctctcttgccctctcctgcttttcatattctcttctactcccaacctcttctttccatggatgctttgtttcttaatatttgccctttatttctttagtgtagaaatgttgttagcctttagtaaagttgtagagtatctctgtttagcctagcaaaataaacaaaaagcagactattatttaggagtaataggtcacatgcagggagaaagtaaaacctgtggatttgggttgtgggcttctaactctggctgagctgccctctctggcctcaaaagtgataggattgtctgtcgcagttgcctccttggagactgaatcttgtttctctgggttatgtgctaatacttttcctgccagagtttagtagacctctggttttgtctcctttgttgcctctgccccttcatctgtatgcatgaatagtccagcactgacttctacagacttgctctttctgtgggttcagaaagaattaagtctgagtggcatatggttttgtctctgggtcctatttttcttgtcttcagaacaacagatgcatcaagggctaaaaacagtgcttccaaagtctctttttcttaatatatcatcagaatgctttgtaagcagaatgctttgcatccctcttgtttgcttttgttttcaagctttgctactcctgccctggtcagtggactacttgctccaaatgtcaagtattaactaatacttgttcctgaccatttgaacattagcttctttctcatgttgatatttttcctcccggagttctaatccctctcctctccttttttatgttcacatgtaaccataaactcaaataggaaaagctcataagatcatcttacccctgtctcccatctgtacccacaaatgttattgagagtccaatgctcagattttcttccttacctataaaacccacatgtttgtgctctcttttagtggaattcttatctaccaacttgtctaatgaagccaaggggggtcatttccctattatcttcaatatggccccatgttttacaattctgtctggaattttctttttctagttcattaactcttttctgtttccgctgtatagatgcaggtccttatctcctgcctgagcaattgtaaaagcctaatcttacggtcttcaggaggtttccactgcccacattgctacaagattatctttttttttttttgagacggagccttgctctgtcgcccaggctggaatgcaatggcatgatcttagctcactgcaacttccaccctctgggttcaagcgattcttccgcctaagcctccctagtagctaggattacaggcatctgccatcatgcccggctaatttttgtatttttatagagatggggttccaccatgttggccaggctggtcttgaactcctgacctcaggtgatccacctgccttggactcccaaagtgctgggattacaggtgggagccaccgcgcctggccccaagataatcttttaaaattactaacatgagttcattttgtgctaaaagtatctccattttgggatggtgaacattccttttcctcattgtaagccaaataggaacttgtcaagaaaggacacgtggaaccctgttaatcatacacataagggtatggtgtcagatacgacttcctctctgtaaaacaggcttcaaagcactcttaggttgagctccctttccaagcacagcgatgatttgtaagtgtggtctttttagttaactttaacaaaaaaactgtagccagtcaggtgctggtctgaaggacaaataattctacgaaattgtagtcactgctgttggataaacttggctgcattgtcagcaagatcccattggcagtgcataagttttttcttctctcagcccatcctctggatgggaattctgagcctagggtgtaggtgcttgacaggaattgttaggaaaagctaacactgcagcagcacagtaagagtgctgctgttctcagctgcatctagagcctttgacttgatttccaggccttggctttgaccttcctgatttccaggaccagcttctgatgttagacctgcttatttggttcaatccatatgtttaaaagtctgaaaacaccaagacaacgttaaataaaagttttggggtttttttccccaagatatgaaaaagctaacttttttaaacctctgctcctttcccctttctttaataacaggggaccagactgtatttgtgacatttaaaagcagtttttaattatggttatgatagttggagaagcagaattccaaagaattctacagtgggaaaatgcaacctagagctcctctaagaataagcactaaaattaaactaagtatatatctcatatgataaggaagagaaacttgtgggtattaattgagacagttctgctcatggctctgaggtcgtcactgggctcatgtgaagctcagcttgcttttgttctcaaggtccagacttgttactactaagttagaagcagaaataattctgaagaactaaataaagctggggtgctttgattgaatgtgcttattccatagcttttgaagaccctgatagtgccgtcgatgaccgagatagtgactatcgcagtgagaccagcaacagcttcccacctccttaccatacagcttcccagcccaacgcttctgtgcaccagttccctgtgccggtgcgatcgccacagcagctgctacttcaaggcagttcccgggactcttgtaatgactctatgcaaagttatgaccttgattatccagagcggcgggctatcaggtgggtattgagcacaaagtactttctcttcctaatatccaggtctcatgatgcaattggcaagaagaatttggatgctttaacctgaagaggtagcgtaagtgtagcagtatcaccggccaaactacagtcattttgtgtagattattagtcttttttttcttccacatgtttatacattgccataaggaattttatgtttatatattgccataaggaatacttctcttcatgatcagtgattctcaactgatcagggcgatcccacttggggtgtatctgccccacttcctgactcagtgagtttgttataccctttgccaagattaaaaacagaaaaaatcacagattggatagtccttcttgcctaaatatttccctgggaactttagaagaaaaccagtatgatttcttatagcagattcagtatttttactggaactttgttttaatttattttatttcttaaatatataaaacaattatgtggttaaaaaatgtcaatacagcataaagagtttcccacccacacttaccttcctccaccccatcttcttcctgtttcataattcccttcctactgttgtttcttatgtatccttccatagactgttgtcatatatttatgagtataaaagcaagtacatacatatgtgctctcccctgccctaagattaaaaaaaatttcagacttaaagaaaatttggagacataattcaatgaaaacccatattcatgttgcctagatttaccagttgtgttaacattttaccacatttactttatctcattctccctaatatgtattcatatacacatacattttctctgaaccacttaaaaataagttgcagatattgtgttacttcatcagaaagtatttcagcatgttactcctaagaaaaagaactttatcttatataacctcaatatcatgatcacactcaagaagtttaatgatgcaatgttattacctaatgtttagaccatatttaaatttctccagttatctccataatgttctgtatgtatatttgttcctttctggtccaggatccaatccagaaccgtgatgcattgcatttggttttcatgtttccttagcttcctttaatttagcaaaaatttcattaccttggttttttggtcttttaagaagcttttttttttttttttgagacagagtctcactctgtctcccaggctggagtgcagtggcgtgatctcggctcactacaacctcagcatccccggttcaagtgattctcgtgcctcagcctccggagtagctgagactacaggtgcacgccaccatgcccggctaatttttgtatttttggtagagacggggtttcatcatgttggtcaagctggtctccatctcctggcctcaaacgatacgccttcctctgcttcccaaatggaattacaggcgtgagccaccgtgcctggcctaagacacattttttttttgaagagtgcaggccagttgttttgagaatgcctcttcgtttggttttgtctgattatttcttcatgtttagaatcaggttaaacgtttttggcaaaaatgctggatgtttccttcacatgcattcaggaagcacatactttgtcttttttttttttttttttttgagacggagtctcgctctttcgcccaggccggactgcagtggcgctatctcggctcacggcaagctccgcctcccgggttcacgccattctcctgcctcagcctcccgagtagctgggattacaggcacccgccaccgtgcccggctaattttttgtatttttagtagagacggggtttcactgtgttagccaggatggtctcgatctcctgacctcgtgattcacccacctcggcctcccaaagtgctgggattacaggcgtgagccaccgcgcccggcccctactttgtcttattattggtgatgtttagtttgatctcatggttaaaaaatttggtatatgccgtatttctccagtgtaaagtttcctcttctcctttgtaattaataatatctggagtgatacctgagactgtatcaatactctgtttccccaatagtcttttactcaatgatattagcatccattgatccgtgcctgaatcaattattttattgattggaggttagttttcaagaaatcattccaatttagcttatccttttagtttctaaaattcactagactggctaggtgcagtgactgatgcctataatcccagcactttgggaggccaaggcgggaggatcactggagtccaagagcttgagaccagcctgagaaatatagtgaaacctcatctctacaaaaaataaacaaaattagctggatgtggtggcgcatgcctatggtcctagctacttgggaggctgagttgggagagattgcttgagtctgggaggtcgaagctatagtatgccaagattgcaccactgcactccagcctggatgacagagcaagactctgtctcagtcaatcaatacaaaattcaccagaccataggatgatgtccttttcttgcccacctcaccaaactgctacatggtgagtttagacacagggtcttgcgttgttgctcaggccggtcttgaattcctgggttcaagtgatcctcctgccttggcctccgaaagtgcttggattacaggtgagagccactgcacctggccttctggaagatttttagtgactaagtgtctgctttgatcttgcttctgtttcctaaatgaatgcttttggatgttatatctataaagaacacactgaactcataagctcctagcctttaggttctttctccatccctaccttggtacacagaagaaggcagtctttaatctaagtgaaagaaagttcaggctatcttcagtattcattgttttaaggtgggcatgtagcttctgctgctataatcagtatagggaaagattttcttttcactgtgatcctcaatgcatatagcctttagatttcacaaacaacaaattataatgccttaggctgggcatggtggctcatgcctgtaattccagtagtttgggaggctgagggcgggtggatcacctgaggtcaggagttcaagaccagcctggccaacatggtgaaaacccacctctactaaaaatacaaaaattagctgggcctagtcgtgggtgcctgtagacccagctactcgggaggctgaggcaggagaattgcttgaacccaggaggcggacattgcaatgagctgagaatgtgccattgcactccagcctgggcaacaagagcaaaactccgtctcaaaaaaaaattataaggccttaaataatttgttatttttttgtagtataacaaagtttgacttctgctgatagtaaaaaatggttttatatgtatttttttcttattaaaagaaatatgtttgactatattcttggctacacatcctcaaatataactttcagaaagttaacagcttggcttctttttagactaaaaatttatcagcaaatttcgttttcttgaaatcccttgatatattttgctggtatactttaatattgcaaatacattctagatattggtacaacatgtttcatttttttcatttgtttcttagaaaaataaaagaattctaaaaagctcaccaatgaaaaatgattgcaagttgaagcatttaaaaattgatattatagctgttctttttctcatatggaataaactatttgactacattgatataatatttaagaacatgtggatttccttttcatatttttttagtctgaatgctttttatcacattggcaattttattgttctagtcttctcattgaacatgtattaaatcttataacttctttcttccttttccctgtctcttcctttttctttgctttattgttcctccaattttatcccttcacatcagacaaggctcacaggctaaagatgaaaaaattaggattatttcagctttctctgatgttgactatgaagagcaagaagatatacataaggagatagaggggaaaatatcacaagagtttctagaaaataataacataaacttgaaggaagcagagataaaagaaattagaaccctttcaaaagctgataaatactacagccaacaaaaacaaccaaagtataagaacaggaaaaagataccacctcagagccaacaaacagaattctctactgagtttaaggttgaaacttctgttttctccaggtatgctcagaaatatgatacactagatagaagaagaaaaaagaaatccttatacaatcattttgaagacagtgaaagaaggcaatatggtgagagatctgaaactaagactaactacaaaagtacatattctaatactgaaaattgtaccctttgccatactgaaaagaaacaaaatatggggtacccagttttgtacccctacaaaaatggatttgtggttaagagtggcatgcagcgcattaagttggaaagtcatgattatgatctgtccagttgtttaaggcactgtgaaaagtcatctggctcaaaccagcatgtcactaattttacctcattagatattcttgaagattctactagtagtacttctgatgaacttctgggttcccccatttctgataagcaggaaaatttacagtcaccaacatggcattcatccaatgtccaccatattggagattttcctgaggaatattatgtagcaaattcagcattgccattacaaaggatgaattgtgatgcaaaaacacttggagatctgtctgagtgctctatagaagagataaccccttcctctattgaggagcccaaggaggaccgtattgatacaatggatgagcttcagtgtttggtagaaacggtgtcagaatatttagcagagaaggaagaggagattaatagatttggttcactttcaaaaactaaaaaatcacataaacaaaatagtactcttgatgcagaacagagaacgcctggggatcaaataccacctttaactattgtcaagaatgacaaggacacggccatctctttccctgagttgactggagtacaatgtgctgttggttctttgtttagttcactcacagaaaaagtgggttcaggcacaaagcatctaacaaactctgtggaaaagttggtttccttagttccagaaaaaacagaaactcttaatcaaatagaggcaattaatttgggatctaaacccagagccatggcagtattggggaaggatctttccatgcaatctccattatcctctcaaaaagatgataatgtgaatatagacagacatagaaaaacctctgaaaatgagcacatgggtaataaaactgggagtttatactttcagaatacaacagaaagtattgcaaaggacttggctccacagagtcagagttcagttataaagtcggttttcagcaggttaaatccattgaagatcttttcagaaaaggaggaaacaaaaaaagatgatgaccagagtaagccaccaagaaaagaaagctttgttgagtgtggtttggagttaaataaaagggaaggcactcttgacaattacagtagtagcatcattgctttaaatgggagtgatgaagaaactacgggctggttccagatgcccacaagtgagaatttgttgtcctcccaagtaaccagtgaaccttcaaacttagttagttctgcaagtaaaaatgatgagagtctattggaagaaaaactctgtatagatctgtctcttttaccagatcaacaaaaaatatgtgccaaagatactccaggacatccttgtatagctggcagtagaactgcaaataaagaggtattttcaaagccattagaggaggacaaagttacaggtaatgatgatttccttgagccactcagaaaatcatttagccagtttttgctcacttcccctgagacttgttcaaaggaaagtttgtcagaacctgtgaaaattcgccaggtggaggaagatggtttagaaaggggctctaagaaagatggtcattccttttcctttagtggaaaactaaatcttccattttttagaagtcttggtcattctgaaaagcaacaggagttaaaagagaaaggaagcatttttcctttgtttaaattttctttcactgacagcaaggttactgttaatgaccagagtttacgtggctcagcagtaaccactgatgaggagagcaaaaaaaattgccatgaagataccaaacatagttcaataaaatctagttctgttccaaatattcatagtgatctaggaaaatttgacagtacagaggaatttaaaaagaatgaccagataaattgtcctgaagatgccaaacttaattcaataaaatctagttcagttccaaatattcatgatgatctagagaagtttgacagtataaaggaatttaataagaatgaccaagtaaattgtcctgaagatgccaaacttagttcaataaaatctggttcagctccaaatactcaggataatctagggaaatttgacagtacagaggaatttaatcagaatgaccaaataaatagtcctgaagatgccaaatttaatataataaagtctgattcagttacaaatattaataatgatctggggaaatttgggaatatagaggaattaaatccaagtgaccacacagcaggacagaattttgaaagggatggcttagccatccctggagttgtgcccaaagaacatataacttcagatcctttaggagaagataagaatcttatacaagcagcatcttcagtagcatcagactcttcattagagtgtatttctaccacttccaaatccactttggttaatgaaattaatgaagatgaggttatagataagacttccaagaaaaatacccaaggaagcttcctttctggcctgtttaataggttttcttctgctgaaaatttgtctagtcaagaattaaatttgaaaaatgatgactcccatcacaagaataataccccaggtttaatctctggaatatttaacctgctatcaaatagcggtatgattgatcataaaccagaggaagcaaagttcatgtctttaggcaacatgaagagtttgaatggagataaccatttatccttggatgaggtccctgctacttcatgtgtgacttctgagaacccgaagaaccatgttgaaaaacatgaaacttctagcttcatagaagcctccttattacctaaagaaaacataccattatctgatgctggggatgataatcattattgttcccctacagagaaaaaccagcaaagtgaaaagcatcacccctcctctgagaacattgtacttcactgtgctccaagtgctcagctaggttttttggagaaatctatggctaagaggcaaatgccaaaccatgttcttgaggcaaaactacatgaaaattcaaacaagttaaattcacctgtactaaataccaacattctcaataaatcaaacaactatcaggcttttgaagagatgaacagtcctttctgttttgaatgggactctgacataaaagatttgtctaaaaattccagaaaacttcagccagtttattatatgttaaatcaaaatagatttctatcagccgatgcttgcttgtggcttgactcagaaaactcagtgataaatttttgccaaaaagatcaaaatgcaaacatcttggagtggagaacaaatccaaacagtgtcatttggtgtgacttaccatatgaatcattcaatcagttagcatttaatgaagattacttattaagaggtgatgtgtgggcagctaactcattatatggaaactctggtcctcttccaattaatgaggctaataattcactagaagaattacccattgacttaagttcttcatcagatcatgaaaagactacatgccccgtagttgatcaagaatcattaagaatggatgaaaactttgttttttcaagttttggttatgagtaccaggaatggttgtcatgtcttgaacatggagtgtggtggccatcagaggatggggattatggatattatatgtttcatgatggtcaatatatctattctcttctcactgattctactgggcagtatgcatatttatttatacctgattcttatcaagagtatttggattgtgatttacagacaaatggtctatcaagtattacgttggatgacagcattatttctgcctgtagttttaaagtacttgataaggaagatgaaatattttggtatgttgaagaggaaccaattgatgaccctcttgatttatctttagctttgccaagaagtgaggaaccattgtatctaaatttagaaaccttttcacaagtacttaaagagtcaagttgtgaccaaagcgatcagccactagatttttcaggctataatcgtcaaaagtttaaaggagactttagatctttcaaagaaaggccgtgtggttctgaagacgctgaatgtacattagatctcagaaatcagccccaaactattagtaatcatgtctcaagcagagatcaaattatagagagagataaaaaccagcctctagctgaagattcatcagttcacctttccagtttccattggcttcagtcttctgttgaagaagttaccactttggttcatcctgaaaatatgactaaaggctcacaacaagcagaagagacatcattagtgaacaaagtggcttcagtattttctgttttgggtgcctcagttggtagtactttgaagtttgataagagtgaatccttagaggctttggccatgcagaaagtgaatcagcagtcagatttagcagagctcacaaatgatggctttcagtcattaatcatgagtaagcaattagagggtaactccccaaatgtggaaaaaagtcttcttaaggattcagaaagacagatagtatccaatgttcagcatccagaattgatcaaaaatataaggcaagaattctctttaaataaaaacaaccatgtgaaaaagcaaagtttgttaaaatctggtttccaggtaagccaaacaactcctcaggctaaatcaggtgtaaaagatgatgaaatcattacaacagactctatttcagtttctcctgcacctcagcatagtggggatgagcgtgagaattatgagcttccccagggccagtcatccaaagagtctgataaaacattatttaaaagttcattgaaactcttcagtcaagaagaatcgtcagttagtatgacagcaaatgaaaaacagtcatctggatttttgaatctttttaagactcaggtgaataaagaaggatcaccaaacttagaaaagattggtgatacaaatgtcaagataccacctcaagaaaagaaagaatcttctggtgtttcaaatttttggggtacccttggggatttctttaaagccaatgtatctcctatacagacaactgaaaatacgtctgtttcttcaatgactattaaggatgaggtcaggtcaagtcctactcctatggagctagctagccagggtgctgggaactttcctgctgcaccaatttcctctaaagggaaggctagagttagaagactgaacaaacagactactatcgatgacagtaggttagaggaatcaactagagggatccagggtaatgatttgactgaaaaagaggtaccattcagagaccatctaatccagcagtcacctaattcatctttttcaacaagtagtctcaaagagtcttccagggagtcttcagtagaaactagtggtgtgactacagtgacagaagtttcaaaaagtaatgaaatatcctttgataccctgagcaagagaaattcaaatgaacaagatcatttttctgacaaagactggagtttctctatggctgcaacatcttcatctcaaccagagttatcaaccaaaaagagtatattttcttttctcactggatctgaaaaatctgagaacagagcctctgctactctaccaagagccaaatctcaggcagaagggctattcacacttccttcatttttttccactgctagctcaagcattaagaaggatgcctctcatagtagttctacttttagtttcttcagcttgtcctttttggatcaaaaaaaggagacctctggggaaaaacaaagcatttcaactgttgttccagtgacctcccagccctgtaagaagacaaatgtttttgtagagagtggtagcacaatgaccagagaaagttccagtggtcatagagatagcatagcccaagaagtagttcatgaacagcaaatggcaccttgtatttccattaacaacaccattgaggttacctcccttgcagatgagctcagtgtagacaaggactgtcaggaaaaactgagttccaatattgtaccagggacatcagtggatttccagatgaatgaattgcaaaaagacattattcctccttcaccagaatttcaggcacaggctgaaacattcctcactggcccagagaaccttgggatagctccccatgaagaagaggctttcaaccacaaagccttccccagtgactcactgtccaactctttttcacatgctaaacagttaattgaaaaattcaatgatttagacacttgtactaactgccaccaaaatgagaaatttactactgacccagtgaacttgccattagaaaaggcccccgatgaggtcttaccacagatcctagagccagcctcttcctctccagagccagggtgtgcagggaaccttcagaaccaagatgcagataaagaggaagacaaatttgcattaggctcttcagtagacatgctttcagggtttgtgaccaaagtgaaatctttctctgggagcttaattgaacctcccaaaacactctctggacttttctcctctcctaaatctccaaagaaaaactcctttttctctcttgcttctgatgtatcatctcagcccctcaaaggtgaattatttggaattttcaaaagtcccaagccagagccatacaaacaagaatcatctctcccagctacttcatggcttcaaaatggttgttccagagatgctgtaggatcagtacctccagaaaggagagaagctgcctttacagcactaagttcagaatctactctcagtgactgtagaatgactgtggttagtgcaaagccagaatcagatatcttgacagatgatcctaaactaacaaccaaaatggaagacaataatactcctgaaaatattctggaacctcaacgttctgaaacaattaatacatcttctttctcgggtgatgatactgggcaaggagtattgtctctgagtgatgaaggagacatggggatattgcaagctacagacacggaggcatcgttagaagcagagaactttgcgctgccagcacagttgcatccagatcctacctgcattgccgaagagcttcctcctcccattcagccacctcttcctcttgagccagagccagctattcaaactgcctccacaaaccaagacttactggagctgcatccagccagttcactagaaactgatactatgctgttcaatgatgcaagtgtgagccagagcaccactctggaaaccgaagggcacttttctcatcctctgctggaggaccctgtgcttgctgccagagaaagttgtgagataattcatgcccagaaagatccacctgtagtaccccaggaaacagagcagtcaagaccacgttttgagatcccaaatgtgaccacttggccaaagcttcgtttgccatcctctgctactaaccatgggaaaccactgagctctttcttttcctcacctctcccctctggcaatagagcagcagagactggtttaatgtccagttttaagaagttgtcaactctatttgagggaagtagtgaggggaaagggagtgtattagcaagtgattcaaaactaggatttggaaaggtagatctttcatttccatggccaaaagagaacaaaggggtccctgaacaaatgcctacagaatcctcccctccagttttagttactagcagtgatcaggaccttaactccagtgaggctaacaaagctttgaagtcttctcaaatatctggggccagtgctcagccaggtaaagtctacactcagccctctgggacctctgagcagctggtggccagtccagaggtctgtgctcaggggctttcagggtctggagaagggggaaaccagcaggaaatctcagcatctggagaacactgggataccaaagccaacctgtctagccccgcctgtccttcagggaaacatgaggaagaaccctccactgtctctgagatatttcaccagctagaaaaacaagaagaggaggcagtacctgccagtactgactctgatttgaatgtacagcagccagtcactctgaatgacatcaaggagcccatgaccaacaaaaggcctgttcttaactcaagcatcataaatggctttaaggaattgaccatttatgatgcaagtgacttagtggtagattaatcatagcttgctttttatccttcttgtgtctttcctagtacccgagcttcatgttaattaggggttaaataacaagaactcagtgtgtgggtattttcatcctccccttctctctctgccaaatgtaattcatttactggaacaaggagcttcctgcttaaagcaaaagctgggcccccgatatttactcactctggtttgctctgccttgtataatgtgaaatggagaaaggagggcaggaagaggtagtaagtagttggtggtatatattaactacaactacatgataggctaggatgcttccttgggccttaggcacttatatcttgtaggagatggggatagatctattttgctttgttttttcaagtcttctaagatgctttctccagtggcaatgagtgtattaagcaaaatacaaagtgcaaaggatgccttgggatagtctgtattcccatatcctattccatacagatttgcatagtttcttccatggtatcatctctgccttttactaccctcaaggctgatgtctgataaatgctttgagtaaaatctcacaggaactcagagctgtcctttgctgtagttcttcagtctcgagcagtgtacaggatctatctgcagagggtactgttatttcccctaagaagcagtaccatacagtacagattaagaatgctaccttgacctctggcccaaacttgttcaaaggggttggtcagggtcagtgtgtgtgtgtgtgtgtgtgtgtgtgtgtgtgtgtgtgtgtatacttatgtacaagtatatgtgtttgtgtgttgaactactcagaacagtgacctggtacctattctgctggcatgggctagaggatcagaaatcagcctgaaaataccaggtaattaggaggaactttagggaaaatcccattggaaaataacagtgatttctcttctttgaccaagggtaaacacaagccctttagttaaaggcttgactctgtggtaagaaaattcttcaaaagaactgaagcccttagatgacagggccataaaactcaaggaagtaacttctagatactgctcttctttccaccactctgcccttcttgccactgtcacattctctgctataactgctttctctcatgactttctggatatgggaatacaggtgattgagaaaagattggcttgctggtcttcagatatagagatgcatgaatacggctctgacccagatcctggagttggactttgtccactctttccaaaactgagccttgccctgaaagaagctcagttacagatgttcatctttgggacgcttcctatgctgccagggatatcattgtagcatttatgttgatgagaccattcgtttgtgtattctcttggtcctggcctctatcttccaatgggttctattaactcatcttgcagatgaggaaactgagatgataactgaaagaacatgtctgctctcctttgctcatcctaaggtacaggcgtacacatttacaattgtagaggaagaaatgatgacctcaatgtaataagtaatagaaaaagagtggagttcattcattccattttactgtgtggaaattaaagaaagattaatcacagccactggacaagcttctttagaagactgaataaagaattttaggaataagtaacaggccattttaataatttttaatcctactcacaaatagcctattaagataaaatatacttcaaagtcaagtgcagaactgaggttaagtgtcgttggagaacccagcatgttgtgttgttttcctgttgtgttttcgctgaatagagactaattcttctagattatgaagtttggtcctctcttcccaggaacctcctatttgattcttgctactaatgtagtcattatttcctggatgtctcctttcttttgtcctggtccctgattgcatttatttacttatctgtctttctgtcattctcacagccccaccagcagcagtaggtatggctcctcctgtaatgtgagtcaaggaagctctcagctaagtgaactagaccagtatcacgaacaagatgacgaccatcgggagacggactcgattcattcttgccacagctctcacagcctgtccagagatggccaagcaggttttggagaacaagagaaacccttggaggtgacaggtcaagcagagaaggaggcagcatgtgaacccaaggagatgaaagaagatgccacaacccaccctcccccagatctggtgctgcaaaaagaccacttcctaggtccccaggagaggtaggcaacagctgccttgaggagctcacatggcttcctcagtacctgccctgtggtattgctgaaaataagtgattgtcatttgtttccctgcagctgggtatggtggtagttaacacctccaggctcaactctgtattgcttcctttgatttatggtgcactttccaagacattttggagatctctgaagaatatttgggtttttgtttgtttgcttttgagatagggtctcactctgttgtccaggctggcacgatcttggctcactgcagcctcaacagcctggtctcaagcaattctcccacctcagcttcctgagtagctgggactactaggtgtgcaccaccacacctggctaattgtatgtttatagagacaaggtttcaccatgttgcccaggctggtcttgaactcctgagctcaagcaatccacctgcctcagactcccaaagtgctgggattacagcggtgtgccactgcacccagccagcacttgggttctttgtagttagtgagctgcagtgtaccagggcttcttgagtctgcagttcatagcttactagttgaccttgtatatggcagcctctgagtcaggaactgacttgagccaggttatttcatccactggggctgtggtaggtactttggctgacttcctaacctattaagaatgctactttgacctctggcccaaacttgttcaaaggggttggtcagggtcagtgtgtgtgcatgtacttatgtacaggtatatgtgtatgtgtgttgaagtactcagaacagtgacctggtacctattctgctggtatgggctagaggatcagaaatcagcctgaaaataccaggcaattaggaggaacttagggaaaatcccattggaaaataacagtgatttctgttgtaacttttttggtgaacattttgttttgtttttccctggctgagaaacccaggacagagttaagaaagaattgatctagaagtcagatttaacccacccctcagcctcctcagggcctagcaatgtgtctgccaattggtatccataggaagaaaaatttaaaatgtatcctctttaacatctcataatgaagctgagtacagagtctgaatgttattactgagctaaatcggttagactagctgataggttggagcagagccagagttctcagtctcggcactcgtgacattttgggccagattattctttgttgtgtatattataggatgtttaatagcatcactggcctctacacactagatgccagtagcaatccttgcaaccctcagttgtgacaattaaaactgtctcctgacagatttcccctggcggggacagttgcccactggggtagagtgataagggatgggtgtgacttagagtttcaaatttcaagatctaataataaagcctctcactgaaacaccagagcactgaatgcagattacatggtaaaaattagggagtgactggtgcttctactttaccactggattaatagatgagtcgcaaacctttctgaagatattaacttattttctctcttcttcccttttttggtttttggtcatctctggtagctcatctaatagatgggacatccaggaggtgagctgtggaccaggcttcttattgggttgatgactcactgaaaaactgactctggctctccatagaccttagacttggcagtcactgttatcagggcagagttcctggtggagaagcagaagtgcccagcacaagtccttgtccttctctactggttgtgtcctctcaggtcctagctgtgagagtgaaacccagttctaccttggccagaagtgcccacaaatgttttacaacagttgacacatttagttggcatcagaaacgaccatatattttaacatgtctagatggtggacacttgtctgctgaattggctgtagacctcaaagagagaaaggagaaacattgttgccaagaattaaccactattctagttaataatgtggataatgagttgttctaatgcagggtagtgtttctgtctcaaaggtattttgttatgtgtattgttcattttactgaggttgttctagaagcagctcaaggaaccagatcatggcagtaaaagggctgtgtgttttttttcttttctttcttggcacttttcatgtaaaaaggaatgggtaagccttctaaaatacttagtggagcaggaagggtttgcaggaacaaaattctgccctaaggatgctatgcaaaagccccaagggaactgatcgttttaagaagtgcagtgagaggggttgaaaggcttattccacccctctctgcatggtttctatactacgtattgactcagggctctcgccattgcctctagagtcctgatcccagactgttccagggagctaccacattgggtaaatgacaaaaacgagtaggaaaagagggaacagatgaaaagctaaaaggaattgtcattttagagatgaattattttcacattgagtattcagtactatgctgctcattgggtaaatgaaaaagaaggaaaagaaggaacagatgaggcgcagtggctcacgcctgtaatcccagcactttgggaggccgaggtgagcagattgcttgtgctcaggagttcaagacaagcctgggcaacatggcgaaacatcgtctctacaaaaagtacagaaattagctgggtgtggtggcacgcacctgtagtcccagctatttggaaggctgaggtgggaggattgcctgagcccaggagattaaggctgcagtgagccgtgatcatgccacagcacttcagccgaggcaacagggtgagaccctgtctcaaaataaataaataaataaataaataaataaataaataaataaataaataaaagagggaacagatgagaagctaaaaggagttatcgttttagagaggaattgttttcacattggatattcaagtactatgctgttttagtagcctgaatcactaaataagtgtaggcatgagtacaaaccattttattttagacatttggcagtcttgccttgagcagtgtcaccttgtggccttggctatttttaagaaatgtactttttctctgttacaagttttcctgaggagaatgcatcttcaccatttacccaagccagagcacattggatccgagcagttaccaaggttcgactccagctgcaggaggtaggaaatctgttctagtactggttgggacaatttttcctttgaaattgggagacatatggtgctggagaagcaatcagtgattagtcatcttcttacagtgtgcttctgggaatgcatgacaattaagccagagctttaagggatgggaagtggccagtggctttcttctgtgctgattaatggaaatcaaatagacctagtgggctgagagcctgactgtaaagttagatgcttattttcaagtactgttcattgtctctttgaagccgtttgagtttagggcgagtttagggcaagaaatgatttcaagcccctgaggatagttgtctcccttacctagccggtccatactggctcatctgtagggccaaaacagggtacaaaaatatctatggaatttgccagtttaagtcccaaagtatcagcacactaagatctgaaacaacgtcaaaaaaatgtaaaaacaaagataaatatttttcattttcagtgttacaagtttgaagtgtctttatctgtgtgttaggaggtaggcagtctttaggcagaaggtacttttttttccatataaatttaggaggtacccgtgcagttttgatacatggatatgttgcatagtggtgaagtctgggctttgggtgtagccatcatctgaatagtgtacattatacccattaagttatttctctttccttacccgcttccacccttctaagtctccagtgtctattattccacactctaaatccatgcgtacacattatttagctcccacttataagtgagaccatgcagtatcccatggtgtgtatatatatatatatacaccacatttttaaaagccaaacatctgttgatggacacttaggttgattccgtatcttttttttttttttttttttttttttttgagttcaggtcttgctcctttgcccagctggagtgcagtggtgtgatcattgcagctttgaactcctaggctcaagcaatcctcctacctgtgcctctttagtagcagggtctacaggcatgcaccaccatgcctggctaatttaaaaaaaattttttttttttttttttgtagatgcagggtcttgctgtattgcccaggctggtcttgaactcctggcctgaagtgatcctcccactttggccttccaaagtgctgagagtacaggtgtgagccactatactcagcccataatatttttgctactgtgaatagtgctgcaataaacatatgggtgcaggtatctttttgatataatgatttattgaagttacatgtttaatgacaattggctgtcagtagtataatatctggcagatattaaaagcacaatcatgctcacatatgtgcacatatactttaaaaattaatttattttgaagcaatttcaaacttaaggaaaagttgcaaaaacagtaaagaactactatgtctcctcacccagatgctccaactattcacatttcacatttacttcattgccttccctccattatgatcaatctttttctgaatcatttgagagaaaattggagacatgatattctgtcattcctaaatcttcctttgtatttccctataaacaaggctacagttctgtataaccatgatataaccattcaaatctgccaaacaacaataacaacactattatcaagaccctatccatattttgccaaccatcccaacaatgtctctttttcctttctaatccagaatccaatccagaatgacatgttgcatttagtcgtgatatctctttagcttcgttcggtgtttcccatccttagcagttttaaatggtataggcttttcattttgtagcatgttcttcagtttgggtccattcagtgtttcctcatgtccggactgaggccatcctttcatggcaggaattacacaaaaaaaatgatgctgtgctcttttcagagcattgcgtcagaaagtacctgatgtcaacatgtcctaccatttataatgtcagccttgatgacttggttaagtttgcattggccaggtttctccactgtcaaggtaccatttcttccctctgtaattgttaagtgccttgtggtgcagtactctgaggatatgctggtattttgttccttatcaaatctctacctaccagctaagtagccgtctcctatctgaatctaccaccactaatgatggttgccaattggtaactttctgtttctattattctttctatattaattaattagttggcactctatttttaggaagagatttcccttttctctcattaatttatttatgtcaatattgcattatgactcttacatttctaatttattacatgagttataatccattattgtcatttattttggtgctcaaatcgttctggcttcatatgagcactcttaatttgacccttcagggagaagataatgttttagtaattattgaaaagatagctgcttggaaaaggtattgtgaatacagatatttgaaaatgctattatttgtatatagatgtgcgtgtgtgtgttcttttatcagaaacaatgttactgataaaaactcataattgcatgctctaaaatcttggaaagagactattaacatattaaaaatatttctaatgaagattttcaatgagttttgaacttacttgttaaaaatatgaaaatatttctcacaattttgcaagaacggctgactgacatcagagaagaggaaaaattactagccaaagtttaacaaaatctctgaataattagtatgttggaaccaattgctcttctttcattagatttgatatatcattatctttttcggctgtgacagctatgaaaaccatgtattgaagtaattgaatgtacaatcagaccttaaagtcattctataacaaaatattaaaataagatttaggaaacaattaggcacattatatcacattgttttaaaaaaaagtatcactgtgaatatttttagttacagcaaaaaaatttttgttaataaacattaaaaaacttttaaatttgttatgcttttcacattttaatttttataatatatattaatgcagttatacatctatataatttttaaatgaataagcgtacatatgttgagaggttcatgctaaaaaaattttccatggatagggctgcctaactgcaaacactgggagtctgttgatatagactgacgtgaggcaaacaaatgtttgtttatttatttattgagacagggtcttactctgtcgcttaggctggagtgcagtggcatgatcatagctcactgcagcgtcaacctcctgggctcaagtgatcctcccacctcagcctcccttgtagctaggactataggtacgcactaccacacccagctgattttttttaatgctttgtagagatggaatttcactgtgttgcccaggctggtcttgaacttctgaacttctgagctcaagcgatcctcctatctcagcctcctaaagtgctgggattataggcgtgagccactgcatctggctaaagaagcttttttttttttttttttttttaagacagagcctcactctgttgcccaggctggaatgcagtggtatgatctcggctgattgtaatctccgcctcccaggttcaagcagttctcatgtctcagcctccctagtagctgggactacaggcgtgggccaccatgcctggctaattttttttttttttttttttaatttttagtagagatggggttttaccatgttggccaggctggtctcaaactcctgacctcaagtgatccacctggctcagcctcccaaaatgctgggattacaggcatgagccaccacgcctggcctaaacaagcatttaaaatgaacatttatggaatgaatgtcataatacttactgattttttatttctaagttttttaaaagtaagggtcttgtaattcttcctataaagcaaagcaaagtaattagccttatccatgtaaaaggaaagctctgaattagaaaaataagaatatattggagaagacacagtttaagttatggccttttctttttcagaagtataataattcagtctctcaaaaagactagctgaaaacagttgccaaagcttggaatcatacagacagaggcatggtttacctaagagtaactaagaacttaattgaataagagaacaatagtaaagatattcttaacacaggtaaagtaactggcaactgattagaaatgtccaagaggagaacaagaagccagagtttaaagagggttctgataacagtttaagattgaagcagaaatgtaccatttgtacttaagatgagatttagtaacatattggttgaagttatgtgagagaaagaagttaagcacaacaccaaggatttttttgccccgctgccgccccgccaccccaatcactccttcaccctccactcaagataatcttgttagtttcctatttatcgttctagaatatctgtctacaagtacaagcaaatatgaatatactaatgcttctttacccgtttttatacaaaagatggtatattatacataccaagcatttcttgattttgtatttggagatccttccatatcagctctaagaaaatttttcattcttttttatagctgcgtaatattccattgaatgaaatatttgttctgcaagtatttagtcctttgttgatgttcatttggttgtttccagtcatttgctgttaaccatgttacaaatgaataaccttgtacatatgtcattttgcatgtgtgcaggtataccaaggggatatgcatttataattttgataaatattgccaaattgccatccatttgtctatggcttaaaataacaagggcttgtttcttgctcgtattccacatcaaggagttttgctttaaagttgtcttctctctgcaatccaggctgatggagcaaccaacacctggaacactgccagtcacaatggtaaaaggaagggaaagataacaagtgaaagaaaatatagcaagttgtactttggctcttaaaacttctacccagaagttattaatacatatgttgcttttgctcatattttcctagctaaaggaaatcatgaaaccaaacttaactttttaaaaataatttcaacttctattaatattttagatacagagggctgagtgcagtggcttatgcctgtaatcccagcaggagtttgagaccagcctggccaacatggtgaaaccctcatccttaccaaaaatacaaaaattagccgggtgtggtggtgcatacctgtaatcccagctacttgggaggctgaggcaggagaattgcctgaacccgggaagcagaggttgcagtgggccaagctcatgccactgcactccaacctaggtgacagagtgagaccctatctcaaaaaaaaaaaaaaaaaaaaaaaaaaaaaaaaaattagatacaggggatacctgtgcaggtttgttacataggtattttgcatgatgctgagatttggggtatagatcctgtcacccatgtagtgaacatagtactcaggtagtttttcaatccctgccatcttcctccttcctccctctagtagtctacagtgtctattgttcccatatttatgagtacccaatgtttagatgccactcattttttaaaacttttttttttaattttatttttttgagatggggtctcactctgtcacccaggctggagtgcacgggcatgatcacagctcactgcaaccttaactcctgggctcaagcaacccttcacctcagcctcccaagtagctgggaccacaggcatgtgccacttatgcccagcaaattaaaaaattcttgtgtagagatagggtctcattatgtttcctaggctggtcttgaactcctggcctcaagcaatcctcttgtctcagactcccaaagtgctgggattacaggcatgattataggcctggcccctagctcccatttataaatgagaatatgcaatatatggttttctgttcctgcattaatttgcttaaaattatggcctccaactgcatccatgttgttgcaaaggacatttcactgttttttatggctgcatagtattccatgatgcatatgtaccacattttctttatccagtccactgttgatgggtacctaggttgatttgatgtctctgctattgtgaataatgctgcgatgaatatatgagggtatgtgtttttttggtagaacaatttgttttcttttcattatatacccagtaatgggattgctgggttgaatgctagctctgttttaattaaagtggagcagtatgacatacttttaaagagatagagaaggatatttgtcaatggctttaatgcctacccccaaaagtatatgcttcccatagggagtgtaccaatttatactcccactagtaatgtcttaagagtggttttctctttcctaacccatcagtaatgtatcaaacttttggattttcacttatctgctaggctctttttgctatcctgtttaggtgaaatgcttccaacatatagaattatttatatttcaaaaattctcagagactttatatttgctgtttcccatgcttagaatgctctttctcttaattcacttagctaacttttcattcacatcttttaaaacccagtcagctgtcagttttggggtaaagtttctagactctttgcatatttttttctactgcatgatgatgtaatggagttacttgtttactgctatgtcttacttttctgtgtacttcttgtaagatcctttaatgtcaggctaagctttttaaggctgatattcaagagcccagtatggaatctggcaaagtgtgtttagctaaccttttgtggatgcttaaccagccagagatgccccgcattatttccacagaagtctccatgtgcttctttatcttctaattaatactatttttaattattcccaaggcccagcacttaaagtcaataatagcagaatattaactattaacattagctatattttcttatataagctttatatacatgaacataaatttactgaatttagatcataatatgtgtggatttaaacattttttttctcactttgtttttgtgaactttattctgggttattaaatatttttgaaaacatgatttaatgacttaatagattaatattctcttatataggtattttataatattcctcttgtttctttcttttcttttttcttcttttcttttgagacagcgtcttgcctgggctggagtgcagtggtacaagcacagctcactgcagccttgaccttccaggctcaagtgatcctcccacctcagcctcccaagtagctgggactacaggcgtgtgccaccatgcccggctgatttatttcttgtagagatggagtcttcctatgttgcccagcctgatcttgaactcctgggctcaagcaattttcctgtctcaacctcccaaaatgctgggattacaggcatgagccctcatacctggctcctcttgttactattatgaataacgctgtgatgagcatcattgtgcatacatctgttttcatttctgattatttctttaacttaaaatagattaaattactgagttgaagggtataagtttttaaatttaaattttattttttatttttaattttattttttaaaatagagaccaggtctcactacattgcctaggctggtcttgaactcttagcctcaggtgatcgtcctgtctgggcctcctgcaatgccatgattactggtatgagccatcacactcggcttcaggggtatatatatattttaagacttctgtcaaacttcttaatttattttcagaaaagcttttccggtttgtactttcagtatttgagtgtgctgtaccaacattaagtattcttattttagaaaatttttgccaatttgacagaagaatggtataccattgtttaatttgcatttctttgattatctgtgatttgaatatatctcataagtttataggtcacttatacttcttcagctaatattacatcaaagagactttgagaatcatagaaacctagttacacttatgctattcctataagattgtcagtcacttgagggaagaggttatatagagtcatctctgtgtcttctgggctggctgagtacatggccatatgtacttaataagtgtttgatgacattgctattgctgatgaggcagtaatgttggtagtgtgggtgggagtggatatgaatctgtaccttatttggcttagctgcagaaaaatctgggggaggaggtgagactttagctctagaaacggagattgcggtggcagcgggtgggtgggtgttccaggtggaagggacagttcaggagaaggcatggagataggccaggaagaaggcttgacaggagctcttgggttgttgaagaaagctgaggaaggagagccttggtaagcagagacagaacagcaaatagatgagaaggcctgggtttaaatggagcagtctcaggagaggtaggattacagctgccagcctgagaggtagatcagcattttcttaggggcgatcattaagacagagaacgaatcgaaactcttctgcaaagttccgttctcacttgttactccctcccaagaaaagtgacttccttcttgttctataattgaagcctcaaaaatgggtccctaggggaaaaataatgaggcttaaggagagggcttttgagaactgcaccattcagactttgcaccagggaaatactctttccataatcttaaactctggaattttttctgatcatgtctgcctatcttaacttctcaactctttgccctcatggagactaccaatttccgatccctcctttttctcacaacttttcatccctctccctaaccattgccattctaacatttctaaaaaaaactgaagaatgttttgaataagtaataaatgtaaaatataaaattgaaaaggatattatatatagatatatatttataaatatataatgcacagttttcctacttcagattcccaggccccctcatctccttttcccccatcttattatttgtgtctcatggatcagtccagagttaatccatccatttatgagcatgtgtgtgccccaaaacttgtatgtgtgtattacacacattgtcctacaccttgcttttttcatttattgctctatctcggagatttttttccttattagtataaatagagttcatactctattaacagctgcatagtttttctgttagtataaatagggctactgctttgtaaatagttatatagtatttctttctgtagatgtgttataatttatatactctgcccccattgatggatctttaggttgtttctaatgtagttgcaatgcaaatcctgtacataagcctgaatacttcaagacttatcttagccacagcttttgagacccctcttcaaacttcatggtaagccctacccaagaacaggccttactattgcttcacaaaccagagtgaccttccctggccctagctgctcctctgaatgctgtgagacaacccttgttctcaacagactgttttcgccttctgagaaactgcagtgcctttacctgatatctgagaccagaaccaacatattctctaccttctgaccttgactggacctggctgttccttgaagccctctttggtagagactatgccttttatatgccccatgcattactgggtcagaagtgaggtttggttttctctggcttcctctgccacttccaagccattactagatccttgcctaacctgtttctacagccaccttccttgttgcaattagattacaactttcccataattccccatttattcattgaaaattttagtacctgcatcacagttttcctttttaatctcaactcttgccataataataatatcattatagtaaccacatttattgaatactactatgtgtaggcactatatctttacatgcattacctaatgaattcataataataattctgtgaattaggcttatgttattaggcccactttattgattaagcaactgagtgtttagaaagatagaaacttgttcaggatcacccagctagtaagatttaggaccaggattcaaatctagatctatttaacttcagagcttgtctttttaacactaatcttagaaccctactttccaaagcatgttccacaggactccagtttctagagtcattaataggtatcatattatacacggttctatgtcaaagaaatttgggaaacacagaattcaacagagcacaaagccaatagattgccttatatcttaggacttctcagaaacttcagtatacttaggcttattgtgattctttaagaagggaatataatatgcacagctttattgcagacttatttgaccatgaaacactcttttagagacacattctgtgggactagttttccaaggaatatacttgagaaaagtctgcgtcagagatcccattgtcatttcattaaaactgtatttgtgaaggtcatcagtgagctcctaactgataacttagtggttgcttttcagtgtttatcttattggacctctttgcagtatttgacacttctgcacagtccctcctgttttgacatctaagaaaccatctccaactctcctctttgatctgtcttcagtctcttttctgatttctctgtttgctcatttcttaaatgttgttctttccagagttctttcctcaatgctcttttcatataaatctatacatttttcttttgaaatatcatttattatgtcacctatcacctatatgtgggttgctctcttatccagcccagaccctaaacccatatttctaactacttcttggacactcacttgtcccatcagcatctcaaattcagcttgtcccaatcaaaagacatcacctctctaaaacctgttttacgtcctgcattttgttcccatgcttcccaaatcaaccctgaacccactagatgtgattgggctcctgagagataagagaaagcgaagacattctttttaagatgtagaagaatgaggagctggagtttcacttatcctcagagggagagaaggatgaggtaactatcttatgcacataaaaagtactccataaatatctgttggcaggatgaatgaacaggatgtagagtaaggaagcttgtccttttgcattctgggcagttgagttgtgaagaggaatgaggggggttttcttgcctaaaaatctctagaaaaggagaggtccatacccattctcgcctattctcacttttggttgagaaaaaaaattttttttatttccaaattttatcttttaccagctacccatggctcttccctctgcttacacagcttgcctccacttccttttactattctaagtgacatagagacaaggatacactgccgttgtactcttgcagccttctcattcagccctactttcataccatttcccctcagtggcttgacaacaaattcttgttcctttgtttttagtaacaaatatttttaaattcagatataattaatataacataaagccatcttaaagtatacaattaagtggtatttaatatagtcactagatcacacaaccatcaccactacctaattccagaacattttcatcacctcaaaaggaaatcccatacccattagggattactccctattcccttttccaccagcctgtagcaaccatgaatttactttctgtagatttgtctggacatttcataccaatggattcctatcatatgtggcctactgtgtctggattcttttatttagcttaatgttcttaaggttcatccatgttgtagcatggatcgttacttttggctattatgaataatgcagctgtgaacattcatgtacaagttcttgtgtgaacataagttttcagcttttttgggtatgcacttaggaatggaaccgctaggtcatatggtaacgttgtttaacattttgagaaaccgccagactgttttttaaagtggttgtgctattttaccttcccatcagcagtgtatgagggtttcattttccccccatctttgccaacacttattgtctgtctttttttattatagccatcctagtgggtgtgaagtgctaacttgtgattttgatttgcatttccttagtaactaatgatgttgagtatcttttcatgtgcttattggccatttttatatcttctttggagtttagtagtctcctcttaaacataggggatacattcccagaccccaaatgggtacctgaaaccatggatagtaccaaacttcacatatactatgttttttcctatacatacatatgataaggtttaatttgttaattttagagacaggatctcactctgtcctgcaggctggaatgcagtggttcactgcagccttgaatcctgggctcaagcagtccttctacctcagcttcctgagtagcttggactataggcatgcaccaccacacctggctaagtttctattttttagttttttgtagagacaagagctgtgttgcccaggctggtcttcaacttctgggctcaagtgatccttatgccttggtctcccgaggcactgggattgcaggtgtgaaccactgtgcccagccaatgtttaatttataaattaggcacagtaagagattaacaacataataaaataaaacaattataaccatatactgtaattaaagatatgtaaatatgatctctcaaaatattttattgtattgtacagcaggtaactgaaaccacagaaagcaaaacagtggctaaggagggactaccgtaatatctattcaaatcctccgctcatttttaaattgggttatttgtctttttgttgttgagttgtaagagttcttcacatattttggatagaagtcccttatcaaacatatgatttgcaaatattttctcctactcctgttcctttttaattttttcaaacctcttttgaatttgccatgttttgccttaattatgccctaacttgcaacctttcttctctttctcttgcctatctctggggaaattggccacagcagccaagcctctgaagcaataaggaggagctgttttttctagggtgtggaagtagcttgcctagttggtcagtgtattattagggttctccagtgggagagaaccaataggatatatgtatatataaaagggactttattaaggagaattggcttacatgattacaaggtgaagtcccatgcatgataggctgtctgcaagctggagaaagagaggagccagtagaggctcagtccaagtccaaaagcctcaaaaccagggaagctgacagtacagccttcagtctgcagctgaagacctaagggaccccaggaagcctcttggtgcaagtcccaaataacctgttcaagggccggagaagaggaagcaaatgtccacatgggaagaaaaaagagagccagaaaactcagcaagcaaatttattccaccttcttccacctgctttgttctagctacactggcagccaattagattgtgcccacccacattgagggtgggtcttcctctcccagtccaccaactcaaatttctatcttctgtggcaacaccctcacaacacccagaaacaatacttccccagccatctatctaggcatccctccagtcaggttgacacctaatattaaccattaccgtcaatgaaagcatgttctggagcattgcagccatgaaagcatgttctggagctgccagctcatgtagcatcctgatggtctcagtccctccttttctgtttctctaatatacgcatctagctccgtccttggaattcaaccatttaggtaaaaactaaagttgtcagtagaaaggaattcaaaagatgaagctaagtagatgacaacagtgatttctttaggaataaagcttcaaattttcttttctttttcttttactttttcttcttttctttttcgagactgagtctcactctgttgcccaggctgtagtgcagtggctcgatctcagctcactgcaacctctgcctcccaggttcaagcaattctcctgcctcagcctcccgagtagctgggactacaggcatgtgccaacatgcccagctaattttttttgtatttttagtagagatggggtttgaccgtgttggccaggctggtctcgaattcctgacctcaggtgatcctcccaccttgacctaccaaagtgctgggattacaggcgtgagccaccatgcccagcctaaattttcttttaaacatgagcaaagtccctccacctctcccacctctattgacactgaaaagagcagagctgccagaaggattcatgtggttctcctgcttctgttctccatatctgctaagcagcagcccagagtagggatgaaagctgagactggtctagttctcattctccaaagccaccaactgagatgatccttccactgtattccaaagtttccctacaaaggaaaggaaaaaaccagagtgcctggcttctggttctgaattgtccccttccttccttccttccttccttccttccttccttccttccttccttccttccttccttccttcctccctcccttccttcccttccctttcttcctcccttccttccctttcttcccttccttctgttccttcctttccttcttttcttttcctttcttttccttccctttccctttcctttctttttgacagagtctggctctgtcgcccaggctggagtgcagtagtgtgatctctgctcactgcaagctccgcctcctgggttcacgccattctcctgcctcagcctcccgagtagctgggactacaggcgcctgccaccatgcctggctaattttttttttgtatttttagtagagatggggtttcactgtgttagctaagatggtctcgatctcctgaccttgtgatccgcccacctcggcctcccaaagtgctgggattacatgcgtgagccacctcgcccagccccgaattgtcccctttcttcccttgccttttaaatatctgataccactgagttcctgatttcaccttttcctcctctcatgggctgagtttgttcccattcccaccccaaagttcataatgttgaagtcttaaccttccccaggggttggatacctaaccccaggtatcttagaatgtgacattatttggagatagggtcgttaagtgggtaattaatataaactgaagtcatatgggtgggctttactccattatgactaatgtccttggaagaagaagaaatgaggacacagacacagagaggaaagaccatttgaaggcagagaagatggccattgacaagccaaggaaagaggccttgggagaaatcaaccttcttggcatcttgatcttggatttctaatatccagcattgtgagattttttttttttttgagatagggtctcactctgttgcccaggctggagtgcagtggtgcgatcttggctcactacagcctccacctcctaggctcaagtggtcctcccatcccagcctccctagtagctgggaccacaggtacatgccactatgcccagctaattttttatattttttgtggagatggggtttctctatgttgcccaggctggtctcgaactcccaagctcaaacaatctgccccccttggcctcccaaagtgctgggattacaccacgcctggtcaaaaataaattttagttggttaagccacccagactgttctactttgttttggcagccctagaaaactaatatacctcccatggcagaagagggaagagggtggcacaagcctcagtatttctcgcctgtcaatatttgtttcctgaggtccacttggagagaaatagggtttccagactggtagacacagagcccaagagcccattcacaatattgtgtcttttgtatccgtttactgttaaattgttactaacaaaatttagggctggatagaaatgccgagaactgggtttttgtattagctcacccttaaaatctgaaataactaacaaattcatatttgttgttcttctcagttataaaattagggatagcgacttgttctctctcacaggattttggtgagatcacagaaaaatgcatttttgagtacaaagctctacaagcatttgcttaaaagtctctagccagcctcctagtactttccagaactgttggcttttagggatctgtcatgacctttctagcctagacctgaggcaactgaatgacccatcaaaggtcattgctgaccatggctggaacctttgctgctaagtgaggatccattgacactgctgtttttttggctgatgtggcaatgagccaatgccataggatttcaggctgttatagggatctaggccaccaggtctcccctgtggtaacagggttgctagggtaacttatctatggatgactccaatgaggctatttggtatgttagtgcttctctgggaccaccaaagaagaggaagaagtcaacggaagccaaaggctgacctgtgcaatgtgggaacattttcaaagagcagctttcatgcacttgtcagtagcaatacggatgttttttgtttgttttacctctgaaatattctggacacatttatggcctggatctggatgttcatcaatggtggatcttctataaaccttctagttctgggctgtgactgagcctggtgaattataggatgtcacacctggactgagatttggggcagtggatcatttggaagggtggatttggctctggtttccaaggagcacatagaacatttccaagggatgccataatgtcatcaacctgtccagagttagagaaaagggtatcagatactggctgcgggccttagctccaaatggtaggtattttctgggcatagtatcaataaagggaggtacatagttaactcttatggaataagtcagattcctctacaaaattacttgcttccaagtaataagcaaagcatcctttctcactctttaccaccaccttctctgattcctgctgcttatttgaccatccaaccaatgagaatattcattgctggctgttcctctgtgaaaaaacatccttttgccaaagttatccaaaatgaagcaacttaagtaattattcagggttttttgttttgttttgttttttcgttttcttttgttttttgagacaaggtctcgctctgtcacccaggctgcagtgtagtggcgtgatctcggctgactgcaacctctgcctccagattcaagcgattcttgtgccttagcctcccatgtagctgggattacaggagtgcatcaccacacccggctaaatttgtatttttaatagagatggggtttcgccatcttggccaggctggtcttgaactcctggcctcaagcgatctgcctgccttggcctcctaaagtgctggtattacaggcatgtgccactgtgcccagcactttttcagttttaaatcaagcccctaataagtgggtactgctgggtactgttgggactatttgtaagacattttcctattctccaagagcttataggccagaggggaggtagaaataattaacagttaagtatttaaatacttttttctctcagtcactttttcctcattcttactttctgtgcagcattccatagtgtttttaaaactcccttttttcgtttcctattttcttctattattcttagattctcccaattctcttccttccttagctcctgcctcatttctttctacagtcttccctcaagcatcacttttaatctcaaaactgcatctcttcagcctctaatcaagaatctttaattaagcaactactctatggaaggtaatgtgcttggtcctacctactgtgataggtaaccagtaggcttccaactagccttttttttttttgaacggagtcttgctcttgcccaggctggagtgcaatggtgcgatctcagctcactgcaacctccacctaccaggatcaagcaattctcctgccttagcctcccaagtagctgggactacaggcatgagccaccacgtctggctaatttgttttgtatttttagtacagatggggattcaccaataatccacccgcctcggcctcccaaagtgccagggttacaggcttgagccactgcacccagcctcccaactagcctttgtaagcagatgttcccaaatctaaaccttccctttttccttaggctctattcttcctgtctagttatctactagttattttcactataatttcccaatgtttaaaacttccctcttgagcctattccttttcctttgttctctatttatattaaagttaccatcattctactagtcacccactcaaaatcacggtgtcactttttattcttccttctctcttgcctcccacttagatcatttgccagctcttgctcttcttttctttgtggtttcttttaccagtctctgtctcttctctgtttccctttgtgttcgggttctctttatttgcttagactatagtattagtcttctaatggtttccttgcttttattttcttagaagccattttatgtattactgccagatttatctttctgaaatagagctcgagtcatggctaccatttataccaagggctcaacttggatgtcacattctttgaagcctttcccaaagtgcccaggccaagttagagtctcatcttttatctttctatagcatttcatatataatcaactttgatgttaatcacattgtcctggaattatgtgagcatttgccctcaagattatatatttcttaaaataatatattttgtatgattctttttgtattaagttcaaaaacaggaaaaagtaacctgtggtgtcagacatcaggatagtgattacctttgggggatggaatttgtagtgattagatatgagcacaggaggcttctggagttctggttatattgttttcttgatctagattctgtttacatggatgtaaaagtacacttttgacttgtttatgttataattataatgtatattatcattcaataaaaagtttaaataaaagctaaatgaaaaatagcattaaaatacagagtagagaaaatgtctgactttatatccctgatgcctggcacccactaaactctttgcagatgagtgagtgagtgagtgaatagagaagtgaatgaaagtttatcctcaaaaaaattaatttttctttacattggtaattaaattatagtctcaacagagcctgagttctccaccacttacggcctgtgtaaccttaggcttaggcaagttacccagccctttggaaacataattttttcatctctgaatatcatagttgcctcagtggatgaataagggtttaataatatcatacatgtagagcagggcatggtgtgttgttagcattcagtaaatgttaatatccttttctttccaacgccttcctccttctccctttcatctctttacccatcctctatcctctgccttaaatatcctttccttttagtttccacatatccaaatattatccattctttggatcaatctcagatatcatgctcttcacagagccttctctgactcacatccaaaccagtgtttctaatgctggaaatatttccctctctcaaattcttgtacattttatctgtgtcccttatgatacatattagtcactcactccaacctttaggagttgctgaaggctgccgtctgacttcaggcccaaagaagaataagcactgtaattgggctaatatgctggaggcaggagctctgtcatttggaacaaacttgggaatgaaaagtcaggttgagaaaactgctttgggcttttcatattcatttttttgtttgtttttttttttgttttttgagacggagtcttgctcttgtcacccaggctggagtgcagtggtgtgatcttggcttactgcaacctcctcctccctggttcaagtgattctcctgcctcagcctcccaagtagctgggattacaggtgcccaccaccataactggctaacttttatatttttagtagagacagggttttaccatgttggccaggctggtcttgaactcctgacctcaggtgatctgcccgctctggcctcccaaagtgctgggattgcaggcgtgagccactgcacctagccctgatattcatttttgtacctccccttacacttggagaaattcagatgtctattaaaaaatatgggcccaggggctaaagtttaagttgcagactgtttgacctgccttttgaaatggttaaaaacctcttctgctaaagacgtcttttggcccagcttggcttatcaaggtaaaaggccatgcagatgtttgagtctcaagtcttaggaattaagagtagacattcacctggagtatcttctctgcctaatatccctagtgcatgtaggtagaaaaacagttcagggaagaccccattcctggccacttattttcttattattttggctttctacgtgtattttccttgcatacttacaggctttaaatcctttgctagattgctcttgaggtcaagaactgatcaccaattcttagcatcaattcctcctgatacttagtaaaaactcagcaaagatttatggaatgaacacttaaaaatattaggtggccgggcgcggtggctcacgcctgtaatcccagcactttgggaggctgaggcgagtggatcacctgaggtcaggagttccagaccagcctggccaacatggcgaaacccccatctctactaaaagtacaaaaattatccgggcttggtggcgggcacctgtaatcccagctactcaggaggctgagagaggagaatcacttgaacccgggaggtggaggttgcagtgagccgagatcgcgccactgcattccagctgggtgacaagagtgagactccgtctcaaaacaaataaaaaattaaaaaaattaagtggtattacacggccctaagtaactgattgcaaaagaaataattaagtcttttaactgaaaatagttgccacaggactttaaggaacaagccctttggattagggtgatcagagaagtcttctcagaggaattcccagagaatactaagttagcagttaagtatcaggaaatggccaagaaataaaataacatgagcttctaaagatggaaatcaagggataacttgcttcctgtgtttgcaagcatatgccatgggggagatccatggcctcttgcaagtggcatgttgcattcttcctgtggacaatgcagctgctatttaccactatgccctgaagtacagtcatattgtaagacttcagtaaacttcctgaagccaaagggaaagaggtaagttgtagcccattctttaagctgcttcttctctttgctggttgtcaccttcaagcatgctaaggaaatgtgtttattcagtcctcacctgagaacactcagacttaaacagccaaagaagacaagttaggaagatcattttagatgaaaaccaacctcctggagcatttgttaacgacagatgagataaaactgttgactgatttctctctaaaatattcttccttcttggcctttttttttttttttaaaggggtcttggtctgtcactcaagctggagtgcagtggcacaatcacggctcactgtaacctcgaactcctgggctcaggcagacctcctgcttcagcctccaagtagctgggattagaatagctaggactacaaggatgtgccaccagacctggctaatttttaaatttttcttgtagagatgggggtccccctatgttgcccaggctggtcttgaactcctggcctcagtccttctacttcagcctccataagtggtgggattacaggcctgagtcactgcgcctggccccatctttgatttcttcatagcatttctctttctctgcttgccccttaaaacttgataattcccaggctttgttttctacctcattttcttttctagttaatctcatccatgtcctaacctgtaactgataaatcccaaattactatctctacctcagtcctctttcatgagttccagacttttttatccagcttcctgtggatattgtcacctgaatgttcatagccacttcatacaatgtgttcaaaccgtacttaccatcttttttttctcctccacttcctcttctatatatcctttcttactaccccgtcaaacataaaatctaacactcctctccctcagaatatataacatgggtataacaatgcctcttgctttaacatttcccccgttaggttatgaacttcttaagggcaaggattgtatcttttcattacgcctgttaacaagatgttgttacttaataggtgttcatttattttttgttttttatttattttattttttcgagaaagagtctcgctctgtcacccaggttgaagtgcagtggtgtgatcatggctcactgctgccttgacgccctgggcttaggatatcttaggttatcttcccacctcagcttcccaagtagctggtggaaggggcaaaagaactcctgtgggcctcttttataaaggcactaatcccattcattagggctctgccttcatgatctgttcacctccccaaaggctcacctcctaatgtcatcaccttgagggttaggattttaacatatgaattttggagtgacacagacgttcaggcaattcaacccattacaggtaccaaagtagtttttcatgtttatttacaagtcttatcttctgacaaagcacttgaaaaggttcctaccttctcaccatcctgatgtttactctctgatggcactctacatagggccatctggaaacagaaaggatgagatggcacattaagtgagtgcaaggggtttgctttgactaaagttagggtgttgggaagccaaattcctctagacatgggcaggtcaagaaagaactttgataacatgtaaagaactaggacttttttttttttcacagtcactgacggattttaagaaaatgagtgacaaaaacttatgtacatcttagaaatatccccctagcaaattgtgcatcacggatcaagggtaaagaggagtgagtgggaggtggttctggaggaatggagtctagggagaatgaatattttgcagtagttgaagtgagaaataagcctggactaaagattgcagaggagacactgatagataagaaggtaaaatagattatggcagaggcacaaagggctttgcaggggcttctctcactgggtaaagaattagaatatatggattccaatgatccagtatctgagcagagaagtcatctctgcatgggttgatatgggtgagctggcagcctagtcctctaaacacgtagttctctcttcagacttacctagttgagtgcttccctttctttccaccatgcttccctcttactgtcagagatccccagtgaaggatacgccttcattaagtcttcttttcccctttgtacattagctaccttcctgtaattcagtacctcatatcagatacttttgaatatttggagaatcctgtagggaaaaacccacctctttgggatcccttcattgaatgtgaagacacttgaaactcatctgctggttagggacatatttccacaagactatagaaacaggggcctaagccaggagaattctccagatttgggtttgccctatatcttattcttagatgtatcttagaacaagccataaagaactgaggggatatttgatcaatattaacccagttagtctccacttagtacaagaggttcatttctccctgggatgtcaaattttggattccttttagaggatcctcggtatatggcctctttgtttcctttgggtatagagattgaggcagggccaatgcactctgtggcttgggctgggatatatatataaacaaatactactttaggaccggcattagtcctaaatctgggagctgtgacttttgatcgggtttatgtgagagggcagtagacatataggtttcttatgatcatgaattgttaattatttggtcctgaaatagatagggggccacagcctttggaggtacaggctgaaaacctaactggttagctggccagttccaagaagtttatcagctccttatgttcaagtttctgctaatcagggatggtccttgacctgattgtaggactaagacttgtcagcaatttatgactcttagggcctgccttgcagcttgtcgggtctgtttaggtaacaaagcagctatgtcttagtgcatcagtaaagtcagcacatctctgccaggcttgtcactcccctaggatggcatgctcctcagggaaggagcaggattacctcctgctgcccgtcattctctgctgcatatgctttctccatggtgtagggagggcatcattctacagcgggaaaaatgacttttcttagccaccagaaaaatcatcttcctcatgaaataaatcccagctgtgtgactatatgtcagctttttcatgttgcttctggctttcctcagcagtagagaaggaaaacagtcacaagctgactcttgcatgatatagatattggccgcacccatcctttgtactctgcgtctgtgttgatattggacaataaggtaagcacctgctggtcctgacccagcctgtctctggcattgacacctgaaaaggcaggccaggtttggagcaggcatattctttgcttctagaccagttgtatctgacgtcagggagacttagactggtttgtatgagtagggagaattgtgattggtgaggccctcctccagtatttctgtgacaccactcagttgctttagctgaagatgaattttgtatgccaggtggttttctgactaacccacccattcggctcccctttagaactcctgcaggtctgaaccttcccacaactctgcgtgagtgtcagtgtatcatgttgagtttccatcttgactcatctgtctctaggcgaagatccctgcaaggatttaaattgggaaccagaccttgagaatgtctgttcagagcatttcacagcttctggataaatgccttttccttcttaacccaatctgtttttccagttctgcccagctagctcctgagcagcctactttgaggaagcttcccaactgaggtgggtgctgtgctatttcttacctctaaaaagcaccccatcctttcggcctactcaggcttccccagggccagatccactgtgatgagggggctgcattgttgcccatgtggctcacaaaacaaattgcctgcttgtcccaaagagctagtccactgaggagtcctgatgtcctttggccatgtggtgtctggcactctgtgggccctgtagaacagtggcagaaggggccatgctcttttacaagagcttccactgactgtttgccacttccccacttactctgtttcttgcttttgctggaacatgggaaggtggatagatacaaaggtaatttgtggtcaaagctgcatgagctctcctgtgaagtttgaagattgtaactggagatggcagatttgttgtgcctcatgtgctaaccacgtcttctactgcctgagcctttgtttttctggaaagcccaagctgcttagaaaaatgggctggatgtgtttgggtgacaagacagggtgggttccattagcctcagaaatgccatctggaggccttagccaggccttagggccactttgtcaattaggcaggaagaagtaggttcttttagcagggtcctacctctggggaatctttcccactcttgaaagtttgagcttctccttagcctaggaagcctgaccaaacctgatagtgacagccactgttctgggctctttatgagtggctgcagatttgggggagggaattctaatttaatcaatcttccctatatttcttgttttaaaccttttacctccttctcctggctgaaggatgggaaactccacagtaaattggctgtgacttccacagaaacttgacagttttcaagttatttttttcctctgtgtttagatgcggttatagttgtgctgtcaggccttatctcttctgtcatctagccagctcccaactaggttaggaggtatgtgctctgctgttagtgttggctgtgtaatgaggtggatggctaagaaatgggttgtttagcatctcttggaatctaaattttcttccttggttgagggggaagcaatgttattggaagaaggcagtagggaggcacatgttggctctgaaatcaaccctttcttctcaggatcttggataagccaaacaaatcattcttaatttaaatgcttgttttatctaccataaagggctgcctgttctgcaatggcagatcctaggatggtccccatagactgactacctggtttgtgggctaaagaggccatactctgttgtggattgccatgaggaatgttgcagggcagcagaagtcacaaggtttgagagcctggtttgggcatgctgggtaaatcaaacttgcccacgtactgttggcctaaggaggaagagggccttttctcttaagatcaagctcaggggagtcagaagaggaatgacttcactggattgttactggctgatcgagctctatattgagaaggattctgaggttatctaggttcattatgcgatgtttttcatgtcctatggttgcagagtggaaaggggatatcacatttcatgtatttggcattttatgctacagagcttcaaggggtcctggcttgtgctcggacattatgttgcagtgaacaacttgagtgttctttgaagataaggacattcaatttcccagtgagtcctaactagaattgttgaattattaggaattagggtcacatgagagccacctggctagtgagtctccagggagatagggcatccattggcaaagaagggttatgaaatttggggtcataaaaggggccctgaaccttaggcagctttttggtcatggtgatatcactttaggttacttcgttcctaattctggattctgaaaccatctttggtctagacttctgcaatacagagttcatctcagctcacctaacttcccctccttctctcgggttgttgctttggcatagcctgagggagctcttattttccagttgattctcttgtggtggttgttcagtaagaactggaatagatgtctactccaagaacatggcactgtttgattttaactgcacttgatcactgtacctatccttcagctttgccaaatgctgacaacagattatatatacacgaaaccaaccaaccaaccaacttagagcttgtctcagtagaagggaagactccctttgtattgtgctccagcagttccacggctggcatgctgtgttccggcttccctctgagactaggagctcctgaaagtataggtctccatctgtgtctgtttatatcctatagcccagatgtgagagaggtggataggggaaaagaaagcagggaggagaagaacgagggaaggaaatggaggaggggagagagtaagatctatatttagcaaaagggagagacacttaccaagggtgtgtgagtgagcttgctggcaagggttgtgtgtgcgtgagtgtgctgggaagggggtgtgtgcgccaggaacgtgtgaggagggctggtgccctatgggaggttgcaggcaggaagcagctggagaggaggaggagcagcagcaggagcaggagctgccctgctttctgcctcagtctcaaagcccagaatcgattgagttagaattccacatccagttgaagtttggctgctgttgccttcagcaggctgatctcagaatcccccttgccagagaggtgtggaccaggttagatttctacgtttgcagccagtgagactcctgccaagcccttcactgaggggtttttttgcagggcattgtttctgtcatcaactttgtgccgtggagccagccagctgggtgcaactgagaatattagctccttgggtctgtttgtcggttgggcaagcagtggtgctttggctcagaaagttcgtcctgtggcttctctgtcaaaccaaggagtgctcctggatggatttcctcttaaagacagcatttgccttctaaaacttgagaattcatggttttaatttttttttttaatttccttaacccttattttggttgcagcagcaaggtaagtggtaccgagtgtgtatgactgactgaacaacaagcagggcaaaaggaaagcatttgtgggtggaatatggagcagctacattaattacgtaattgcttgagtcaacttgctggtgaggggggtcattataatgagtgaaaagtagcatatgccgcactggggtagaatcttcacatgcatgtatttgtgtgctgataatctgaccatccattcctctgtggtactttcctgtatgtatatagataacccagccaccctctggatgtgtgcatattcatatacaaataatctgtttctcctttttcatgtgtccatatgtgtttatgaataaatgacctgtccattcctctcctgcatgtgcatatgtatagacaactcattcatccagcttgcatatatgaatatgcaaaattcgtctctccctacttgcacatacatatataatccatcccttcatctcctatgtgtatgcatgtactcaagtaacctttctgttcttgaatatattctgtatcatttccacccttcctgtatgtgtatatgtgagagagagagaaagagagagagagacagagagaaagagaaaaaaccaccatcctaatgtattaattcatccctttcatgtgtgtatatgccatataaacagaaaagtcatcttgagttttctcagtcttgaatatatgcacacatgcgcaatagacagtctgtccacttgtgtcttgcatgtatgaagaaagagcactaactttgcagattgaagactcacttttaaatcctagctatactcagtgaccttggtcaagtcatttagcctctctgagcttcatttttctcatctatgaaatcagtataatcagaacagtaacaacaaacctcctgcctcacagggttgttgtgatgataaaataggaatcatataaactgaaaattctaaacaaatataatctcttactactgtgtgtccctctagtatgagttggataggatagcgtactcttggtccagttttattgaaattatgttcttgtctgtgagaggtttctaagttttccatgtgaaggggaagcatctattgaggtaaccaggtttatcctgtggttttctgcagagtattggaaagaagcggggtaccgtgaaagggtcaggtggagagggagaaaagctctcatcttctgtaggctggggccttgatactttgttttttgtaccttgaggaggattgaacctcacacaaaatggaaatgggctgcttccagccaggatcaaagtgagcaggtgaaaagatgagtgaaagaacgtaacattcgactgcctctgggatgacagtgtgccctttgcagtgagcttctactgccaggtttggaaggctctccagagtatttcccaccccagaattctagacccatgctgtccaatgtggtagctactggccacatgtgactgctgagtacttaaaatgtggctagtctaatttgagatgcattctaaacataagatacatactagatttcaagaacttagtataggaaacaaatgcaagtatatgattaataattttttatattgattatatgttgaaataatactttggctattgggttagataaaatatattaaaattaattctacctgtttcttttttatgtggcgattagaaattttaaaatgacacatgtggttcacattatatttctgttagtcagtgctgctctaaactcacccatcactagcacaaggatcagggcagcttttccaactcggggtaggggatgggagccctgtcacagcatccctggggtaacaggaaccacagcaggatctctccctgccagtctcatacactggagagataccagctaattgatggtctggcagagaccggtgctgccatgcccccacactctttttttgtttttcttttttctttttttgtcctgagtgagttcccagataattttaagtacaactggggaaagatttccaccttagttttacaatgaaagaggactgtaagccatcaatctagaaggaaacctagaacttgaatgcagcatgttgtcatggaaacagaaatggatgagaaaattaggagacctggattctaattcggctctgccatcaattcatttatgctttccatgacaatgaattctcactgtgtgtcaggcatagtaatgccctgttctaggcactggaaattcagaaacaaataagacacagcttccaatgtaatggagttcacacccgctgcggatctttgaataggagcctcccatctagtagtctgccacagcaaaacagattaatgacaacaagggtctcattctaggtcaagggtagtagggcttttgagaagctagagcacctgccctgcctaaagactttcaaattcaaagtatagaaaagcactatgatggtaagactactccataacctagatcacaatgtagtgtgagattccaggcctagacaccctctaaagggtttgtccaactatgttctggtttcttttattcaatgacagggttggtttgttttgggtttttgtttgtttgtttgtttgtttttagcacaggcactgttttaggtgctgaagatacagttatgaacaaaacaaagtccctgctcatgttttgggatacagaggtcagggagggagacagataatgaacaagctatcagatgggaatgagttctatgaaggaaattctagaggaagaggatagagatgggtttttttgtggtggggtgttcagtgagtagattctcctgcactcgtatctttttcagtgtactcacaagagcaggaggtagtaaggaaaaagagggtatgtgagtgttaaacaaaaaattattttgacacttgttaaagatgataagacagactttatgtggggggacgacaatactggggttttgtagtgagggtgaacaattgagctcaactccaaatataaggaaaagtgggaatttagccaaggagcagggtggggtatcagtggacggaaattactaagatgaagtatcaaaggggattttggctaaacttacttgacaggatttttgctgaaggcaggccaaggtggtaagatatcaggggtaggggataagaaatttggtcagataccaagcatagacagatactaagggtgaaagatgaggaatttgatcagaaatcaagggtgggaattttcactaaaatgacctggctggattcttgttaaaactggactaaatgagccaatgtcaagggcctactcagaaagaggactcagaggagcctgacttatgtttcgtcaaagaagagtctttgtcatgggttagattctgggtgtgattgtatttgttgtatgctttgttatactccttggtataaaaaaccttgctactgctgaaagggagccctgggcagggcacagaatagcctgctctcatgcctggcattcagtctccattatgaggtattgatatgccctccctctgaaggctaggtccgccctcatgccactgtcttttaactgtatgttacctgagattgtctcccttcttggatatagaggcttgaagttttctttcccttgtatatgtctagcttctggcctataaatggggctgctcttaatgctgatgaggatggatggcaagtcctaggaactgcaatactgggaccttgctaagcctttgatctagggcatttctcattccctttggctaatctcacttgccatatcttgtgccctgatcattttgatgattaacatcctgagaatccccatacctgctgtggccctagaaatccattcctcttagcccatattagccatacaacataattgatatatggcccagaaatgctctgtcctctgttgggggctcagagctcttggatttctgcttgctgggattgtttcacacaaactgggaagctgcttgatatatgtacatcgagtcctggccttttcccagaggtcccctggttgtttcctctaagccagatttgggttagaagcagtttttacaaggaatagttacattcctaatcacatttatttgataagtcagagagaaggataaaagaatcagccatttcaaaaaactgaggtgttttcctttctctttttcgttggtaggctggtggtgatgcaatgtggtttaagggatctactccctgcagtaattgttagctttccatcattaaagctttaatctttttgattaattcattttgttttgatgtgctcccttttcaaatgcagatagtccttgaaaggggctgccttatttttcccagccttaggcagtcctgaggaaaagagcacagaaaggtatggtttttgtcggaatgtgtgtgtatgaaatttggagagttgtccagagtcaataggccaacaaagtagggcagacagataacattgggtatcttaaaggaaactccaaggctaggtggactccagagcctacttaccccatcccagctcaaacattacttttctgtggccttgtatgcctcgttttgctgggcctctcacctcctttccattcccaacccctgaattaaatgcttactttctttttcattttttttttttttaaagacagggtcttgttctgtcacccaagctggagtacagcctcaacctcctgtgctcaagcgatcctcccacttcagcctcccaagcagctgggaccacaggcacatgccaccacatccagctaattttttattttttgtagagacgtgatctccctaccttgcccatactggtctctaactcctgggctcaaaggatcttcctgctttggcctcccaaagtgttgtgattacaggcgtgagcccagctaaatgcttactttttattataacttttattataatatgtatcactttatattgtgatcatctatatatatctttctctccaaatcttaatgtattagagagcaggtactgcatcttatctccctggcacacacagtaagtactcatgcagttcaactgacttggagatcaaatggtccttcttacagtttgctccctgtcatttcacttctgtggacagtagtagcaaagagaggctgggaaggaggtgaattgggcctcctgtccctgagggttgccctttcagcccattctggcttctgatattctactgagctcagcacagtgactggttggtcctctgagcatcacatcgagctccatcccctgcttcaaagcccaaagactggattactaagtgagtttggtgcccttcctatatcaccagaagagattcttgagttcaaagttcatcccagggcagtggctaccaactcataagaaggtgtggaggcttttgtttgtttaatatggaaggaagcatctttgtttgaggctgggagaagctgctatggcagctctagttgaaaatttcctatttgtcagtaacatggggaaccaggcagctctgccttcagtcttcaggaggccacaggaaaggactctgaacccagtggctatgccatttgccccctgtgtggctggccagccagtgtcgtaagcactgtagtttggaagggaataccttgtaaggtgtccgggaaatgaggccaagtatgtctggagggctgggcacggtggctcacacctgtaatcctagcactttgggaggcgagatgggcggatcacctgaggtcgggagtttgagaccagcctgaccaacatggagaaaccccatctctactaaaacaaaaacaaaaacaaaacaaaacaaaacaaaaacttatgtctgcagtattgatctgaggggcagaagcagataggccccaggttagcctggtctacactgaatcagtagcagtagcaggggagtcagcttcattagtgttcccgacaaactgccttatctggaccaaagtgaggctggccttagaagacctggcaatgaattctgggcctcaccagcattggaaaaataaagcttggcttctatagccatttatctcttcctcagcgttcaggctgtctgagagacggccggcctcctgacacttgaatgaggtgttgggaactgaatgatttactcctccttctccttaccttaaaaagaaaacttctaggagaaagcaggactaactttaagggtgacagtctcctcgtaggattccaggcactgctgcagaccattagaagggagtgggaaaggcaggagtctggggcagaagtagaagtcatggctcactcaaattgtgccagttaggtggttggatgcttgctttagatatgggtttccctactttgttgactcagggacttgccacatcagtagcaataacaacaggacagtgctttacagtttagtaagtacagttctctcattttagctttatataataacattcctgtaattatctcccccactttacagatgaggaaactaattcacatagaggtcaagtgtttaatccaaggtcactggtggaacaagacccaaacttaagtctcttgatgccagtccagtagcacttgctcatggcttcatgtagttgtacacagagcttccatcttagtttactaagcttactaagcaattctaatttttttttttgagacagtcttgctctattgcccaggctggagtgcagtggtgcgatcttggctcaccgcaacctctgcctcctgggttcaagtgattctcttgcctcagcctcccgagtagctgggattacaggcacctgccatcactcccagctaatttttatatttttaatagagagggggtttcaccatattggccaggctggtctcaaactcctgaccttgtgatctgcctgcctcggcctcccaaagtgctgggattacaggcgagagccaccacgcccagccgcagtacttcttttttaaagacaaatttgaaaggccacttgccagctgcagcccttgtaaagccaggaacattgttcatggctaataccaagagcaaatcagggatacccaatccctacatggttggggaggaaaaaaaaaaaaaaaaaaaggagtatctttggaaattcagattttgtccttgtgggaagagagaaggaagaatttggcatcctctagactttggagcgtggtctacctaggcagctgggcaccaagcccaagacccagaaattctggttgtgcaggtagtgcatcctcgcaggctagactgagttggccagattaggggcatggctgttcctggccccatgagaccttgaggtgaagcagtaatgcctcacaggatggatagggttcttagatgaagaattcctcaatgaattagagttgttagataagctggaaagaaaaggagagatgtgaaatgggaatacatgcagtttctgtctcttggttcttggcctagttatttctagtaaaaagaatcagcttcatctttatcccaagtcctctgactcgtccttctggttcctcctagtctggggaagcacaatgcttttaaattccaggcccacagactagatgtaggtggtggcctttcctgaaaatgggttgccatgagagcagtctgcctgtgttctttaaggcattttcccacttttaggattaacttgagtactgggaaaataaaaggaggcagagtttagaagatttagaaatctccatcaaatctagaaaatggggaaagcatccctggtcaaagaacatgaagagtagcatgtctcccaccaatccatcttacccctcccaggagacctagcaggactggaatattagttgtcccatgtgcctcctagatctctgctttcctccttgtactttccactctactgcttccgtacactctccacattctcagtaaaaagggaatgtattctcactccacatgaggtaatcatcgtctctgcctctgtaatgcagtcaccaatagcttagggtgtagggactagactggtggcaagtctgtctttaccttattggagaagagtaaagcaccctggagccctctgtgaggtaaccctcccccacatgtcccatgtgatattctctctgggccaggcagaggattagagcaaccctttgttattaatacttgagcagtggacagtgtgctggacaatcacttattgtggtgctctgaaagatcctctgtgggccaggaaagccaaacccagatattgactagctgcagcaagcccttagagagtattaagtggagctcaggagcaccaagctaagcctaaacctccttcatccccagttgtgagttcatgatacctgtctctttggctacctgcctctctacctgcctctctcatgctaaatgccacctacgtctggacagtgtgtgcgtactgtgccactttattctagaattaggtaaagaaatatttttcctgctaagtttaaaatacgtaaaccattgtcctttctccaagtgaacggttgccatcactcaacaaagggaaaatactttgtgctataagcacaggcaggggtaaacttttgagtaagtggagtcttcaccagaacaacaaactggaaaagaaagaaagaaagaaacattccatgtcttgtctttcactgtgtatgtgatttgagccttggtggttaagcatttgtttgtttatttctgagccagactcctagtactgaattttgtgaaagttcaaataaggacttactcattgaccttacttcatctacctcccagcagcttgtctcaatatcgttgactttgggtacttgcccagaacacaaggactttattttaattttacattgatactctaaggggaagctaatgagaaacaactgactgcccatagcctttaagactggggttgggaggcaggtcagggttgattcctataatcttaggagataatgtttttattcctgcttgacaacttgattcaaactaaaatcatcctgctactttctgacctgagtgcactattttcctttttcactagctacaggataaatcaagccaggatccaggggcatgtgcgaggtttggaggccacacatggggccattccaggcagcactgtgggctaagcccaaagcatcagccagcaataattgctagaaacaaactgaaaagagcaggacaggctgttgccttccaaggtaatctctattaagcatcctgaccagaaataagaggaagaagcagagaacccctcaaaccctgagggagaaaatgaagcgattgttgcaagagtcagaggaagaaatcatggttaccttgggaccctcctccaggctttccccagataaggctaaggcagagaccatgtgtggcaccaagagcaaatcctctggccctgctggatccttaccagaggacaactccctgcccccttgctgtgggtcagcagccttagccattggtggagatagagatggggacctggcccagctttgcagctttgggcagcagaacaacagccagcttcctctgggctccactgcctatgtttcagggtctggttctcaggatccctcatctgtcagcattaccacaagctgtcaggagccctcagagaggaaccaaaccaagacccttttgtccagaggccatggccaaggctgtagccgtgaacagcgggaacctttgggggatgtagtagaatacatcatcagagagctgcaaggcatcagccgtcttcagactgagattgctgagctgcagcagcacttgagccaagtccagggttccgtggatgaagtctctagctgtgtagactcagtactgagtgaaatagaaggcttacaggtgagcacctgttccctggccaaggtgtgtgagggtgaaaaggcccaggaaccccacgtggacagacccagtgaggaagccattctgtatttgtacggacttcctgaacaagatggagaaaatactatggaactggtggaaagctttctagccaagcacctttgtgttaatggcatgcagtgcaacaggtacattaaaaaggcttacagggcaggcacatccccttcccctaggcccactgttgtgaagcttgcccatctagagcatagagacttcatcttgcagaaatccatcctcttgcagaatgtgggagtccgaattgccaccagagaagaaccaagctgcccacagggtaataagaatccccagaaggagtctatatcattttttcaacaacaacatcaggattatagtcagacttctttaaaccaggatgaaccagttcttcagatggaaacaggggacaggggacccataacaggaacatatcagatgaaggctcaggatcaacagagagagcaccaggcccctgagcagcaaggcccttgctttctactcaagaacaatttatcaaaggaaagtgatgtgcccaagctaggggatgaaataaaaggagcatcaagaacatctcaagttatcagtggcagctgtgatgaactgtcagagaaaaaggcttctctgtctaccccccatcagtttgaggaacctgccctagtattaatctcaaaagaggaggcttctgggaagtcccagtttttcaaacagtacagccaaaaacatgaagcatgtaaagtaggaaaaccagaaaatgactgccacgataaaagtgaggccagcagctgcctgtcattgtctgggttactgaagacagagagaataaacgcagaggacaagctcctgggctgcgaagctgggctcgatattctgagctcaaaggaactagaggaccttttggcagacaagtccagaaggcttgcagctctgagctgtgacagcatgatggaggaaattatcatagggcctgagactttcagtgacatggttcatattgacctgaatgaagaggaggaatgtgctgctcacgtcctcaaggatgtctttgacaagtcctcttgtgttctgggtggctctcaggaggatgaggatgtggaaatcaagttttatacaagtaaactgggccgagcaattcaccactttcgttctgctctgcagggtgtgtttcagaagctggagaacagtgggtccatcagtcctgaggacctggaaagcaatgagagtggttcccagtcagagaacagtgatcgacttcttgggacagtgagttcagggggtgcccaggattgctcactggagagccctgggagtcaggggagtgaaagcttgctcagtgtggtctctggtggagttggcgtctccacacagggagagcaaacccctcaggatccaagcaccttctctcttgcttctaataactccttgccaagtgttgctctggctccatgtctgggaagtgagacttgttccaggcctggatctcccaagcagggcagactgagcctagagcaagtgtgtacagagaccgtttacctcaacaagtgcatcaacaattttaagaatgttctaagagagaaaagactaaggcagaaaaaacttctgcatgagctagtacagaaggcaaaccgtctctcagtagaagacatacactcaggtattctgagtcactatttaacagggtcccagctggctaaagtatgacctccatctggccagcatgagacctggtgtggtggccagtttaataaggtgttggttgacgtccatagcttgaatcaggctaaattactcaagtagagagcttaagctaatcctgtgggaattggagtgaaagatggttctcaagcaagaggaagcttgaattggagttaaagagggttctcaagcaagaggaagccgtccttatcttccagtctcttgttgtggtgctatacctgttcaaaagagggaggagcatctggagcagaagtagtttgcagctgcagagcttttaggatatcagatgtaaagaaggggtgggagtgagaggcaggagttggggatgacacatatttgctcacaggcactagaagggctgagaaagaatcctgtgttgcatttaaaaattcttctctgtggatttgttgctgagataagattgccatttccccagtagctgatggggcttctctcataggcccctgtgggaatttcccctaccccaggtacctgtctcttcctagtacctgacttgctgacacagaaccttatttctgatttggggcatccaggagctgcttatagtgctgacctagccctagagcccaacgttgccctccacaggtcttattccctttcttccatctccccctaaaagctgctcacctgcaagctggcaaatggaatgttttttgactacaggaagtaagagaacatttttctaggcagtttggagatatgtagctttaaaattactcttcccaatcaaaattaaatttatccaaagagcatatgctatattcatccagttttaaatttaaatggggttgtcctcttatgcatataacctgattaatcttcctaaggcaacatctaaattgtgaagcatattgtgttggcaaaggtgtgagggaatatgcacttgtacgttgctggtgggatgggagtataaattggcataatctctaaggaaggtaattggcaaaatttatcaaaattacaaatatatatataccctttaagtcctcaacaccacttacaggaatgtatcctgcagacacattttcacatgtggaagtgacatatggacaaggctatttttgaagcatagcttttaatagcaaagattaaaaataacctaaaaattcatcaggaattactggttaaataaattattggcacgtccaaacaatgggatatagtactgtgtagctataaaaagaatgtggtagctctttactgaaatggaaagttatctaagatatattgacatacaaaaaaaagcaaagtgcagagcagtatgtataagatgctttcatttgtataaaaagagggaaagaatacaatacacacacttataatgtctgcttgtatatgtatagattatctaatgaaagatatgtaagaaacggatacattgttgcccatggggaaatgtattaggtgaacaaatggaatgggagggagatttttctctgtgtgccttcttttaatttttagaatttgaatcatatgaatataatactaagccataaagttacatttaaaaaatgaaaattacgtcattctcttttcaaatttccctagagctccttcttagaacttatcaaaaagagtctaaattccttcactttgcattcaaggtcactgcaattggtctctagtttatatttccaggcttatctcccattgtcccaccataagtctttcaaaaggaagctttgctgtcatacaaatttgccttgcactttctattcttaatacattcatatatacatgcttccttctaacataaaatgctatgtttgccatttcaacctagcagaatttacctattcttcaacatatatcacctcttccaggaagctttctgaggcagtaatttctcagctgtgagggatttctctgtcttcataactttgcagcctctttttcttcttcccaggcaatgagaaattatttcagcacagcaacaatagaaacaacaaatatcaaagcaatacttcttacaagctctttaaatattggtgggagctgatgttagcatgagcaccaatgatgaggacacttgtgtctaactcttcagcttgcagagtttcctttctgggctgcatccttctaggcaatgcagaaacttgtggtgccatggtaggcaggtggtagtagcagcagtcttgatgaatagaaggaggttttctaaagcaccaataagaaagcaagtcacagttctgggtcctatccaagactcagtactcagtctggcctgagggctgcagacagaatcatggacagggtgctccagcactcccttgcatagagcaggacaagcacacaggccagactctcaccaacatagacttcactggagcagtcccctaacctagtaaactgattcagtatcacagagactaccagcataacgaagcttttgaaaactctgctttctttactgttctgcttgggatcttttaggccctaagcttactagttgtagcttatgattaatttgagttagttttcatcttttttttcttggtatgtgccaggtactgttttaagtactctcatgtgcattgtataaaattcaattcttttattcctgtcactccaccaaaatagctttgatcagggccattagatgtccaccatattgccaaactaatggttcattttcagtcttctttttatcagtcagcaatttgacacagttgatgatcactttcctctttttattataacagctttattgagttataattcatgtgccataaaattcaccttaaagtcccttaaaaagtattgaatcgaatggtttttagtttattcatagttatgcagacatcatcaccatctaatttcagaacatttccatcaccccataagaaacctcttacccattggcagtcactccccacttctctttgcccccagcctctggcaaccattaatttacttcctgtttctatgaatttgcctattatgtacatttcatataaatgggtttataaaatatgtgcccttttgtgtctggcatgatgtttttaaggatgctgtagcatgtatcagtacttcatttctttttctggctgaacaatatttattgatggacattttttaaatccatcagttggcggacatttgagttattattaccacttcttgcttattatgaataatgctgctatgaacatttgtatacaagtttttctatggaactatattttcaattctcttgggtatttacctagaagtaaaattgctgggtcatatggtaattctgtttaccatttgaggaactgccagactgttttccaaagtcattgcagtatttacattcccacccgtaacatatgaaggttctaatttctctacatccttggcaacacttgttattatcttttttattatagccatcctagtggatatgaagtggtgtctcattgtggttttgatttgtgtttctctagtgactaatgatgttgagcatcttttcatgtgctcatcagccatttttctatcttctttggagtaatgtctatttaagccttggaccacttttaaattgaggttttttttcgttttgtttttgagctgtaagaattctttatatattctggatataagtcccttatcagatatattatttgtaaatattttctctcattctgtgggttgtcttttcactttcttgacagtgtcctttgaagcatacatttttttattgtttttttttttttttttaaattctattggccaggtctgttggctcatgtctgtaatcccagcactttgggagaccgaggcgagaggatcacttgagctcagaaatttgagaccagcctggccaacatagtgagaccttgtctttactaaaaatcaaaaaacaattttttgtggtaaaatatacataacataaaatgtgttatttaaaccatgttttttctgaatattatgtggaacattttaaccatttaaaaatatatagttccataacatcaagtacattcgtattgttctgcaaccaccgttcatctccagaatgcttctcatcttgcaaaactgaaactctatacctattaaatagtaactcctcatcccatctcaccccagtccctggcaaccactactctactttctgtctctatgaatttgattgatctaagtacctcatgtaagtggaatcaaataacatttgtccttttatgactggcttattccacttagcgtaatgtcctcaaggttcatctatgttgtaatgtgtcagaatttcactctgaaatttcactctggaatttttaaggctgcatcgtattccattgtacacatgtatcacattttatttatctgttcactcatcaggacacacattgcttccaccttttggctattgtgaacaatgctgctataaacagtggtatacaaatattttttgagtccctgctttcagtcttttggctatgtaccccaaagtggattgatcaaattttatggtaattctaattttttgaagaatcaccataccattttccatggtggctgcaccgttttacgttcccaccatcagggcacaagggttccttccaatttctctacattttcttcaacacttgttattttctgttttgttttttttaagtaatagccattgtaatgggtatgaagtagagcacaaaagttttaaattttggtgaagtgcaatttatccatttttttcttgttttgattgtgcttttggtgtcatagctgagaaatcattggttaatctgaagtcagaaagatttgctcctattttttttatgagttttatagtttttactcctatatttaggtctatgatttttttttttttttttttttgagacggagttttgctctgttgcccaggctggagtgcagtggcgtgatttcggctcacagcaacctccgcctcctgagttcgagcaattcttctgcctcagccttctgagtagactagctgggattacaggcatccaccacgaagcctggttaattttttgtatttttagtagagaggaggtttcaccatgttggccaggctggtctcgaactcctgacctgaagtgatcttcccaccttggcttcccaaagtgctgggattagaggcttgagccaccacgcccagccagttttgagttaatttttgtgcatagtatgaggtaggagtccagctttattcttgtgcatatgggtatctagttgtcccagaatgatttgttgaaaagattattcttttttcattgaatagtcttaccactcttgtcaaaaatcaatgaccataaatgtaagagtttatgtctggactcaattctattctattgatattcagtctgttcttgtgctcaattccttctttttgaaacactttcttcatttggcttccagaacacctctctgtcttggtttcctcctctcccccaacattactggccattccttcttagttatctttgctcttcctctccccaaccttgtagcatcctgggattcaatcttgacttcctatgctcacttcctagatgataatctttcaatcccgagtttcataagcattcccaggtttatatctccaacccaaacatcttccatgaacaccagactccaaatccacgtaacacctccttatggatgtaaataggcatctcatttgacatatccaaagccaaactcctgatccttcttctgaagcccctgccaaacctgcctttcctattgtctttcttacccatgagtggcatctttattcttgcagctattcaggcccaatccatagagtcattcttgactctcccttctctctcacaacctgtattcagtccgttagtaaattccacttcctccacttttaaaaaatatcttgaatcttgccattatctctacctccaccactgtcatccttgtttaagccaccattttctctcatctagattactgcagtggtctcactgctctccctgcttctagaaccttgtccctctacagtctgttctcctcacaacaatcagagtaatccccatagagcatgagtcaggttatatcacctctctgctcaatgatttcctgtctcactcagaatggacaccagcattcttataaaggcctgtagagccctatttgaactggtactttattgcaaatttgctgtttctccacaccaattatgctctcacctcaggctttgcatttgctatatgttcttccgaaaatactttttcccagaactccaaatggcttctttactcatttctttcaagtctgctttgatatcacctatcagtgaggccgccctaacaaccattttttggatttttaataacaactctacctccatcatcagggggcattatctttttcccttatctgaatttttcagccaagttcctatcacatgtgacatagtatattgttatttcttatggaaagcagaccctggaacaagaatgtctgttaggaattttggctttgccacttgctggcatcttgcttaacctctctgatcttcaatttaattatcaaagaagtggaggtaataatggtatttacccagtgtggagttgtgagaaataaatgagcttacccaaataaaatgccagatacaaaataagtgtttgattagtatcagctactgtcatcatcttcatcattgtttattatctgctcctcttactaaaataaaagcttttcaggatcagggagtttgtgtcattcactgccacatcaccagcactgattgagaacagtgcctagtgtgcacattaggttcttttaaaatttttttagttaaaaattttttttgaaagacagagtctcagtctgtcacccaggctggagtgcagtggagtgatcagagctcactgcagccttgatctcctggtctcaatggatcctcccaccccagtctcaagtagctgcactgcacgtgcaggcacatgccaccactacaggcatatgccaccacacccagctatttttttcatgttttgtagagatgggggtctcactttgttacccaggctggtcttgagctcctgacctcaagctatccttcctcctgccttagtctcccaaagtgttgggattataggcatgagccaccatgaccagcccttagtataataggttcttaagaaatgaatccttgcaataaccctgggaggtagttgttcatatacctatctttttatagttaaggaaatgtaggctcaaataagttgaacgtctcaagtcttttgactctcaataatggagttaagattgtattattgggtatactgaggggagtgctgatgaggaggtatgtcacttccttataaaatggactgtctggaacagtgagagagatcattcttagggggtcagggattttcctgcaaagcagttgttttgtagacatttataacttaacctgcaaactaaatctaagtggaaaaatcctaaggcattttagggagttgggaagcacagaaagtttgattcttaagaaaaaaagttgttttttaatgtttgtccaacgggtaggacaaactgaatagccagtatagcagttcctcagggtctggaaaatggtacagactactggttaagagacttataccttctctggttgggcaagagacacttcttagaatagctgttgttttctaagtcctgaaagttatagttttcttttactacatagaaatgataggcgatgtgctaagccctcaggctacaaaggtgaaataatatataatccttttttctgaagaagtagtataaagtgagaaatattataaaggaagatgtttatacagacaactacaatatatgatactacaaaacagtattaacaacatactgtcttagaagtgtggacatagaatggtggagaccagggcagctagtggagaggcacttaatcctaccttgggaaggaaagcagacagaaatttcacagagtcattagtatttgaactaagtcttagggaatatgcctgagtccacccagtaggctgggtgtgggagggaggtgtgaaaagtctcagatgtgatggagaatgttcagtaagacttgaatacaggacacgtgaggagcggaaggaaagtaagctagaacggtaggggaagtacaaatcttgaagcactttatgtgctacagtaagcaacggggagaattgatgcaattaagcaaagaaaaaaatgcgatcagaatttcgaaatgggaaatgtggagtatggattggagaggagcaagtctagtggcagagagatcagcttggagtctcctgttatagtccagttaagagatgatagtggcagtgtgaaatggaaaggcagcagtggatgccagagatatttaggaggtaaaaagtacagggctgagtgattggatagggacagagtgcagagagggagagatccattgtctggctggggacaggaggagacgtttagagatggaagatagaagtttagtgtttggatatgttgaatttgaactaagcatgcgatatctaggtgatacacactaagcagtggttaatgtgttgtgataaagtaggtatctgaaggttaggtataactcctttgagaagtggaagagggagctgactaatggaagaagagacttatcaagtgacacagagggcccagttgaagttaaaaatctgcatctagggcggggcgtggtggctcacgcctgtaatcccagcactttgggaggccgaggtgggcggatcacaaggtcaggagatcaagaccatcctggctaacacagtgaaaccctgtaaatacaaaaaattagctgggcatggtggtgggcgcctgtagtcccagctacttgggaggctgaggcaggagaatggtgtgaacccaggaggtggagcttgcagtgagccgagatcgcaccactgcactctagcctgggcaatagagcgagactccgtctcaaaaaaaaaaaaaaaaaaaatctgcatctatttgctctggttctcatctgtacaatggtgggacttgtcaaggcattatgtgttaaataccaatgagaaggatgaatgtaacttaggtgcactaggatggccttattaactcttgcttgggtgggcatcagagaaggcttcccagaactatgccttggaggaagagttggattttcctctatggaaaggaggtgtgagatgctatttcaggctaatggaacagaatgagtaaataaaaatttggggttttgagtatgtgacgtctttgtgaaacaagacaattagattgtaggaatgtatatggggtcaagaaagagggcagaggagaggaatttggggatttgggccagatcatggagagccgtgacggctctgtcaatggattgatttgattttaatctttaggcattatggggaaacctgtggagaacagaaggacacaatcaactttgacatggttgtagaatatatttaagatagtgaagggggagaggtacatttccagtttgagtcatggggtcagttaaaggattgtttgcctaattttcttactcaaaaggaacacattatcctgggggggttgagatgtagatatggaagagatatgtccccattccagggagtgtctttctcatctttcccaccttcctggagctgcactgttttggaggattccttgtcacctagtccaggacaggtgacccattaagtaagcagaaatagcttgaaaaattgggaacctgtgaattcgattcttgaattctcccctctacttgtgatgtgacatcaatgggcctttaaaagagaaaagaaaatggaggggcactaatggaccaaggtgggtggactttccttacagaaggaagcctgtgggcctatccatgtatggcctagaaggcaatgtagtctctgatgaataggaaaggagtaatctctgggctttatttttatcctgttatggcttgatcgggcccttctggaagtgtcagtttcctttagagtattgtcctgggtttgataaataatcagatttgggattgcagtcatggttttatcatctagatcactgtgatttctattaggaaagcagccagtcgatgcccccaggcctgtagccattcagcatcctggtcctggacttaactccaggccctaccctggtccaacttaatttcaggtccgagaaacgggccagagctcattgagtgaatgcatggccaagcctgcattgcaaaatggaaaaggctcagtcaccagggcctttggagtttgaggacttataccagatctagaataagctcacgtggcttctgaggaaggaaatcactctgtgctcagccagcttagatagtctgttggagtggtcattggtaacaaatctggtcttgcaaccttggcagccctgacccttgatgcaggccactttggaaatgggaaaaggatgactggaacccctgggtagattttgtcccttgatttagtttggaacatctccagggatgttccaaactaaaaatcctgggccagcaaatacaggcaggaaggattctggaagccagtcagctgggctctatgaactgcctagttgtcccgaggacctctccctctcttccatgtcccttggagtttagctggcattttctttgggttccctacttataggactgactctactaacctttctgcccttttttctgctctttctctccttgcagaagaaaagcgaggagcccttcaggttgtgcctatgaccctttgggtcgtccttttttgtctatttccctcccctccttcccaagcactgtatgtgtgtgtgtatgtgtgtgtgtgtgtgtacatgcacatgtgcgtgcatgatctgtgcctctgagctttggctcatgcagtctatttttctgaaaagcagtttgtgtgcatgctccttgcttgtgtgtgctcctgcagatatccctggagcacactgcgagaatgtgtgtgcaccagcatgggtgtgcattcaatgtagcatgtgtgtgcttatactcagtttgactcccccagacactgattaccctccttttctcctactcagctcagtgtgtgtccattttctacctgttgctgcaaactctggcatatgctgtaaaaccttggctgagcccagcacgcatgtgtactttgtatttgagagcaggctttgctgcaggcatttcctgcctcttgcctgaggccctaagtgtgaaggtacttgtgctctgaacaggcttcctgacctctctgttgagcacaggcttctgtagccctgttacgtggtttccccaaaccatgtgaatgcatagtatactaatgccctgtgcttgcaagcactggctcttgaagaccatgagggtttgctttgcctgtgatttgggccatagtaaacactgtgaatcctcctcagatgagtttctgcagatcactgaatactctgaagcttatgttctgaagccataagcctaggatccatgctcaccatgtgtttccttcagacacaagttgtgtgtactatgtgtgcaggcttttgcagacatgttgttatcccttctgagcacaggaaatgtgcatgatctgagccaggttctcagactttttgtgactttgtttccttaagcccagtggtttctggcaaatatctcactctggataggaaataagaacctgctgagtacggtggctatttccagagggaaaataagttctggttggtaagatctggggatttagggattggctccccaacactcaacccttaccccttccataagcaaccttagaagacttgcagcttttctgttatttcccacctactgttgtttcttcccacctactgttgtttcttctatactatccccattgtcttttgcttcagccacttctggctgccttttggacctggccctcccattaccaatatcatcctacctatagaaaggataggaggcagatggggtggaatgggggctctggtccgtagggagataggcttgattaaaacatagacaacctaagaggagtcttaaatccaaaattcatgtgagcctattgctgacccaggtaattctccctcacttttccatcaccattagctctgtcctatctgtccctattctcctctgtattgcctcattgttatccataacttctccccactttagctctccaaaacatcactcactgttcaaagctaagcaccttaattctgcctcccttctggagctcatttgctccaggatagttaggaggcagggaagttgttgggagtggaagaaaacaaggaggggcaggaagccccagacctgttagcctgaaaaaagcatgtgctattggacctctggagcactctggcagctttggacctttctgcatgctgcttgaaggatttgcttttgtttattttgttttcttttggtacagaaacctttaaaaggtgatttttgaactgttcccttccttgaattatttggtgtctcaagtttcgacttctcattctagggcctatagaattcactagaatgataatccaagtgtctaatctaccctgggttctcttgttatgtagaatttattaaatagagagaatatacttagtgtcagtgagtcagaggttcaaggcacccaaactaaatccaaccacaaaatgagataggaatccagagagaccaggtctgactctgggacattaagggagtttaggaatatagctggaagaagactggactctatatgaaggtgtccttttgctttagtgaggcctggaagcctaagtaggcccttctcctgtgcttggtttactgctgtctacactaatggctcatataagagtgatatgagttctgccattccagtagacttcagccctgcaaactcagtgagctttgccctatctcctattcaccaaggagacaggtaccactcatttcagcagcctgcttgttgccctgactgatcaggacattggtttagatgtcagacaggctgtcaccacatggtgaatgtgacttacactgctctgggcttgtactctactgctcgctgctcagattacaggcaatctcccatctttcccaggatctaacttgtttcctatctctttttaaagattccagatgatggtgacccctctctgcctcagtggctcccggaagggtaagtaattcactgcaaggtttctgtggattttattcagtatctcttgatgcttttagcttttcccctgggaagcaggggaaccagcttcataagctgcatcctggggaaggaaaaggttccactataggttggttggttctctgaggcagaggagagaactctgctgatggattccttggaggcagaagagggaactttgcagaatggttaccctggtgcaggggagggagctttggggccttctcatccttgcctctataatttctggtccatcttttcatagtggtgaaatactctttaagtagaacaaagaggaaattagaaaaatatctgcatttggaaacattttctttccatttcatttgtttttaatttttgtaggtacatactaggtgtgtctatttatgggttacattagatattttgatacaggcatacagtgtgtaatactcacatcagggtaaatggggtatccatcacttcaagcagttatcctttctttttgttacaatccacttacactcttttcgttattttaaaatgtgcaataaattgttgttgactgtagtcaccctgctgtgctatcaatactagatcttattcattctatccattccattgttgatggtgtggctgattaagttactcctaggcttgatcctgctccagctgttgtgagtcatctacttattccattccactgtagtcaggatataagtaacacccctttctgagctctgtatgttctgtccgtgcttcttgtttgggagtttcagacctgtgtgattgtaccagagtcattttaagctgctcagtgtagcctgtaactgactgttcttaaagagagaagagagttcaagtaccttctcattccccactccttcccacaaataccaccaattagttatctagaccttccttttccctttttcctacaaaggcttctgacatcagaagtctcagtagttgcttcctcttgtggccagggaagaagaaagatcaggtagatgatctactatatttttacatgctcctttcccttgcaatttgtcatctttaaaaaaaaattttttttaacttttgttttaggttcaggggtacatgtgcaggtttgttatatagttaaactcgtgtcacagggatttgttgtacagattatttcatcacccaagtactataacaatagttattttttctgctcctctccctcctcctacccttcaccctcaagtaggcccgtgtctgttgttaccctctttgtgtccatgtgttctcatcatttagctcccacttataagagagaacatgcagtgtttggttttctgttcctgcattagtttgctaagaatagtggcctccagctccagccatgttcctgcaaaggacatgatctcgttcttttttatggccacatagtattctgcggtgtatatgtatcacattttctttatccagtgtgccactgatgggcatttagcttgattccatgtctttgctattgtgaataatgctgcagcgaacatactcatccatctgtctttatggtagaacactgtatattcctttgggtatatacccaataatgggattgttgagtcgaatggttgttctgtttttagttctttgaggaatcaccacactgctttccacaacggttgaactaatttacactcctgccaacagtgtataagtgttctcttttccctgcagctttgtcagtatctgttttttttttttttagtttgtcttcttttaatcaagggtgaatcattgaatgagctacccccttcttcttttattgaaagatcatttatgtttaaaaaaaaaacttcttgccttaagagatacatattgtagtttctagaattagctacaaagttgtggcatcagttgcttcttcagtgatctttagtttttttcttctaataattgtaaaatacacacatgtcaatgggacatatccagactacttctgaatgtagctatgtagtagttttctaaatgattccctattgtctttcttccttttctttcaccttcgtccttagaagctgtcctaagtatagaacttccctcagtctggtagtctcattaaaaacaaagcctactgcctatgttcagggagctgttttattagaaatcagcatattgagtggcctgtttcaactcctggacttgacccaatttgtggttccattctttgcctagatagctacaagtacctactttttctgttgggatatttctgtctttagaccagccgtggtatacagcccagctacccaactttcccaacgtctttgctctcattaaaaccaagtacatgagttctttgcattaaggccagagagttttttgttgcttatccatctcattttatagaagcgtcaccaaggcccaaagtgaagaaggaattttgggagaagacatagtacattaatagaagaactggagttaaaatccaggttatttcagtgtagtttcttttgggtacattttctgtttttattgcatattgttataaaagaacaataaaattaatcagtatagaaaaggtgtaaaagttttagaaatgtccagctgctgtagctgtaatttttctccaggctctgttgatgtgtccatagggctaggccacactcatacagtccctttgctgtttccttcctaaatggtgttttgttttgttttttcttcccttaggtggtcttttggaagtctctcataccacctcccctattacacttgattatgagggctcctttctccatggagaaggcttttcttcaggaggcctaggtagacagaactggtgactcttttactcttggatggagacggtctccttctatgtgccattgtctggtatagtcttactcacctagactcttgccgtagagccaccctgtgggttctgttctagcacagccttggcaagacttatctttggggagcagtgtctttgccctgaatgtggggagaagccctcttgagtgccaattcctaccttgccttatggagcataaaagtgccttcaaataaatagaaatgccttgaactatcactgggataaaagagcctcagttctcagctgaaactgtaagagacactgaggggtcctgtgagaacagattctattgctcactcttccatgactttatttccctgactttctgtctttccttcccgtcctaaaagcacatggtagaggtcagttcatcttcctctggggagagggagagcaaggtgaatggaacactgaacccaccagctaactcaaagcaagactgacggtcctgacatattttcttctctcctcaggccagccggagggctctatggcattgacagcatgccagatttacgcagaaagaagccactgccacttgtcagtgatctggtgagtgaagactcttgtgcaggcataggcagtagccttggggtatcccccattgggccttggcaagctgtcaggattggaagtcgtccatttaatgactcaaattgatctgatgatcaatcatttaaagccttcggagacttagcagtggcttcacagggactgtgttctacctcactccctagtcagagtcctgaatttattagctcaagctcctacctggaatatttgtgacttgggctctcaaagttaggattttgtgtcttcctataggcatctagctcttataggtatctctacagccttctttgatgacctgtaatggaaattgcctccagcccttgacctcttgatcattgagcttggtatgggatgagcatgactggagcttgatgccttcttggaagtcaagcaaaagtctcttctcaagacataggcttttgagactatctctgtaacctagtgtcaggcactgagaggcaatgataaaaatttgtggaattgaattgaaacaggcttaagagttaaagctgatcccagggcctccatcccatcctcccaggatgaccagaagccccattctgggtcataccttctgaggcacaaacaacccaaggaattttctgtagccttgtgggtagttgggggtgaagtgaggtccaggttctctcagagctctaaagctagaaatcgggtgtaaggattcagttaaatgtgaacccttttcccttattaccattttctgtttctgttttcttttttctctctattctatctattgtttttcctaaccacccctcttccctcttccccatttcctgctccactagtttctccctccttagttgaccgaatgaaagtatcatctgccattttctcttcatcatttttcttcccttccattatttcttaccatttgttcatcttctcctttctctctctttctttctttctttttttttttttttatagagacggagtccctgttacccaggctggtctcaaactcccgggctcaagtgatcctcctgcctcagcttcccaaagtgctgggattacaggcgtgagccaccatgcccgactcctcctttctaatgtacctcttcttccactagctcttcatctagctggttgaagataaattctgatgccatgtcttcttcaataccattttcctttccttaatgtctctcatctcctcttttttttcttcctcttcttcctactttttttcctcatcctttctcactgtttgcccatgagcaagtatctagtttatttcttgctatccctctctgtcttttgccctatctttggctttatggcataatactccttagagtaggtgctctaggctttgggtcctggccagtggtctgggttgaagacagtttttagtggacagaagcagagtggattgggaaatgctccctgctttggactatagggaagaacctctcagttgcctctgaaagttttcatgccctttcgagcctttaacatcatgttgttcttttctctgctgtcctctacgcaggctatggtgagtgtctccagagccctttctcatcctctttaaaagtctgcatccctggctggttgcagtggctcatgcctgtaatcccagcactttgggaggctgaggcgggcggatcacaaggtcaggagttcgagactagcctgaccaacatagtgaaacactgtttctactaaaaatacaaaaaaattagccagccgtggtggcgagtacctgtaatctcagctacttgggaggctgaggcaggagaatcgcttgaacccgggaggcggaagttgcaatgagctgagatcgcaccactgcactcctgcctgggcgacagtgcaagactctgtctccaaacaaacaaacaaacaaacaaaatcctcatcccaaatcacttgggcccttcccagctgttcctcctgcttaggctgatattatgacttctgccttctcagcgtcctctgcctttaggaaaccatgtgcctctccaggggctgcccctaaagcttgggcttggcagatacatgggccctgtgcaagagtgtggctagcaaggcagccccagctctcagacttaactctctgggcttggcagatacatggggcccctgtgcaagagtgtggctagcaaggcagccccagctctcagacttaactctctgggcttggcagatacatggggcccctgtgcaagagtgtggctagcaaggcagccccagctctcagacttaactctctgggcttggcagatacatggggcccctgtgcaagagtgtggctagcaaggcagccccagctctcagacttaactctctgggcttggcagatacatgggcccctgtgcaagagtgtggctagcaaggcagccccagctctcagacttaactctctgtgcttggcagatacatggggccctgtgcaagagtgtggctagcaaggcagccccagctctcagacttaactctctgggcttggcagatacatggggcccctgtgcaagagtgtggctagcaaggcagccccagctctcagacttaactctctgggcttggcagatacatgggccctgtgcaagagtgtggctagcaaggcagccccagctctcagacttaactctctgtgcttggcagatacatggggccctgtgcaagagtgtggctagcaaggcagccccagctctcagacttaactctctgggcttggcagatacatggggcccctgtgcaagagtgtggctagcaaggcagccccagctctcagacttaactctctgggcttggcagatacatggggccctgtgcaagagtgtggctagcaaggcagccccagctctcagacttaactctctgtgcttggcagatacatggggccctgtgcaagagtgtggctagcaaggcagccccagctctcagacttaactctctgggcttggcagatacatgggcccctgtgcaagagtgtggctagcaaggcagccccagctctcagacttaactctctgtgcttggcagatacatggggccctgtgcaagagtgtggctagcaaggcagccccagctctcagacttaactctctgggcttggcagatacatggggccctgtgcaagagtgtggctagcaaggcagccccagctctcagacttaactctctgggcttggcagatacatggggcccctgtgcaagagtgtggctagcaaggcagccccagctctcagacttaactctctgggcttggcagatacatggggccctgtgcaagagtgtggctagcaaggcagccccagctctcagacttaactctctgggcttggcagatacatggggcccctgtgcaagagtgtggctagcaaggcagccccagctctcagacttaactctctgggcttggcagatacatggggcccctgtgcaagagtgtggctagcaaggcagccccagctctcagacttaactctctgggcttggcagatacatggggcccctgtgcaagagtgtggctagcaaggcagccccagctctcagacttaactctctgggcttggcagatacatggggccctgtgcaagagtgtggctagcaaggcagccccagctctcagacttaactctctgggcttggcagatacatggggccctgtgcaagagtgtggctagcaaggcagccccagctctcagacttaactctctgggcttggcagatacatggggcccctgtgcaagagtgtggctagcaaggcagccccagctctcagacttaactctctgggcttggcagatacatggggcccctgtgcaagagtgtggctagcaaggcagccccagctctcagacttaactctctgtgcttggcagatacatgggccctgtgcaagagtgtggctagcaaggcagccccagctctcagacttaactctctgggcttggcatatacatcgggccctgtgcaagagtgtggctagcaaggcagccccagctctcagacttaactctctgggcttggcagatacatggggcccctgtgcaagagtgtggctagcaaggcagccccagctctcagacttaactctctgggcttggcagatacatggggccccctatgcaagagtgtggctagcaaggcagccccagctctcagacttaactctctgtcctgcttgatttgactgaggcttcaatgcccttttcacttgccaagtgccctacttgtaggcctgctggcctctgcagccatccagggattatgtgggcttggggaggtgccaaggtatagaggttagcatggaatcatttttctccataatggctcttgaatgtgactctgacagagttgtgtgtctctattattcttaattacctgtttcctactatagttctaagcttttcattttcctttgccttcccataaacaaggagtttctgtggggtaggacactaagaagagtgaaagaaaaagaaactctttggatgatagataccctgaagaaagtgctgttctaacatagttagagcagccccctgagggccttgggttttgcatcttaacctgggacacttgtcacctgttagggcggttgctgtgagtgacaataaaaatagaaagtactgtagtaagctatagtcaagtggctttggtcactgaagctccctcccccagactttgccagcccttggcagtggtcagggctaacagcagatcttccctgacagtcactggtccagtctcggaaggcaggaatcacttctgcaatggctacacgcacttctcttaaggacgaagagctggtaagtgtcccaagtgctttcgtaagtccactggcctcaggactggtgatcatctctgtagccatgctattaataattgggaattctgggaattcaagagtgctggacacacattgctgatgaaaaagatagatagcatcaggtgttagttttccacactgggaaagactctaagcaagtctagatcagagagtaagcccaagtctcatgttgaagggtgtgaccactgaactcaaggttttatgatggacctagtaccttctgttttcttagaaagcgtgaatgctggaacaaggctcggatccagcatcaggtccaacctgtgttggacaaccagaagcacactatattgtgggcctcattctgctatgctgggctctgggctgggccaggatagagcatcttcttcattgccagaggagacacgaaatcaaggtcctgattgtcccacagggtctcagttctggtatctccctgcagaacccaaaagtcatggggaccaggcatgttggcttatgcctgtaatcccagcactttgggaggccaaggcaggtggatcacttgaggtcaggagttcgagacaagcctgaccaacatggtgaaaccctgtctctactaaaaatacaaaaattagctgggcatggtagcatgtgcatgtaatcccagctacttgggggccaaggcaggagaattgcttgaacctgggaggtggaggttgcaatgagccgagatcataccactgcactccagcctgggcaacagagcaagactctgtctcaaaacaaacaaaaaacaaaaatcatgggatggggtatgtgtctttcagaaatcccacgtgtataagaaaaccctgcaggccttaatctaccccatttcgtgcaccactcctcataactttgaggtctggacggccactaccccaacctactgctatgagtgtgaaggcctgctctggggcattgcccggcagggcatgcgctgcagcgaatgtggagtcaagtgccatgagaagtgccaggatctgctcaatgctgactgcctgcagcgtgagtgccctgcgggatgaggggcggggagtggggcagcaggggctttccaaaatagtctgcagcaaagagctgggatggctgaaccaatcattcccccagtccacctgattctgaaaccctatccatttcagagaaggtaggattctgaatcaaggggcattgcctttccaaataacaggtcttacactaccttcttaagcacctttaggaaaaattctttgagctttctgtggtagtgtagctagaatcttataggattcagttgatcccagagactgagctttgtagtgtatacagcacagcggccttattgtccaaatgacaaaagcatcaggatctgaggctaatgagaggaaagaaatagagttttgtggggttccaggccccacagaggaacctcctaaagcctagaatctaggactcagggaaggcagcattcattacttgtttttagacaatagtgccagaaatagaaatgtcaaatgaatctggtagaggtccaagaggagagtataccagacccccagggccttggctaaatatatgacttgtcctgccatgatggagtggggacaataggagcaggaaaagcaacaagttcttgttagaggaaatggtagcgctcaaagttcatatctccttgctcccctcctgctggccttgcactcactgtggctggaccccaggaaaagcaggggtgaaggaagtgggaaactattttcctgccctccagacctcccaggtattacccacaagccaagctgtagcactgaaagctttaaagattgtgctaggagaagggaaggtcacctctagacccacaagtacttcattatcccaaggacagctatgacatataaaaggggaccagggagaggccttgagcaattattcatggaaaatgtcctttgaagagcctcaaattggtgccaatggcaaggctaggttagacgtgaagagacaggtaggacagagtcagcggaagagatgggctctgaaaagactgcctgaagacaaatgctagtaatgacttggccaaaatccatcatgaaggggtggcaagtgcaggtgccagagggcccttgcttaattgctgagaactagcaaccaggctggctgcatagtttctccactgctctgcagcctctcccaggccccattcctcagctcaacccttggtctggtaggtgacctgttgtgttcctggccaccttcaggggctgcagaaaagagctgtaaacatggagctgaggaccggacccagaacattatcatggccatgaaggaccgcatgaagatccgagagcgaaataagccagagatctttgaagttatccgggacgtcttcacagtgaacaaagctgcccatgtgcagcagatgaaaacagtgaagcagagtgtactggatggcacctccaaatggtcagccaagatcaccattactggtgagcaggccacagtttgaggggacaggaaggcctgggctatggggaggagactggggaagaaacatcctgagcgtgagggagcaagggattagggagaaagaaaaaggaaatcactgggaaggaaaggcctctttattaatcacttctccttacctagaccctggtgccggagaggcaagattgctatctgcaaacaacatgaaccataatacaaggatttgctaacaacctaacgctgtagacttggctaacagtttgatattataagaggtggggggagggggaaggggaagggcaggggaccagggagtagctaaccagtggtttgctaactgggtggggctgaagcatgtatatatcagagggtgtaaagatcaatatagagataagtggtcagttagggcttgggtagggagatgggatgcttgggctttaagggaaaggctggtggcccaggacaaagaataaatatggaggaatgggattacggtatctgtgcaaggagcatagactgctctaagatggaaagcatatgagtagtgttgtggggggcttctgaacgactctgaagcctcctatacatgcttgggttgcagtggtgtgtgcccagggcctacaagccaaggacaaaacaggatccagtgacccttacgtgactgtgcaagtcagcaaaactaagaagcgtaccaagaccatttttggaaacttgaatcctgtttgggaggagaagttccatttgtaagtcacagagagctttgtcttacctgggactgtgtgtattgggggagcaggatcacatcctgccattctgggcttgagcttgaagattgggcaaaggcaggggagaaaactcatttctcgcatgcttcgttcagacatcagccattctttctctggttttcttctcatgagctgttgtgtcaggattactgtgcccatgccctgtcttcaccagggctattaaaggggccctagggcaccccatcctgctttttctagcagtagaaagattttactactttactgctcagtgacagaaccagggactgactgccttattgtacctcctacccttgcctaggaaggtacagtagggttaggctctcataaggaaggctcttataaggagtggggagggagtgtccttgtcctaaaactgggtaattctggcttaaaagtggaaatctgggttctgaagaagatgctgtttcccataaagatagtgtttcttcctgcctcagcttctacactcactcatttttttattatctcactttcttacaaactatttcttatgacagtaaaggatggttattgaaaaatggcaaactaatgtctgagaatccacatgctttgtcgctccctaataaggcctagggtcaggattttggatttgaatcagccaagcaggctggctatgtagaggcctccttctgttggctcctcagaagattcagaaagggattaaggccagcgtggtggctcacacctgtaatcccagcactttgggaggctgaggcaggcagatcacctgaggtcaggagttccagaccagactggccaacatggcaaaaccccatctctattaagaatacaaaaataagccaggcatggtggcaggtgcctgtagtcccagcttactcgggaggctgagggaagagaatcccctgaacctgggaggcagacgttgcagtgcaccaagatcatgccactgtactccagcctggtgacagagtgagactccgtctaaaaaaagaaaagaaaaaaaaaagggattaggatatagtaaaattcatctctaatccagagataatattaatagctaccaggagaaacacctgtttgagaatctgaatagttcctgcttgaattcttcttatgactaatttaaaatgaactagctcttggtcatttttgcccacttttagtaaacagtttattaagctcatattctgtacaagacactatacataatacagtgtatccaaaaatgaatagaacaatccctggcttcaagaagctccttgttgatttgtctattatcttctcacagagcagtggttatactgtaatattttaatggaatgtggaaagataacataagaacatagggaaagtaagagcacattttgccagttacaacttttgggtgaaacaacagatcccagaaagcaactgttggagaggagagcttgagacaagacctgggaaaactcctttctccaaagcaaacccgatagacgagatgacaattcaatgggatatgataggctaatatagaagttcaccaagcacatagttaggcagatgagagagttagatagaaagccaaacagttataaccctatgggcctaccatgaacatgtctagcacctttactgacttcatgtcctgggctctgaggatggagctagcagttgcttcctggagctccgtggcatgtctagctattttcctcttggtgttgctgatacagctagctgtataggaagtcagaattgacctgaattactcttccctccaccccttgccctttgttctaggacaataagaactgtacagtggtagatagagccacccaggccgaggaatgaagagtcatttgctaggatagcccaactttcttggaacttttgtactgctgtcctctgacttctcctctttcagggcctcaagtgcagctgtcggagcttttgggagggaataggaagtaacaggatttggcgctactgggtctgcccctaacagagcctgcctaattctctcacagtgagtgccacaactcctctgaccgcattaaggtgcgtgtatgggatgaggatgatgacatcaagtcaagagtaaagcaacgcctaaagcgagagtctgatgatttccttggccaaaccatcattgaggttcggaccctaagtggcgagatggacgtctggtacaacttgggtgaggaaactggacccgagaaagttgcttggaagggaaagcatgaaggggacctgggaatagtccttctaccaaaaccaccatctgtccccaaagcatacctctatacagagcctgtctcacctgcaaagaactgactgtggggagggatgggggacagaggagtggcagtggctgtgagtcactctggctgaatgttctctaggtttcagaaggccctttaatcttcatactagtgcttttgtcccccctccacactcctgttctcctacccagctagttcaagggtacttgtggaatatgtggtcactggagtgattcaccctatttggtgagtccttgggttggccccttcttttccttgggttggccccttctcttccttgggttaagccagaatggaactatctatgctgtctagttgcattggtgtcaatctccagtcttctttccttcctagagaagaggacagacaaatcagccgtctcaggggctatccgactacaaatcagtgtggagatcaagggggaggagaaagtagccccataccacgtgcagtatacatgtctccatgaggtgagccagcccttggtaggtgggggatcagaaagcagtgctgggagaggcctttggccataagtaggattgctaggtggttggaatccgaggcccattttaaattttatccttgattcactctgttaccctggagagtccgagtgactgaactcagactgcattctcttccactaatgtgagaacagcctactggggccacaggaggaactgagcaatgactggaaggacagaatttctgtgggaccttgtgcacattcttctgggctttaccaccaagtttgtttttgtctttcatatgtgtttaacccattccctttctctgctctgtctcctgcagaatcttttccattacctcacagacattcagggcagtggaggagtccgcatccctgaagctcgaggagacgatgcctggaaggtgtactttgatgagacagcccaagaaattgtggatgaatttgccatgcgttatggcattgagtccatatatcaggccatgacgtgagtctctgctgcggcaccgggaagtggctactaatcactggggtggctaattaaggcacactgacatggtgggcaggtccttagtgaggtagcatgcagtgattcctttactttcctctctgagctgggtgagatgggtctatgccccaagacaagaagggtatatgtagaaaaagaatgttgtaactcacagaaaaggtatttctgtctgcctcagagttgagggaactctgcagggaaagaggcatgtgagagtatgcaaggacaacctgcctagacatcacaggcctgagcagacagggtatgtgtgctcgtgtacatgtgtttgtgacaaccggtctggcctagactggcctgggggttcaaagagaacactaaactgcagggaaagcagctgtgtatggagttgaccaggactccttgaatgggaattccagattgctatgagaagcagggtagcctttctgtcagtgaggctgcccctagagctgtgtgcagaaagtagccctaggcaagagagggcagcaattgccctggctgtgcttcatttatcccataaacttttagagttcctgcttggcttttgctgcaagccctgaagagtctttgaggctgcgggtgctgtgtttttcaggcactttgcatgtttatcatccaagtacatgtgtcctggtgtgccagcagtgatgagcaccttactggccaacatcaacgcctactatgcccacacaactgcctctaccaatgtctctgcatctgatcgctttgcagcctccaactttggggtaagtatcatgtaaacacatatgtctgcatttgttaccaattaataaagtttgattttttttttttttttttgagacagagtctcgctctgttgcccaggctggagtacagtggcgtggtctcggctcactgcaacttctacctcctgggttcaagcgattctcctttctcagcctcctgagtagctgggattacaggcacccgccaccacgcccggataatttttgtgcttttagtagagatgggggttttgccatgttggccaggctggtctggaactcctgacctcaggtgatccactcacctcggcctcccaaagggctgggattacaggcttgagccaccgtgcccagccaagtttgatttttcttggctggtcctatagagttacttgatgtgcttaaaattcagatagctaccattttgatagatgaatcttgtttcctgtttccttatgggtatgcggactatactaatagcctctcctcacacacagataaagaagagaaggtggttgggggtggtaccacctgggcttggccagaacccctctgggccaacaacttggttgaattacgatagtcttccatattcttcagtcttgcaggtccacaaatggatttttaaaaatcttgttcagtctgtctgtgatggattcatattacttgagttgatatgagactgatgtctaagcaatgatgccagtgtgcacttgaacctgttccttttctagtgtccagactgttttccctatccagggtgtgcccttcctgggttaaggtacctgagaagttgagtcattactcagaatgtcacctgacattaattcagtataaactagataaaataattctgacccaacacaaaaattaccattttgggcataaagttactgatatcaccccaattcactgagtctatgaaatctgacttttttgtactaatgaattttttgttgttgatagagcctttctgtagatgtgtaacttattaagccagtcaaatatttgttccattttgcctcatctcattatgtattgacttaatcaacatctactcatataatcaatatatgagttctaggagtgggatgccaacatcctgcaggcatatgattccacgtttaattatactttttctatgaaaatcagctattaaaatagtatatgttagatattttaacatttaaaaagtatacactatgggaaatgtgtgtggaatgtggtttaaagagagaccccttcctgcctgtcctgttatctttcatatgcatcagattctccctcctatcatcactgctaggctgtggctgtataactgttatgcactaccccgagataagtcaggagacctcagactcaagagagaatgtgtttggagtttcttcttatctaactaagataagttacagtcccaaaggtatagagatgcactggtcatgccctattgactctcatatagaaggagccatttctccccccagggacttggctttttccttgtcagtgtgagatttcccagattgggacagagctgcaaagagatagaacagggactttctatctcattttttccgttacactgtttgttgttcttcccatgggcagggatgtgtctccaacccaatgcctcccgactctttctactcatccaggggtggttctgtttctgttatagtttaggggactcagacacaggttctctttttcttcccctttatttgtttctcaccctcagaaagagagatttgtaaaactgctggaccagctacacaactcactgaggatcgacctctctacatacagggtgagtgaagacacggctgtgggcaggataatagatatcaagcacggtcccagagagactgtaggccaatcttggctataaagattgaggccagggaaaactggtctgtgtcatcacatccacccaaatggccaatgctactgacacctgtggttcttttaactccagggaccatgtggtgtataaatagcagcaggtatggttagtttttatagacagttgtctttccaacctcattcttaacactctactaaactctctggtgacattctcattagggagtttcctgaggataatctcttccaggagtatccttttaaaaaattagatacctaattacatttcttttttgcatttttccatactctcctcgttttccagcggaggtgtgagaatctggctaggggacagagagtagcttggcttttgcaagtaatctgtatcagagagcatgtccattcctagtataaagggaggaaataggtatagtaggaggatggttactgggacgggacaggataaggaaatgggcagtttcttagttcctcctatgttagatcttagaaatggcttcattacttgctttaaagtgtgtgaattttcagaacaggcaatatatgcacattaaaaagtaagtataaaaacaaccttaaagtcaaaaagaaatgaggttttaattgtctgcactcaagtgccctccatttgcacaaataatggacagctgactgtatatcttatatttggcatataagtagccatttgaaggtttaaaaactgaccattaatgtgaagacaggctcagcatctcccttcagctcttcatagcagctccctcctaagactcgtgccaaagtgaatgaagtaaggatggctggaaattcctaaggaactcactccaaaagcagttctgctcagagatctgccatctgctggctgcagaacagtagaagagctgggttctattgtacaaaaagtacaggtcctggacctcagtttggtctgtagtgtggctccacttatattccaggatatacagttagattgtaattttcgaagaactcactgttggtgtgtaagaatcttcatccaagaaaaaagcatgtgtgtaagtttgtgtgtgcctgtgtgttcctttgtacaagtgcttatacattgcatgggaagtagggctggaggaggatgtgtcactttctagggtggggagtattaacccctgcttttggcaagagcctgtttgcatcaatagaaaaaagagaaggagacctgtaactttacagtgtttttggccagctcaactagagaaaaacccagtaggtaacaattagggaagcttttgatatcatcacttttggcagggaaggttttcatagtcctctgttcctttcttacatttgcttgatttgcaacagaataatttccctgctgggagtcctgaacggcttcaggacttaaaatccacagtggatttgctgaccagcattactttcttcagaatgaaggtaagaaatggactggggcttgggtggtgctgggctggagacctggctacaggaacgtgaagaatgagaatcattgggcagagtctgaggctacaggattcatcacctctaagcttacatttctgtgtacctgttccctgggttacttctgagagagcacatagactatggatccatgaggatggggtggaagttttccctgtcaactatcctggcaatttcatcacagggaaaagtctagggacccagacagggatgaaagaatctagagtaggtttggggtagtgctaggagaatatcccacccaggtgagcaggtccttgggcccatatttcttcttttaattggcaggtacaagaactgcaaagccctccaagagccagccaggtggtaaaggattgtgtgaaggcctgtttgaactccacatatgaatatatcttcaacaactgccacgacttatacagccgccagtaccagctggtaagaggttcaggatcaggtggggccagctgtcagtggctctttggagcctcagttttccttcatgatggtggtggaaaagcactcaggacaaagtacttgatgttctcaagggtgagtgagttgtggagtatgaaccatgtggaccatgtgagatatgtggatggaaagagacccctgggcaagatgagacatacctgaattgaacagaaatggcaacaataatgatgttgaagaaagtaaacctaaattcatgcacagttcaggggttgagtaggggaattctcagtccatcccagagtctttttttctccctcaagtttaactttattctgactcttgcagactcttgtaagttctgggcttccttcctctgagatctgaagtggtctctgagctgctggctcctggaagctttacttttccctctaattacttctctctgaaatgtgtggttcttctgggttgtattcatccactggctatcaagactgaccctatccttctgtgaggctgagctacttcacctgttttagcctggcaccctaagtcagtacctggtgacttagtacattttcccagatccttctaatagtgtccccgatccatgctcccaacttatttgaaagccagaacttacttctagctccaattactcaattacagttccaatcttaggagtttcttgctgaccatacatttgcagagtggattcccttcagtccaacaaatattgaatgtttgttctaggccaggtctgaggagagcacagtgctccttcagtaagtttgcagtctcataaacatatatataactctaatcaaaagagtctgtttgaagggccttgaaaaagggataagattaaaggaattccaaggaggaagagtcttttcgcactcttgatcagataccaggaaaagctacataaaacaaggaacatttgagatagaccttaaaaggcagtgggatttggacaaccaatgatggcaggacaacctaaatgtcttggacatttatctttaagtaactacatccaatttgtaaagcttcctaggaacaccctcataaagactaagatcttgttcctactgcctcttctcattcccaagtgtactttctgtgccagccatgtatttaaggcttcttccttttaaggtttctaaagcctcctgttgattctgaaatccatgggaggttttcctgaggcctttgttttacttgatacattctaggctcctctgtcatctgtctatgaagtctctggttgaggaaagacactgttctcataaactattcagggatactctttagcctttgtattttagtatctgctttttactttctctcaatttcattttttccttattccatatttacactggcataaactcttgatgtcttttaaaatttccatctgttgaccttcagtcattggtttattcgtccattcatttacttaacagagcattagagacataaagttgagtaagagacatttcagcctttggggatctcatggtttagtggaggtcagggcaaattactacatttattgtttttttgttgttgttattttgttgttactatgttttattgtagttgtagttttctgatacatctacaccaaaggttcacagagggtgctgtgggagcccagaccaaggatgtcaggaaaatctctcagaagaggcaaagttcaatctgaattttgaggaaggagtaggaattaactaaagaaaggggctggagggaaggggcataccacagagagaatagaatgcttggaggcacagaattatgtatgagcttgttaatttaaagaaatataagcaggccgggcgcaatggctcaagcctgtaatcctaacactttgggaagccggggcgggtggatcacttgaggtcaggagtttgaaactagcctggccaatatggtgaaaccctgtctctactaaaaatacaaaaattaggcaggcatgatggtgggtgcttggaatcccagctacttgggaagttgaggcaggagaattgcttgaacccaggaggcagaggttgcagtgagctgagatcgtgctgctgcactccagcctgggcgacagagtgagactccgtctcaaaaaaaaagacaaaataaaaataagataaagaagtatagcaatttagggtacttacggcatccagctgtgggattcagctatctgggatcaaatcttagttctgctctttaaaactgcatgactttggacaagtcatgtaaccttgctgcccttcactctcctcatctgtaaatgaaggtgataataatttctactaaatggagttgttgtgaggattagataggataatgtgtgtaaaggtcttagcagagtgtgcggcacataataagcagtaaataagtggtggtggtgtggtaatagctggaacaaaaagagttgtaaggtatgaggttgagagtcatattctggaaggtgtaaactaaggaatttaaactgtattgaacgccgttgaagggctttaagcagaggagtaacacattgagattttctttgtagaaagatcacgatagctgcaaggaggagggattggattgaagatcaaagaccagttcagaaatccttgaatgataagagcctgagccaggacagtgacagaaaaataaaaggaagagatgtatttaagttatattaaagattctgtcctggtttctaggaacttcttgataatgcaggcttattaaggactgtggaagctttccagtgacatatgacatcccacataaaggccctgttcctgtccttctgggcagctccaccttcacctttgacttagtgggagataatgtgtgttccaccctccctgtggtgactcctacttcacttttctgggctgtgaatatagagtgatttctctttacctgaaagtcaccattgtattcccttgcctcttcccaagtaaggccctatcttatctagttaggcagatagcttcctagatgcagttcttccccctaataacttcaggggatcaagggaagtcctactccactgaaaggctgaaatgcgcaccagatctgttcagtagctcctgcagaagttgaaagagcttctcagagctgagatgtgtatgtgtgtggtcgtggtgtgctgtcagtagaggaataccaccagaagaggagggctgcctgcctgtaggggccgcatagaagtagacctatttagtaaggctggaggggctgtttcctttagccagcgagttactctgcccatagcaactgagagaaggaaggaggatgggcatccttatgtctcttggactgaccaagtttatcagagagaacttctcagcgataggctccctgtgttcagggatctcacaatagtcactcttacagaacagggatagtcttgtggaagacaggctctaggagaggaaaggtccttgattctagaggaagaggtataggaaggggaagagaaagaggatcgttggagacaccctctacattctactctgactctttctccctctctctcactgtgtcctctggatcaagaagcaggagctacctccagaggaacaagggcccagcattcggaacctggatttctggcccaagctcatcacactcatcgtgtcaatcatagaggaagataagaattcctacacacctgttctgaaccagtgagtatcaccctctttggccctgtctgttggtggttggtctgtccatctgtctaacaacctctttctttcctgtctctgtatgtttgcagtgccacctcttcttcctgtccatccatctgtccctctgtcccttgtatctgtctgggtaactgtttctggagacaggtgtggaaacataatgggggtccctggccagattgagccagcttccctggagtgagagacttctgggactgggactgccataggagccccaggggatccagagaccatgtgtgtatgtgtctgtccactgtgaatgaagtgggccttcttatagcccacccccacttgccctttctcctccagcttatttagcctgcgcctgctttccagcctctgcctggagagtctctacctctcaattccctgccttctgggcatcttctgcccccaggcccatcttgcctatggggatcccttctgccctcacttgtcctgccactggcccctggcccctgggccccttttctccagattggacctagccctgttccctaagcatctcctctctccaatatgacttccaagaactaggcactttagccttgaaatgaatcaaatcaaatggctcttgccttattctctgactgtggtttcttctgtcatccaggtttcctcaggagttgaatgtgggaaaagtcagcgcagaagtgatgtggcatttgtttgcccaagacatgaaatatgcattggagggtaaggatctgttcaaatcagtgggctgccaggctcctagcccaagctcctcgttcactgtccctttcctcttctagacaactacaagttctgggtgagtggtatagtgagaaactaaaggaattctaggcctagtgggatgtaggccccgggagaccttgggtgggcaaagttgcagccaaaggacatatgaaaatggctgtgtggatgtagcttcctccttccagctttggagcaactgcctgttcaagaccttcccagcccagagatgaaattctcccatggtgggtgttcttaggtggcccacttcctggagaatggtcttgggaaacttcagttttaaagaatcagagaaccttaaatacacagatagatgtaattgttttcttatgttggggactctctggcctggcttttcttgcaagctgctctggattagtatgacaatgccaggaagatacttcttccctcacttctcctatagagcagggccacaggcaaattattattcatcttactcattcagcttgttcttttattcatttcctaccttggtccacaaagatatcattccatacctgtattagaccttcctatctgtacccatctgtactcacctatttagcagcgtttcctgccattttatgtgtggtagtctctctactcagtctgtgaaagcccatctaggaggaggaggagccatctgggcaaggacaaagcagagtctggatctgttatttgggtgggatggcagggcagatgagccaccctcagatgcttgaatgtgtgaggtttagaatcagtgagtcttgagattgaaagaaaccttgaagatctgtgttacatttgagccagccacagactacacgcatacattctgtaacacaagcccagagcagggctgcctgctgtcaggccagggaggaggtcattggtctctccctccagatgccacttagtgagcctgatggggagtacagtctcagttcttgaagaactctggctccagtgggtttgggggaaaagagaaaacacctgtgaaaagtgaatcaactccacaagagaagtagtgtgaggtggggcagaggttttcaaacagaagtatcttaggagctaagttgaaggggaaacccagaggctaggctccaggcctcttgcatgatgacagctcagccagccctgcatttatcaatcttacatggaattctagctgagatttcttttgaaaggggagttctgctaatgtttaaaacaaacacaaaaggattgaaaacttctactttaagagaaagaattaatgttggcctgatttcatacctcaatttcaccgcctatgtagcactgtgaatttggtccaaactacttaatttttatgagctcccattttctcatctgtaaaatgggagtgatgatagcatctgtttctttgaactgatgaagtactgagatgtatttagcatactgcctggcacttactcagcactgactaaatcttagttcttaagaacaataagaaaccattgcaggctcttgagcagagatgcaatgtgaagccagcagtattttaataagatctacctcagtgggagatgagggcagctagaatagggagagactagaatcagagaacgcagataatgaagagctgttgtaataatttagggatagagggtgctgggattagagaagggaagtggagagaggagaatgggctttgatagacattggaaggaagccagaacaggacttcgtgattgtcagaatatggagggcaagagaaggggaggagttttgggggcctggatgataggagagtggcattgactctgactaaaccaaacaccgcatattctcactcataggtgggaattgagcaatgagaacacatggacacaggaaggggaacatcacactctggggactgtggtggggtagggggaggggggagggatagcattgggagatatacctaatgctagatgacaagttagtgggtgcagtgcaccagcatggcacatgtatacatatgtaactaacctgcacattgtgcacatgtaccctaaaacttaaagtataataaaaaataaaataaaataaagaaaagggtgaaacattaaaaaaaagaaaagaaaagaaaatgctgtccgtcaccaaatattttgtaagtcaacattattaaggtatcatttatagacaatacaataagaccactttaagaatacaatttaatgagttttgacaaataagcccaactgtgtaacaactctcccaattaaaatatgaaacaaaagttccttcttgccactttgcagtaaatccccactccattcaccaaatgtttattgaatattttctctgtgcctggctctgtgctggttattggaacccaatgagatgaacaaggcatagcaccatcccttaagaaactcacagagcagtctagaaaacagtcgtataaattggtagttacaacacaaagttataatgccacaagaggagtaagtatagggtgctgagagcacacaggagaaccatgtaacccagattctgaggacctgggaaggcttcctggaggaggtgatgtacaagccgaaacctgaagggtaataagatttagccaggagggtggtagtgacaagaaagggagacacagaacatttcaagcagaggctacagcatgtccaagacctggggtctagagagagctggcatgcttggagaactggaagcagcagttcagtgtgactagcacttcagagggtaggggaagagataagtaagacctgaagatggagaggtgtgacggagtcagatcgtgaaggaggttgtaagccatgcataggcttttggactctctctctttttttttttttttttttttgagtctctctgtgtcacccaggctggagtgcagtgggctgattttggctcactgcaacctccgcctcctggattcaagcgattctcatgcctcagccacccgagtagctgggattacaagcgtgtgccaccacacccagctaatttttgtatttttagtagagacggggtttcaccatgttggccagtctggtcttgaaccctagcctcaagtgatccacccccctcagcctcccaaagtgctgggattacaggtgtgagccaatgcatccagctgacttttggactctatcttgaggtagctgggagccactgacatatgtcaagcaagggattgacatgatcagattattatgtagaaaggccagtcgctctgtctacagtgtggagagtggattgggaggcagaatgaccagtctggaggctattatagtaatccaggttacagatgggggtaatgagacctaggcaggtaatagcgtggctagaaggaatggatagattccagagacatttggaggtgaaatcaggggctggcgatttaactgggtatgaataaagaggtagaaagaagatttgaggatgatgctcagcattgaacaagagggtaagattagttggtgtactctgttccacttcagctggagattttaagatagtgagagacaggggcaagttaaatctaggcatgatgaaatgttccatccgaagcttatataggccaggcatgggggctcacgcctgtaatcccagcactttatgggcctgaggcgggtggatcacctgagttcaggagttcatgaccagcctggccaacatggtgaaaccccaactctactaaaaatacaaacattagccaggtgtgctggcacatgtctgtaatcccagctactcaggagcctgaggcaggagaattgcttgaacccaggaggcagaggttgcagtgagcagagatagcaccactgcactccaccctgggtgacagagcgagactccatctcaaaaaaaataagaagtttatatagacgttaccagaaccaaagagagattagggggagataccagcaaactgggtagttgaaatcatgaggttggaagagctctccaggaggaaaggagggagttaggtggaagtcaggggcaggaggttatggattggcctttctgacagattaccccacctcaaacaactttactggagcatgactccatgggacttgttagaatagtttaaagtgtgaccggtgtttcagaacttgtcagttagtttttataccagagaagttaatacagaaattagggataggggccagagtgcagataataaattgacagagaaagtgaaaattatatgtagaaacagtaacttgaaggtccctaaaagaaagagttagggagttatggagtgatgggcagtcctgcttgaaaaggaaggaggagggccctcctgatgtttctaggttcttagactggttccagaacagcaggggatgggggtggaggagaggggctctcttttgatgtccctgagggtctctctgatgtccctgattttttcactctctttgttgctcattggtgtctgctctgtcacaagcaaccactgtcattcatatacgaaaagtcctctttctgggtggtaagaacatttagttgtccttttgcctctagtcttacaccttttccctcttctcctgctcactgcttcatagaagagactgcaaatgcaactttaggttgagacagtgctgcctgcagtgccagggaatgaaattcctgggacttgaagccctttgaggcagaatcccgggcttccatttcctccttcagtgtctgctacactagttcacaagggccagctgccccagcctggatgttccgccttgacttggaggagcatcacccatggcaactcaaagttgagcaacaaagtccccaaggacagtggccttctcttctctgctgcttagtcctctcccacatttgcttgcttttaccattatgttgatgtgtcagcatacaattgatttttattattcaaattagtgcttcaactatgaagcgggtagatgaagagaacctatgggtgtggccagtgctccagactctgagcaaattgtgagttatctttgtcttagattttccagaaggctctggagattcagcaagatgacttttcaaattcgtagtaagtgccccattttctgcagcatgatatgtcctttcatctggctgtgtttccatagtttccaaactgactattcatatttgcatacttccctgagaattcattttttcaatgtctcagctctgccctggagcccttcagtttgcctcaagattccattacaccatggctgcccaactgctctgtcaacttgggcccagtttgattttccctgtctctgtagttgtcactgacccattcatgccatgtacacctgctcatctctgcctttaagcctgtctgaaggatgactcagctactgtgatcagaaaggccctggaaaaccattgtcctctacagtcatgggcagtctccctactaatcagcatcagcacccatggccctttctcctcttctacaccagaggccagatgctagaacaaaaagaccacttccaaacgctagagcaaaaagactgcaggctttatctgggagtctggcttagtctttctagaggaagatttgggccaagcttgtggagagttgctgagcagaacactgttggggagagatggctgtgagaaggaggttgggagtcacccttgtcctaagacatctgatggagctgcctgaccagatctgctgccttgggaaggctcaggaaccatggcctctactgctgggacctgacccaacctttctccctaccactagagcatgagaaagaccacctgtgtaaaagtgctgactacatgaacctgcacttcaaggtgaagtggctccacaatgaatacgtgcgggatctgcctgtcctccaggggcaggtgcctgagtacccagcgtgagtcatcatgtgggcactacagagggaagggagccctctgggtgggcagggctagtatccccaattcatttcagcaagccagtctcggggactgcctgttcaggtaccaccgtagacaaagaaaagtgttaaactgtgccctgccatcccgaggaccccagtctggtggagctgtcaggaagtggcgtattcccaccgctagttctaagcccctgttctcctgctgtggctgcaggtggtttgagcagttcgtgctacaatggctggatgagaatgaggatgtatccctggaattcctgcgtggggccctggaacgagataagaaggatggagtaagtcaggggctttggctgcaccgggttcaggccaggtctcccagcaattagctattggcagaagttcctgggctttggccaggatggctatgcctgccctgtggagttcacaggagggctgttgagggccattagccactcttgctggtcagagccttttcaaactctacaagcttgggaaaagatagcagctgtggatggtgaccctgtgtgtggtcttccttagttccagcagacatcagagcatgcactcttttcctgctctgtggtggatgtcttcacacaactcaatcagagctttgagatcatccggaagctggaatgcccagaccccagcatccttgcccactacatgaggaggtttgctaaggtgaccataactcttcctactccctcccccttaccaccaccacactcacagtctcatcacaggcctgagctcagcacctctccactgtggcctcctggtaaagctcgtgtgacccccattctcctttgctggtttctggggcagacagatggttctgtcttagtgctgttctgtggttgagagagagctttctcctgtactgtgggattccccctttacctccctgttgttattgttctgtgatgagaagtgccacctcaggcaagatccccatagaagagctaagagttccctttccttttctttcctttctcctcttctcagaccatcgggaaggtgctgatgcagtatgcagacatcttgtcaaaggacttcccagcctattgcacaaaggagaaactggtaggttcaggccctgggactcttacagaaagagagtggaagacatttgaatccttgcttttgaagctgtcctcagaattgagggttggggtgacactcctgatgcctgattcccaccatggctttgcttcagatccatgccacaaaattacgagaacttgacagagttcctgtgagtctcatttggtacattatcctctgctaagctagacctttgcttagtcttttttttaatatatatataaaaactttagatattcagaaagttataaaggataatacattaatacttgagtacctaccacccagcttaaaaatgaaaacatttgcttttagtcaaggagaattatctgaactggccccagctcttagtgctgagggagaaacctatgtcatatgtgaagtccctgtggcttttgtgagagagggagggaacctaggctaatgggtcctatgctgaaaggagccaagactcaacagctacatctgtccccaaagccctgcatcctgatgaacaacgtgcagcaactgagggtccagctggagaaaatgtttgaggccatgggaggcaaggaggtaggtcttagggtttgggagtcactgtattttccctttattcctgagctccttggccatagaactccaccctctcttaactaggtgtaggccaggaatttagcttggggtctgggctggcttaatctgaggtaggcattcgggtaaggccctgcgagggaggaataggcactggggtaagccctgcaaggaagtagtaggggtgtggcagggtagaagagggtaagaaaagcagcctagccaggcttacctcctgtgaatacagctggaccttgaagctgcagacagtctgaaggagctgcaggtgaaactgaatacggttctggatgagctcagcatggtgtttggaaacaggtcagtgaccccacaatacaaggccctcagagccagatgtggtccctagccaatcccagagcccttgccccacacctctccatatagctgcaggtgtgtggatcttccctgtactcctgctgactgtccctgctggaaatgcaccatgagcatatgggaatgggaccaaatagctggtgccgctccagggacagtgtgtgtttggggagggaaaggctacactgcgggcacatgtgtagtttccaggtacggattgatgagtgtgttcgacaaatggccgacatcctgggccaggttcggggcacagggaatgcatctccagacgccagggcctcagcggctcaggatgcagatagcgtactccggcctctcatggacttcctggatggcaagtgagtacagcattcaggactatcctgtggggatgagcaaagcagatgctatcgggcaagggagccccttggggagaggggttctcaaactctcaccctggtctcacctgttgcctggacttgcagcctcaccctctttgccactgtgtgtgagaagacggttctgaagcgtgtactgaaggagctctggcgcgtggtgatgaacacaatggagaggatgattgttctgcccccactcactgaccagacggtaaggacacctccttccacttcctcctgctgtctcccttcccctcactccctgcttcctgatggagttggggtcctctgcttttgactgattccctctctgcccagggcacccagctgatcttcactgctgccaaggagctgagccatctttccaaactcaaggtactctgggtgtggggtcctcctggcaggtgtggtccttctgaagtcatggagagagggtggctgcggggaaggaaattggagctttggagactgaagaggaaaaggaggagatgaatatgcactgggggctggcaggtgggtgcaagactttcatgactgctgtgagctgtcctgatgctgctgatttctctgaacaggatcacatggtacgagaggaaacacggaatctcactccaaagcagtgtgcagtccttgacctcgccctggacaccatcaaggtggaggccccccctttttcagacagtcttaaccaccacactcacttggccctggcattccactctcccagaccaggtgtccctccaattcttaacactccacatccagaagagagttactatgtactgccaaggatacagaatcagatatggttcctaaattcaagatgcttatcattggtaaggtgatataaggcaggaacatatgaactgtgcttcaaggcacctgggagaggtatgtcataggtctcaagttctctaaggttcagatgggtaaaagagcacttttggttcttctccgtgcctgaagtgtttctattccatttctgtgcctgtccagaaagacccatccttcaaacactgccgtacctccaggaatgtggccatcccctactaatcctgccaaatacccaaataatactcatccaagagcctatgctctggttctgtgggtgttcctgaacagcctattctcacagtcctcttcttgcttctctgaggacaatgttggggagctgctttctgtaaggggatgaagcagtcacgggtgctcttttatcttgcagcaatacttccatgcaggaggcaatgggctgaagaaaaccttcctggagaagagcccagatctgcagtctctacgctatgccctgtctctgtacacacagactactgacactctcatcaagacctttgtgcgctcgcagaccacccaaggtaaggccctgagggctttgggtatccacctctcctctctgatacacatcttcccctagggagtctgtatcttcatgcccttgggagcagatccagttacttcttcagagagcccttcaaattcagatctctattgcttgatgggacctcagtacttacctccaccccatacccattaccaggcaggagaatcacagaggcctgggaaatatgtctaagatttcttttcccagacattgcctggcccatgcatgtttattaaactcaaggaatataccctgactggtaagcggcaagaatgaaaaatctgtgaggaagccttgagaatgaatggaagccatgagaaatgtgaaggctcatagtgtgtggagctttgctgggagttgttctggggagagaaggcaaaagactttccagactctgcagcatggatagggagacaaggaagagaggcaaaccatggcagctgctgaagggagggtgtggatcctggggccctgtgcacagctgaggctccagtctcaggggtgctgtttatgcacaggggacccaggaagccggttttctcccagtgactttcagtcctcagaacccctccctacctccagcatggcctgtccaaaacaaaacacatctgcatagatgtagctcaggttgaaattctgacgctggagcagagccctcccaggaggcacctcaggcacatttgttactgcttgttccaaggaaacctgagcaggctgcctgggggagtgaacctggtgggggaagttggcgcttaggcattactgagctgtgtgtgaatctggggcacagggctgacctagaggggagagggctctaagcaggtagactggtgatggaaagtaagaaaatggaagggaccgaaagtactgctctattccccatctgttctcatttccaatccagggagggaagaatagagagcaaaagaagagctgtgagtctcacttaagtggacaggtagaacttttacagagctgggtacatgttcaggcatacaccatcaaggaagatctgagttaatccagaaaggctttttagaagcattgagctttaagcttgataaaagatgaggagagcctggaatgagcacacatatgatgagagcagggttggcaactgcgggaagaatccatgtgtatgcgtgtgcattttctacccgttgctttatcatttaagggtctaggaaattaaagcctacagcctgtctcttgtcctgcttgtctcagatacctcctctctgtatttttctactgtttctgcccatgatttggttggtctctgacccatgaagtctaatttggagcattcacacactgactgcagctctttcacttctttctccactctgccccacctctgtgctccctcagaatatgtgtagagctgctttgaatggctgttaactccttagactgctaacggattcttctttctctgttctgctgctgctactacctctgacttgcctgtcctcattcagtgcatgatgggaaaggtattagatttactgctaatgaggacattcgtccggaaaagggtatgttgtacaccgtgcagatatggatctaacatgggctaacactgacccctgggagctagaatgagcaactcgtgctgggggtgggggaacaagctgtcaaggtttaggagctctatctcaagtcttagagatgggtaatgccttcatatagcccaggaaggggttctgttgttgatctctgtcgtattctcagcattctcccacccctccacctcaggacaaagaaggattttctctggggtgtaagattgtggtggtgttttctttttttctttttttttttttttttgagacggagtctcgctctgtcgcccaggctggagtccagtggagcgatctctgcccactgcaagctccgcctcccaggttcacaccattgttctgcctcagcctccctagtagctgggactacaggcgcctgccaccactgccagctaatttttttgtatttttagtagagacggggtttcaccatgttagccaggatggtctcaatctcctgacctcgtgatccccccacctcagcctcccaaagtcctgggattacaggtgtgagccactgcacctggccaggtgttttcttaaaatagggtggggtctctgctaaggggagcctgtagattggctcttttcagagattggaactggggagttcattctatagaggggcccaggtttgagggggatgaagtatttcagagcacagcagcctcccaagcagggacctctaggaatcctgggcataggtgggaggttgctgcttttggctagagaggacccacatttttccattaagagacactaccaggtcaacataattcccagacacagatacaaggtgatggcactgccctaccccaacgtctttcagttaaaagtccttcagcctaggagataagagttttggggatccttgagagagagtcttagtgcacttttggaaaatgttgcgcctaagatgctgtcagcttaacttgtgttacaagacacagccttgttctttatcccatttctttcccttctcctattgcttacttcccatggttactgtggtgattgcttcttgcttttgggtatagggtggtgacctcctcacccctcaggtttacctcctacagttctccaatggggaatcatctctccatttgtccctcagggtctggtgtggacgatcctgtgggagaagtctctattcaggtggacttgtttacacaccctggtactggggagcacaaggtcacagtgaaaggtgagtgatggacttacaggtctgccctttccttgcccagtggcctcactcatcactcaaaagcaggggctgctcatcccagccctccagctcagccctcctccaaggggaaggtcacctggggttcaagaactgggaaatcctggtgggatccctcacaggtttcccttgtttgggcagtggtggctgccaatgacctcaagtggcagacagcgggtatgttccggcctttcgtggaggtgactatggttggcccacaccaaagtgataagaagaggaagttcacaaccaaatccaaaagcaacaactgggcccccaagtacaatgagacattccacttgtaagttacgggggggacatacaggactctgggatgggggtaagacttgaggggtggggggagaggagggcccggggggatggcagactggggtgaaatcagctgaagactcaactctggcctcataacttctatcttgtgctcacagcctcctgggaaatgaggaggggcccgagtcctatgagttgcagatatgcgtgaaggattactgctttgcccgggaagatcgcgtgctagggctggctgtgatgcctctgagggatgtcacagccaagggcagctgtgcctgctggtgccccttgggccggaagatccatatggatgagacaggcctgaccattctccggattttatctcagaggagcaatgacgaggtggcccgagaatttgtgaaactcaaatcagagtctcgttccacggaggaggggagctgaacaccttcgactcctgtgccaatcaggcagcagcaatttcacaaatcagggccagtgggagttagctgtgtaaccggcttagggtctttgcagtcaagaggctgaccccttcagttaaagatatttaaggaaaaatttggggtggtgataatatggcttttcacagaaagggtcatgaagccctggcccaacaggactgtggtactaggggctgggatgtggggttaccacatggagagattttccattaagagagaaggacaaacatttctgagagtgtcagccattcttggtagacacctctccactcctcatcccacctctacccatctccatgccacaccttatccagttagacacatacataccaatcattagaagaacaagtttagaaggtgtggaacttgtgcctggctggctgggtagtcagctgagcctgttgctgagcccggtggtctggattggagtatggccagggcaggagtacacagaatagaatttagactgtcccttgagtagaatccactgattttctgtggctccagtgagaacaaggctttgaaactgaacaagataacttctagaaatgaactgtactaatccctttccccagattgtatcatgagtagaatcaggttcacgtggtgcttcaaagccctgagaagaatatttctttggaccccaggcactaggggccacctgcctgggagtctccctgcctcactcctctaggcaggggagtgatgcttcaggacgtgacaggctgttctaacatgtgtctacctgagggctagttgaaggatccaggagtattttcttcttgggtgggccctgaacaaagccaaaaattgtagaaaccagtctagaaaaagtcctgctcatctgtggccactgccttctagccgtcctccaccttgcagaaagaatctagcctttggtctctctctctctcatcggggtcatttgctattcccctctgatattcaaccctatagaaggagcctggactctgatccctctgtacaggctggatggaaggggccctccacacttcctgggaggtcagagacaaactgtttcagagagtcagatggacttcccaagacttgttgagagatgtgacatggttcttggatttcctctgtagcagcctcctggacttcctgaggactcgacattgtccacagatgtactggccattacatgaaacaagaaaccaagcatctttgctgttgttaattattatatgtgccattgttacaggagattataggctagtctgtaataaattatcttatagc

SEQ ID NO: 36279 - DNA, 39120 bp, Homo sapiens
atgaagccggggccgccgcaccgtgccggggccgcccacggggccggcgccggggccggggccgcggccgggcccggggcccgcgggctgctcctgccaccgctgctgctgctgctgctggcggggcgcgccgcgggggtgagtgacacgcgcccggatccccgccacggctccccggggccgccccccgcgcggggtgccggtccccgcccgcgaccccccctccgggaccccgctccctcccccccggctgcttcccccggggccgcggtccctgccacccctcgaccctcccccgagcgcccctttctgcaccctgctcccccccctccggaatctccccctagctggcatccgcggggagaggccgcccccgccgctggtcatcttcggggggcgcatctctccttccttttgggacccctccccagagggaatcccgggagggaacccgatcgcgggtcctcagccctgttcccccacctcccagtggctccgggaactgtctccccggggacgaagcgggacccctgcgctggcctgggaggcgcgagaaggacccggcggcgggctgggggtcgccgtcccggctgggtgtgtcttggggtgggagtgagcctggcttttgcctcgtgggtgtgcccagaccatggccactttttgggaatcggatcggttccccttccgaggggagggtgtgcatttggttcttcccagggtcgcggcagccggccagggcagtgggcccgggaaggggaggtggaggtggagggtgacttggtgaaggtgacctgaggggggagtgagggtaaccctgtgtgtgggcgtgtgtgggcgtgtgtggccaactcagtgaggggtgcggggacctgtggggcgtgtgcaggtgaaggatgtgtctgccacatgggtggatgccagcgtgccctcccgtccgtggtcgtgggagggtgacccattgtgcatgatgtgtgcctgtgcctggctgggccactgttggctatggccgtgtgtggctgcagtgggtgagggtgtgtgtgtgaaagacctctggtgggcgtgtgcttggacccatgaatgtgtgtgagtgcacatagcagcgtgtgcatgcaggtgcatgggggaccctggacataggacgaggacccctgaggggaaccaagcatgtgcaggtggaggtgatggtatgtatgaggtgacccttgagtgtccctttgagtgaccgtagcagccatgcttggtcccagctccgtcagggatggcagagaaaggaaggacctcatccccctttgagggatccaggccccagatgagttcttgttggacaagtgtccaggttctggctcaggcgggctggggatttctaggtccagcctcccaggttggttccaggagctatgctgtcctgcatcccccaggctgaaaaggacccaggcctctcaagcaacactgggtgcccagccgccctctgcaagttccttccctttcccagcctcagtgggccagtcagtaagacaggaggaggacaggcaggggctccaagcttgcttcttggatggacaggcccctcctcagccttccccatctagggggctgtcagctggagggaggggaagtgttgagggctgacctgtgtgaagtgcctgctggccaggatgtctcattcccagctctcccctaagtggggtgagaggaagaggtccctgggagggatagagacccagcacaccctagcagctggggtcgccttctcagccaaatttctgaaagaccatccttaaaatcaaaggcttgggaatcacacaaccctgggttccaatcctgctacccccgccgattcgtggcatggtttgggcaggtcctcttacttctctgacccttggttgtccctctgtgaaatggggctaatgaccccttcctcagagggcaaaaattcaatgggatgactgacgagtgtcctgagaaggagctcaggagtcatgtggtgtgcacatgaatgaaaggggctcaggacagaaagctttagacttggaggccaggtggagcgctgggcaggccactttccttgctgaataaggctaataattcatactccacgaggtggtggaaggacttagtgagagcatttaatagcctcatgcacagtagggcctcgcaacacgggtgacctgaatctgagaggtgtggctcagacccagtgttgggtggcagatcaagcagaccctgggagtctgagcccagaggctgaaatggtgggtggggcctgggggagggcaggtactggggcgcctggtgaggtggtgggaagtggagtgtcctccaggcctcacatcttcccatgggtcaagctgtcaaggaggggcatcatccctcttgtcctcatctgacttgggaggaaaagggttaatgggtggtacctggttgccggggttccgcaccagagggagagggcagtgcctgcagcaggagggactgaggttagatcagaagagccccagccagggaagctccaggggtggccttggtagatgagcggtggctggcacagggcagggaagggcagggacatgatgacccttgggtcacctgccagcctttgtgtgtgtgtgtgtgtgtgtgtgtgtgtcttcgtgtctttcagcatggggatagcagggagagcaggcctcattcacactgcagatggtgaattgcagtgtgtgtgtgtgtgtgtgtttgtgtgtctgtgtctgtctcctggcatctcctttgaggagtccctcttctgacagaccaagttaccaggactctgagggacatctgcctttaaggccacctcagctactgtacttaagtcaccactcaaagttttggagtgtgaggatcctgaacattttagcttttgaaacatgttctttcaaaagtccagggctggaagggatcttaggtgttagtcttgtttgaatactcccagtgatgggagaccactaccttgtggctgtgtgaccttgtgaaagttacctaacctctctgtgccttagtttccacctctttaaaatggagacaatgcgagaatggaagggcttaatttggaaagcttttagcccagtggctggcacctactaagggctcaacaaatatggatttcttgttcttttacaaagttgctgtactgtggttgggaaggcaggaggggtggggagtggaagggtgggagacgtgtgtgtgtgtgtgtgtgtgtgtgtgtgtgtttgtgagagagagagagtacggatgggggtgggggtgggggtggggtggggtgggggaattagtagggaattcttttgaagctcagccccaggcctggtggtttccgttccttcctcaccctgtttcaagcatccctgctcttctcccctccaggctcccctgggtgactgtgagccttgggtttccaggatgagatagtcctcaccaaaaaaatggaaagttgggggcccctgggctgttctgggccaggctcttgggtgaaccatctccccttccagcatttgggggacaggcacagggacaccacagctgtatgctgcctgttagctcccaaggtaccaggggctctggggacagacacctgctgtgtgatttccagtgagggatttctttctgtctcaaagtccttgtctataaaatgcggacagtaatggtgtcagcctcacagggatgttgtgacttggaaatgagctgcttgagtagaccgagcacacctgccacgtagtgagctctcaggagatgggacctttctgggagggagcatggatggggtcagggaaggcttcctggaggaggagggttttgagctaagcaatgaaagtggtcatcacatgacagtagcaggctgtaacctgccctgaccctcagctttcttacctgtcaactgggggcaacaaatacttggcttttagaatcactactgggggctgtgactctatcctcaaggcagggctgggatttgaacctgaagcctcctgctctctggggaggagtgagcacaatgcctccagctgtgagttcagtgtgttgggggttggtgcgaggtgagctgtgctggaaaaaaaagtgaaagaaaacaacaaacaaaaaacaaaaaaaatggccttttgaaacccagtggctcctcccacctcatacaagcgggcatagggtccctggggggtccggggcagcaggagtggtggcagtggtggggagagcgagggggggctcatcccaagtgggagagagaggtcatgtttaccgagagccccgcccaccaagcactttacatgtatcggcttatttcatccttacaataattttttgatgtaggaattattagaatcctcattttagtattttattttatttagagacagagtctctatcgccaaggctggagtgtggtggtatgatcctggctcactgcaacctctgcctcctgagtacaagcgattctcccacctcagcctcccaagtagctgggattacaggcacctgacaccacacctgcctaatttttgtatttttagtagagatggggtttcaccatgttgcccaggctgttctcgaacacctgacctcaagtgatcttcccacctcggcccccgcaaagtgctgggattacagttgtgagccacaacccccagccagaacccccattttacagaggagaaaactgaggcacagagaggctcagtgacttactcaaagtcacacagccagaagtggcagagctagtatgagccagggcctgacaggctaatgggactgggctgcagtcctaaatttaccccctcttgctgtgtgatcttaggcaagctgctttacctctctggggcctccctaccccctggattatgtctgcattagctactgtttagtaaatgcctgctcttctggcggggtggggctgggaagggggttggtcccatatcttttctcacttaattctcccacagccctggaggtcagtgatgctgtctcaccctgtgggagggattggccagggctcttcctcatctaccgcctcccaaggctctgtagcccataaaagcagctactctgagggccactgggggtgtatggggtggggagagagagctttataaactgcgaagggctgtcagcaagattgtgtgtgcgtgcatgtgtacatttgtgtgtgtgcccacacatgtgtatgcggaagggagtttatgtctgggtcatgtggtcagggcacaggagaggggaaatgtttggaatctcaggatgagaggggtctaaaaagccaccataagccctgatatgtgccagatgcccccagtgttggggactgagtctgcagaggtgaccaggcctgcctttaaccccctctggcccttagaaagtgtgtggaggccaaatccgtgttcctcctgctccatctctgagcactggccccattgcagccaagattctctctggcctcatagtgattgaggcttagagatggggtgtgacttggtgggggtcccccagctgtcaggagtgatgtcagtgctttcttgatagactttgagcttcctgggcaggctcgtggctgccatgttttctcactgaacccccagggaccactctgtgcttggtgcaggctcgagtgaatgattcaaaggaatgaatgaatgaatgagggaataaaggaatgaaggaagccgggactgtgagctatggagcccaggcaggggcttgtgtcctttcctgtgtaggtgggttggggacagtgaggctggcagagtcctgctgcatgcaaggcatgtgcccgtgggctgggaggcgccagggggctgcatcgggcgggccttcagtctgagtgccaaggcactgccaccaccacatctgggcaggaccgagggactgtggctctggactacagcccagctgcttggagccctttgattttgtgtctcaagggacagggtggccagagccaggagctgcccaggccccaggcccttgctcccatcatccccccaaacccctgtcccagcagggagcagggtcctggacttcctgacctgtctcactggcccctccaggcctctgtcctccataacatcacatcctgggaacatcgggctggctcttggtaaatatttgttgatggcaccccccacaccctcactccccttggctcccagcctccccagattccaggaggcctggtggccttcacttccggcccccctcccgccatggccagaggggcagccactcccctcccccactggccaagcccagtctcagcgccaaacaggaagccgtgattacagggggagcctgagcggccatggctgagggcccagcagtgggggtggcggtggccccaacaaatgatctggccctttttttacctggctgctgtgggtggagggcaggaaacgcctatgctggccttttataccaggtggagagggttctacaacccctgttgccccagctggctgaggcctgccttctccccacccctggccttggtgctatgtctgttttggggtgtcccaagcctgagggggcagcttgaagtcatcgaaggagtagggatcctggagccagctgattcagggttgaaatcctggctttgtcacattcctgctgtgtgaccttggtgagttcacctaacctctctgaacccgcagtctcctcttctttaaaatgggacctcagggttgcttgagaattagtaatataaagtaataaagtaaataaagtactaaagtaaataaggagcgggctgctcctgcaaatcttgttttttttccattcacctgccttggtttttgttctttttctgtccctctctgggtcttactgaagaactactgcttgggggtgaggagcagggttttcttttggagagagggggaactaagtttgaataatcatggatggcctgaaggagaactctgggggtgggggtacccttagaaggagaccaagggccggactcccagttggagccagcaggacttaagccagatgagaggaagcacattctagggtccgtggtgctgagtttctgggggctggttctccagagctgttgagcagcctgcagtccatcctgcatgatgactcttcaggcccttccactcctggaactccagagaggccttgttatttgcagcttgagcccaggacttggtgagactgggtgctttccattttcctcccagccagggagcatctcggctgtgttctgtctgtcacatgggccctggcccagagtaggtgactattgatgtttacgcaggatctcaggggtggagagtcctagagagatggccagccctacagcctgacatcccacagctgatggcccagccacagcctggggccttgccaatggattggggctggctctccagccttagatggtcccactgagcctcccaccactcttgaggggctggtgggattccccttatttagaggaaggctcagagatgttaggccacctgccaaagcacacacagccaggagctggtggagcctggtgttcatttgccccttctcctaccctggagccccatctgatcttgtcgtcacatcccctacttagccagggttttctgggggtgcagctgggactggggataacactgacttgggccttcatcctgcttttggatgggccatgggcttccagggtgctgtctggtgctgcttcaccctggggttagccttggcccaggcgaccctagagattcctgtaccccctgcactgccagctaggacccccccatccatcctgccctcccccatccctgcctgccagcccagactttaatgagggtaatttagaatcaatcaccagcgggatctgggaaatctaattgcagcaaactgattgccaattcgattgcgggcaccagggggctgtgggcggctcattagacctgtccccctccctgggctggggcttgggggtgctccgtgggggatgcagggcctgagtaggcaaggctcctggagagctggggggaggtggactgttgttttgggagcaggggaagggcatttttacctgacagaagccatacactattccctgtccaggcccacagttggggtataggtgcctgtgtcagtctttaccctctgtcatccaccccttgcttaatgccccctcctcaaggcctggatgccattgttggggggtgtctgcagctgcatcttacctggttcctgccttcaagatgctccctgtgtcagggagacagacacaagcacagatgatgacgaggaagatgatgagaaagataacggccaatacttactgctgcatgtcatgtgctaggtgtggttctaagtgcttaacatgctttatctcagtgggtcctcactatggccctgtgaggcaggcatggttaccccattttacagatgggggcacagaggccctgagaggttgagcaatgtgcccacagtggggcagttagcaggactctgagcctggagcctgggtgcttatggagatgctcgttcaagagcgtggggaaaagaaagggcgatcagactgttactgtgtctatgtagaaaaggaagacataagaaactccattttgatctctttcttttccccacacaagggcatcaggcagacgtgtgggctcctgcatgggcgcctgtcttgattgactgcgttgctcactcagcagacatttactaagcacctgctgtatatgaagccctgtgcaagggggctgtcagtgttcagttgtgtcgtgtgtgtcctatgtcttgtctggccatgtcttgcttcaggcaggtttactggtggcaggtgcatgtgcttttgtgaggtctcgaggggggaattgaagagaagcagggaggaagccctacccctcctccctgacaggctgagccccagctctgccattagaagtgggtggattttggctgggcgaggtagctcacgcctgtaatcccagcactttgggaggccaaggcgggtggatcatgaggtcaggagttcaagacccacctggccaagatggtgaaactccatctctactaaagacacaaaaattagccaggcggtggcaggtgcctgtaatcccagcttcttgggtggctgaggcagagaattgcttgaacccgggaggcggaggttgcagtgagccgagatcgcatcactgcactctcgcctgggtgacagagcgcgactgtctcaaaaacaacaaggcaggcttggtgactcatgcctgtaatcccaacactttgggaggccgaggcgagcagatcacaaggtcaggagttcgagaccagcctgaccaacatggtgaaaccccatctctactaaaaatacaaaaattagctgggcatggtggtgcacacctgtaatcccagctactccagaggctgaggcaggagaattgcttgatcctgggaggtggaggttgcagtgaactgagattgtgccactgcactccagcctgggcaacagagcgagactccatctcaaacaacaacaacgaaacgaagaagtgggtggatttggctaagtgactcttgactcagccttagtctcctcttctgtcagacagatccagtgatccctgacccgttaggtggtggtgaggagtggtgggaggtgcagatggttaaaaggaacctgctgctgggtgatgacttttaattattatacattccccaaggtggttgtgtctcagaggtgaatttgccactagcttgtcaagtggtagcaggcagcctgttccctctctgggcctccacttccacgtctgttaaatgggaagagtgaatggtgacccaggggcccttgtagtcttcagatttgaggaactatcagaaagacctgaggccagagacagggcctgacctagagttggcttagtggggaagggcaggcaggacggctggcctgggtggggaggggaggcctgctcccttcacgtggcttgtctctggttcctcttgggccagggtaggaggcatctctttccttgcccatcacgctgggcaccaccaccctccctgaaccctggaacatgatcatcagttccaagctagctgggggctgggcagggagtccagtacctggatccttatccccactgtgctactgtttactgatggaccctctgtgtctggtctcagccgagcactagggacccccagggggctcagcttggtccctgacattaggaagctctcaattctgtggggtaatgagaggttgatttagaccctgaagactaggaagacttcatggaggaggcgtcctttgtaccaggccttgacagatggcagcacattgatagggggactaggatggacaaagtctgagaagtggggaaggtcgcagtatatcagggagctaccacatgtggagaggggaacacgcctcccttggcggcgaggggtcactgctgtaggggccgccctttctgatgagagtgtgtttcatgcctttaacacacagtcaccaggtacctggtgggtgtctggccctgtgcctcagttcttgttctgaacagttgaaccccacaggtcctccacatggaagagctcactggctcacaaggtgggctttgagtccaaaccaaggcatttgggtactgtcctgcaggtagagggtgctgcccttttgtcgtgaggagatagcatgagatgccggagcttggaggtgacatattgagttctgcccattgagtgcctgccactcgcaaaacactcggccaaatgtttcatctataaacaatccttagccttatgagggagatgccattgtaatcttcattttacaaaagaggaaatcaaggtacagagaggttaaataatttgtgcaaggtcacagagctagtgagtggcccagctgggatttgaatccaagcagcctgcccctggagtcccatctagtacataagcactgcttcatgctgccgtgtacatttctaactgtaaagcatggtatccctacaggatgaatgtagggccaatcaggccttgctgggtacctgaacttgtgtggctgttgtcgggcaggccctttcttgggactttgggctcctggcttccacatggatctgttctctgcagcatattttctgtctgtatggggctatgggcagaggctaacccaggctggggaaagatcagatggctggagaggatttcagctggaagggcccttgaaaatactcttgtccaaattgttcactgttccaaaggggacactgaggccaaagcattgatctcgagtcatcatgagtatcttctgagagtctataattcaactttcttacatgacatttggggaagttgaggatcagagaagtgcaatgatttgtccaaagtacacaacaagttgatggctgagctgggactaagagctctgtctcctgactcctgggcagggcactatcccctgtactatgttccttttctgtacttgtctctgctctgtccagaatgcaggctcagctcctcccacacccttcttccaggaagccttccttgaccaccccagctgcccatatatgcccaatatttcctatgccaaattaattcccgtcagtgccttcaatgcacttctccagcctcatccctttgccttcccacgctcctgtttttttgtttttggcatggacttttactctgttgcccagattggagtgcagtggtgtgatcttggttcactgcaacctccgcttcccgggttcaagcaattctcctggctcagcctcctgagtagctggaactacaggcccatgccaccatgcctggctaatattttggatttttggtataaacggggttttactatgttggccaggctggtttcgaactactggcctcaaatgatccacctacctcagcctcccaaaatgctgagcccaaaatgctcccaaatgtaagcccagtctgtacatcccacgcttctaccagccctcctgagcacagagcataccattgtctctttttccttcatgcctacccagatgctgttccctcttcatggactgttcctttattcttcagtgaactcctacacatcctctaaaacccagcacagatgtctcctcctctgggaatccaataatgacccctcctaccagcccccaagcacagtaagccactcctcagccccctcactcctgcctccctcttctaggttcctaggtgcctcttctacctgttaggattctttgccaagcccaattatgttatttcacttcgtagtgtctggttcccctcagggttacattgttaccaccttggagctctcacttggatacattgttgcagctgctaattccccattacatcatctcccctccaaccctcacacatggtactttgttacatttccccaaattctgacattgctactttgtttcttttccctgctttcacacgtcctcaatctgtttcactcctagttctcccctgttgtcacatttggtcctttctccccagcccccagctcatgtgacccccaagactgggagaagaggaaagtggagcctggcagcagggagcagtgggcacccagtgagctatggaggtgcaggcggggagaggtgcactggagcctgtttggctccgtctttctggagggtggacagactgtgggctcggaggctcaggctcggttttgaggagaccttctcctctccaacctccctcctctccatctcctcctccgtctctgctcagcccccctccctccctccctcctcccaccctcctcctcttactcgcttcctccccctgctctgcttccctagaggcccttatcttgctccctggctggttggaacctcccatgtccctggctgtgacccaccagggccagaacctgagggctccccttggggacaggggtcttgagggctgagggggtagttaggaccaaggctagagggattcttgattcttctttagttccttgccctcccggccccagaactcacagttccctgcatccgtccctcctgaaatggagttttggggcaaagagccaggaatcagccctggccttgctgttcagatgaggagactgaacccagagatgaagtgtggctgttgagggtcactcagcagtgagaagtggaacagcttccccggggctgaagcccctacatggcctctgggagctgagccctggctggctggatcctattctcatgtgagctgcggagctggggggcttgtggggacaatctcagatccagagggagctcagctgtgtcttgagggatggtctgcaaggctgcaagtgaggccaggtaatcctttttccacgtggagctaaggccatgtttctgtttaggacgttagtttgggttaggggtttgcgtgtacctgcaacatgtgtgatggcatgttgttgtgtgtctgtgctgatgcatggggccctggtgtctttgtaggaaaaagtgtttgtagcctatgccagggggatcaggagtcccccaactgctgtccctccccctgcctcagctccaggggcttacccgcaacactgtggattaaggaagttgggagatgctctctaccttgggaggctcagatgcatgcttacaaatggaggaacatggacctgtgcaaatacccttgtcctgtgcacacgtgtagagacagagacagggacacacatacactgccatgtgcacaggtaccactcagagacacagccctccacgctaacatggacacactcagacccacacaggcatctaagccactcgagacagccctaggcatacacacatggatgcacctagacagacacacacgcccagaaatacccctgaatgtgcttggatgtgtgcatgtgcatgcctgtgtacgcccacacattcacacatacacacacacactccccacacacacccacacactctcacccacacactcacagtcatccacacacactcacccacacacaccccacacacacccacacactctcacccacactcacactcatccacacacacccacacacacgtagcccacacatacacccacacactctcacccacacacactcatccacgcacactctcacccactcacactctcacccactcatactcaccccccacattcatccacacccccccacacactcatccacccccccacactcatccacacactcaatgcacacactcacccccacacacacattctcactcccccacacactcacactctcacccacacacacactcacacacactcatccacacaccccacacacactcatccacacactcatgcacacacacccccacacactctctcactcccccacacacactcacccacacacacacatactcatccacacacacgctgtcgtccccacacactcacacacacactctcatgcacacacacgcactcttacccccacacccactcacacacacgcacactcacaatcacacactctctctcacacacacacactgctggggctctgagctacgaaaatatgtctgtccttaatcctgactcttaatcccagggtctaggagcccaggccagaggggcagctggtcatctggcctcgttagaggtgattaaggcaggagcagtgtgtgtggtgtgtgtgtggagggcctcagagctttgttttctgcctgacctccagggacacttctcactcccccgcaccctgcactaaaaaaccaaccttggattccttcggagatgcagttatatgttatttaccacactctggatgccggcaggctagggggtagcaggagagggagtgtggctgtgcccctgaggaaattgacagctggggtcagagaggccaggagacgcgggtccctttatttcaccacctgcctggggaaaccctgatcagagtcttcggcactagggcctcgtggggattctgatttctgggggggattctgtttctttgatcagagcatttctgacttatgggaaaatgatgcccaaccaagagatgttgaagttggggccctgagcagggaggaggggtggttgcctgagactagggtgggatggggacgcctccatgaggaggggacgcgtgagctgggcattaagggtgctggctcctggggcattttgaaatttttggttgtcatagtagtggaagtgcagctggcattggccaggtgggggtcgggctgctaaatggctacagtgtccagaacagtcccgctggtggaaaatcgtcctgcccaggtaccaatagtgttgcttttgacaaatgtttggtcatgagacatggtggggggggggggggctcctggtgggtggggtgggtatggaccatggcacagtggtgagactgtctttgtcatgctgtgggagggaggaacattccacactgcctggggcaccgtggaggtgcacagagattgcatgggccgattcccctgaccctgcaccttccccaccctcagcacttccctcccttttgcctttccatgtttacagggatgtgtgtcccgtgttgtgtctaaggggatggccgtgataaatggtggaaagagggcgtttgggcatcagcccaacttggctgttgggctggcctttccctggtggagctccctataggggagggggccacgctgctgtgactcggtccctaatggcagcagctggcctctgatcctgccgggggaggctcaggggaggatgaatcagctgagacttgacatggacttggacttggactttgacctctgcatgtcagctgggtgaacttgggcaggtcactatacttgtgtcgtcctctgagcctgtgttgtcctctatgaagctggagggtgaccatggtgctacagggtgttgcaagagctagggcttacttggcgcagagtccagcacactgctctgctcacaggctgctactagtcatggtaaatgttgggggagtggccatgagagcccaccatcaccacagaggtggcagtcactacccatcctcgtcctgggtttggggaacaagactgtgttctagcaacagccacttgcctgaagtccaactttgagtccatcttttctagcccagttcctctcccacaagcactgtctactgcagagctttggtttctgtttggtagactgttttaggatcattcattcattcattcattcattccctgggggcctgggggcctggggctaaggctggtgggcaaccttgccctggtggagcttcctacaggggagggggccaagctggtgtgactaggtccctactggcagaagctgggcttctgatcctgcctggggatgctcagggagctattcctggtggagtgggtgggtcagctgagacctgaagcagtttgattcagggaagccacgttcaggtgacacatgaggagtggaggccaggccttatccctgggctgcagggataggggccagggcactcagggtccttgagccctggcaggtgtttggactctgagctcagtgggggagaggaagagcctgtagctgtgtggagaaggggctggcaggatacctggggaacgcaggacctgcaggaggctggaggaggatgttgggttgggggggtgagcactgggttttctttggctccctgcaccccattgctgaggggcagggggtccttgtagagttcttggcctccccactcaggatcctctgtggtccctgcctggcagtctaaggcactgtgaggcctcctcccttcttcttcttcctcttttttttttttttttgacggcgtctcactgtgtcgcccaggctggagtgcagtggcgtgatcttggctcactgcaatctccacctcccgggttcaagccatcctcctgcctcagccttctgagtagctgggattacaggtgtgcgccaccatgcccagctaatttttgtatttttagtagagacggggtctcgaactcctgatctcgtgatccacccgcctcagcctcccaaaattctgggattacaggtgtgagccactgctcctggcctcctcctcccttcttaatggctgagagatcagagtctgggaggcaaagccaaggtgttgaggctcaagacagggcctaaggggttttaggcttcatacctgagttcagccaggcaggagagacggggctaccgagcaccttccagacaaaggcctggtagctccagcccaggcctagcccaggacagacaggcctctgccagagagtagagtggaaaccacccgaggggcttggcggctgccagctgtgctgggcggagctggtgcttgggagccaggtgaagatggggccagggtgaagggtggggcctgaagaggcacctgtcctcagggttgccctagacagccatggggacagagggcagatggacttgagttaaaattcaggcgtgttttaccactgggaccctgataggctctgccccttccctggcagggacatatcctcatgccttttcctgagggcagccaggggtgaggcacatggtcaaagggtggggtggggcatccggaaccactgagggctgcagctggaatgctggggtcgagggttggggacggcagatagcctgggtctggagtccctggagtctctgaagactctgggctgagcctgtccccctccactggccccacctgacaaagtggcctttgaacagcctagaagaggcagttgctgagctgggcctcccacttgtggtctgcggactaaacgtttgcctgtctgggggcgggggctgtggaggcttcacctgaggcttggtaagaagatgttcaaatgggagaggaggtgagcagggccaagacaagcgtgttgtcaggataaggaatgctgggcttctctgaacttgagtccaggctctgctgtgtgaccctgggcaagtttcttgtcctctctgagcctcagtctcatattcattgttatttttgaaacaacagctttattgatatataactcatatacatcttgcccatctaaagtatttaattcagtggtttttagtatatttacatagttgtaaagccatcactaaatttagaacgtttttatcaccccagaaagaaacgctgtacccattaacagttgctccttgtttctccacaatccctgcaggcataggctgtcactaatctattttctgtctgtatggatttgcctatcccagacatttcatataaatggaataatataatatgtggtcttttgtggccaatttctttcacttaacataatggtttcaaggttcatccacactgtagtatcagtattagttcatttgtttatttttgagactgagttttgctcttgttgcccaggctggggtgcaatggcatgatctcggctccctgcaacctctgcctcccaggttcaagcaattctgcctcagcctcccaaatagctgggactacaggcacgtgccaccacaccttgctaattttgtatttttagtagagatggggttttaccatgttgcccaggctggtctcgaactcctgacctcaggtgaccctcccacctcggcctcccaaagtgttgggattacaggtgtgagccaccatgcccagcctcagtattagtttttttttcttttgccaaataatattccattgtatgaacataccacattttatttattcattcatcagctgatggatatttgggtggtttcaatcttttggctattatgaataatgctaccttttttggtgtgtggacatatatattttcatttttcttgaatatataccctaggagtagaattactgagtcatatggaaactccatttaacattttgagagactgccagcctctttcctaaagcggctgtgctgttttacattcccaccagtggtgtgtgagggttccgatttccccacgtcctcgccaacgcttgtgattatctgactttttgatcacattcattcttgcatccattcatccctcaagtatttatagaacatctatattcaacaaggcagaaggcccactgcagagctgggaagggaatttatcccttgaagagttgtttagaagattccatggcataatatctagaacaacccccaccaagctcagcacatagtagatgctcagagacgggagacagggagcatcaaggagaggatctgggggtggtcagcaaccatggggcccccgggaatggaggaaaagaggatggaatttgtacgtgctgaccacgtactgtgtgtgggaaccagtgcttcagtccttatgaccctctgggccatatcattgttccatttgcagatggtggaactgaggctcaagccaagcagcttgttctgggtcactaggctgagaagtagtcagactgtgggctgagagccttgtttggatcatcttatttaatcctcccaacccctgaggtcagtcctattactatacccatttagtaggtgaagaaactgaggctcagagaggtagactgacttgcccagagtcgcgtagctggtgaagttctgtcctgggatttggagccacatagtcgagcatcagagtccctgctgtgtctcccaggcctctggaggggagggtgagggcttggacatgtctgctccctccttccctccctttctcaccccactgtgtcccacagagcctcatcttgggttggagacagtcctggggcaagtgtggccctaggctggcttttgagggccctgccaacccttcttccagcctttttgtctgatgccttgctctgtgcctcagtttcccatctgggtgatggtggtggtgacttccaaggctgctgtggctcagatcatctgagtctggcttgttctgtccctagaagaggagcagccgagaagccagtgggactgctccaggctgggggcggggagtggcatctccactgtgtgtgagtttgggctggttataaataacccagcaaacaggagggtgcggggaaccacagcccgcctcctcaggaggagaggcctggacacacacacacattcttacagacagggccgtttcagttatgtgtgtgtgtgtgctgtgtgtgcccagggtgtatgctcagcatgtgtgtggggagggctttggggagccgtcagagctgtgcaggctcccgggacagctggaaggtctgggcctgctcaggctgactccagcaggttctcttcagttccctggaggaggctggggtcagcccagcagagctctagggctggcgaggtccctggagccccctcacctggcttcaagtgattccaaggtcaggctgaggatccttctgctcttaggggcctccatgtgctcctccagccccttcccactgccacgtcccaccctgcctgctctccctgtccctgctccagtcctgaatcccatcctgactctccggctgagctcactgacctctagcaagtcgcctgggctttctgcctctgtggagtaaggaggcccatttcactggctcctgagaaggtagagtccagtgcttagtgtgtgctcagtgaaggctgctttcttccagtcctggttgagaaatggccagaatgtatgctccactgggagcccactgatctgcatatttgcatataatttacataaacattttgtgacaaaatatgctgggatcagtgtctgtttctcttccctcctcccagctcacttggagtcctcctggctggattttggagggatcagagagaactcttgttcattcctcggttttacacacagggagactgaggccagagaagagcagggcctgccttgggatcccatagcgattgggagcaggaggcaggtgatgcagatctctgggggatgatgcaacccacagtattcactgaacaaagactgatggaggctgactgtgttccagaagcagtctgagccctggggttagagaaatgaccacacagacccagtcactgccaccaggagcaattggagggggagacagacacattcctctgaagcccggaaataaaccagccaattttcaggcagtggtaagcgattgaggactagccctggttttgcagactagctgggcacgtggggacgtcgtttgggtggatttggtggttcagggaggtgagctttgagtggggacacagtgtcatgtcccagtgcctactaactgcctatcaccactaggcacgtgacagctggtatctctgtgtgttggggatcattattcccgtttcataggaggacagagcgaggcccagtgaggcgaagggatgtgaccaggtaaccagtttgggagtgggaagccagggcgggaacacctaactccacaccaggttgttcctcggagactcctgggccccaggagcgggcaacccttgccgtgtttgctggcagtgaccgtcatggagcctggagacagactcctagaggcacctgctggtgagtcatggtgggggcagggggtgcctacctgagctgggccacctgtcgtgtgagtgcgccttgtcctccatttctactcactcccaggctttcaggctgtctctgtgcagggagctgagtgtgaggtggtgctggtctctgacatttgccctgcttttgagagccttctggtaggggaaactgattagggctaggagcaggtgtgctctgcaatccaaagggcatggtctttggggttcagctaatcttgggttcaaatcctggcccattgctgtgtgactttgagccagttgcttcacctctctgaattttagtttgcccatctgtgaaatgggaatggcaatccctttctggtcaagtgagaagagaaatgaggcaatgtgcatataaggaacctggcacttagtgagggctccctccgtcggggctgtgatcattttcataagggatggaatggcccagccttttccagaaaagtgctcagtggaaggagtcttgaatcacaaactggcattccctgcaggcattctcaggggttcaggagttcactgaacacaggatttagactcaacaaggccagaattcaactcctgtgtgaccccactggtggcttaacaggctcagtctcctcatctataaatggagaccatattatctgcttcccagggcagctgagtggtttcactgagatccagtggaagggcctgttagagtgatgggagcatggttggtgggccttctcccttagtaaatgacaacacagtggaggtactgagtccccaagaaaggacttcctaatttggaccagggaggtggttggcgtgcgtatgtgacattcaagcaggctgacaaaggaggcattgtgtgagctgagccagctttgtggggacatatctagtgcctaggatggtgcttggcacacagtaggagcttaataaccattggttttactgattaaccagctgagtaggtgctggccaggcagagatggtggggaaaggtattccaggaagcaggaacaggcctgaaggagcccgtgttcccagaactgtaaatagttttgtgtgggaggagtatgggggtgggcagctgggagtggggtgtggggggtgctgctgggtctggaaacggggcctcagtgggtggtcctgctctcaggcacgagcttggggacaggcatcaatgagcagtgtgagtcagggtggccaagagtgacgtgagagggcaggtggctgggattgatggggcggtgacggaggcgtcccagccctgggttgaggagggggcctggctttcccagggttgcattgtcagcttctgtctaggcacaggggacagagtgggctgctgtagggcagccagtctgcacctcaacagagactggccagcccggctgagccaggaacagggctgatgggagaaggcgggcgggtgggtgtctgggcaccacaggccaaggtggccgccagacaggctgatgccaggggagggagccaggtcctgccaagccagcctgtctgtggtgagactcggttgggccgtgggccctgccagctccctcagaggcttttgtgttcatttcctttccaccccccttttcagtttcctcgtaaggtccctcacgaacagtctcaatggggtctcagcagaaccaggggacccggaagtttcacagaccagagaacaccagggatggagactcagggaggatgtgcgctctctaataacaaaagtgctatgggtttatcggagaaattgtggaaaatacagaaaggtcctgagaagaaattaaagctgcctgtaatcccaccacccagagagagcctctgggaacctttagttataatgcagcatttggaaattcactttgatagtgagttcattaaaacaggatcaagttctacatattttttgtaacctattttttaaacataatgatgatactcatattaatagccagcatttactgagcaatttgttaatgggtgaacatgcccagcctccttctgtaaaccccacgaggtgggcattcttatctttgttttaccagttaaagcagcctgagagagttaaatatctgcccaaagtcacatcggaattgagagagccatctgcatattcctatcaacagctatactgtcttgtcttctgatgatcaatatgtgcattttcctacatccttcaatattccttgtagcaagtaaaaaaaagccttctatgacacatttatgtcttttaataacctcattagacagtgtagatttgtgagaactcaattgttgatagctgcgtaatattccatgttatggttgtaccctcatttatttaactcgtcccctgtcgttcagtatgtgggttatttccattttttccctctcgtaaattacattgtcctggatctccttgacctaaggatcaaattcttgggagtccagagtgtcagaatcagaaaggcccttagaccaccatgcttggttttccattttgcaaatggggcaaaggaaaggcagagaagggggaagaggatttgtccacggtcttggaggctgtgggcgcctgagccagggctgctacctgctctcctgttggggctggggtggggatgtgggtggaggcaggtgccacagtgggaaaaagggcatcctggggggatggtgggaacacagggctgggtagagggcagactggaggtgacaggagagatacaggcttggggtagggagggctctgctgccatgatatctttgcagaggagttgactgggatgggacaggcccaaagggaacatttcctgccctctgagctgcctttgtagatgggagtagggggtggggataggtttggtttgtgagaggcttgagtgtgtgagttggggcgagtgggagggtgtgtgtctgggcttggtggatttttcttggggggggtctgtggtgtttcagcttggccttctctgccctccccattccactcctccccgggcttctgctctctgggacttgggctccatagccccttccccagcaggtgcagtcctcgtgcccctcatctccagccacaagtgggtgtgggactgccggcttcctggccagggcagctgtggctgggtgggggtggggactgagacatccccctcctggtcccggctcccaattgtgcagcccccttggctgtcttgctgcccggagcttggccccagcccacattcctgcggtgatgctctgggtctccggggtggatctggtgagcgtgaggggcactgagttctcacaggactgagggctttttggggacggagcctgcagggatccagagggccatgctgagacaccctccctccctgcctcgaggagctagtagttacgtcgctgtgtgtctttgggcaaatcactttacctctctgaatgcttcgtggcagactaaccccgccccctcctttcgtgataagcaaggctttcccctctctgtgcctcagtttccacatcggtaaaaggggagagttgaactcagtgatccctcaggcccagtgtagccttgaagttgcagcctgaggtgggaagtgcaggctgtaggaatatagacaaagccttatacggctccgactgtgtgcaggcatgatctcacttgattctcacaactgccctatgaagtatcattgttggcctcatttaaccaaacaggctcagagaggttaagtaacacatccaaagtcacccagcaagtaagcagagctgaatttgaatccaagactgtcagaacctaaagctgggcccccaccccttgctcatgtcgcctctggtcaccaggaaagtgaggcctgagtctggctaattaggggaaggaagctcgggcagaactaattacactcgattttattcttggctttttgcaacatgattagcgctgcacaggggtgccgggctcctggcccccagcctgctgacctaatttgtgtgcttgtgtctgtttctgtaacttgccctttctcccccttcatccaacctctctctttttgtctctctctgcactctcccctgctgtgtggccttggcaatgccacttaacctctccgggcattaatcgtctcatctgcctgggtgtagtcatcccaatttggcttccctcatgaggaggttgaggcttacatgagataaaggcttcgaaataataatagaaattttaacataaactaacagcaatcgtggctacactgatttattcatttttcacttggtgtcgggtcctgtgcttagccccttcccacagcaatgctatgagctgcgtagtcttctcatcatctccattttacagatgagaaaactgaggtgctgagattaaatggcttgcctgacagccaaccgggtagtaaagaggagctggttcattatgctttgcctctgtgctgaccggtttctctaggaaggctcatggtggtgtggggctgggcacgagagaccccaaattctggagtgggctctgagagaggatggggtgggagggatgcactggccttcctgaacgtgtcccctgcactcagagtgagtgatgagtgggtgggtagaggtagccgtgaaagtgaggagacttagctgacatccagctcatttggaccctcacccatcacagccctgatggggtgctcctgggagggagggggctgggcaacctgggaggtggcacctccttgcccctggcccaggggagcctccccagctgctgctctaaaactctaggagaggatcggtgggagtggatgtggagtgagggggcctgtgggtcactgctgggcctggtcccttctgggctgggagcctgaggtgcctctgtggagtgaggctgtgggttacttcaggaaggtgtggtgactaggggactgtgaggaaaaatggaagcagggggcatcagtccactaggaagggtgccacatttcatcccgatgtgtgtgtgcacttgtgtgtacccggaaggaaagtgcgtgtttgcgcgcatgtgtgtgtggagggaactgagatgcaggtattgtggacctgttaatggcatgtgaggcgggatgtatgtctgctggggcaggttcagggagggacaagtaggctgcgcacatgtggaggcagggtgttgggagtgcctggtgtgttgggtcccgtgctcagccccttctcctgcaatgctatgagctgcatagtcttatcaccatcgtgtgctggcgcgtgggtgtggatgttgggtgggcatggacagctgtgggcattgccgagttgatgtcatgcagggggtgagggcagctgcggggcacagatgtatgaatttagccctggacaagcaatgggtctgggggtggctcaggaatgtccaggacaagggtttcagagacagaggcctcatgcctggattctaacccctgcctcagttcctgcatctgtggaatggggatgataaaaccctgggcagttgtgatgcttaaaggaggctgcataaataacatgctcccagcacctggcctggggcaggccctcagcagcagcaggcagaggtctctagagtgccctgggaacgctcagcggctcccctgggacctgatgctcaggccttcatgggccgcttgcggagcctctgctgggtgtcccctcccgagatcagtggtggccggaagcagaaggttcagtgcttccaccgggcacgctcgctgtgtgtggggggtgcagccgagaggaaaggttgtatccgagttgtgaggttcatgtctgagtcagaggatgcacctgccgagggtgatgtctaggagcgatgtgtgtttagggaacatacgtggccatggcggtgggtccgtgttgtgggccttggtgaggtgagtgtggtgcgtggggtcaggagaatgtgctgaggtttctcgggggcatccgtggggtgtgtggtgaggagaggagtgtgtgtgtgtgtctgtgagtaccctagggcatgtgtacaggcagctaggggtgaagtagatgggtgagtgtgtgctggtgtgggctgggctgtattgcctataggctgtggtgagtatacagattggtgtgggcaaacattgcacttaatagtgtgtgtgtgtatccattggggtgcatagtacatgcagaagaatatatatgcatgaggatgttgggctgtcgtgtgtgtgtgtgtgtgtgtgtgtgtgcatgcgtgcgcgcgtgtcttgggggtatggaagcctcctatcaggcatgggggggttgtgtttacctggagggggcacagtgagggtcaaggagaagctggcagcgtcctggggcttttggattcagttctcctttaagggaatggcatggataattatgcttattatgatggattatgcaaatgcggaggtcgtttgggggtcaaagcctgcttgtcaccctcctcctcaggcattctgtgacttctaaggctttccctgctgcctcccaggctccgttccccaacccctatttctctgtcccctctgggagttgcagctaccagcaccccctctgtagtgttcctgagagggcctcatgagtcccagcgcccatgcctgcaggtcccaggtgtcctcgcattaagttcccgctgagcatcccaggtgggctcaggggtgactgggccgttcctccccctgcacaccctgccattggggatgcttgctgttcggaaagaatgtactcttggaagcaggtttggaaaattactgaggtggccccttccccagccttgcctcatcagcatgaggctaaattaggatgtgtgagttctcccctctgcctcccacccttgccttctctccttctctcgtacccccagcccaccctccccgtctctgcccctctgccccctggcctccctcagtcctcgactctctgtcaccgtctctgtctctgcctcccccttccctgtcatcctctcagttcccccgtgatctctccctctcctgtaccaccccatctctgtggggagctgcagctcctggtcgttagcatggagaagatggtcgtcatggtaacggttgtcatgtcgatggctactgagctggggatgaatagtatgtaggtgagcgctacctgagtggaggctgatgggtttccaggaggctcgatgcttgtctctgagctcagagctgcacagcaggcccagctcctcctgccccatgtgagtggctgtttttacccccaggcatgctgacacgctgagccctctgtggctgcttttaggtgagcatgtttcagtgtgtgtctgtgcatgtgctgtgtctctggggtgtgtcatttcaagggtctatgtggcatgggggtaggtctttgggtttgtacaggcttttcttggagcaggaagttaggggctaagtggcactggtcactgaggaatcttggggactcccttgttttggcacccacatttacttcagttgggggcttccagggaccacagacctcttagtatccctcctcccagctaaaggcctcccagccactgcccagcctactgggaaggatagaaagacagtgaagacagccctgggcaggggcaggagccggagcctgggtccctgctcagtccccattcttctgtgtgacttcaggctgcttgccagagagctggagggagcagggactccaggttggctggttcaggttgtggaggggagtgccatggggagttctagctcctccaccgtgggtatttttctttctgggcagaggggagctggggaaaagttgggccctactgctctgagctcctagaatgtttaaaaaaggaggaagacccagcaattcgtcacgggagaaattacactaattgttccactccatgactcactggtagaaagtaaatactgattaattcattactttgagactatgtgtgtgtgtgcattttgtgagggggcacctcctggctccctgccctggctgggctgggcagggctctggagcaggtggttgaggctggggatatgaagacaggattgagatcctcactctggctctgtatcaactccagaagggggcccatcagtggcagggggtgagaggctgggccccaaatgcagggccattccagccctcgcctgctcacacatgccccagggctccccacagccagcccaacattgcggctgctcagagaccaccccagacctactgaaccactgaatttagttttcacaatattcagatgtgcagtcaagatgaaaaatgaccagtttctaagagaaagtcatcagccagacactgaaagccttctgggatgggaccccaggtgacttgccacaccccacccctgccctgtgaattattcacacacgcactttccttcagggtacacacaagatctctgtcacccacgtggatgtcactcagcccacaagggcacctgtcgcccttctgggctcacccaggctgccagtctcgggtgccgagccctgtgtccacctctaccttccctaggcccagcgctggcgcagtgagaacttcgagagacccgtggacctggagggctctggggatgatgactcctttcccgatgatgaactggatgacctctactcggggtcgggctcgggctgtaagtacccccctccctacctctgcctgggggcagtgaccagtctgtatccagcctcaactctgagaagcccacggggggcttgcttcagtgaggcagggggcattcactgcctgggtcaggcaagttcttcttgctctggatccccagaacaagaagggcagaacatccttctggggatagaacaagacctgggaggacctcagggcccagaatgtccaggtctccagggtcccacgtctgcatctttgtgtgtgctatgtggctttctctgcagaccttgcttggttccggtggtcccgtcaggtgcaataagctgtggccaatggtggggttagggcagtgatgacacagggcaggtgcttcaagtggtgcctgggatggccccgccctggggaaggggagccaggtcagctgggtctagcagaatctcgggagagaagggcaccgcgaaccccactctgccatgtagcaactgtgtgcccctcggtgctccccctccctgaatccctgtattttcacctgtggatggtgagaaatacgacttcttctcagtgcctctaggagggtttgggataggaagctggggtctggcacagaggaggagctctcaaaatggtagcaaaaagaaggcagctgagactgggcccagtgagggcacgggctggcatctgaggagatggtacggggtctgcacgccacagagctggctccccacagccctcgcctctggtctcccctccttagccaagtcctttgagcctctttcaaattaatctttgtaaaacccgtttatattgggtcacatctctattcgcaaagttccctggctcccctccctcctgcctggttccgagcccaggagctggctgtggcttctccctcccccatcccctactccccatctcatttcctcccaagttccttcactgtcccggctttgcgtcagccagattgctcaagcagttcccctgcctcaagggcttcttttcccttttaccctccgcctctgcctctgggggaagcccttagtgtaccacccctgccttgagcttgtggtaggggtgcctttggggtctgactcttcccagaatgccactcctgtgttcccctgcaagccccagcaagttttgcagccagtagcgcctcagttgctgctgcctggattcaacctcatagaaactgtaggctgggtgggcaggaatagtcaaggaaggcttcccgggagaggcggcccccagaatttttgacttggcagagagaagttggggaacatcagcaactgaccacctttagctgggctgtgccttcctcctttctctcatcttttctgggaaaattgggtaaagagagggggttgggagacctaatcttgatggccattgcttacctgggatcctcatgcccctcacaaccacccagctccctagctctctccctctcccccaccccctcagacttcgagcaggagtcgggcattgagacagccatgcgcttcagcccagatgtagccctggcggtgtccaccacacctgcggtgctgcccaccacgaacatccagcctgtgggcacaccatttgaagagctcccctctgagcgccccaccctggagccagccaccagccccctggtggtgacagaagtcccggaagagcccagccagagagccaccaccgtctccactaccatggctaccactgctgccacaagcacaggggacccgactgtggccacagtgcctgccacagtggccaccgccacccccagcacccctgcagcacccccttttacggccaccactgctgttataaggaccactggcgtacggaggcttctgcctctcccactgaccacagtggctacggcacgggccactacccccgaggcgccctccccgcccaccacggcggctgtcttggacaccgaggccccaacacccaggctggtcagcacagctacctcccggccaagagcccttcccaggccggccaccacccaggagcctgacatccctgagaggagcaccctgcccctggggaccactgcccctggacccacagaggtggctcaggtgagggtgttgagaagggacagggaggagggcggaggagggtgggtcaggggagggatgaggaggatggggctggacaggactgaggaccaggaggctatagagatgagccagacaaagtgggggcgaggggcaggaccaagggacagagatcggatagggagggaagagggacagaaaacgagggctggggtggttggatcctaatgggatgggacattggtggggaaggaattgggtgaacgtgtgcattggtgacaaggggggccgggctgagtgtttcggttgagagaattaattcagtggtctggcagctggattagaatctttccactgccacttcctagtcacgggacctcaggccagtccctgatcatttctatacctccgcttcctcatctacggaaaggagaaaacaatagaatgtgtatcatttcattgtgagcgtgaagtctcctgacatccacagtgcttagaacagcgcctggtgatggtacagccagtgggttctcagctgctgtcgtcatcacggttgttattatcatgggtctgagggtggttaagagctggtgtatgagaaggcatcactcgccttgtggagggctgcctgggtgtgggtcagtgctcagcactttacctgtgttagccccagccctcatgcccaccccacgggcagcactgtggtcatctcattttacagacgagcaactgtgggtgcacagggaggtgaagccacttcccaaggctccgcagccagcgatgacagtcaggatttgaacccaggcagttggtgccagagccgggcagtctcgcagggccagggctgcatgtgtgtgcatttgggatattctggatggggcaggggaattgatgggaagaggatgaagatgtcaggagtgccagggatggatgaatcccaaggacatgagagaggtggtctggtcccagctgggtgcactaagtaagatggagaggtgggaacatggactgggtgccagagccctctgcagctggcctcactgtggaaggcccttgggccgtggcgctgccttggggtcagtgtcagtccctctgactccccagccagctctagcaggatgcaggcccttcccttgcctcctcaagcagctggggcagcctggtgttttcacacagacttggccaagcaggaaggggaaacagtgatggggcacggagcccaggagaaggtgcacagggcccaggttgctggaggagccattgtgcacgctgtgtacgctggggcactgctgcagcctcttttcagcctggacatcaggcctgcctttccatgcccacctttgaagtagcgacatccctgctctgatggctcccacagcccccactttggtctcatcattcccagctctgatcctgcctccgagtggtgggagccctagagattgtcagtcactgagctggtttccgggacacctgcccctgaggccatcatagtctgcaggttgtgctcttggactggcctccaggctacagaatgctcccctgccttaggcatggactgggaccaggcccacatccatagcatctgcacccagcagttcccaaacagcttctcggcaggaatcccccaaggattgttactaaggcagctggaggggacatgagggggacaggatgtccagagcaagaacagaggcagtgtgttagtggttagaaacacagactgtggagacagatagatctgaattttagttctgtcccccacttactagctgtgtgtccttgggcaggtcatttatgctctgagctgacttcctgctctgtaaactgggggcattgttacactccttcatggggatagtgtgtagcacagtgcctggcatgtagggagtgctaagtgttagccccccagggcagtaggatggtggtggggggttatgcatgcatgtgtggttgtcctgggctcatgccaccctctctgcagaccccaactccagagaccttcctgaccacaatccgggatgagccagaggttccggtgagtggggggcccagtggagacttcgagctgccagaagaagagaccacacaaccagacacagccaatgaggtggtagctgtgggaggggctgcggccaaggcatcatctccacctgggacactgcccaagggtgcccgcccgggccctggcctcctggacaatgccatcgactcgggcagctcagctgctcagctgcctcagaagagtatcctggagcggaaggaggtgctcgtaggtgaggcttggggtctgggccaaggggagcctgggaggataccagagtgagacagctggctgggcctcagtttgcctctaggaacccagaaaggagatcagggcgtggtttcctaggagccagataggaaggaaacttgagaactcaaccccccaggacctgccttctggctcctcccaactttcctccttcccaatatccaaccctgacttcatgtccatctctaggtcttccctcagtgtcctctgacccctctgtggactctgactttgatccctgctttcctgggccacactggctgaccccctgggaccttacttcctagatgctaatctctgacccatccttcagcttgaccttccccagtttttgaccccagtccctgtggacctgccctggccgcatctagggagtctgtggactcctggttcaaatcctggctttgcactcaaggcaaggtacttcacctctccagtcttccttctcttcatcggtagaatggggatagtcattttgcccttaatcaattctaagaggcacatctgttcacatgttaagtcttctgtagttggggtatgtcatatttagttagcagagctttttctttcctagcagttataaaatactggggcatcttatgagtggtggcattttaaatttgatgaagccctcagatgacccctccctcatagggctggtgtgagggttcagtgagttagtgtgttgggcgattagaatgcagccagtgaaggcctatgatggtacccagtgctggtagtagtagtattgactccatcatcactccaactcagatctgggactcccagccctctcctcaccctggcccccacccctgaggaccctttgccctggttctaccctgcctctgggccttgacctgtgccctcttcttccacagctgtgattgtgggcggggtggtgggcgccctctttgctgccttcttggtcacactgctcatctatcgtatgaagaaaaaggatgagggcagctacacgctggaggaacccaagcaggcgagcgtcacataccagaagcctgacaagcaggaggagttctatgcctagtggagccacagtgcctccctgcagcctcaacaccaccctgctgtccagtccccagcctggccccaccagcccaagcctgggactgggcctggaacctggccccagttcttctctgccctctctcccaaggtctgcccaggctgccagcctcacacagatcttccccgaggaagaggggctgctgccatctgccccagactgtgcccttacgagctcatctcttgttcccctcatccctgccaccagtctggggcttcaggacctcatgtcagatggatgggaggaagaaagctcctgattggctggtggtggaagaaagggtggggcttgagatgagcctgagccctgacttggcacccacagtgctcactgagatctcctttttggggcagagaggcactcaggctggtttccaggacaaacatttggtaaacacagcccttgaaatcatctagacactgcaacctcttgctcgtatcccagggcctctctctagctgggtgagagggtgtcccttgtcaccagcctgttttgtcctggtctctctggggttgttgaatctctcctcttgcctgccaagtacacatgtacccagacttcatttctttctgcatcttcccccaagaaacagcttcctgagggtgctggggcagccactggtgaggaggggctgctctgatgtccctcctatgaggggactctgcacagacaccattgcccacactatcaccatattttcactcagtcacacacaagacaaaagcatgcaatgacaaaaccatacgcaatcctgaccgcccagccaatcaagacatatcacagaacacacgcgtccttccaagaatgtttatcctcatgcatcacttacacacccccagacacgtactgcaatgcaagtcactagtcatggtcacatgacagtgacagtgtggcctcctcctaccccaaatacacccacactctggcaccacacacattgtctccagctttcaggcttactggggagggtggaatcgagccagaacaatcagcccatattgggtccccctaagttgccccgtcatactcagtcccatgccatggtgcccacaccaaccatgcagccgccaaccccagccagtgtcagacacaatcccatgtggatgcacagtctcactccacatgacctgctctcaatgctggagggaaacaggcaggcccttgcctttctcggaaaaagtgtggggccacagcccttttagggcattgcatgcaggtgggcctggcttcacccctacctgcttcctccccaccgcagctggcagagggggaggtttggggccagacccccactagctgggagcctgggggctcctctaaggctgaggaaggaaatttggccccaggttgttggggggtcttgggtctcccaggacggaaggcccagggcagggagggggcatgtggttgggctcctttatctccctgtgtccccttcctgctttgagctagggggctgactctgcctcccaggacacaagtctccaaagtgcctgtgagggcgggccctccgcaccctctgccctctgcctggcaggccaacctcagcccacctgcccagaggccctccctgtggacaccccctcacctatttggccaaacaattctggctgcagcttcaggggccatggctggaagcagcccctgcagatccctcaggccccgaggtcagggtttgagggatgagaccaggtgatagtgggggaggggttacttcctttgttacctagcaagtagggctatttccatcggtattttaaatgtggggtcacagatcttttggggagggtgtgcttggcagggggcctcttggagccaaagggatgtggtgtgagttgcgattggctggcactcacacccccacccctcacccacatcccagattcaagtcaggaaggcaggttttatttcagggcccttttcaagatgccctggcagcagatttctgcaggatgaggggtagcggtgtgtaggcagtgagggggaggttccaggggctgtcccacagcctgtcttttccaggctgggctccatcttccagtcccaaaaccctccttcacagggcccagaggcttgtgaggaagccaggtggacccagccttagaagagtgggcatggggggcccctgatatctggagggggcgggttggcctcagtcatctttggagcagaagggctgggtcctggggccacagaccacaaggctcagcctccctaccctgctccctggggtgctgctgtcttggagagcacagctctggtgagacggcctgggcaggccgaggctgagaaaccagggaggatagaggagaaaagggcttgggcccccagccccagaagatgctggaccccaggtgggagacccaacagtgggtgcagtttctcagtagggctggagccaatggtgggggtggccccggcaggcctggctcctcacatcccaggggttggcttctgatttggggcttgggctccaggcactggcttctcttctctgtgtccttagcatttgagagaagaggccaggggccttgttcatggatccctggacccaaggcagatgtccaggctttatcctcctgaggatgaggagtctgaccagcccaaatctgccctggccggcctgaccggggcaaggcagtccaagagagttcagtgaggaccagctaggctctcccaggtgcaatgtgggtgcagggccctcatgtccccctacccctgcctgtgatggagtgttctgaggggctttggcatttgctggaagcacagggagttccaaatgagagggagcttctgtggcttgagagcctctggggccttggctgccagagcacgaggcaggccaggacctggagagcccagaccctgtctccaggaggccaggaggccagatgggggccttgcctgaaagactggtccccttgatcgctggaggcatgtgggtggcaaccagggctgggcagggcttagggtgtgtgggccaaacccccctggggttggcaaagccgcctgtcaggcctcctggtgggggcccctggacacagggagcagaccctctgcctcatggggtaggagtggctgcctcctgtgttctctggatttcttctcccaacaactacaaccctggacttgcctccccaggcctcttgcctgtaaatagaagcccgcaaactgtacagatttacagaggcatcgagactgggccctgggagttgccatctgagagccgatggccccagcatcccccaggtgcctgcctggcaccacagtgaccctggcctcagcgtggcaaatgcatgtaaatatttttcgtaggcagcgtggctccagagagccccctgaagacagtgtccctccctcctgtgagtcctttctcctgtacagaacctgcctggggtgggtgggggtctgccattccctcccccaggccttccctgccccttctctcccctgtaacctgtttattaaccatacctgtcctgagttcatggccaaaaccttaaataagaaaaacaaaagaaaaagacagtggaaaaaagagaccaaggcgcctgccccactgcgggtactctcctgttccagccttgtgaaggaactggttttgtttttgtttttttttttttttttttttttttgtttgtttgtttttttaacacttcctgtgctgtgcccatttataagaggaaataaaattaagctgaaatg

SEQ ID NO: 36280 - DNA, 9050 bp, Homo sapiens
gtgagtgagagagttggttggtgttgggccggaggaaagcgggaagactcatcggagcgtgtggatttgagccgccgcattttttaaccctagatctcggtaagagaccagcgaaagagggaatgaggtggaaatggaatttaacagtaccaaggagccaggcccaatggcggcgccagattgagacaaagaggcgccgccgccattttgtgacgttcagcacggggcggtggcgggggctcccggcccatcggagggtttcctagtcttggagtggaagtctttatattcctcattggggcatgagccaggatgggggttacctgggagttgggaaccacaaaggggagccgatagccgagttgtattccaggtcacggcctttttatttttatggcgccttttttttttttggcccctcatttaattgggaagcttctcagaatgtttttgtaaagtcactaaccaagaccggacctttcagttcatattaaatggcccccgtagtcaccttactttcatgtagtttcagattttgcagcctgaatctaatcacctttttctaagaccgaaagatcttccttgaacttaagattcgttctttcatcgcttcccattaaaatggaggcttaagacaggtgccagcagtgtttttaaaaattttcaccagtggtttggtcttagaacttactcctgggcacagggtgtggtcacggcaaataggatgtgtctggactggatattttaattagacaagcccagagtaagaagaacgtggtgtttatggaaagcacttcagctgaattattgagtagatggtttttatgtaattgaaactggtctacaagtttatcagattcatcgtcgaagtgactcagtaataaagctttatcaaatacaagtccgccaaggaagaacaaaaaaataagtccccaaagtgcagtaaattttttagtagcaaatatctctttgtaattttttattaaagtgaaattatctttaagtggtatttagtatattcagtgttgtgtaatcatcacttacacgtagttccaaaacatttccgtcacctccccccgcaggagactactacccattgagcacttactcccagattccctgtcccccttcctctagtccctagcaaccactaatcttcctgtctctctgaacttagctattttagatatttagtatttatggaatcgtgtacttttatgtctggcttctttaacttagcgtaatgttttcaagattttccaacgttggaggatttgtcagtacatcattctgaataatactcattttatgtctataccacattttgcttatccgtttctgttgatggacatttgggttaacatctttgggctactgtgaataagtgctactatgagtttacattttttaaaaaactgtaaagttggtctcgttgcttgataaatttttaccgcgtaagactctggtctatctaatgacatttgatactagccttgttcctatagttccaaatgaccaaaataggcatttatttatttatttatttgtggtttttttttggcgatggaatctcgctctgtcgccgaggctggagtgcagtggcgcgatctcggctcactgccacctccgcctcgcgggttcaagcgattgttctgcctcagcctcccgagtagctgggactacaggtgtgcgccaccatgcccggctaatttttgtatttttagttgtgacggggtttcaccatattggccaggctgggtcgaactcctgacctcgtgattcgcccgcctcggcttcccaaaagttctgggattgcaggtgtgagccgccgcgcccggtccatgggcatttttttaaaagtgaaaatcgttggccttatttttattaaagctggtaagttttggcttatgtaggtactttgaatcgcttgcctggtagtataaccttaaggactagctttcttcatcattgttttatttagttttgagtccccaacagaattctcttctgtttttctagaaatgctttattttggggattaaatgaaataacaggttaagtctcttaactcacggcccagatggtggtaaatgctcctccagttgttctcaacgttccaaggaagctgtttttttcttcactaattgctggcttcctgagggttaggagtaaagataatggggcggggtggcggggggggggaaatgggtgcttagcagtaacatttcttgtttggtttctagcatttttgtaatttttttttctttacgtgctaccttaaactctcttgtcctctctaatggagttctttctaaggatctgtggttttaactgtagatgtttagatgaatgaatatttttggtatttttcattacagaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaaggtgatttaatgattacgctgataaaaatgtgttgcttgtgtttttcatatttaaaatctacaggatatgtggctcttagatggctttcccaatcactggccaattgtatctttagatacaattgggatctttttttttttttttttttttggtggggagacgagtcttgcactgtcactgggctggagtgcagtggtacagtctcccgctccccgcaacctcggcctccggggttcaagtgattctcctgcctcagccttctgagtaactgggactacaggcgtgtgccatcatgcggggctgatttttgtatttctagcagagatggggtttcaccatgttggccaggctggtctcgaactcctgaccccaggtgatctgaccgccttgacctcccaaagtgctggaattacaggtgggagccactgtgcccagccaggatcaaatatttttaagagtagttgtgaactgatccttgtttaaaaaattgtttacaaaatggttacatgggttggttgtacctttacttttatgtgtttgaaatactccagaaagtgaatcacttactatttccctttgtgttaatagtgtcctgttagctggctgagtaaggcctgagtattgacctccatgcccccacccccctttcctcatatttggaagtataatgggaaaaaggagctgagtgttcactgtaaagctgcatgaaaggttggtcaattcaagcaggttgtagtaaagttttccagggcccacctcttcccagtcactcttcaaatatgatagcttatctaaatttaatgactggttgtattaagggtgaggaataatggtcttttttttttttttttactactgtgagctataatttctttttttaaaaaaatgtatatttattatttaaaaaataatacagacgacagtctgtgttgcccaggctggcctcaagctcctgggctcaagccatcctcctgcctcagcctctctgagtgctgggattacaggcatgagccacctcacctggccacagctataatttcttctgtgctgactgttgaggggagagggtgctgtaaaatggccaaaatggttctgtcttgtcttgaactgattttttacttggagtggggcagggggagaccaataaatacagcctggtaaataactgaaataagtgcagggacttcaagggaagaaatcataatgaagatacaggagaacttgtttttcaaggataaatggatcttcacacttaaattgcaactgttaacaaattaacattgagctcagtaatcagactggctctaacaattaggtgataaaatagaatttgacttccttgtgaattggtactttagaaaatcctatttgtttaatttgaaattaattgaaattttaatttgaaactgggaaacaagcttattttatttttcaagacagagtcttgctctgtcccccaggctggagtgcaatggtgtgatcttggctcgttgtaacctctgcctactgggttcaagtgattctcctgcctcagccgcctgagtagctgggattacaggcatgtaccaccacacctggctattttttgtatttttagtagagcgagggtttcaccacgttggccaagatagtgtcgaactcttgaccttgtgatccgcctgcctcggcctcataaagtgttgggattacaggcgtgtaccaccgtgcctggccaaagctcattttatattagtaaaaataagggagctagaaatttgatgttaaattgcacagacacttaggtgtgttctttgcagaatagccaactgagagtacttttggctttaatacgcatgtcagaaagtcaggctgttttaagtttaatatctttgccccctcagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcaggtacttgagagaaagcttgttaagaggtattggtgtaatggagtagctagtaggagcaggtatttctcttaagtttgttggtgggttttaaactttggaagaatcggaggtttctgtgaaacatttgttgggtgtaatttggggtatgtgagttgtgctgagtgttggcttttgtctttaggtcactgttcatgttggtagtcagtaacttctatcttggatctgtcttctagttcatctttctagttgcatctttccaaatcttcccttatacttcagtttaggcctttttccatttcttggctccataatgacaaacattacattcaactctagctcttcacaaatttgtgttttctactattagcacaattgtaatatttatcaaacaggcagctgttttaatgttacaactggtaaagtagaaatcattctgagactaacttaagtcactgaccaataaagggggctaaaaaagaagtaatcccagtcatctgttcttcaatcccaaataggagaaaattcagtttttttataattgaaaatggcatcattcttggaccaggcagtattgtctgggtgctaactccacatctcctcagacctccaaaatagtttctataggactaaatttacctcttacaggtgagtggagtccttctaggagacaggagttcaaaatcttgccccttttgctattttgaaaaacaacagcacactgttgcccatcataataaagagtatttgttagctaatagatggttgtactgatggcttgtttttcattttttttgtgctttttggtccatctattaataaaaatgaaccccgttacagagtcaccatcatgtctcttctcaccaccctctgaatctgcattagccagtcaactagccctttcagcgtcatgtgaccagcgcgccccattcagcttggctggtgtcgtttcacatgacccaggctggccagtcgtcaggttgcaccgccctttggttcccgagcatgctgttttctctcagccttctctccaaccttaaccaaatcggcagcagccacctcgaccgcccacacattcctggccaatcagctcagctgtttatttaccaaatgtcttcacaacaactacagcagcagccttcggctaacaaaaaagcaggaaaaatccacaacacccccttcgccaaccaactaaatccaacgcaacatctggcaaaaccttttcagcaaattcttcctggccgtcagtccggcagcctcacctcaccatttctagcttgttgaaacccaaaactagtaagtttttcctgcttatacagtttactgctggttaaaataaggagtaagcggcttaaagtaattcttttttctggatcaaaggctggctgtgcataattgaatggtaacgtacatatatattgcttgaaaaacttttaagggtgatagggaactcgtaatgtaactaggccttcaagtgaaacttatttgcatgtgcaagatgccaaactaaaaattttaatatctctaacagattagcttttctggcaaaaatttgttgaatcctatcacctttaaatggttttactaacagtttcaaaatttaaaattttggggttgaagtgtgggccaagctaaggtaattttggtaagcctaaacacactcttaaatgtgacgatcacaaatgcagttctaatgtagcacttaatggcatcaatatttacacctaccgcgttttcacaaaattacactatccacctggtacctaagtcttgtcatggacttacaggtttgcatgggttccaaatactggtttatggtactgtttttggaactacttgtgggactatattttggtgtggtgtttgggtagtgaagttagtttgacatgaagttttgcattggacagatctgctgtgaagcattctttgttaaagtgaatccatggttggaatacctgcttttcacttgagctttttgtttcttaatccttctgtgccttttttttcttttcttttttttctttttttttttttttttttttttttggacgatgggtgccagttcttcggcacattcactgggcccaacagtgagattgaaaagttgggaaatgcctcacgccataaatactaattgatgatgagcctaattttcctgtttctgcttttagatctccaagaaggagaagcttctctcgcagccggagcaggtaaatgactaccttttttggctacgttcttagaaatggcagtgtttctgctattcctaaacttttccaggtggcttagttaatgggaataaaccttggctttaatagtgaatcaagttgtaaggatgagtcagctttctttgagttttcaaaggctttttagaaagtatttaattttttaaaaaaggatctgtcacccaggctggagtgcagtggtgtgattatagctcactgtagcctttaactcctggccttggagtgatcctccctcttcagcctcctgagtagcttggactacaggcaagtactgccatacctggctaatttattttttgtggagatgggatctcactttgttgtccaatctgttctcaaactcttggcttcaagtgagcctcctgcctctgcctcccaaaatattggaattattggcatgagtcaccatgccagatcaagaaaatatttatgtataattttatcatacctcattggtcctaatgtttttttgcttgtttaggtccctttctagagataggagaagagagagatcgctgtctcgggagagaaatcacaagccgtcccgatccttctctaggtctcgtaggtaagatctttgataacttgtatttaagactttgcatacatagtatgctaaggcctgtcttctaagccataaattttttaccttaaagttctatttcgatatgtcactaaagtgtcaccaagttacagatgtaatgttttgttttctttttttttttttttttttagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaacttgaaagcctgtttttccttgcaaactcaaatctgtgagcttggtaccaagtccaggtataacattcctattggaagccatacttatattttcttgtaaagtgcttttgaattaataaaatattagcataattgtgtatagtcagttgaacccactgttaccattgttcttatcccatgggaagcagttggttacacgattcttattttataagaaacagctgagaggcactatggattagtcttctgaagtgaaggaaatatagatgtcacctaagtgatagttaacccattttttttttttttaggcatagaagccagttcagggtccataatatttagtgaccaacattttaaagtatagcagcaacctggttcttaaacacaaagtaagttgcccattaacaaatggcttttatctttagcatgaaaactttccacaggtctaaaaattgcttccattttataatttgaggtgttgcatgggaattctaagctgatccatcatgatgtaaaagttcacaatatggttcaaatgtaacagtgcagaattgaatatggaggcatgcataaccttcctcttagaaaatggcaggtgttgtaatttcaaatttttgtgcaattagattaaatcataatgcaacagtc

SEQ ID NO: 36281 - DNA, 51336 bp, Homo sapiens
gagcgcgcacgtcccggagcccatgccgaccgcaggcgccgtatccgcgctcgtctagcagccccggttacgcggttgcacgtcggccccagccctgaggagccggaccgatgtggaaactgctgcccgccgcgggcccggcaggaggtaagggcagaagggaagcctcggggcctattttcccggtagcgactgcctcgggggagggcctgcgggtgattcctgcgtcgcgtccgttcctgcccggggacgctgcggaagcggtcgcagaagcggcgagtacgctgtatggcaagcgcatattcttcccgggcagcacggcggctgtgagctggaattcagcgcgggcggtggggtgattgcggcgccccctggtggcagtcctccgcgcccctcccctgactccccctccctcccagcctcacccccgcgccgttgcagcgctagggctggatggcctgcgggtaagcggcagcaggcgcctagtgggaacccccggcaggaagttagcatgggcggaccacacgggggccacacatgacttgtgaagaactactggacagtttggggaaatgactaccacgaaaaggcttactttcagttttgtttcagactccttttccacaatgtcatcagaacaatgggaaaagtcgattttttcccattcatttccagcggtgtgaaatgtgatcacatgttaattggttgcccgtggtgggtgtgaagggtcttgtcctcgggaagtttacatgatgattggcaaagatctatgtagagactaaatggactggcagggtaagagagtatggagagcgccaaactaaataaattttatactgtgaagactcacaggtcaaggcgtccctggagacctggctcttctggactccctactctttatctgccctaatctccctgccactcgggtaatgaaattatgctcccagactcaactccgcatgtctccaatatatatactgttactccaacaacttatgatttacagcaattttaaaagaaactgataaccctttcccactgattggagatgttatctttaagataaaaacaaattttcaaaaaatgtacacgtgcatcttagtctggactttgttgcattggtctgtgttgtttactcatggtccagtaccatacttttagttttatggcatattttgccatctggtagggcaagctcctattatattattcacatttttcttgatttttttttttttttgagacggagtctcactctgtcaccgaggctggagtgcagtggcactgtgtcggctcactgcaacctccatcccctgggttcaagcagttctcttgcttcagcctcccaagtagctgggattacaggcttgagcatctttttttatagtttcctgatatttttgtttatcaagttccaaacataatattgtgattgttgctaggtaatacattaagtttttaagttaatttgagggaacattgactcctttcagcattgctttccctttagaaaaatgatgtagccttctatctgtttagataacctttttttctttttctcttttttattgtattttaaattttgttgttgttactcctgaaacaccatagttagataacctttgatagccttcagtgaggctttactgaaaacacaagtttgacatatgtaaagttgactaacatttgaataacaaaggtgttttatttaatatttgtcatacctatatcatatacacttacatgtatgtgtgtgttcgtgtacatgtgtatgtgtctatcaacttatctttttttaaaaaaaaatttatctcaggagaaccatacagacttttgactggcgttgagtacgttgttggaaggaaaaactgtgccattctgattgaaaatgatcagtcgatcagccgaaatcatgctgtgttaactgctaacttttctgtaaccaacctggtatgttactaattttatttcactagtttccagtaagggggttgaaatcacaaaatattctcttggtttgtatgtgagagagagttcacaggatttgtcattttatagagctgtgtagacttttttaatgttaacaaaattaaatacttatattgtggcagtggtaccagtggtatttgttcattttgagatttgaagtttctatttcagtaatttactctttgttttagttagaaactcagaggaagtaggacatagttatttttatttgcttactaaacatttattgtttactattagtttggtgcaaaagtaattgctgtttttgccattagcagtaatgtgtttttatgtgtcagtaactgtgccaaccctgcgaatagaacaatgaacagaccttcatgactctggctcttaaagaggttatgtagctgtgtggaaacgggcatttctcatataatacaagtttttgcaatgggaattgatttgttttattagggaaatgcttacttatgccccacagctcctttaaatggctttcagtttgttttgatcataaccttgggtgataaaagtgctaaaaaaaatacataggaatatctgtactcatgataacgctggtggtaataagaaagatgagccattattttaatcaaagattgcatatatgcgatatgaatttcttcagttttatttaggttttgtttctgttcttttaggtatagaaaaacattttggaaatttctacagaaaaagtaaaattgttactgtaagtcagaaacactagcctataacctcgtattctcatgggactaatttttacaatgtggttttgatactgtaaaacaaacaaaaaaagatctaggaatgaaattgtcatgttttaaatgaaacagactgcaccaaagcaaaaaattctcaaatgtgtgtgaggggtcaggagaatccccactgacttacacaaataaagaacatgtgtgttctaggaggggtattcctgggttaagaaacttccctaaggggaaatatgaattgttagttgagtgatcttcctctcaaggcaaccgaagcagtaattgttgtctgccgtgttgggaggttagccacctgcctattgtcttttcttttgaaaactttttctctgagaagtgaatgtactgagtggtaaaagactttaaattatttgctaacttttcagagtcaaacagatgaaatccctgtattgacattaaaagataattctaagtatggtacctttgttaatgaggaaaaaatgcagaatggcttttcccgaactttgaagtcgggggatggtattacttttggagtgtttggaagtaaattcaggtaagacattttaaaattgattttaaaatggacagctttgtttcagccaaatcctaaaggaaaatgatatttctgattaatgaatttaaaacagtataatttagttcctgcttagcacagtattggactctgtgccatgggtggtgagtgcattttgtacatcacggtgatgagagtttgagtgggccctgagggacttcatgggaagttacatttcttcgattcctcattggtgaaggtataatgttaacttttggtcattgttttttcttcatttggactcaagacttaggatttgataattttctaggttacaaagcttaatgatgaggaactgataatttcataggttacaaagggtaacaataaataaaagttacaataacagtatatgatgtgagcttaaagttttaaagtactaaaaattgccatctctgcaactctgatactatgactttatttaacttattctcatttacagaatagagtatgagcctttggttgcatgctcttcttgtttagatgtctctgggaaaactgctttaaatcaagctatattgcaacttggaggatttactgtaaacaattggacagaagaatgcactcaccttgtcatggtatcagtgaaagttaccattaaagtaggttgaatgtcttgttcttatgttaaaaataagttatttgaatttaagcttacccactatacacagatttttttttaattactttaaaactatcagaactgttagttgtagatttatatatacccactccatccctttgtataccatttaggcttgagtggcttttcatataacctgtttattatctgagacaagccaaaagcaactaaaattatatttcagattttgtttagcattttaaaaagcgattctgttgtccttccaccgagaaggttatgacagtgcatactttgtgttttcagtcttaaagcaacgcaactagagattaactgccagtcttcaaagtttgcatctcatgtctttctatcaagttgtctttctccaatctccaggtgattcatctccttttaaacaggttgacctatagatttgtgggatccttttaggttaatatctatagtaaaaagccacaaatacttagattcctttattaaaaatcctttagtatttaatataattaaactagaattatgttttatagctaaagagttatcgtggagaaaggcttgccgctcagctggaactcaacttgtactttggtggggttgtctgtaatcaagggtttttttatttttgcacatttatgaaattgattttataaattcagcagtgtgattagcctccagagtactaatatatgcatataaacttacaaatagtagatttacaaatcaaagtgtccatttatggttttcagtagggatgcacctttaccagaatatttaagtgtgggccctagcacagtcctctttaagatattacttaagaaatagagtaagtaatcatacactagcttggttggtgtgaaatacaatcaaaggtagttaaattgtcttgagagatattttactacatctgtgacagacctggacacttccagcgagtgggatgctgatgaccaccttgtgaattgctccattacacacaccaacgtggtttacagagtaatttgttaaaaaaaattcctggtcattcatatgccaaaatagaaaaccttgttgttatatttttttttttggtaaattttctgaaagtacagttagcttatattttttaaatcattgaatgttagagccaaaaaggaatttaaagaccatttattcttactattagctacttaaaaacaacaacaacaacaacaacaaaaaaagcgttcagttcaacttttattttctgaagtgtaaactgaggcatggaccaattaatttcccaagtcacatgtattagagtttacccaatacagtgttgatttgcacattactggttcatgctagtttatttctttcacattggaaagtggtatctttcaggttccattcttgagagacaatctaaatctgcttgcccctatttagacaataaaataccctgtgttattgaaagcatattcatggctgggtgcagtggcttgcgtctgtaatcccagcactttgggatgccgaggtgggaggattgcttgagcccaggaatttgagaccagcctgggcaacatagtgagactccatctctacaaaaaattttaaaaattagctgggtatggtggcatgtgcctgtagtcccagctactcaggaggctgagacaggaggattgcttgagcccaggaggttgaggctgcagtgaaccaggatcacgccactgcagtccagcctggacaacagagcgagaccctgtctcaaaaataaaaaagcatatttatattattctgaatcttattttcattgcccactgtagcattttctaatgtttgtcatattttttggatgtatcatatttgaggcttatagcttaattcacatgtgagtttaagtttctttttttccactttatatgtacttattttgtgcttttaccaaaaattattttatttactttctcaaaaaggctttattgcatagttacaatctttttgaaagacaattagtctaaaaatagctcatgttcatctcctaatattgtcttccctgaagcagatatgttacatttcctcaattctgaaatatatttttaacattttaatgtcttcgaaagtggaatgcattttaaaattgaattttattttatgttgttccaccctttccaaaaaagcagttttaaaaattagtattataatcggtgacttcttataattgagtgattatactgtgatttatgttctaaaataatgcagtgaccaaagaccgacttctattttatagattgtggcttctttataaatttagagagatgaaagggaaaacattattttttatggatgtaaacagcctctttgtagtttataacttaaaacttttctttaaaaaatgctagcatgtgaatatatatattcacatgttttcttcattgtagacaatatgtgcactcatttgtggacgtccaattgtaaagccagaatattttactgaattcctgaaagcagttgagtccaagaagcagcctccacaaattgaaaggtatattatgtattttaaatataacaagatgtcacttatatgatagcattgatttttatttaagttaattccctctttaatgcttgtttcaggatgtaatagttgctgtgttatagttcggtattattaatggaaggttttttgttagtttgtaaagaaagagttccccaaatttctttgttggttattctgtatctctgaaacaaatgttaaatatgtgctaatatttaaagaaaaaaatggaaagacagtaaatggcactgaggtaacctcatggtcagaagagcacatatgtcagttccaggcatcacgccacagttagctctggaattgtgtggtgcagcagccctctttgcaagccacatagtccagaatattaacagcaccatagctttgggaatggagcttagtttttctgagctccagttactcattgcaaaattgagagtaatacctacctagctgagttaaaaagtcaggaaacaacagatgctggcgaggctgtggagaaataaggcttttacactgttggtgggggtgtaaattagttcaaccattatggaagacagtgtggtgattccttaaggatctagaaccagaaataccaattgacccagcaatcccattactgggtatatacccaaaggattaaaaatcattccactgtaaagacacatgcacacatatgtttattgcagcactattaacaacagcaaagacttggaaccaacccaaatgcccatcaatgatagactgggtatatgtccatacctatgcacatatacaccatggaatactatgcagccataaaagagaatgagttcatgtcgtttgcagggacatggatgaagctggaaaccatcattctcagcaaactaacacaggaacagaaaaccaaacaccgtatgttctcactcataagtgggagtggaacaatgagaacacgtggccacagggaggggaacatcacataccggggcctgtttgggggtgggggacaaggggagggagagcattaggacaaatacctaatgcatgtgggtcttaaaacctggatgacaggttgataggtgcagcagaccaccatggcacatggatacctatgtaacaaatctgcatgttctgcacatgtatcccagaacttaaagtaacattaaaaaaaaaattttaaatgttatgccagttaggaattttattgctaattttaatgtgttttgagctgctataagctatttggcttaatgttagttttttagggactgtttataccggataacagctgtctgcttttaaaagtaataaaaaatcaggttttcctctttgtttataatttttatctgggaagtttttttgtatttatactccagttggcaggtaatgtgatatatttggactctggaaaaatatactcagattttaaaatagaagattcttaaaattttttgagtccaagacccctcagtatgtgccaggtctgacccgcagaccctgacccagcgacagatgaacaaatgcactcaaacacaggtatccagtgaaagagtgagctagggggctgggccacccacagacactgaggagggtgctgtaaagagttagcagccgcggtcccgactagctgttgctgtggtcatttattcagtatagatataatggcaaaggctttgagtcaacacacttgtggataattaacatggttcccctcccaggagagagcagtcctacgaatgattaaaggccaggttccgagctaagtaacttatctagatcagtttcttaacatcccgttatctaacctaagctttcaggcaccgtataaaagaatctggctgctttcagccaaatcctgttccgaaactgatgtaaaaccttttggccttccaaggtttgcatctttctacattttttcccaccaccctgactgaactcctgcaaatatgaaagcaggccagccctggtggctcacgcctgtaatcccagcacttcgggatgccaaggtaggcagatcacttggggtcaggagttcgagaccagtgggaccaacatactaaaaatacaaaattagctgggtgtggtggcaggtgcctgtaatcccagctgcttggaagactgaggcttaagaatcccttgaatccaggaagtggaggttgcagtgagctgagatcccacctctgcactccagcctgggcgactcaaaaaaaaagaagttgaaagcactgatctcacctcaagaaacttcaccgacataactacaaacttgcatagtattttaacagaatcacatttttccctgaagcctcttgaggaacctccctgaggaagtacataaatcttgtaaataatgactctagctgcaaatagtgagctattcttaattctagattatacttgaggatagaggagtctgataagttttcactactagtagatatatttcatggtcttggagtttttagaattagtcgttgattcctctttttgttcacattgtcagttgtgtttaacctaaggttgtttttgaccaagttcaacataatttttttctagattcaatttttgattgtatcaatgtacatgacgactatacaacatccctaccataagattgttgaatccctcctaattcggtgttaactgggacaggttatttatcctattaacccatattcgatgatggcaattgataatacaatttttaaatatatttagttatttgccttaatagagtcctatacctatctggatccattttgatgtgcttgttgaaggcttatttgtctgagtactcaattaacagaaaaaagattcaatttataaacattagtagaaggaatgggttacgaaaaggatatgaaataaattgtggtgacgcctttgattacataagtacctctaatgttccaaaaaagcatgactgctagtcctggatttaaattaggaggcatactataatattttttccaataaaatatacagtcctatttagtacagctatgtctacatctttgcactgttaccaagaaacaggatatgacagttataacttcatgtacatgaaatgatttgcaatatctcattttccttgactgtcatcaaagtagtaaagtagatgaagtcatttttagaagaatacatttaaaaggagtgtttaatttcaataatctgtgctctaatagaggagatttgtatgtctaaatgtaaggagattatcccccagaaaggagggggagttggcttttatttgagttttacaaagtctctcatgttgtaggatggtgtattaattatttcaaacaacaagtattgttttagtgagacactcttgagagatggagtcctccatgggtcccttgcattcataaacaatttgctgaataggccaagaatgcaaagccttgaccctcctttacacagaccatttctcaagggtatgtttgcagtgagaaacctcgagggatgaagtaatgtttccttcctgtgacaaaatgtaggcttgcttaaagcttgttataataccggtggtttcccaagttcagtgttcctctctcctgtaacacacaccactgtatgtacctttcactgtatgtaccctctacgtcttccctatgggacttggtcagagaggagacctgcagcaaacatactggggctcatgctgcttgctttgctgtgactcaggagtgtttgtcttctgccagcatccatgaaacaggaacaggttaacttaccagctgataatcaaatctcagacccaacagacacattggcctgaaataatctcagtaaatgaaagtttgacagtttaggaagcttatagaagtcaccttacatagttaatttaaatcgaaggtaagaaatatgactagtattagtaatttttttcaggatatggaacctcacatttgcaaattgtggatgtcactgtagtctagccttttcaagatcaccaaaaaaaaaaaaaaaaaaaagccatatagtaaatggttctagaaattatgaacatatgcctgcaggactaatgaaataaacagctgtccagatattgaacaaataagtatgtgtggcttgggatacagtttctagagccagaattatacatggattcagaaaaattctgtatttgcaaaatcttcgtacagaagtgaaaatgatatactgtaggttagatgaaatttattgaagatcatgtaaagaatttaaatagaaaatgtgaatgggaaaaagcaaaatttctagattaatatcattttatagaatgtatgattcataatatgtaccagttactgtgtaataaaacataattatttgtagctcttaaagtttctgtataaacgaacccaaaacattttaattttttaatgatagaaattggagatcactttatatttgtagtatcgttatattcagtcaatatgcctctagcctaggtctctgacaggttactttcctattttccagtttttgtactagtttattaaattactagagtgtcagaaatgctttaaaacttctagaatgtaatgcttcagacgtaatgattttcaatgatctcttcacattcatcactagtcttttctttcttgctctcatcattacactggtaaagagaaaaaggcttatgtaggtatttgaaattctagaacatagtgttttttgatcactgtgttatcaattatctatgtatgaatgtgtctatcatatatcaaatgtaggtattactaagaataacccatgttggagtcatagccagcatttggttagcttctagataatacagttttgtatttttttgttcaagattgatcttaccaagtattggggctcaaatttatcagtgttctcaaaacaaaaccaaaatacattgttcaagttctagaattttaatacttaaatctatacttgagggaattgaaggatgtttatactttttattcacttttaaattattaagttgaatttttatttatattttgtaatgtcagtttatttgtaaatatgtattgaatgcctacagtgaagcaggcaagatagacttgtggatataatgatgagccaaaaaaagttacagtttctgccctcatggcacttagtggagaagccagctgttaaagaatgacactaataaagttagaactctggtagagccattagagaggcctaacaggctaccatacacatatgtttaggaacctggctcaaacttcatcgaactaagctacagttagctgctccctggctactgtaaactgttatctatggcataattaagaatgacagtgtgaataatagaaagctgtagataatttaaaaatcattcaactttagtgttttgggaaagcaggaagaatctcacatctactcagtcatagttttatagtcatgtttgactgtaacacacagtcatatgtgttaaacatttccttactgtttttgtctgtaactggctctgtaatctgtcctagtgttgttacattattgtgtgaactaattggtaaactagttatttgtatataagtaaagtgttagttggcttttacactaagaaagaagtataagttatgggggaatatttattaggagataaaggataaaaaggattcaaagagatattaaaattgatcctttttatgtgtccgaatgtctactaactttccagtgctcttattgtagatttagtttttgttaacagttaaaatagtttccactgttctctgtatattttaaaagtaaaataaatagaattttaaagtcggttgtttagaaaaaccataactaacgcagttgcctgcattctgtcctgccaagtgagtctgctcttgcctgcagataactcatttgagattgcagcttccagaaatcattgctttaaaacagacttacagcatctattgtagtgaaattaaaatacatgcatcagttatcaaaaaaattttaaagtattgtaactcttcaatcataacttagctttactttatgaaatatgtatgtttccaaggagaagtccaggggaaagatgtaaggtaattagttctaaagtgctggatagtgactcttaatgactgcagtgtttttaccacgttggatgttgatctctgcagatagttaactcttgatttgtgactgattgtccaggttgtgaatttctccctccctacattgtccccttatcatcatcatcatgggttagtaatttttactgaaaggaagagagacaagtcgaaatgccggtcagttatgaacagctgtagcaaaagatctgattatacaggaagttgaaactctagactgatgagaggcttaagaattatctgttgatatttctccatttcttattttcctttattttcatggatgattaagatgttcttatagcattaaattaaagagctaaaacattatattctttagtcttgttttggaaattttatttgaactgagtaaataatgtaagtttaaaaatttcctgaacttctccaaagagatctctaacaaaacactcataatagattgtgctagtagaattgaaacatgagcgttttaatagatattggctcctaagtaaacacaagatgctaatagaatttgatctttatggatgatgtttctctcaaacttttgtaattcagacaccttgtttgagtcatgtgtgtttaatgttcatcctgttatgattgtctaccttggattatttattttgagatattaatgatcaattctagctcttctttgtgtcacctgccaccatatttctagaaaacgcgattagatgctttttgtcattttgtcccagataaaattcttacttaaaaaaaatactataaaggtattatggaaattatgccttttgagtgtcagatagtcactccgtttacaatttaatagcaaacatagtagtatataattagaatatactttaattatttttacagtttttacccacctcttgatgaaccatctattggaagtaaaaatgttgatctgtcaggacggcaggaaagaaaacaaatcttcaaagggaaaacatttatatttttgaatgccaaacaggtaattatgttataagctaaattttcctaaagaatacattacaaactaggatacattattaactcttatcagtagttgttaacgtatttcattttgggattttgtgtaaaagtgtgaagtagaataaaaaaaccccaggcaccagacctgcccagtgatcatggctgtgattacggggtttcttaaaatctgtgataactggcctattcataaatatgcaagtgagaaggacaggaaacttagttttaacttctttagttagtaagctaaacctctttagttagtaagctcactaaagaagttaaatcagttgaatatgttctgtgtaccaaagtggggtttccaagagtttatgttgtagtggagaaatgcagataagcccacagttagagtgctgttaggaagtgtgatgaggaaccacagagagtgtaacagttccagggccgcagagacctgttgaactagggactttctcaaagtggaagctgaaatgacctactcaagaagtagcaccaagtcttcttgaattgtacttctatgtttcccaaatcaaattcttatgtgttcaaaaaattactacattttactttaaaaaatgtttccttccatttttagcataagaaattgagttccgcagttgtctttggaggtggggaagctaggttgataacagaagagaatgaagaagaacataatttctttttggctccgggaacgtgtgttgttgatacaggaataacaaactcacagaccttaattcctgactgtcagaagaaatggattcagtcaataatggatatgctccaaaggtatagaattattctttattagtaaaaaactgcaagtaggagattttatgtttaaccttttttgttgcttttcacctaacaatgtaaaagtagatacaagaattttttttttttgagacggagtcttgctcttgttgcccaggctggagtgcagtggcacgatctcggctcactgcaacttctgccttctgggttcaagcaattctcctgccttagtctcctgagtagctgcgattataggcacccaccaccacacccagctaatttttgtacttttagtagagacagggttttgccatgtaggccaggctggtcttgaactcctgacctcaggtgatcctcctgcctcagtctcccaaagtgctgggattacaggtatgagccaccgtgcctggcctattttttatttttttgagacagggtcttgctctgttgtccaggctggagtgcagtggcacaatcttagctcactgcaacctctgccttctgggttcaaacgatcctctgcctcagccactctagtagctgggactacaggtgtgcaccaccacacccagctaatttttgtatttttagtagagatggggtttcaacatgttggccagcctggtctcaaactcccatcctgagatgatccacccacctcggcctcccaaagtgctgggattacaggcgtgagctactgcgcccggccgatacaagaattaataaaaggttttatagtgtagtatacttgaaaattaattgtgacttggtatattagatatagaatatctttattcatgacagttttactcaaaaatattttatgcttttttgttactttaatagaatttgtagaatttacctctgtaaattaacaaagtagtgttaagtttttttacagaatatgttgcatttgagaaacttaaaactcaacggtaaaaggttttctgcaattgcctagcgttgaaatgtatttgccctttgatggttattacccattagaaagacatataaacattcctatccttatataggctattatgggaaagcagacaaaaagtcagataggttgaaatgatgtttgtagagtggagggagactgtaaaagagctaactgaaggatttttcttagactttaatttgcattaataatcttagcattgttgaagccagtaagtattgtagaaatatatggcttggcagtcttctgactaaattgctcttcatgtggcaaaaagtaggtgaggactaaagtgtttatatgcctgaaaagtccacagccagcttcctaccaaagattcattcttcctgtcccaggagtccttctgaccatggggggattttctttttttctcttacaggcttgctgaaataaaaagtaaaattttagtcatctatcctataaatattttacttaattgagatatattaactactgtaaaaaagaagatatactatataacaaaaatactatcttattactacaacacaaatttactgtagttccattgtgttttaggcactggaaatataatgaaaaacaagatagtcacagtccctgccatcactggagcttactgtctagaggcagagacagagaaagacaagtaaacaaatcattacacatgtatataaaggaagcagtaacccggcagtggggaagaagcttattctaaacagagaaggcctcttttaggcaatgtcttacctatgaccagtttttcaaagagccagacaaagaatgtgccaagcagagcaacagcagtaatacattaaaaaaaaaattatcctacatagcaggttctggtctaagaatttatgtatgtataaacatttaatcctcaacctatatattatttactgttgtggtcctcactgtgcagatgagggaactgaggcagaagggggtttgcatatagcagaggcagtgagcagggtggccaggatgtgagcccaggcagttggattctggagtccaggctctttactttcagcacatattgacaccctgaggttaaaaaaaagtagctggagtaccaggtagctcagaccctggtgccttgatcatgaggtgacacttggcccctgttacaatatggttttttgggtttttggtggggggatgttgagacatggtttcactccaggctggagtgcaatggtgtgatcttggctcactgcagcctccacttcccaggctcaagcaattctcctgcctcagcctcccaagtagctgggactacaggcgtacaccaccacgttgctgctaatttctttatttcttgtagagactgggttttgccatgttgcccaggctggtcttgaactcctgagctgaagtgatctgcctgcctcagcctcccaaagtgctggcatcataggtgtgagccaccacacctggccacaatatgttttttggagggaatgcagtattatattttgagaaagactgtcacttaaaatgatacctgttaacttagttcaagccaatgaaggagcaattatatgaagcagagtggccagtaaagccagctattgaccgaacttcaacagggcaacattgtgattggtgattgccatggctgtattgattagatgtcagaagtgagtataggaaatctgtggtaaagattaagtgtcttttggagaagattagaagtctaggggaacaatacagccctgatttttgttcttgctgagacctttttccggtatctcagctcaaatttggtaactcttcctgttattaatttaattattttctctttatttcctcctgcttttccttctttcctgacctgttccccagccttgcacagaattggatgaatcataatccttggtccatgacacatgctcatcattgatttatgcgtaatacacatttattttgttcaccaattatttagttatttttcagacagcaagtgtttgaaaaaatctgtcatctaaaataccagccagatctttgaaaataacttacgtggttacccctagcccagttttctcctgtgtgaaataactgtcatccagaatccagtttacagttgtgggtggccagagcctattcagcagttcagggtgcaaggtgggaaccaaccttggataggacactattccattgcagggcacactgacacacccacccacactcactcagactggtacaatttggacacaccagttcacctaatgtgcacatctttggaatgtggtagtaaagcagagtacacacagaaaacccacacggacactgggggagagtgcaaattccacacagacagcggccctggttaggaatcagttttttcttgccgatgtcataatgaaatgacactgaatgaaatgatgttattcgaggacctgctatatagtaaaaatcttttctgttttagtcagtgctaaagatactcacctatgttttttactagtattttgataccatcttttgtttttgacatttgtttttaacttatctggaattctgttttataccaaagttacatgcacttttgtgtttttgactttattctttttcattcatcagtctgcctttctttgtaccaataccacattgtcttaattagtataacttccatgaagtcctcctagctggtagaacaagtctttttttgctcttcttcggaagcatcctggctattcttggccctttattttttcatttacatttagaatcatcttttgttaaagtttgtttggattttgattaggaagtgcattgaatctacaaggcaacttgagaattaacgatttatgtaaattttaattgtttttatccttgaatgtggtatccccatttatttaggtttgcttgaaatctcttaatagaattttatattttctgtagagagatcttgaatatcttactgtatttattcctagctagtacatattctctgatattattataaatgaatgatattgtcacttaaattaccttttctagttcactactgctgtaaagaaattcagctgacattcagataatcatcttatatccagccatcttgccagactcctcttttttcctaataatttatctatagtcttttctataaatcattatcatctataaggaatgtttccattctcctttgtaatcgttatttctctgatacctcttttttctgtctctttgttccataccaactgggacctccagagcagtgttgaacagaagtggtgaaaatggccacatttatctcactgttgactttaaaataaatgcttccagtgtttctccattaagggtgatgtaatttctgtagagcattattaaatatgtattaaaaatgtttctattttatgtaaccattctttataactaattcacatagtataagttatagttgcaaaagttagtaaataaaataccagttttgaattacctaaattacaggtaggtatatgtgatcacttgattataaaggttttttagattttatttttttagtctgatactttaattgcacgtataactgaatcctatttaagtaagctcagtacacacaaaaagacacattaagcatttcaaaaagaccttacgaactaaccatttaaaatatcttgactgagcaaggtggttcacgcctgtaatcccagcactttgggaggccgaggagggtggatcacttgaggccaggagttcgataccagcctggccagcgtagtgaaaccccatctctactaaaaatacaaaaattagctgggtgtgttggtgcgcgcctgtggttccagctacttgggaagctcagggcacaagaattgcctgaacctgggaggcagaggttgcagtgagccatggttgcaccactgctctccagcctgggtgaaagagcaagtctctgtctcagaaaaaaaaaaaaaaatctttacaatgagtattgaagacattttgtagttgtttgttaaaatttgaggtgtaatttttatatgatattaaatggtgtatttttgtttttataaaatcagtcattgaccttacagaacaacaaaaaataggttcaccataagattcctttaatgtgaagataccttaatacttgtaaatttggcaaaatgatttgatttactaaaagttgtaacacatgtatagatataccttaggtatagttctgtctacttctctccgtccttcctctctctcttctttttttcttctctttgaagtttcatcttaggctcatagtatccgtagatttgtttgtaaaagcctgtggtgattttttttaattttttttttttgagacggagtctcgctttgtcatccaggctggagtgcagtggcgcgatctcagcttactgcaacctccacctcataagttcaggcgattctcttgcctcagccttttgagtagctaggattacaagcgtgcaccactacacccagctaatttttgtatttttagtagagatgaggttttaccatgttggccaggctggtctcaaactcctgacctcaagtgatccacccgcctcagcctcccaaagtgctgggattacaggcatgaaccaccatgcctggccataaaagcctgttctgttgtttaatttgggtagtactgtattctttttattccaaaaattgtagaattttagaactgggaagatctatattctttagccccttattttacagatgaagttaatggagttactaaaagatggtagacttgtcaacgtaacagtgccccagcgagtaagctattatagtactctgcatttgaaattctgtctataccataaaattatttgggaggaaaaaaaagaggttgctttatcttgacattatctgaataaaagttgctagttttaatatattatcatacttaaactattttattctaataggcaaggtcttagacctattcctgaagcagaaattggattggcggtgattttcatgactacaaagaattactgtgatcctcagggccatcccagtacaggtaattgaagcattattttattgattcgttagcaactttattatgtaaatcgataagctaaatatacgttactcatatacttgctaggggtgaccatattcaccatgttttaaaattcatccatttatactttcatttattcattccataaatatttgtggctgccatgtagcagaaactgttatgaagtggtaaataaaataagaaagatccttgttattataaactttatgttctgaagatcaagatttagtaaccaaacacacacacatggtaagttcagatcaagccaagtataaagacaggtaaaacaaggtgatgtatgtaatagtgatggtagtaggctatttagataggtattcaaggaaagtctcaggaggtgacatttgagccatgtgtcctgaatgatgggaaaaggcagctgtgtgaggatctgggtggtggataattccaggtagaaggaacagatcactcttaggtttgtgtggagaattctaagggtcgacagtgtaagaggagatgtgaatagaatgctattgtggaaatctggatgtgaaagagcctgatgccttggaccagcatggtaatagtagagatgcagaaaaatgaacaggttcaggatatattttagaactagacctggtgggactttccggtggagcagttagaaacaactcctagtttcctagcataagtaactgggtggatggtggtgccatttactgagatgaagaatgtgcattataataatctcagtgttaatcatgaaagccaatgtattcagagacagtcactgtttcccctttattagttaaaacacatttccatagtttttaaaaaaattttttagtaagttgttgtaaaaatggtttatttcttttcttcttgcttttttaccttggagatttttacatttattctctctactaacttttatctaatttgcctagctctcagagcatccattctgtattccttatatatttatttgctccctggatttgttgtgtagttatttcatcagcagctattgaacttgggctaaaagagacaagttagagaacagcactaccagattgcacactccggggagcatcattcactgtagtccattgaatggcaactatggagtcagtccgtgtatctcctgagtgctctgcaaccttggtttaaacaagtaaggaatgtgctaagctaaattttggaaggagttagccattacggcctaatgaccaggaagctattaggtatgtagatcgttagtaaccatgcatagtaataataactgctgtctctggagtgtgcagagactagagtaagcactttaccatcatcaaactttaatctgcaaaacagtccttataagatagagggaagagcatcatctacttttcgtagatgagggaactgacggacagagaggaaattagctggaggtcacatagcaagtaattggttcaagctgagtcttaaagctgttacgacatcacattgcagtacaaatggcttatattttaatgtgtgacgttttgagaaatggtggtgtagggatgattgggagctgatgcaaaagcatagacatctgataaaatttgacaggctagtattttattatttggataagaatgtttattcagctgacatctctaccctgtcccattgagtatactacatatgtttgtgtctgtacataggtaaccttcaaatacacacagtcgtaagttcttgtgaagttttaaatataaccaaatcacttattttggtggaatcgtgatatgattaatattttcaccaaattcccagaattcatccataaagtaaaaagctaaagaccaactcttcaggctcttggcaagggaactttttaaatgtggatgccaaagagagccatattcttggagaaactactgcttccttgtctactagaaatatgctcaacttttagaactagcaggtgctgtagatattattttgttgatagatttctgttctcttacagaaaaaagatcagtatcagtaattttagactttaattacaacaaacatataaaaacggtgattaggtctaagtcagtagctccccttgtctcagcacccatttggggtcactgtcctgtgtttctctgtttagaaaatcaattctcaactagatatatgcttcagaaacaattctgaatacaaacgtacattgtccatgattcagaacattctgggatgcatcctagacatctgagttttttggttggttttgtttgatttttaagctcctgtttcctatacaaactctagaaaccactaaattagaatagtcttgagaagaaatgaactagagaggagtcttcttttatataaaaagaagaagcactcagactggaaactttggacattttttattcttccttttccattttatcaccaagacctgaaattctcactctacagcttctgctcaagaggtctgtgactgtccccttctcacagccagtaccctgtttgaaccctctacatccttctctctggagtgctggttgtattagtaattgccctagtaatggtccttactccagactcatctctacagttaatatttcactatgccactattcaattaccttctcttttctcaaaaattttaactagctcttattatccacagaataaatctccaagccctttgtctagacttctgagtcctcagtagtttagctgcagccttcctcctcccgacctcgccttttttacatagtttctctacagaatatgtgtgccatattttttatagttcccacacttcctcaccttgaacatcatgttccattcctagaatgttcagtactgctcgtcaaaatctgactcattctacaaatgattacctccttcgtaaggctcttctaaattgttttcactcccaactcctccaagtcagatgtaattattctgtttctatgctcagtagcttttttgcattccagccggagtttcttcctactttggatataaccagttgtttccacacctctttcagccactgagtagattgtaggctcttactaatttgggatcccctaacagcagcaagcacggtacttgtttgtaataggtataaatattttgcgtaattgaactaagctattggtacacaagattatgttttccagtgtggagcaacaaaatattgtcacccactgttgaaattgtgtttatagctgaaagggccttagagatcatctaatcgttctattaaaagataaggtataccaaggctgagaaaagttaaggtacataactacttcatggccaagccagttctaaaatttggttttctgactaccagactggtgcttttttctgatgtattatttcctacagaaacaaagtcatgagagtgaattaaaaagtacactgtatgtagtattacttcttgcatattttcgtaggtaggtttaggtgggttccaagtcatagtcctctgataataaaataattttatagcacaaccaactttgggggaacagagtgaatgagtctcccttttctctcctccttcctttgtttttatattcactcttttgttattcaacaaatacttattgaacatttgttatatacctgtattatggcaagcacttgaaataaagaggtgaatagatgagaccaagttcctgcccttatggtatttttaacaaggagaaaattgtaagtaatctgttaacaaacaccagttattttgggtcattagcttattattattattattatttcataaagtcttgctctgtcacccaggctggagtacagtggcatgatcataactcacgcagccttgaactcctcggcccaagcaatcctcctgcctcaccctcctgagtagctgggactataggtgtgcaccaccatgcccagctaatttttaaatttttttgttgagatgaagtctcactatgttgaccaggttggtctcttaactcctggcctcaagcagtcctcttgcctcatcctcccaaagtgctgagcagcagcgagccacctcaccgagcctacattaaattattcagtgatgatatgaacatttataatttttactctttccaaacttatgtgcagctgaaaatgaattctagagatatgtgtcttaaaggaaatgccagtgagcttctagaggtcacatagagaaagtggcggaagtcatttaaatatctgaatttagaattagtagtaaatattaagcacatcctgtgtcacaaggacctagcagaatgataatttagcttaggtgtttagtaaatatcaacttaaaatttttttcagttaatagtgtaaactttttttacatctactctataccaaatattgctctaggtactggtgatacagaaatacacaagacttagtccttattctcaaggatacaccagtctaacaagggaaagtagcaagtaaacaagtgatgataatgataacagctaatgctggcacagtgcttactatgttccaagcatttttctaggggctattttaccctccaaacaactttgtgaggcagatgttataattattctcattttatagatgaggaaagggaagcatagagaagttaaataacttgacacaggtcactcagctagtcataagtgaattttgtttattgcttttttgttgttgttttttgagatagggtcttaggctggagtgccatggcacaatcactgctcactgcagccttgacctcctgggctcaagtgatcctcccactttagcctcctgagtagcttggactgcaggtgtgtgccaccatgcctggcaagttttttttaatttttgtagagatggggtctcccagtgttgcccaggctgggctcaaactcctgggctcaagtgatcctcctgcctcagccttccaaagtgctgggataacaggcgtgaaccactgcacctggcttgaattgttattagaatgatttgcgtggtggtatggaaggagaattggagagcacttaattcagtgtgggagattcaaaaaaagtattccagaagagcagcacttgaactaagttgttcttctggtaagtaaaaagatgaggtaatcattatggttttctggagtagccagaagtttatgtctaagatggttttacatgatttgtttcaaataatgtattccttatgaaaataaaactcactaattctgatttctatagatggtagggtgtatacactttctgtgggggaataaatgtaattttttggcccactgacttaaaacataatttgaattagaatttgcttattttatttttctttcagttgataagacttcagcacaaagtatctgatgtggctttaaaatgatttggtttagataagcccgtcatagatgcccgcaggctgcttatagactgttttgtgtttgttggtaccactcattggagaaaaccatgtgcagtattccctagttaatcccctcagcatggtatagtctaacaattttaagtgaccagatgttcatcttctatctagcagttgtgattctttctttctacttgtgtgatttacaggattaaagacaacaactccaggaccaagcctttcacaaggcgtgtcagttgatgaaaaactaatgccaagcgccccagtgaacactacaacatacgtagctgacacagaatcagagcaagcagatacatggtaaagcttcttcattaccgtactattgttattattctatcaataaattaatagtatattcaggaagtaatgccctttatcaggttgtctcttgagagagaaagcatggaagaatgggataccagggaaaatgatatcttaggacaagggtcagcaggttttctgtaaaggagcggcgagtagttattttcggctttgaagactgttgatctctgtcccagctcctccactctgccactgtagcatgaaagtggccatagacgatatgtagtcattgtcaagagacaatacgtagtctcttaaagacaaggatactttccaagaaatgcttccttacacaattttggcattgtgtgaacatcgaacagtgtgttgacataaacctacatggtatagcgtactgtatagtatagatagcccaggggttccttatctctcagccacggtatcagtccatcacctgttaggaaccaggccacacagcagtaggtgatcagcgggcaagctagcaaagcttcatctttatttgcagctgctcccattgcttgcattaccgcctgagctccacctcctgtcagatcagcggtagcattagattctcataggagcacaaaccctattgtgagctgtgcatgtgagggatctaggttcttatgataatctaatgcctgatgatctgtcactgtctcccatcaccctcagatgggactgactagttgcaggaaaacgagcttaaggctctcactgattctacattatggtgagttgtataattttttcattatatattacaacgtaataataatagaaataaagtacataataaatatgcttgaattatccaaaaccattcccccctctgcccgcaaacctggaacctcaccacgaagctggtcctggttgccaaaaaggatgggaactgctggtatagactatttctcctaggctacacacttatatggcatgttactgtactgatactgtaggcaattgtaacacaatgggaagtatttgtgtatctaaacatagaaaaggtacagaaaaaatattgtataaaagataaaaaatggtatacctgtataagacacttaccgtgaatggagcttgtaggactggaagctgttctgggtaagtcaatgagtgagtggtaagtgaatgtgaaagcctaggacattactgtacatgattgttgccttattagcactacatttagactacactaaatttatatgcaaaaaaatcttcaataataaattaaccttagcttactgtaacttttgtactctgtaaactttaataatacctagcttaaaacatttaaaacattgtatagctgtgcaaaaatattttcttcatattattcgataaggttttctgttttcaaatttttaaattttgttttactttttaaacttttgttaaaaacaaagacataaacatacatgttagcctaggcctgcacagagttaggatcatcgcagtcattgccacatcctgtcccactggaaagtcttctggggcactaacacacatggagctgtcatctcctatgataataatgtcatcttctggaatccctcctgaagggactgcctgagactgttttaaagttattttttttataagaaggagtacattctaatgataaaaagtataatatagtaaatacattaaccagtaacatagtcatttattatcattatcaagtattatgtattgtaccgaattgtatgtgctgttgtgctatacttttatacaattggcagcataggtttgtttacatcaacatcaccatagacacttaataggttgcactgtgctgtcaataggtgatagcaatttttcagctcctttataatcttatgggaccagcatcatatgttgcagtccattgttgacagaaatatcattatatagtgtctgtgactgtaattgaaagtgttgtgttctaataactgtgtttataaaaataagtggcagatcagatttggcctacaggctgtagtttggcaactcctgtcttaggatagtttttttattccttgcaaatgtacatggatgactggaaagaattgttcaacttatttgtaactggtgagataagtttgaaatacatatatttgtattgcgtgatgttgcctatatttgaatgttacttgtaattttgaagatactttatatgtgtctacctagctatttaaatagttaatagttgtccataaagatagtttttctatggttctttatctgaagagggattttgttttgttttgtttttaatggaaggggttagcacttttatattatttgttattttctatttacaaccgtatgttttttattttaaatatgacataatgaagtgttcatattaagatacttaagatatcactgtattaaaccttatttattttaatttttgctacactcatattgaggccagatttaactttttcaagagaaattgttaaggttttggaagttgcttgaatgacagcctgacctcttgtttttgttttttttttttctgtaaaataagaatagcaaaggcagtgtctaatttaaccatactttgtaaaagtaaaaagtatataaaagtatactctgtgcatgtatgttgaaaatatttttctggtaatctaaagttctgttctattctcgagtctgccatctggctgaaataatgatatcagttcatttacagtgacctgaatatcttatatgtgattttattctgattttccatttttaataaaaaggtactataataatataataataaataataatgaaagtaccataatagtgattttacgtgggaataatttaaaatttttaaacaaaacagaaattgcctaggattatcacctagtttaacttataataggctatgctaagttggtattctgtgtgtgtttgtcagtcgtctatagtggagcaacaatatgtgctgtagggggtgaagaagagtaaggtatcatccttccacaggatgcttaggtaataaaggagttgctttcttgggatggtaaaatatattcagtgtatttttgtctaaaaattatcttctaaggttatattacgttagaactatttaacgatctttgtttctctattaaagttgctgtaaacttgattatttaccttgcattcttttctttttctacagggatttgagtgaaaggccaaaagaaatcaaagtctccaaaatggaacaaaaattcagaatgctttcacaagatgcacccactgtaaaggagtcctgcaaaacaagctctaataataatagtatggtatcaaatactttggctaagatgagaatcccaaactatcagctttcaccaactaaattgccaagtataaataaaagtaaagatagggcttctcagcagcagcagaccaactccatcagaaactactttcagccgtctaccaaaaaaaggtctgtttttgataacttctctcatgtctctgaaaaaaaaatgaaagttttttatactgttgtagaatggtattgtctttagtctgttctgattaagtatgcttctgctgctgcagctttttgaccgctttccctctcagaaatgtccctgatctccttcactagagccactagacagtttctccttcatctccttctatgtatgtacttacgtgttattttacttgccgcaattctcttcaataagaactaaccccctgtctcagctctaaaatcacatttctgctggttttccttgagaaccgctctcactccctctaggaccatattccatcaattattttctcaatttccatattttgaatatattgatcatcccagatttttttcttctgttttcaaaagttcaatctcacctttatttttgaaaaccttctcttgacctggtttcttcctctagctactgctgccttttttcttgtgccgtcccgttaagcttctcagaaaagatgatgttatttctcccatttctgtatgaactttggaggacttcttttcttccccgtactgctctttatactctaccttcaggttttgagactttattactgacaatcaacatatgtggccctaacttttcctttaaactttacttcttttccacaggggtttcatgctgtttccccagtaatagacctaaaaactttttctgtcctctcaccaaatgtggttttgttttttttttttagtaaaatagcttatgttgttacaatttttgactcttgtcctctggctcctgaaatcagtgttattgattgttattttcagtgtctgtcaatccctccatttccatctattgccaggttcaaactctgaccacctaaattattacaaaaacctctcgattggttggtttgtccagtaccttggcattaaattagtgttaatagaacattgggttgactgttcttgttcaacatgaatccaataaactcctggagaacagagtcccaggtctttgtgtcctctatgggcttagtacagtttgcataaagtgtttggtatttattgaatgaatgatacagtattgtataggaaacttttagtgatatattcacatagcatttgcagtatacagtcagtaccgtattgtagatttagtcactctgacttactgtcttgaatccatctctcattaacccatcagattgtattcccagggcagttttccctgcccacaaccttactacgttataaagtaagttgctgtctcttggcaacagtttctttgtatttttatatttttctaccttttcctgtaatttatcaactaatgcaacttaagcagagaagatagagatcaccgtactgctttagccacagggtccgtcagttctatcaaaacagcagaatgtatgtgagttctgcactgttttcaaaggtctatttgttgatttccagtaatattgttaataaaatcaagagtacattgtgaactaaatggagggagtgatgaatattgccaaactaaatggttacttagctgtgttcattttcttgttttgttttcttctttttttttaaatctaagggaaagggatgaagaaaatcaagaaatgtcttcatgcaaatcagcaagaatagaaacgtcttgttctcttttagaacaaacacaacctgctacaccctcattgtggaaaaataaggagcagcatctatctgagaatgagcctgtggacacaaactcagacaataacttatttacagatacagatttaaaatctattgtgaaaaattctgccagtaaatctcatgctgcagaaaagctaagatcaaataaaaaaagggaaatggatgatgtggccatagaagatgaagtattggaacagttattcaaggacacaaaaccagagttagaaattgatgtgaaagttcaaaaacaggaggaagatgtcaatgttagaaaaaggccaaggatggatatagaaacaaatgacactttcagtgatgaagcagtaccagaaagtagcaaaatatctgtaagtaacattttaaatgagaggtatagtacatagaagcttagaatgctaacaggtactttcgattttgtattgacagtatgagcatccattaatgtctttaacactcagtactatagaaatttgttggttgataaggtaaatggtaaatgttaaaagtacagtgattcttcagtagtgtaaaataaatgaccacaaattaaactttcatatgagattgttttactagatttccaaattaggctgtactattataaaagacatttggctatgatgataagtgtaggagatgcttcagtataagaaacaggcacagaaagatgaagttagtaaaacaaagtatctactcaataaatttttaggatataacatcactaggaattttcattttcatttaggttttgtaatgtccttgtctattttcatgactgttgataatttgtcttacccactttgatctatgaaaacacctgagattattttcttttttgtatacatcagtaagttgacttatctgtagatttgttagctctttagatgagagcacagacctgatgaagtaaaactttaatattctgatctccaatgtggattcattagctccactcattcatggctgtggtcatcctctccagtaacacctgcagaataaggacaggaataggcgaaaggataggattaagtgaacggaagttatagtttattagctaagcagttgagaacctagtgtgtatcaaggaccttataaatctacaactactattcaaaaaacagaacctatgtcctatttggcctgtgtattgttatcttcatataggcaagggaatccccattatttgttacttcttctgagtgatcctaaatgcccttctgtggaccagctgcattggagtcagctggtaagcttttctaaaatatagattcccaggccagagccccagagattttcattcagtatatctgattttccttcccaggataagttccctcattgggttagctaagaattcctttgatatttttaaaaattctaaaatcagtggcttccgtaaaataggatcttttttcccctataaaagtgtcctggaagtagataatcagagctgcttcccatggtattaatttactaggtgtctgtctttctgctctttgagaggatacctccagccatcaagtctactttccagggagggagaatgtgatgatgaggggacaggtaaaggcctttccagctgaattcctccctgttttctaaggagctttctcagaaacccaacttaatagcttttgttattggccagaattggaaataatttagccactctctatcctcaatctagaagagtctggaaatgttttaaacttggcacattgctgtccctgataaagagttgcatttaaggaaaaaagagagaatgaatgttgaattatcggattccattttgcagccagagtgagaagttcagagacagaggttttttttttattgtgaaggatttaagactactctcatttcacagatgcactaagtgaaacaagagatttgtatgttctataagtcacttctgtcgcaattcctactatggtggagagctaggtaaattagtttaatgtgacatttgttgaaatccaagacatcatttgctaagtttaatacatttacatatgtttataaagctatctttattctgttggtattatggatttacattgttactttagttccagacttttcagaatctgtattcaggttacttaatattacatgtaagtgtttagaaagttaggcactttttacattactttggccacacctttggaaatacatttcccttgctgtgctctcttctcctctgattttctctgacatgttattttctttagtcttcttgtcctagtacatgctttaatcttttttttttttttttttttgagacagagtcttgctctgtcacccaggctggagttcagtggcgtgatctccgctcactgcaagctccgcctcccgggttcacgccattctcctgcctcagcatccctagtagctgggactacaggcgcccgccaccacgcctggctaattttttgtacttatagtagagatggggtttcgctgtgttagccaggatgatctcaatctcctgacctcgtgatccacccacttcggcctcccaaagtgactttaattttttttaagtagctacccccaccccactttttttcccttaaattccatcccagattagtctactgctatggtggccacaaatctatctggaaatggttgtggttttagtctgtaacagccctccttggctcatcctggatgactgctaattaatcttcctgaagacctactttcactgcacattctcccagggcttatgtcactcagggcactgggcattagagcacagacagggaaagacaagaactgagcactatacacccttgacatgggagccatcaaacagtctttcatagaccgaaagaaactttcatttaatatgtaaggtttatatgaggtataacgatatgaggaaatataattattttattttgccctatgattctatagcataattccatttttcctttattttactgtttgagaattcatgacattctaaatgaaaattacagtacaaaatatgttgttgtaggcttttggagaaagaatagcaatttaattgcggtatctctcattgagatacagttggccctctgtatccatgggtcccacatcctctgattttaccaacctgtgattgaaagtatttgggaaaaaaaaaatgcgtctgtacatgtacaaactttttaaaaattattatttcctaaacaatgcaatataacaactacttacgtagcacttacattgtattaggtattgtaagtattctagagatgatttaaagtatatgagaggatgtgcctaggttatatgcaaaatttatgcttttttttatcagggacttgagcatccatggattttggtgtccatgggaagtcatggaaccagttcctcagggataccacagggatgactactacaagttaaatcactgtattccagcactataatatttttagtaagaatctgtaatagctacaaaagtatttctgttttcaatgtaaggttacttttaaaaactgtttgagacaattgtttgtccacatgcagcgaaccctttatctaatttcccctgattgttacagcttgcataactacagtacagtatcacaaccaggaaattgacattgataaaatccatcaaccttactcaatgtggggttgttttaaattattttatttttgttattttaagaatttgtctgaaagtccatgttaatctcatggattaaaggaattggtgcttaatttttttagctacagaagtgactgtcagagaaaaatacttcttaatcctttcatttaaacatttttttggcgattttttgaaggcaaaaaatgtgatacttctctttggtgttggaatccctagctatatttcagaaaggcactttccaatagatgttgatggtagaactgtcatttctctgtttttggatctaaatttagattatagcatgtctgtaagatttcctgtcagctgaaatggaaaactattagcttaatattcctcctaggactttatccttatacgaatgatagctgtgcctgagtcttggccttactttcagtttcccagtctctataaaatgcaaaactgactcaagatccttaacattcttctccttaacagcacccactgtgtctatagtatatttcctcttcacttcattgtactctcctttctcaagtcaagcatttttatatagcattttttcaatacccagtagtaaattcttaaaactacagcattttccagtaccctgtagtaatagctaccacttattggatacttttattatatttacagcaaccctacaatgcagcaattaatatcctattgaacatgtgtggaaactgatagtgggagtttttaagtaacttgccaaggtcacatagctaggtttgacaactcggacttaaacacaggtctgccatgctcttctgactgatccttttgttagctttcactgtgtaattcactcagttattccattactgtaggcattgggcatctgccatgaaaggcagtttgagaagagaagtttgataggcattgaggtagaatccccaagacttggtggtttacttatatgggaaataaatagataggaaagaatataagataatttccaagcttatattctgagtatctaggtaggtcgtatgattctctgagttggaaaatcaaaacttgctcaagaggaagagcaactttgagagagtagggcaggatggggagaaggtacataaaaggagtttgtattctgattatgtataaagggagtaaaatgttctgattgtgataacaactttctgtaaatgatatgtgcctaagtaaaatggcacttgataggcttgaaacatacatttaattctattgattaaaatatcctctttactctgtggggaagcacaaagtacatttgtttttctgccgtttccaacttcatttttaaaacttttaagacttactgctgtattactgaaaatgtgacgtaaaatgttatgtgccccactttgcatccaagagaattgtagtttttactgaaatcattacccatttatgtaatattgttccgtctaggacatgatccagacatgttaatgtgaaagatactgtgactaatatacaaggcagtcttcatttttattgcagacaaatatcttgaacagttgaagtaactgtttcttctttaagtatgatttaagatactattgtaaacttgaattcttttaaaatgtttcttttttgattttaaaagtaatacacgatcgtacagacatgtagaaaataaaacagacagtttgttgataatcctaccatctacagacaaccatggttaatattttggtattttctctttccattttattttgcagactgttagtgcaattttgtagtcattttttaaatttacttataatcattttcccatattgttaaatattctctaagcatgtgatttatatggatttagatcgcttccaattctttgtcctgatactgcagtatctctttcaatatatattttcatctcataatttcttttggaaagacagttgaaagccaaatgcctggtcatacataacatgaatatctcttaagtttttagaaaggaaccattttacacttcatcttattcaaaaggccaagaagtgatagaaacataccattttattactcctatgaacagtattttttattttatttctttagcaagaaaatgaaattgggaagaaacgtgaactcaaggaagactcactatggtcagctaaagaaatatctgtgagaaacgttttattaatttttatacagatttggcttacggggactgtcatctcatcaatttttgtgattttacattcttaggattatttctctttcctaattatggcttacttcatgattgtgccttgaaatggattgatcatggtattattattattattattttatttatttgtttatttatttattttgagacggaatctcgctcttgttgcccaggctggaatgcaatggtgtgatctcggctcaccgcaacctcagcctcctgggtttaagctattctcctccctcagcctcccgagtagctaggactacaggcatgtgccaccacgcccgactaattttgaatttttaatagagacggggtttctctatgttggtcaggctggtctggaactcccgacctcaggtgatctgcccgccttggcctcacaaagtgctgggattacaggcttgagccaccatgcacggcctggatagatcgtattataaccatgatgcagtgaaaagagtatagagagaagccagggtgtaattccctgccttctgctccttaggtatgtggccttgaacaagtcattttcacatttaagaacctcaaatactctataaaatgaggttgatgcttttctagcaggatttatatcagataagagtaatggatgggaaatatttgtaaactctaaaagtttaggctgttcttaataatgtgctgattacattctgtcactatcagatgaacctttttttctgactttcccctttttttttctttttgactgcttttatcttagacctattagcaacttgcatattaattatgtagttacagcagttaaaagaactaagatgtcaaccttaagcagctgtaataatgttgatgtgtaactgactagttaatagtaaatgacacgaagccaagaatctcatccagcaattgaaagataacaggaaggactcttgaggcaaatttaacagctattaatcttgaattaaaaatggcttgtcaattaatgagatagtatgtccagaactgatgattgacttttttgaggtgttaagaataataaaagatacaaactcttgagaatcccaaaagtttaagaaaagtagatgaggacctgtagaacaggatatattataatctcagtgtacaattttaatgaaaagcaaacagtgctgagattttgtgtcaataagatatatatctggaggtaaattgtttactgagatgatatttattagaataactactaggttaaaaatgcttcacagtttttagccttctgtcacagatgagtatgttataaatgtttccaaagtttatagagcatttgagtaagtaattttcttatcttgaattagctacaatttgattccaaatacaaagttcaggtacaagaaataaaacatttttactattttttcaggtatttgaacttttttctatagattcccaaatgacaagtgacttttctttgttatttcttctctttcttacctatccatcttaaccccatttaagaacaatgacaaacttcaggatgatagtgagatgcttccaaaaaagctgttattgactgaatttagatcactggtgattaaaaactctacttccagaaatccatctggcataaatgatgattatggtcaactaaaaaatttcaagaaattcaaaaaggtaggtatttcaactgtatcacaagaggtcagtgtttgaaatgtttttagagataccagtgatgctaaacaaagataaaagcagtttatgttgaaaactgatacttcttctgcttaaaatgctttaaaaaattcctctaggaaggatatgaacttacagttaatgaatatattgaacacctagaatgaaatagatttcatcaagattgaattctttagaggttgctgtttacctggttttctctaccttaagcaggaagtttttgttgataatcacaggatcttctctgttagtctaatattggtctacaactacttgaggaggttctttagctcaggactttatgaagattaaaatgtatttaaaataactaagcatattcagtaattcaaactatagtctatatttacatataaaacacaatataaatatatatgctgagtatgatcatcagacctgagtttctgctcattaaggaactgatacttattttatcagtaatggttaaaaaaagacttctatccagtaggtattcttttgttgtcttacatttgcttcttgctccagacctacttctgactgctagcctttacttatccatttgatcagagtatagtaattactcaaaagtaatttttgtggagaactgctttcctctataacatgatcttgccatgactgtgaggtagtagagatttttctctctactgtgagcatttactattaacatttcacagttaaattagttttttgccttctgtaatagtacctaaagggttctgaactccatttgatgggaagaatctcttctacttagagcagaagatggaaatatcttccacttaaatggcaccactatacctttttgtttaacaccactttttctcaccctatatctgaggctcatgaatagcacaaaggcattcttactgcatggttacttcatgtttaatattgtgttataagatctcattaaatcaaaattcaaaagactttttttatagttttacaaagaaacagcagtaatgtttactactggcacagagtggtttattaacaactgaagaagtatgaagtaatatgaatctctggaaagtggtttggaaatacttaaaatgtttaaaaatactgctatccttaaccaagtaatctgttctgaaactacagaagaaatccaatccaaaatttctataggaagatgtttaactggattgatattaatgcaggaatttgtctgagttctttacatctccaaatcatgctgggcctggtcgctcacacctgtaatgtcagcactttgggaggccaaggcaggtggatggcttgaacccaggagttcgagaccagcctgggcaatatggtgaaaccctaactctacaaaaaaatatataaaaattagctaggcatggtgatgtctgcctgtagtcccaggtactcaggaggctgaagttgaaggatcatttgagcccaggaggcggaggttgcagtgagccaagattacaccactgtgccgggccaggtatcagagccccagcaccaggaagtggtcaacttgcgggttggtgaaaagaatttaccgacaacagtatagatttggaaaaggaaagtttattagaaaggaagaacactgcagaagaatgcagaggggtgcctcagcgagaggactgagcacactgtggcggattgtccttaggagcatttatggaccttaaggtgggagcttgggattgtaaaatgagtttcaccatggcattccagagatgtataaaaattttagttacttataaaagttgaaagaggcctggaatcagaagccgactttagatactagggaagtttgattacttctaaattacccagataaggagttttgcctccagttagcctgtttgatggtcaccggttggtctttgcccccttctaaattgcttagagaagaagttttgtctctggggcctgttccatggtcaccaggtgattttctctctcctcacactgcactctccagcctaggtgacagagtgagaccctgtctcaaaacaaacaaaaaaccctccaaatcaatgacatagcgttttttaaacttttaaaatactgcttaggggtgaaaataaatttaaaattctctttctacttcatatattggaattttaaaagcatgttacaaatattaaggaactgttactattaacaatgttattaactaataacaagtattaacaatgatcttgatgggcattttcacatggaattttcttttcttaaagcacctctttactagtaaacaattaaaatatcaattagaagtataaattgttggcatccccaacatctcctgcttggactctgtgaactggaaagttttgaaaaagatttaaattttcatcaatattagaaagggcttaagctttgaagtcattagaacaaaatacagtgctttgaattgtagtgtttgtgttcatcttgagttgctttaattgttaaatgataaggtaaggccattttaaaataaaaactccaaatgaaaagtgttaaattatttttaatacataaatcccatgacatgtccagatctgtatatagtaatagctataaaagaagggcaaaaacagatgggtttagaacagagttactgctctcacttttatttgtagaatataaacatctttggcacttatgcatgatttaccatctttgctttttaatctttttaaaaaaatggtcatttttgtttgttaatatgatttactgtactacttttattattcaataggtcacatatcctggagcaggaaaacttccacacatcattggaggatcagatctaatagctcatcatgctcgaaagaatacagaactagaagagtggctaaggcaggaaatggaggttagtaggaagtgaggcccagaaacttgcttaaattgcactttggtccattatggtggccttcaagcaaattcttcttaaaaccaaattaaaataagtgacataaagtcattcattcaggagcattcctgagttacagagcattaatctatacccttccataacacttctttaaaagaatactaaatttatttttgttaaaaaaaaaaaaaaaggtgagacctaagaaattcagtttacatcctaatgaaaagggggagataaaagccacaaaaatttaagggaaactaaaagaatgtggaggatattacaaatatatcacttaaatgtatgtcaagggactggcctttttaaatctggggattgtgttttaacaattctgaaaatttcttattcattctcttgaatattagttacctttttactgttttccccattatctccttctggaattccaacttaacgtaagttaaattttcttttccatttgtctttcctgtgtatttcatttctttgtttccctgggttatatttttggcaactgctgcagatcatcttccgatttactactactgtcttcaactctagttggcattgcatccgttcatttattttttcattactggaagtctgttttatttctttctaaatcttcttgttccttgctgtttttcaagcttccccttttatattatttgcctaatgataccattacctaaaatgtttgatctgttttctgctcttatgtaccttgttttcaagtttgtgctttgtgatttttgaatatgagctgattgttttctttgtaactcgatctgtagggttttcttgagtattaagttcagatgtatttcctctagaaaagatacgttttctatcttcgagtcttctaccaatatgagaccacttcaaattaaaatctctccttgtgattctttgaatcacccagacagttagtatgtattaatatttggaccagaagctggagtgaatgaaggctggcttatcattagaaacttcaaatgagatttttatttatttccttcactaagtgccagaatgaagatgggcaagtttctttcctagctccttctgtgttgtaaggtttatttctctttcttcttttagtgctgggtcttttattaaagtcaacatcttgggttttctttcgtatcactcataccccgtatagacattaaagcagagttcaggtttttcatgacttgcagatactcatagggcaaggcaaaagctgactgtggtccttgctaacctctcagggttccttattttgctttatagtgggtatagtgtaattcacttttaaaagtgcttttttctcagttattttaaaataagggttatttaggaaagtcacttatgaaagtagagttgttaaggtcactcaggatacttatttttaaaaaatgaaagaatggaaatcacatcctttctccttttcttttttgaaagaataattggcttattttgtaacatgtgcattccacagaattatggcagtacacaaagaatgaagatgtgaaaacctaaagcccagaaattacctatttaaacagttaagtgaacaatattccagacatctcttcattgaggagtagtgagaggcagggacagactgggaaggaagagagagacattgataggaggaagttaaactgaaggcattgctgaatttctataaatgtttcttccctccaagatattttattttgtgagatctgtctaatattaaggaggaaaactataaaaatcactgtaagtcggaatgggtagttttaaacttcatattaacttcacatacaattatttgttggctcgctacagtgaaaagtgaggacattattagtacttcctcccacctagcctcccttaccttatgccagtcctgtttttccctttttaggtgacttgcatgcatgaccagtcatctttcttaagctcgaaagccagtaacactcagaatacatctcagtgttgatcattctccattagtttttcctgacatatagtatgctgttttgatttgcaggtgtaattctctttctcaaggaacttttttctattatatattttaaatattttatatttgctgggctctctataagacatttaagacataactatcctttcattggattacctttgtcgtccacatctattttttctgcattcactgtggttttcttaggctctttcactgtatcaaaattttacatttcaggtgtgtctataatgtttctcaccaagtatgtgaccttaggcaaattacttaatgtctctgcttccatctgtgcagaatgagaataataatagtacctttatttcacagacatatgaggattaaatcagatactacatataaatcatttataacagtgggaagtgttagctatttctaatttaattctgaaaggctgttattatggttcttttacttagcatttgttcttttttcatttcattgttctattatctgattttttgtcattatttcattgctttcatgtttctattttactttttattcgtggattattatttcctgcagattaggttctttatctgttttttgcatgttctgttccaatatccctttttttttttttcctctagtagatggagtagcttttctgttttttgccttcacttgagtaaagggaaatgtcttttccagatattctgtttgctacataaaggatcatatgccatctcatgcagggattacattcagaagccagtttgtgagacagaaattcagtataatcaaaattacttctaacattcttgtcttgcccataagaacagaattcagccaggcacaatggtgtggctcatgactataaccccagcactttgggagcaggaggatcacttgaacccgggagttaagagtagcctgcacaacatcttgagaccctgtctctacaaaaaaataaataaatgaaaattaaacaaacaaacaaaaaaacacaacaaattagcgggtcatggtagtgcatgtgcccatagtcccagctactcaggaggctgaggtgggaagattgcttgagcctgggaggttaaggttgcagtgagccatgattgagcccctgcacttcagccttggtgacagagcaaggccacatctcaaaaataataataataaataaaataaaaattaaagaacagaattccctcatgcctcactgtcagtatggcattatgctgaaacagtcagtggcacatggcatatcccatctagtttctgttgtctgaagacattgaatctgggagaggaaaggctcagctggagctgtgtgcagcttgggctagctgtctcctgggattttaattaaatgtcctataccagggagtgtgccctatataaaagagaataacctagcattattaggttgtttacctaatttgttagggatccttggagcctatgtgtttggtcagtgtcagccctgcttctttaccttctacaccattagtcccttcccagcagcccactggcagttgttttccctgttcaggttaccttttccccaaatttggggcattagtaagaatcctcaggtttgaccagttgtgtagcacttttaatggattgagacagtattaggaatcagctgcatcagaatcatttggttctttttacagctgcactttttaagcgtatggcatggcttaaactcttctccttgattaattaacactgtcgagttttgtttgattaattttagatgggagaagttgagagaatgatgatacatcatacagctgctgacttttttctattttttttttgcttatttcattaggaattagatggactgtgttctagatgatttcaccaaatcacttctctttttgctagaatcattttagttgctattggtaggacttactctataacagacttgacttgcttttgctgcatggctactgcttatttatgtaaatgttctgtactgccatctcatttccctgtttgctgcagctattctttttctatattccctccctatttttctttttcatcccttctttctctacctctgctgcagacccaccagtcttgattttcataatcactgcgtcagttcctgaagttcccttgaatttaggatattttcattgtgtacatcaaacataaaaattatttgaactgtatccaacctgatttgaatttgaaagactgtgagtagtagttatctcagacctctgaaaaatgccagtaatatgaggcatttctgtttcttaatactattttatatgtttttactgaaatatatgaaataaaactgctttctcctcagtggtttttccttactatgctacaactttattccccaggcaacctctaagaatgtttagaaaaatgttgccagtagttattttgacagctgttttattaaaatgatgtcttcccatttatgttttgctatccctattagaaaatatgaaaagataagatgtaattttgtttcactatatgatagaaaaatcagtctgtaagatcgaatccctgcaagtcactcttgtaggcttgctctagagattcagaagccctgaggcagcctcgttaagagctggtgctcttaataaggtagacctggtcaaatcccagctattccatctgagttcccctatcttctgcaggtttacctaacctaagtctctgttacctcattggttaaaactgagataatagtataatagtaatgaagttacatgaagattaagtgagatttcatatatatatatacacacacacacatatagagagagagagagagtttaagatagtatctggaagcattcaaatgtaaattagtaacagtaaaaataaacacagtaagtccttaacattgtcagtaggtttttggaaactgcaactttaagcaaaattacataaccaatattttttctcattattacaacaaaacaacatgattcaaggaactgctgtatgtcatctcacttacagttgcagtttccaagaaatatcaaaaacattaagtcaggacttactctatctgtatttaaggaacttctggtcttttagagaggatagggtacaaatataaataattataacagaaggtagaaattgataagcatcctgggaattctgtagctgaagttttgggagagttcttcacagcaggcattatttttagaagaaggggatcaggaagcctttgctaaagaggggaagaacatgttccttgaaacatagtaggcactaaataagtattgaatgaatgtacctttaaagatggttacatgtgggaagagggaaaaaaaggaattaacttccttggcagagggagaaatatgaacaaaagcagatagagggtcacaggatatttattaggagatgattctggggttttgttttggttttgcttttttcttttttgtgtgattcagttttaaccggcatacagagtccacgaagaggaggctgagaagtgattaggaaagtaaaatggaaccaggttatgaagagccttgcacatttcagcgggtcaaatgcaagggcttgtgttttccttggtaggtgggagaagtcacgaagggtttcaaattgcatatgataagggcatagctagactttaggaagatgcactcagcacagggagtttttgattctgactctgtaaggtgctgtagaagtttagtgagtttgtatttaaaaggacttcagaggagaggtaatttagcagcagcttctaagccctgatgtgggaccaagaacacaggagcctctttaactgtggagctgctctagttgaaggtggggtaaatgttgccctcttagtctcatcagtggtctgacccccaagcactgaaatctcatttagtaaaagggttttgctggaaagagtgtttaaaaactcagcaagctagcaatatactattggttgtctttgagtggagatgggtgggagaaagctgtttagttagagctcttttgtaataatcttagcatggattgaaaatatagaggatcagttgaatgaaatattgtagaggcaagaactcagatgtggtgacctccaggatgtggaaatctctaagatgacagtgacctatcactatagcaattcattaactatatattcaccactgagcaaatgtttgaaattatgttaattttgacaggtacaaaatcaacatgcaaaagaagagtctcttgctgatgatctttttaggtaaagtttgattcacctttctcatgtacctttgagagatgtatataaaatttagttctgttcatagaaattaagaatttgtttcttctgtcctcatagacacctagtcccttcacctaacacaagtgtttatttttattacttaagcacctctcaattgggtttattggctatagcatcgaggtttggggttaagttataagatacttaaaatttgtatgggggcattcaggcaaaaagacggttcccgaattgtgtgaaattgttgtatagatttgtgagatttttcagctctgagtagaattacgattgagttttgaattaagacaagtaaaatgccagaccatttgtttagtttttattggcacatgcataaaaacaaaaggctagattaaagtttcaaagcaggtttttgtgggaggttttagagttgtactttgtgattataatttaattctgatttaatacattttcagcattcctgcaggcctaacaaacctattataataattgcctctgaaatactaataaaatactatattataggtagatatcaggggagaagacagaatgaagaaattatttttgagtctgttttgcagccaattagattgattctctaatttcataactgacagtataaattgctggtaaaaatgttgacaaacaggccgggtaatcctagcactttgggaggctgaggtgggcggattacgaggtcaggagttcaacactagcctggccagcatggagaaaccccgtctctactaaaaatacaaaaattagccaggcgtggtggcatgcacctgtaatcccagctactcaggaggctgaggcaggagaatcgcttgaacccaggaggcggaggctgcgtgagccaagatcgcgccactgcactccagagagagactccatctcaaaaaaaaaaaaaaaaaaaagtgttgacagacaatactggtttttcattagtcaaatgagatgggttgttcagccatatttgtttaactgctgtaggagaaaatgttgtaaagtgctaattacatttaagtagattatgctcttttgtgcaaatgatatgcttttattatggggaggaatggggatctttgaagccatacagaaagaagtgtaaacataccttcatttttaaactgttttcattaattattttaaagctttaaaggatttttgttattgttgattttttttttgtttttaccatattttcatcaaagcaacatcaaagggatacatgaaaataaaaatgtcagtgcttagtatctgatcctaaggacaaaattgtcattcccatcctatttgccaaagtgtgactacagtttgaaagttctttacctttaaaagaaataccatcccttatctaaatatcatttaaccccatttctttctttgcagatacaatccttatttaaaaaggagaagataactgaggattttaaaaagaagccatggaaaaacttcctagtaagcatctacttcaggccaacaaggttatatgaatatatagtgtatagaagcgatttaagttacaatgttttatggcctaaatttattaaataaaatgcacaaaactttgattcttttgtatgtaacaattgtttgttctgttttcaggctttgtcattgcatctttttttcatttttaaatgtgttttgtttattaaatagttaatatagtcacagttcaaaattctaaatgtacgtaaggtaaagactaaagtcacccttccaccattgtcctagctacttggttcccctcagaaaaaaattcatgatactcatttcttatgaatctttccagggatttttgagtcctattcaaattcctatttttaaataatttcctacacaaatgatagcataacatatgcagtgttctacaccttgcttttttacttagtagattaaaaattataggaatatcaatataatgtttttaatattttttcttttccattatgctgtagtcttacctaaactctggtgatccaaacaaaatggcttcagtggtgcagatgtcacctacatgttattctagtactagaaactgaagaccatgtggagacttcatcaaacatgggtttagttttcaccagaatggaaagacctgtacccctttttggtggtcttactgagctgggtgggtgtctgttttgagcttatttagagtcctagttttcctacttataaagtagaaatggtgagattgttttctttttctaccttaaagggagatggtaagaaacaatgaatgtcttttttcaaactttattgacaagtgattttcaagtctgtgttcaaaaatatattcatgtacctgtgatccagcaagaagggagttccagtcaagagtcactacaactgattagttgtttagagaatgagaaatggaacagtgaggaatggaggccatatttccatgacttcccttgtaaacagaagcaacagaagggacaagaggctggcctctacatcactctcaccttccaaatcttgtggaagtgcatctacttgccagaaccaaattaacttacttccaagttctggctgcttgcaggtggaactccagctgcaagggagttagggaaatgaaggtctttttttaaaagcttctcagccttcctagggaacagaaattgggtgagccaatctgcaatttctactacaggcattgagaccagttagattattgaaatattatagagagttatgaacacttaaattatgatagtggtatgacattggatagaacatgggatactttagaagtagaattgacagggcatattagttgatgaaatggagtcatttgagtctcttaatagccatgtatcataattaccaagtgaagctggtggaacatatggtctccattttacagttaaggaatataatggacagattaatattgttctctgtcatgcccacaatccctttctaaggaagactgccctactatagcagtttttatatttgtcaatttatgaatataatgaatgagagttctggtacctcctgtctttacaaatattggtgttgtcagtatttttcctttttaaccattccaatcggtgtgtagtgatgtttcattttggttttaatttgtatatccctgatagctataattgggtcatagaaattctttatacattctagatgcaagtctcttgtcggatatatgtattgagatattacacctagtctgtggcttgactgttttctttatgtcttttgatgaatagaagttttaaattttgacaaggtcaaatttatttttttcttttgtttgatattttttctctccaatttaaccccaagatttcagatattctgctctattatataaactttatatttttatatttgtgatctaccttgaattgatatgtatgttgtgaattatggatcagggttctttttttcccccatacaagtatccagtcattgtaacactgtttattgaaagaattatcctttcctcattaaattaccttgccaattagtaaaaaatcaattaaccataatggtggatctgtttctggactttctgtttggttacactgaaatgtttgtccatccttgcactcactcataccatactgccttgaattactgtagctgcatagatgctccttaagttgggattacattgtaataaacgcaatgtaagtt

SEQ ID NO: 36282 - DNA, 33416 bp, Homo sapiens
gtgcagaaggccgcgctagccggctcttcagcagcgagtgcagattgctcccccgcggccgcagatctcccgtttgcgccgcgttcagctgctcccgaacaacttttctgccggcccagaggccccagggcgtcgcagcgccgcgtgcggcccactcacgggccggtgagtacttcggcgctggggcagtggcgcggtggctgtgggcagcgcgcaggaggcgggcaagagccctgaggcactgtcctcttcgggcctcagtttccccttccgagctgatgggtggctggccccaaagtcccgacaaggtccccgaagttggagggccgggggtcccgcccgctctgcaacgcgcaaggcgacccctgttccgggcccgaacgggtcacccggggggcgcgccccggtcccccgcgcgctgtcgcctggagccccgccgcgggcgggacagcaggcccgagaggcggagcggccggcgggcaggccccctccccgcgccccgcgccatcccccccgagttgccccgtcatgcccctcccccgcggtcccgggacccacggccgccctcggtgcccgcccggccgttggaacgcgcctgggcccccgggaggtgttgtgggggggaaggggggttcagtcccccagggggacccggcccgcccgaggggcagcttaggggtcattctgaatccccacagcccacttaggagcgctgtggcagttcctctctctctcggggcccctcagtagagagttgaggggtttcagtggcagcacctggaccctgcctcgtatgaactccaccctctggatcattagctttttgtttgatcaacgaaaactttctggagaatcctacccagcccttttggatgtgatggcgccctggcctctcacccacttagcagatgatgttatgaattccaaggaagtcgcatttgtgcaaccccccaccacccagatttaaccctctcagtagccttaggcggagaagttatagtccccgtttgacaccccaggaagctgaggctcagcagggtttggtgccagcccaggaccacgaagctgatggggcagagcctggtgtgaggcctctgccctatctctccagaagcagccccgtctctcctcaccttggacagtgacccctggcatttggcccagggctttgcagtttgtaaagggctttctcttatgccagcatccatcactcaaggagctgtgccctgggtaccccatgtgctggctgcctgttctctgcagcaggagagggagcccacgggaagcccagaggccacctttgtcactgtcgccacctgtttacttctgtgtccaagggtctgtgattcccatggggtctccgttgtatccaaccagggatttggagggaggcttctccacatttcagcctcttttccctacctgctggtttgtcctcccttcgcagacacaggaaaagttggctgggagaccccatctcaccttctttcccaggatggaagagcatggagggcgtctctgacttaggcctcccctgcccatcccggaccagtgctggacaggcttctggggctggtcacagaggggacctcagctcagtctcaacccccagagatgtctgcactgccagacagacccgaaacacccatccttgacggtggcaataagaatcataataggtcgggagctttatgcctacacggctcccctcccctcccacttccctacttccggaagtggtaccaccacagccagccagccccagccacaaaccagaccaccccctgtgcccttcattcctcactcccagttgggtctctcctggctcctgagcctcactcggatgcctgccctggttcaggaccctcgcctctccctggacgacccccaggctcctccctggtcccgatccgggcctggctgcacgcagccctgctggttcttcagctgccacttccctctgggctatcgggtcaggtccgcctcccgagccaggagccggcattctttcgggccctcagggacccgcctcgctgctcactcagcctctccctcctgtgtcctctctccagcagtcacctcccagccacctgcgtgttcctggccacaagcctggctcactgtccctctgctgcctcctcttctgggcacaacccctgctggaatgcccagccacctcccagcttgcctggctcctgcctgcttgtccagaaggctcagtcaagtcctcctgcaggatttctggcctgcctcttcccacagtggagtgagggcccccttctgtgccgtctttgtgggtgtctgtttaggtgttaacccttcccatctagatgaagctgctccaatgctggccctggacaagacttctctagggcaggggggcccagcacagtgcttggcacaagatggacctaccctcagtccacacctgctgcccatccaggccaggcctggagcaggtgccaggtgtgtggtgggggcttggccactatggccgtcatgaatgctgcttggggcagtcccaattcaaacccctctgttcctgtgaatgtgccacattggatagagctggaatgttccttggtttgtcccttaatactctgagcaaaaataggtacctgggatccatcaagggctttgtgcccttgtcttgaggagcagccctgtgccagggggctgggtcaggccaggccagagcagacatcccagggccaggacctcctgggcctgctcccttagagcttgctcacagatgggttttaaaataacatttgctttaatttcaaaaacatcacacattcattatagaaaactagggaaatatgtttaaaagaagaataaaatgaaaccgcgcataagctttatccccagagacaacaagtatcttttttagggggcgttttcttccgttttttggcagataaattttgttttcatcctaaacagactccggctaatatcttctgctgctttaaatcctgccttaacagtgttaggcccaccttttccttgtctcaaaacgttcatgtacgaggtcacgtttaccagctgtacagcgttgcaccatatggaggggtgtaggctttatagccagcccctttctggacagtgctgaaagtgccatatgatggacattgtgtgtgagccccgagggcatctccagtgactcccctggactggcatcctggaggcagaggcactgatcagagagagtgaacatcatcttggcttcccacaggggctgtttctgaggcactggcttgggagatggggttgcccccccagagagaacagaatgggggtggcctgggtgagggccagagcccttagggcagaaggccacgtgtggtcattctgctgcgggtctgagtggatgcatggtgcctgcagccctctccaggtggcggcctctcagctgaactccttggtgccggtgtttgtgtttggacgggataaaaatatgcctcattgctcatgaggaaagaatgctagcaactttggttttgtggatcttacacagtgacggcttctaagccattgctgtggtcaccagtagggagttggggctgagtgccccaccgtgcaggtggggatctgagggtgcagagtggatgcagctggagatgcctggatgctggggtctgggggagggacttgctaaggtcccacagcattattgcctggatggtgctcctgccctaggccaggctgcctcaggcttctgcccacatgcattaagtgcttaacgtattcctggcaaggcagccggtcttccgagtggataagctgcagccctgccctcagggctcacagtggctgtaacatgcaggaagactcagagagggaaggaccagacagcaggtccttccaccgggagatcttttctgatcttcattgtccctgtgaccaaccatgaccaggaattgttgtgcttgttttgaaataacaagccctttgatccaaaccagacttggccaacccccagggaacctgaaaattaatcctcctgtattcatccattcttactaaccagagattttactttaaacagtttttttttaactgcagtgtgacatacatggtacataggccagctagaatctgttttcctgaaattccttttatgaagtgttttccaactgaacatgcctttgtttagcacctgggagtaatggcttagggtttttcttttcctttttcttttttcttttttttgagacggagtctcgctttgtcacccaggctggagtgcagtggcgcgatctcggctcactgcaagctccatctcctgggttcacaccattctcctgcctcagcctccccagtagttgggactatcggcgcccgccaccacgcctggctaatttttttgtatttttaatagagacggggtttcactgtgttagccaggatggtcttgatctcctgaccttgtgatctgcccgcctcggcctcccaaagtgctgggattacaggcgtgagccaccgcgcctggccggcttagtttttttttaatgcccaatagtttgctttctcttctgccacacacgtaatccccatagcacccctatgtgggaggtgctatccccattttacatatggggaaacagacacagtgaggtcatgtggccactagtaagggtaaccgacgccccacaccatgttgcttccagctgtaacctctagcagagggagggctctgatggagaggtgatcgcctgagtgctgtgtgtttacctgagtaggtgaggaagacagggactcgggacagacatagcttggaagctcccacaaaggaggtatcgctggagctcttgacttgaagggtgcttagggtctaggctgggggaggggggtaagaaggcattccgggaagagggccctgcagaaacagaagtgtggaggtcagcatttgtatgctgatgttgaagggtagccagtgttttgcagtgaatgggccccgggagagagggtgcagtggcatggcggtctgatttcaaagtcgtctttttcagaaatgagcttgcagaagcattagaattgggcaggtctggatttgaatttcaggtctggtacctggagctgtttgaccttgagcaggtccctcccctccctgcacctgggttcctgtctgtgaagtggggtgaggttgaaggataaaacatttccccatctataactctgggatgacaataggatctaccttccaggtccatgcgaggaactcacgacaataggacctaccttccagggccatacgagaaactcatgagaaaagacaagtacagagaacagagccgttggtcttgatggcagagatgccctggcgtaggtcagccctcagtaaaggtgccctctctctctgtctgagaaagtgacacctgacttcggggcagtgggaaccatgggagagaaggtagacaaggccacgtgtcatttgaagacctgacttttcaccatctcaggtggtccggtggcctgcaggaccgtggttctgtttgcccacagcgtgtgggttctacgtgcgatcctgtatttctctgccacagctgactaaggggacacttaggtctgcacgtgcagttaaatggctgcttttgtggaaggtgccagttcccgggagctgggaacttggaaacaggatggagcaggctcccaagcttgaccatgcatggtttgcacctgggggatgcacccgggggtgcttgaccatgcatggtttgcacctgggggatgcacgggggtggggtggggggggggggtgtgcttgaccatgcatggtttgcacctgggggatgttttacactaagggctcagtccctctgagggaggaacgtgtggattgaaatctgcagagttcttgagcgacaccagtctgatctttaggactcatttgcagcgggaatggagcagaaattgttgtgtgtggagcctggggccactcctgactcttccagtcacagctgcccccaaaagtgacctctgggcacctactcagacctggctgctcagtgccaagcgctgggtgttcagaggtggccaggggactccctcgtgctgcccatggtgtctggtctcactggtcctcacagttgccccgtccccattttcagatgaggaggctgaggtgcagagcgggatgtgggctgctcaggaccacacagctggtgggcacagagccaggagtacagcgctgcggcagcttggggctgggagcgagactctctgttaccagcctctccctgctctgtgcctcagaggatggctgtggccctgagcttgggagggtcatttgggaatctgaggaaaagtttccacagcctcacacagcagcaggttcaaggtccagcagtgccaggggtttgcatcccacccctaacgccgctcatccagggcccatccgggtccggggctcgggatcctgcagcgctttcagctctgtgtctgtggccggtggttgtccttcattacagggatggtggtgtttttccatgttgctaagcagcatgtgagggcctctgttgaataaaataaagcccttgctccggcgtgacacgggtcacgggatctctgctcactctagtctcttctgatgcccccaccgcactgtttgccttagtttgctttttactctctgtgttggtttctggggcatcagtcctctgacttcggtgctgtggcttgggcctggggtgggggctgtggagcggcagatctgggtatgaatcccagctccacccatttggctccctctcttctctcccctgccctcttctcccctccccagctcccttcccctctcatatttacttaactttactcagtaccagcgtattagttttctagggcttccgtaagaaactactggaaacttggtggcttaaaacaacagaggtttgttctctgatggttctggaggcagaagtctgaagtcaaggtgtgggcagggtgggtccctcctggaggctctgagggaggctcagttcctcgcctctgtccagcttctggcagtggccagtggtcctcctgctccttggccactgtcacccgtctccgcatggctctgttacacttctcttcctataggccatcagctcttggagccagggcttccctactccaggctgatctcatttcaagatccttaaatacatcttcaaagacctgtttttccaaataagggcacattcacagacattggtgggcacatgatgtggggcccaattcagccccctgcagccaggctccacatgggtgggctctgggtgttgctatcatcatccccgtttcttggatgagggaaggccagggttgtgtggctcatgcccagtgaggcagggactccaggcctcggcatgtgcaggtctgagattgtaagtgccatgccatctgtagagtcacgtgggtgagtgtcctcccatggtttcctccctggaagcggtgctggcccatggggactgtactgagtgtcagcgagatcctgtatggagtgtctggcagctcccacctgcctccctctgcttttctgtctccagcagacactaagtgccagagcgggctctgccggtgctggatgtgcctgaccttgacttttcttccaggcaggatggactccaacactgctccgctgggcccctcctgcccacagcccccgccagcaccgcagccccaggcgcgttcccgactcaatgccacagcctcgttggagcaggagaggagcgaaaggccccgagcacccggaccccaggctggccctggccctggtgttagagacgcagcggcccccgctgaaccccaggcccagcataccaggagccgggaaagagcagacggcaccggtaagggagcaggctgggaagcccaggctggggatgttcagggatagctgggtgggaacggggttcagccacccctggagggtccccccgccaggtcctctgcagttcagcattgtgcagctcccatgctgtgcacaggcgtccatccagtggggctacccacctcctcagagccttgcacctgtcacctttgtggcacccactcgaggtggtgctggtgcccccactcctctgcagtccttctcttcccagggcctctgcagcacttcacagcttccatttgcaacagcgtccaaacatgtggagtaaattcacgggccctctgtaaccaactagggtggcaggccagaggtgacagccacactctcgggagtgaggccacatgcgggcgaagcccttggtgctgagtttcccctctccctgagggagacttgtgagggacgggcgtccttcacctccatcctgaggcgggatgctggggccctgggtgttcacaggcagagctgactgaggcccttggtcttcacaggccgagctgactgaggccctgggtgttcaaagcagagctgaggcccttggtgttcacaggcagagctgacaggcttgttggttcctgggtggtgatgtgagggtggtgggtgtgagccaggggagtccggcccctgggcaccttctccagctgactcaggcctcggtcagccttcacttttgctagagaggccgctgccagggaggctcagtcccagctcatcactgcccctcctgcccatgcagaagccccagacccatggtgagtgcctgctgtgtacaccagccttttccatgtgcctgcaggactcctcatggcagtcctgagaggggaaactgagacaccgagtctaggtgacttgcccaagagacccagcgggtgagagacgaggtgctcgagtggtccaggtttccttcttgtcccagtcaccccactggcagggccgtggggcctccctgctgtggtcgcagcgcgctgaggctcccatgtaccacttatgctgggcgtgcccttggaaactcactgcagccctgggccctgtttgtctttgcatctccttaaaagatcactgtgctcctctgctttgttttggaggcctctgggcggatgagggcctgaccccgggatttgggcccagcctcacggcttcaggggaacagataccagggctcggaagcttggtttcaatctgggtaatgagaacagcccgcaaaggacagagtccaagactgtgtgtttcagataagaagagtcaggaagcagctgtggtttgtttggcttcggtctccaatgtgggggtggtgaagagcaagccctgggcgccgcctgacagcccagtccccaccactgggcctgcagctgggggcagtgggcatcccgtctcccagtcactggtcactgatgtggccaaagcaggcctggccctgcatgcccagtggccgcagggagggcagggcccagggtccctgccagtagcagctgctgcgagaatctgttatttagctcccccatccagccaacataggtgggtgagcatcagttgaaataccaataggtaacaacaagggtagctatttaactgacacttccccgagctaggcatctttttagggcattagcccacttgcctctttaacagccctgggaggcaggctctgctgctgccctgtttttcagatgggaaaccgagggatagagggcttaagtagatgacccagcgtcccgtggttggtgaagggtggaggggagatttaaacataccgtggagcctgtgctcactatgggcctcaggtcatctgcgcccagggatccccatgtcccaggctcagagaagtgcacagagcaggttggcctgtccctagatcagtgcctggccaggccctggtgacaggagtgaaggctcagtcctgccctccgggagccctgagcaatatgggagacaggagtgaacaaggaactacattctggggctcatgtagcgcgggggacaacccacattgcagtcccctaggggcaccccaggagggcctggtcactcttcagggcatcaggaagactgcctggaggaggcatcgtcggagccccatctgagctgctccttggcctgtacacttgggaaacaggagaagagcagccttggggttgcccttctctggttgcctccctgaggaactgacccccttttcagcccttcattcagcaaggctggggaggggctgcttcagaaacgtcactgggctggagccccacacttccttcccatcctggctctgtggccttggcaagtcacctgccacctggggaaccactgccaacgggtcggggcttggaagctcaggggctcctgggcccagacaggtaaaggaaacagtgactccggctagaaaggagactgcagggagttgtgaggctcttgggcgtccctgtgccagggcgggactcctcatggcagccctgagaggggaaactgtgtcctgtgtggagcgtggatgcccacgtgctgagaggtgttgtctgtcctgatttttgacagcagcccaagtgatgtgccagtgggccagggccggcacctgcctgtcggtggctgccccagggctgatgggcaggggccgtttcttcacaggcagctgtggtgagtcctgtgatcacctcagtgttgtctccagccctggggggatctgttgttctgctcaacaagagaataaagctgggcttgtcacacctggtcccaggtgacccagcaggcacagagaggtagagttgacaccaagcctcactcagccaccgtgacacggctgtgcgagtccacgccctggcagagagcctgttctgggcctgttctgtttagccctggggctaaagggcgggctcagatgcacagagggacaggcctggtgcaggtgggaggaaggaaagcagactgtgtcatcgtctcagcttcaggctgggcatgctgtggctatcatgtgcttggcctgtgctaagtgtgtgctaagcatgtggccctggtgggcactcaggcctcctgggtaccagccgaggccccaccccttcccactatgcggccctgagctctcctgctgtctctgtcattcacgggtctaccagtaggacaaggcctggggttggtggaggagggaaggaggtgagattcgggagctttccgagtcgtacccgccactccgtctccgagcagcagcactctcatctctacaagtctctacagcagtgctgccaccgccttgaccagggaatcaccctactgtgaggtggcccagctcactgtgagactctggggcagtcatatgccctttctgttgaccccagtgggtggccagcccacacgactgctgaatctgccaggcctcccagccattgggggtagggggattgctttggcagccacagggacacagatgcggacaggagcaggagccctggggaggaggtgcaccccaccaggaagcacccaccaatgctgactgaggctgcactgccagttagagccgctgggcgagggacaaagaagggccttcgggtgtggggaaagcaggcaccccagctcctacactaagggcaccctgggcagagagggagcccagtggggggcacccaagacccatgaggaattggctgtggtgtcaagaggtcagccaggccaagcagggccctgagggtcagggaaaggagagggcattgtcgtgagtggggctcagctgttagatggattgtttacattaaaggccagccaggaggcggagcagagagaggagtagccaggccacaagaaggctgagggacaggtagacatggaggggagaaagccagggtggcctccaggtttctggctggggctgccaggtggacggtggtggcacagcctgaggtagggtcctgggggtggttcccggcggggtccgagcttagtcttagagggtacaagggggcccaggagggactggggctctgatgcagatgtgggagtgcgctgagcccctgctgccctggggacaggcacagcaggaggtgctactcagggcacccaccgttgattatttaggaagcagctgtcacgcctgttctttatcctgacctggcccatctgattgctgatgtgctcctgctgagccccccacaccacactgaggactggccacaggatctggtggcactcagtcttctgggaacttggcagtgtgcctgtcctactttgcgctccaagcctcggacgtcacctccaggaaccctcccactgtgggtgatgtctacagtcacctacacagccccaactctcatgggtggacgtgctcgttcttgcctggcccagggcaggccgtggtgagctcaggggtcctgcctgtcagtttggtgccctcggctacgcagggcctgttagaagggtgccctccctgccagggcctccagccactgtctgtcctgttcccgcctcagagttcagccagcatagaaagagagggctgaggaccattcagcctgtccattcacgagaatcattgtcagtgtcacagaggctgatgggatgcctgtggtgcagggtgaccccagcttccccatgtgggggatgcgccggtggtgcaaggccaccaccctgtgccctgtctctggcacagggatgatgacagcacacagcacatcctcttttctttctacctttccctttggcacagccccttgttgtgggcgtcacgagaggcgcagagagatcgtggaggtcaagggcttgcccaggaccagtgagggagggagggagagggcagcagcacccttggagacgggaggattacatcatatttatttaccacatgcctaagatcgcactcttaagagcatttgacatacatccaaaaatttttaaacactatggaagtatgtctggatgcatcagtaatatgaaagtggaagccagctgccctgctcccagcccactttgggaaaattttgtgcatgttttgagccagctgtttgggaagggaggccccagccactgccccttgggtgggtttgatgttcattgtgtgggaagaagccttccctccatccttttctatttctgcagaatatctgctcaatcagggagttgagcttggcagttcagctgctcagccagggaggtgctgtgtcctggactatgctaggatttcagaaggagagagggcagctgcaggccctatttgcagtggcttcctcctggaatccccgtctgctccctgtgtactgtccagcgtcgtagtggaagctggtggcgagacgggtgagacccacggacatagatggcatccacgaaggctggcggagcctgtgatagacgatggacgatgacccaggttccagcaagatatggcagtgggctgtgccgggaaggggcgcatcctggaggatgccctaggtagtgcctgagaaagtgagggtcattgactgattccacgtggcatccatgaatctctcaaatccatagggcccgtgcatgacaaataattaaaaagatgtagggtgttctccatagaacctcacagagggaaggagacctgcccatggtatccagctctgatcacactgctattttgtgattgataggcagactttcaaagaatgagttagattcaggacccttttagttgtaagtgacaaaatctcaatataaattgacacaagccaaaaaagtagaggggcaagggattgatgagtccatagatctgtagagcctagagtagtttgcttcaggcacggctggatccaggggctcagatgatgtcatcaggaagtactcccccgcccccattccactctgctttcctgtgctgcctgtgtctcaggggctctgcccacagggtgaccttccacagttcaagctggcatccacgtgccaagatgagcagaaggtgaaagcccatttcccagcagttctagcacaaactccgctgggctgtgtccatccctgaaccaggtgctgtagtcagggagatgacctggcaactctgattggccaggtgggggtgcgggccttctgtgcagcgcaggggagggggcagtgccacccagaccatgaggactgagagtggcggggttccccaaaagggacatcaaggtgcagtcatcagaaaaagcaaggaacggaggtcgagcacacagaaaacacgtgtgtttgatggttcttggtggtccacactgatgcagccggcttctgggggtgatctttctggcactgagcagtgagcatgctgggatttgcctttgagcccacgaaggctcctacttcatggactgagctaactggtctgcaggacgagcccaccactgccatatggaagctggaataatgaagagggtgtgtgtccatctcaaagagattctgggctgggcgcagtggctcagacctgtaatcccagcactttgggaggctgaggcagcagatcacctgaggtcaggggttcgagaccagcctggccaacatggtgaaaccctgtctctactaaaaatacaaaaaaacttagctgggcatggtggcggccgcctgtattcccagctactcaggaggctgaggcagaagaatcgcttgaacccgagaggcagaggttgtggcgagccgagattttgtcattgcattccagcctgggcgatgagagtgaaactctgtctcaaaaaataataataaaaaagagagagagattctgtatatcggggagatgtcttgaaatgtcaggctgtgaataacttctgtgaaaaattaattatggactggaagaatctttttagaccaccatatagacttggaccttccatgttttgatttttttaaaaaagggaagaataatatgacttgtgaacttaggtcaagtaaggagacttgaattcactagaggtgctggcgttgtggtgggaagtacagcaacagccctggggtctcctggggaagtgggggagggaagagaaagcctcctcttgtgaacagcaactttggaccactcactacaaagcatctcttttcatcataaaccatcctatcagattgatgttaacgatcagattgaagctgcttcggagcagtgatgtggcctgcaccaggtcgcacagcaccttactgtggagcatggatccacacgtgcgtctgtgtcattgtgatcgctcacgctgctctgtgggcccatggccttggtgcctgcaggctctgtgtctgcagttcctctagggatagtgagtctgctgctgagcccgcagccagaaaccacgctggggggctggcagggtgacggcagcaaggaaggagaactgtccttgatggattcagggagcaccaaggtctgggggctctggggagggtgggtgtccaaaagggctgccctgcgggacctgatgccatctctgagcagcgtccttgaggaccccggcaaggaagctgagcccgaaactctgtgcaagagttgcgtccagggagagttacatccagggagagttacgtccagggagaggggcgtccaggaagaggggcattcagggagagggacattcagggaggagtcttccagggacggggacatccagggagaggggcgtccagcgagaggagcctctagggaggggtacatccagggaggtggcctgtcagggagggtggtgtccagggaaagcagcatcaagggagaggggtgtccagggatgggggcatccagggaggggggcttccagggagaggggcctttgtgttggcgagttgtccatccacagggctggagtgcgtgtgcctgaccacgagagcttgtgaagaatccatctgattctttccttctccaaacacatgcctcacccacacagccttacctgtgagggcctcacctgccacctgcgacttttgagttgtcccagcctccctctgccctctccaaactgggtgtgacccttcctctctgcctttgcacctggccacatcccatggtctcccactggagtcctgtctcctgtacacctgggtcatctgaaggcagtggccaggcagcacttggtgctgcagagccggttcagagcctggcacggtatggttctgggaaagccctgggtgagttggaccagaaaggctggtcctcagtgtggtgttactgggaaccatgcagcctgtcccgttgtcagccagccttgggtgaaatgggtaagactgcatgatgcttttgtaaattcaggtaacttcttaggaagtaaaatgcagcacaaactgtagttgatgttttgacccttggtctaataattcaactggagaacctgtgctaggaaaatgacttcccaaaagaaaagaaacggttcatggcaccaccgtagaaaacaagaggttattggaagcaacctacagacctgatggagaggaggggagggtcagtaacctgactctgtctccttgatggatctaggagccaccaaaatggtgagctgactgcagcgcatcgtgggaagccagagaacaatccactgctgtggactgaaagtttgtgtctctcccagattcatttgctgaggtcttcacccccagtcccatggtgttaggaggtggggcctttggaggtgatgaatcatgagcgatggctttacggtggaattagtgcccctataaaagaaacctcagggagctcccttgccccttccaccctgtgaggacacagccagaagacctgaaacaaaaagcaggccctcagtagacacggagtctgcaacactatgatcttggacttcccagtctccagaatcgaaagaaatacatttctgatgtttgtaagccaccagcttggtctatggtattaatatttttgttataacagctcgaacagactaaggcattcactcttaagaaggaaaaggtaatatcaagatgtatatacactgattataatatccaaaaaatgtggtttttgttggtacaatcatggaaaacatgaacttgatttgttggggttctgggcttcgggtacaggtgctttgtattatttaggtcatgggctgtcaaacttgagtccttggatctttctagagccccagctagagcaggcctaggccaaggggtgtgatggtgggacttggctctgtgctcgcctccttcccatgcctcccaccccgagcgctttgagttgctgttgaaccacctcacccgcatagagtttgctcatcttgctctggcgctgcttgtgaccggaaggcaaacagtggctttctgggcatcttccctgtctgtgtctgtgtctctctgtactcctggcctggatttgaaagtgacaagcagcagcagatctgaagaccctcatgccttgtcccctccatcctgacaagtgacaaagtctggctttgtgacatgtgtgtttgtttcttctgtgttaaagggcctacaaagggagacatggaaatcccctttgaagaagtcctggagagggccaaggccggggaccccaaggcacagactgaggtgaggactgcggtgccggcagggacttcgggacgcggcccccggcacaacaggcctggccacgagctccacagcccacagagaagtgtcggtgcctgagatcggggtcaggagccagcgtggtgcaccctaccccacttgagccccatgttggtagggtgcccatgttcactgtgccagttttcctcctggcactcctctggggagcagcgctcatcccccttttgtccaactcacacctcatcttgggcatcacctcctccaggatgacctcctggcttcctgcagctgcctgctcagtgccacccctcaacatacactgtgtatgctgcccactcttgtctccctgactggcctttcacctggctgttagctgtgtgcacggggccctcagagcggtgaccattcacttgggcatcagccaagggctgggctttgtgccagtgctggggacatgatgtggccctctcttcatgggtgacaggttagtggaagaagcagacccaaaaaacccaagtagacaagacacagaaatacagtgattttgaattctggtgaggggagaagccagcagaacgctgagacgggaggtggcagggggtcctgtgtcctctgtggaggcaagttctcaccacctcactctgtccccttgcacagggctcaagcaagtgaccacagttatcctgagcagtttcctgccccctcttctccctaaagaggagaaaagcttccacgcgaaaccataaattaagaatttctggctgggagcggtggctcacgcctgtaatcccagcactttgggaggctgaggcgggtggatcacctgaggtcaggagttcgtgaccagcctggccaacatgatgaaaccgtgtctccactacaaatagaaaaattagccagacatggtggtgcatgcctgtaatcccagctacttgggaggctgagacaggaaaatcacttgaacccaggaagtggaggttgcagtgagccgagatcgcaccaccacgctcccaactgagcaacagagcaagactctgtctcaaaaaaaaaaaaaaaaaaatttctttcctgacctcacagccatattgtactttaaagttcctcccacatccttttgcccaggcatttggaggcggggggagcatagtaagcccttttatgggctctctgtgccctgggcctcactttttccatctgtagaatgagaagactggaccatttcagcagggattctttttgcaaagggccagatagtgaatattctggactctgcgcaatctctgccgtgttgctcagctttgctgtggagcacgtaaaagcagcatggacaacatgtaaatgaatggttatggttgtatttcaataaaactttatttgcaaaaacaggcagtgggccagtgctaacccttggttagctggcgtctctccagccctggctttctatggtcccctgactgttttgagaggtgtaaaggacccagtcatggttctgatttccatgcattgatggtgagccttggcaggcaggagcaactcaaggaagagaacctgtaccagtaccagtcggagcccgtgtctccctcgccgtgtggatggggtggccacaccttcctcaccgtgttttgaggagcgagtggccggaggctcagtagggcctagcctagtggacatgcctggtgtgaccccatttctgccccttccttcctggcctgggtgacaaagggaagtgggtgaaaggaggtgggctggcagggagcatggggtgggagagggtcggagaatctggaggctgactggtgtctggcttgcaggtggggaagcactacctgcagttggccggcgacacggatgaagaactcaacagctgcaccgctgtggactggctggtcctcgccgcgaagcagggccgtcgcgaggctgtgaagctgcttcgccggtgcttggcggacagaagaggtgggtctgtgtgaggcttagaacagcctctggagggttgagcagcttgtaatgctgcttgctaactgaacaactaaaatcttaccaaacctaacgctggtgatgctgttgggaaatttcagtttctgttttgctggtggccttctcattttagacactgtttctggacttaacatgggatatttaacagaccaagccattttcattctctttggcttgtgttggtatctccaagtggtaactatacatcctgcttccctgctgggttctgatccaaactgagacatcgatcctgggttcagctgagaggcagtttccctgaggcaaagctggagactgtaatgtggcctgcagtcagagtggcccatgcccctgagctgatgtccgtcgagtctgggcagaccagctgaggggctgtgggcccacacagacctggacaagcatgttcactttgggaggaggcaggctgacccttcatagataatctctttcaaacagagaggcaggggaggaaagggacgcagctcaggccaggggtggtgagttaggacgttgtcctgcgcaagggaagtggctgtccctggtgccgtggggcagtgtgcttcctgaaggttccacgcctcagggaaagatgaaagtgggtgtcacaaaggtgttttttctaatgataccttttttttcagattgtaagagtattttatgcttatcatagaaaacttggactatgtagaaaacataaagatacaaattactcataaccttgaagcccagaagcaactccccatattttggtgtatttccttctgtgtttgttgttgttgttttgagatggagtctcactctgtcgcccaggctagagtgcaggggtgcgatctcaagtcactgtaacctccacctccctggttcaagcaattctcctgcctcagccttttgagtagctgagattacaggcgtgcattaccacacctagctaatttttgtatttttagcagagacagggtttcatcaggttggccaggctggtcacaaactcctgacctcaggggatccaccctccttggcctcccaaagtgatgagagtacaggcgtgagccaccatgcccagcttgtatcatattttaagagttacatttattatacagagtcttctctttgaaaattaaactgatgattttgaaaaactaacagtggcattgttagccagaatttctcaccaacccagcctgctgattccagagcagttggaatgacctggagggggctcaggcggcccacacggctcattgttgggtgccagggatagcccagaggctgctggggcagagcgtgcaagggaggaggccggttggccccgtgttcccccagctgcacacaccttctgatgtgcagttgtgctttctgatttgaaaagaaatacatgctcatgtggaaaattttggaaatgttcaaaaggagaaaaacatccagacccccgtgccagtcctcctgccctctgcttggttgtgccagtgtcccaggccgttgggggtaaagggaggaaggcagctgctgaccagcggtaaaacctgctctccctctccccgctgtccaagccttccttagaaagggctgggctgtgtgtgagacagaggaaagctctgtagacacaggggtggccctgccagtgcacccaggctggtgactgcagtgagtccaccctgggttcaagacagctctgcctctttctgactgtgtgaccttgagtgagccagaacacaggcctgtgcctccgggtctgcacctctgagagaggggaggaacaggaagaggctgccttcttcccgccagcatgtagggggcacttgggggcgtctggtgggagaccagtctggcctcccagctggagagtgggcgtggcgcgatgtcctcttgagtcagatgtccatgcatccttccctggtaaccaagtcctgacaccttctatgagtctcgctcgaaagccttccaggcagagttggcagggtcagagtggcaccgaaagcctaggcagggcacacaaggcctttgaccacatcctatccctcaggcatcacgtccgagaacgaacgggaggtgaggcagctctcctccgagaccgacctggagagggccgtgcgcaaggcagccctggtcatgtactggaagctcaaccccaagaagaagaagcaggtggccgtggcggagctgctggagaatgtcggccaggtcaacgagcacggtgcgaggattcaccctgggcaccagccttccctgggcgccagccttcccacaggagccaggaccttcccataggggctgggaccttccctcaggggctgggtcttcccacaggagccgggaccttccctgtgaggacagggcccttccttgtggggaccaggggaccagaaccttcctgtagagaccgtgccctagtggtgaggtgtgtgggtggcattttgacagcatctgccctggctcaagtgctcactcattgaataaaccagagggtattctgcccagtgctctgtgaccacgtctaccaatgggacggactgtgtccatcaccaagtgggagcacgctacgtggtgctgagtccaccccagctactggaggtacagaggtgtggcccctgctctgcctgccctgggggccctatgatccccagaacgtaggatgcccctggaactggcgtgccctaggaacagtgcgccagtttctggtgggctgcagggcacgaggagatagtcaacttgtctgactgttaatccaccctgtcccctgcagatggaggggcgcagccaggccccgtgcccaagtccctgcagaagcagaggcgcatgctggagcgcctggtcagcagcgagtgtgagtgcagcccctgccccgtctcacccatgcctcccagcctgcacctgcagggcgacctctccttcctgtgcgactccatcctggcctgccctatctcacccgtgcctcccagcctgcgcctgcagggcgacctctccttcctgtgcgaccccatcctggccctgctaggatctcaggcggtccgtttggggctcagtgttctggacgctgggagtagaccctgcccacctggagcgcacgcactggagggaaggcagacccaggacagaaaccatgatgtgccagtccctcttggacaaggaaatactgggggtggggactggcgggggggtcctgagtggggaaggatgaggagggcattaggggaaggggctccgggcagagggaacagcatgagcaaaggcccaggagacccagcagggtgtggaaggggctctgccccagcgtaggccctttgtaggtaggcagggaacagagtgggcagagcctaggttgggggatagagtctctggggcacactgagctgggggtgcctctgggatgtttgtggtcaaagactgagaagagacgtcacatcctccacgtgcagctggccagcctcactgtcttccatccacgtggggtagactctgcagtctgaggcactgggagctcctgtcctggagaagatagacaggcaggaggcttgggggctcagtatcaatggggggatgggccaagacccaggtctgccacagactcttcttgtgacatgggcaggtctcatttttctttctgggtgtcagtttccccttctgaacagtgagatgatcagacaaggggactgaaggacctcgcccatcctagaagcctctgtggcatgtagggcagagtacaggtgggagcacagatcccaccttcccactgggcccgtgaggaaaccgtccatagggtgtggtcagagccctcgcctctgcgtgggcggacatgggtgcttgcgctgctgttttcctgctccatttgggggagacaaagaaacacctcacatggaagtgggaagaaatctgtgactctaggaagcccgaggaccagagaggctgtgacagtgtcctgccaccgaggtggcatggtgcctgctgtcctgaagtgaggtgcctctgggcaggagcagcccagcctgggtctccatcctggggggcactgcaggcagagtctggaccccaacctcacttcccagtcccacaggggtttgtgatgagccgggcacacctgctgctgggccctgtcgctgttgctgggggcgagttaggagtcagcgctgccagcctgtggtcccctccgccaggccctcagggacagggccccagcacccccattgtttcccctctatcagaacgttcccatcaggcatcatctgtttctctgccagcttttccaacagaactcccagaaaggggcgtctgtcatccccttctctcgtcctccgtcctttgctctcaggcctctgccatgttattccaccaaagcggctcgtctaggccatcagtgaccccccttgctcagtcacttcttgtccttgtctgacttgatctgtcagcagcgtgggcagagatgactgctcttctccttagagccctctcccccaccaggcccggggcccttgctgccacactggctgctccttcttggggtccctagactgatgtcctgtctctcaggacaggacatcctgcccaaggtattcatccctatgaggacaggggccttccttgtggggaccagggtcttcccgtagggactgtgctctggtagggagatgtgtgggtggcattggtgaccactctcgtgtgtcagacgccgtcctgaacccgcaagcccccagcccgcccaggctgcatccagcccgtgctccttccacatctcctgtacctggctgtcccatggtcacctcacagctcagtctacagtgagctactgaggcctgtgctacctgccacttgtgtgggcccccccaaggctgcctcatctctttgctgcagctacacctgggtgctgccccgactcctctcctcttgcacacacagctgatccattaggaggtctgtcagcgcccactatcacggctgccatcttggatgcagcctgcctcctccctagggtttctgcagcaccctggcttgtctccctctgccctgccccagcatggtcctttctttcccatccttcccctggaggccctcctggtcaccatctcaccacggcaactggggtccttcaggggcctcattccctcctaggggatcatgttggatagaggggtcagtgggcacgtagctctcgcggatcacgttggatggagggatcagtgggcacgtagcaggctcttggtggaagatgttggatggaggggtaagtcggcccatggcaggacgcatgttgaatggacgggttagcaggcatgtagtaggcccatggcagacacttgttggatggaggtgtcagcaggcacatagtaggtgtgtggcagatcatgttggatggagcggtttagcaggtgcacagtaggccctgggtggatcacgttgaatggaggggttgggggcgcagatcatgttcgatggagcggttggcagggtactgccctacagggcggcttgtcacccgtgctgtgagaagccccacgctggctgaagaggagggtgtcagcatgcactggaggtgcatgttgtaaggcttggcaggtgaactgggtgaaaggtgtgggtgagtggccccaggcataaggagctaggcagagagggacacttggggtgggggacagcacacccaggggccgggggccaggagtggaggctggcacttggcaaacctgcccccttcctcctcacccagcctggtcctcaaccctcaggccgcccagggaagggtttcctccacctgaacccactcagctcctttcttagcttggccccacgccaccgtccccagcccattgctctgtgtgagggtggcagtggggctgcagtgtggggcgcccatgctgttttctctcatgcttcagccaagaactacatcgcgctggatgactttgtggagatcactaagaagtacgccaagggcgtcatccccagcagcctgttcctgcaggacgacgaagatgatgacgagctggcggggaagagccctgaggacctgccactgcgtctgaaggtgagtgaccaagaccccggtcaggccggagcctgcctcccaaggactcgcgcacctcaggcagggcaccttccaggaagctgcaggtggggaggttcgcgcctaacaaagagtgtcttacagccgtgccgctggtacctttgggtcatcatctatcgtcataaggatgtgtcctcgggagagaggcctttcttttctgcgccgtcaggctcagaaaccaggggcggtgttgggcaggagtgctaggatggcaagcaaggggcccctgggtctttctgtgcagtgtagggggcagtggggcgggctggacgcagactttcatctagacttcatcacttagcagatttctccatgtatggtccagagtggaggccagtgccttgaagatgccttccccgaaaacaaagtgccgtgtccgtcaggccagggaggacgtgcagaggcgcctactgcccctggatctgcaagggctcagggagcgaggccagtgtgggagcgtggtgggtgacacttgtgcagggtgccattgggcacacctggaggacatgagcagctttggcggcaggaggaaagcggggagcggggagcgggaagcccagcagtgcgggccctactcctggcctgacagcttgttttcttggccatgtggccctatggcctctcacagagttgctcacagttcagctcgcatggttgaattagatgtgtgcctgtctcactctgcagagaacaccaggatttccagaagcttggcctcctgacccaggatccccaagctgaggccagcacagggggccccagcagatgattgtcacagaggctgcgggcagtatcatgcaggcaccctggggttctgtcttctgaactgactgagaacctggaggaactgccatcattgtattcagatgggcgcgtgagtcagggccaggaccaggagatggttgggccaccaactgtcaggcaggcagcaggctgaaaggtcaccgtcctcgagccagggagaaggtcagagtaggcccgccctccggtgggggggaagagcaggaacccaggtgctgcaggagcagcttcagcccaaagagcagcaggcacagcagccctgctgcagggactcggagccagacaggtctgagtgtgagccccccgagtgcccagagctgcgagtcctttagggtggcaggtggaaggctctgctcctcccacttgggacaggctgtatgtccagggtatgacaccgaccggtctgcagaggttctgagacatgggccaggatggccaagaacttgaaccaagggagcacatggtttttactgatggtctgctcagagctggccctaggcaagcatattcacagattgggtgccatcatctccttactaatgggagatgaggaagctggggtgctggcatggttttggcaaagacactcccgaaatgagagtgagggtcacaggtgaacgggttaacttggagaagacccttgggccaggcggccatggcccaggtgtcccagtttatgccatctggtgtaagtactattataataatgcctccttgcatatgcgtcctgttcggaaaattatgtcacctagttatggatggtgagtctagtgttgtgtagcatctgaaaatcctatttatttatgttacttaatgacagggtctcgttctgttgcacaggctggagtgcagtggcacggtcacagctcactgcagcctcaacgtgccaaactcaagtgatcctcccacctcagcctcccaaatagctggactacaggcatgtgccaccacacccagctgatttttttgaaaacattttgtagcgatgggggtctcactattgttatctacgctggtctcaaactcctgggtcaagcgagcctcccactttggcctcccacactgctgggattcaggcgtgagacactgtatccagcctgaaagtcctttttagaagggagagatttaagctgttttgacaagaagtaaacaagactctgtttccctttagttttggatgctgtcagagcacttcgattcctttgcagtttgtcttcttagaagtctcttgtgagggaggcaatgaatcgtcacaagcgtctcccagggctgagagctgtcccaccttttagtagccttttgtagaacaaggagaggtcttcactcaaagtgaaaatgacagacacctctttgtgagccacccttactcccacaaagaatgttccagactccacacagttctcttctggagcctggaggtgcaagctgtcatcgtagatagaatcctctgaaaacaaacttaatatcttaaaatcgtaacatttttaacattacataattggaagatccgacacgggaacatttttgcccacaggtttgagcagaatctcgtctcggctcccttccccagcctgccttcttcacgggtccgctgggccatcggtgtggtgacgctgcttcctggtttctcgtggcagcagaagggccgatcaccacaggcccagacagagagctctgcagtgttctattcatagaggcagactcctcatagtttttaagtttcgttctttttccatctcaggagttgaatttgtttggaccttctttgcagaaaaggagactgaactttttaatcccatgtcagaggaaggtcttgggtgtacattgcagggagcagaaattggggctttaaaaaggggatcgttccctggtcatcgagttcaggtgggggaccagcccctccacactgtccaagcagaggctagacgccatccaacgtaatgttctagaatattccttgtcttttaaaggccctctcaaccaggtggttgtgtgtgttctaggcaaaagaatgtgcatggctttgagtaagacaggatttcagatttatttttaccaaggccacccccttgctaccgtggcggtcgtgcgtgaaactggtggtgagcagtggcgggccaggccacctttagttgtcctgctgttcgcaaggcccccatacggggattaactgagcagcctgccggctgacgcacatgttgactcgtgtagctgttgattttagccagctggcctggcgtcatactacaggggcttgccccaaacaaaccctggagtaggttggttttcataaatgccctctggctctctggcaagcgttggaaatgccctcaaaccctgtagtgcctggtcttccctggccatctcctggcagtgtgagcgcctctctgctcatgtagaaggttgttgaccccagagagagctaggggagctgttagctgctttaatcgtttatttgcttgttataaaacagagattaagtggactgtcacaaatatacatgaagcagcagagctgttcccccacgtgtagacgtgcatgcacacactcctaaacacttccgtttcttccatgagcctgtccttctcatctgtggaaggctcagtctgtgtagacatgcatgcacacactcataacacttccgtttcctccatgagcctgcccctctcctctcatctgtggaagactcagtcttctggttgtttccaggtgtcctggtcctccagagctgatagccaggctgttggcaggtgagggccacattctggtgttgtcacctagttgccattcacctgggatccctccttggccttctggtgggcctggtggagagaacctgccccaggggatttgtggggtctggtgcttccccgaggcccggagctgatggggggctccagcctggatgtgtcatgtagcccctcagtgggccctggacatgcagccaggcttccctacccccatgtggggccgccccctaggcgtccacttcctggtgttggtccaggcccctggcacttctgaagatgcacagaacctgctttgtatgccacgccatgctgtgtgagcactggcaccatggccactttgtcccccatcccctccagtccctctgcctggctgccctgtgttctggcagggctcagggcctctgagttctgcacagaccaggaaggcatgagggctggccctgggtggcagcgctgcttcaccccatcctgaggctgctcccagcatgcctccctcagccctctgctcctcttggctgtggtgaaggccaagagctctttctgaccttagcgctgcatgcagagcaggggagcaggacccacaggtcgggggaaggcagcctttggccttgactatggggaggtaggggtgcgctggtgtgtatgtgtaggtgcacacgtgtaggggtgggtgtgcatgtgtgagggtgcacgtgtgggggtgggtgtgcacgtgtgtgtaggggtgggttgcgtgtgtgtgaatgtgtataggggtgggttgtgtgaatgtgtgtgtaggggtgggttgcgtgtgtgtgaatgtgtgtgtaggggtgggtttgaatgcaggtaggttgcgtgtgtgtgtaggggtgggttgcgtgtgtgtgaatgtgtgtgtaggggtgggttgtttgcgggtaggttgcgtgtgtgtgaatgtgtgtgtaggggtgggttgtgtgaatgcgggtaggttgcgtgtgtgtgtgtaggggtgggttgcgtgtgtgtgaatgtgtgtgtaggggtgggttgtttgaatgcgggtaggttgcgtgtgtgtgaatgtgtataggggtgggttgtgtgaatgcgtgtgtgtaggggtgggctgcatgtgtgtgtgtaggggtgggttgtgtgtgtgtgtatggggtgggtttgtgtgaatgcgtgtgtgtaggggtgggttgcgtgtgtgtgtgtgcacgtgtgtgtacgggcagaaggtggcctggcagctgcttctcagggtctccggccatagggagggcagctcacccggcagccccgtgcagctgaacggtatttttgctgggagagtggtgctgggccctctgcctgtgtctgcactgaactccctttccctaatgcttgctctgccacccctccggggactgcctgcggcttctcctcctcgtaaggatcgccatttcccttcatggaggctcagggaggtgacatccttgctgtagtgcagagctgggtcacaaaaccagctcccagacaggcatctcagggctccgtcatctcttcatgtgggtgaccctgaggggagggaagtggggagcccgtgggtccctccagtgctggaggtcttgcagggagagaagcacacatgcatctagtcacgctggtagaaggtggggagccaggcacggggcagaggggggctccaggcccagaagagggagggctcacagggaccgcgagcatggggagggccacctggagaaggggggagggaggaccactaggatggggctggtgatgggaaaacgcaagggtgcgggttccttttgcccagaggcagggtggtcagagggaggcgtgagatgggagcagtgggggtcctgtcccagcctcgttcccacgtaccatctttcccccaggtggtcaagtaccccctgcacgccatcatggagatcaaggagtacctgattgacatggcctccagggcaggcatgcactggctgtccaccatcatccccacgcaccacatcaacgcgctcatcttcttcttcatcgtcagcaacctcaccatcgacttcttcgccttcttcatcccgctggtcatcttctacctgtccttcatctccatggtgatctgcaccctcaaggtgttccaggacagcaaggcctgggagaacttccgcaccctcaccgacctgctgctgcgcttcgagcccaacctggatgtggagcaggccgaggtcaacttcggctggaaccacctggagccctatgcccatttcctgctctctgtcttcttcgtcatcttctccttccccatcgccagcaaggactgcatcccctgctcggagctggctgtcatcaccggcttctttaccgtgaccagctacctgagcctgagcacccatgcagagccctacacgcgcagggccctggccaccgaggtcaccgccggcctgctatcgctgctgccctccatgcccttgaattggccctacctgaaggtccttggccagaccttcatcaccgtgcctgtcggccacctggtcgtcctcaacgtcagcgtcccgtgcctgctctatgtctacctgctctatctcttcttccgcatggcacagctgaggaatttcaagggcacctactgctaccttgtgccctacctggtgtgcttcatgtggtgtgagctctccgtggtcatcctgctggagtccaccggcctggggctgctccgcgcctccatcggctacttcctcttcctctttgccctccccatcctggtggccggcctggccctggtgggcgtgctgcagttcgcccggtggttcacgtctctggagctcaccaagatcgcagtcaccgtggcggtctgtagtgtgcccctgctgttgcgctggtggaccaaggccagcttctctgtggtggggatggtgaagtccctgacgcggagctccatggtcaagctcatcctggtgtggctcacggccatcgtgctgttctgctggttctatgtgtaccgctcagagggcatgaaggtctacaactccacactgacctggcagcagtatggtgcgctgtgcgggccacgcgcctggaaggagaccaacatggcgcgcacccagatcctctgcagccacctggagggccacagggtcacgtggaccggccgcttcaagtacgtccgcgtgactgacatcgacaacagcgccgagtctgccatcaacatgctcccgttcttcatcggcgactggatgcgctgcctctacggcgaggcctaccctgcctgcagccctggcaacacctccacggccgaggaggagctctgtcgccttaagctgctggccaagcacccctgccacatcaagaagttcgaccgctacaagtttgagattaccgtgggcatgccattcagcagcggcgctgacggctcgcgcagccgcgaggaggacgacgtcaccaaggacatcgtgctgcgggccagcagcgagttcaagagcgtgctgctcagcctgcgccagggcagcctcatcgagttcagcaccatcctggagggccgcctgggcagcaagtggcctgtcttcgagctcaaggccatcagctgcctcaactgcatggcccagctctcacccaccaggcggcacgtgaagatcgagcacgactggcgcagcaccgtgcatggcgccgtgaagttcgccttcgacttctttttcttcccattcctgtcggcggcctgaggatggtccgccacgaggagcttccagtgcatgttgccatgaggcctttccccagtgtggccccagcccgacaggcatgcaccagtgccgcctgtgcccacgtgtgcagactgtggctgcagagaccttgcgaccatgtgtagattgcgtggaccccgacaaagggaaggctgctgtgtagctctgtccactctgaataccaagtgtgttgggaattgcatgccatctccaccctgagcctgacctttctgagtgacatgggtgtgccaggctagactaggaggttccggtgtctggaaaagcactttacagatgagattccctctcctcccccaccttcaagcaccctgttccctctttctttcttttgtgttggatttgtttaaaaaccaaataagcatctgtgtaacctccacagtagcatttcttatttgtttggtcactgctacaccttagcagctcttcccctttcctgggggatgtgcacggcagcttgagcctgtcacgtggtcaaggcccggccccatcagaggctgggggaggcggcacattggcagtgtgtcacactgagctgggcaccacaggctgcctcatgaccctcctgtccagcaggtagtgggtgaatgtgtgaaggtcttgcctgaatccatcaggacttgggaaacagagaaccctgtgggggcggctgtgggggaggtccctgccagtgtttagaagagcctgactgtgttcagtgccttggagcagaaagccagggtcctgagtggctgaaataaaagcctctggtggaacctgca

SEQ ID NO: 36283 - DNA, 285104 bp, Homo sapiens
gtaagcttttgggttgttagagagattcttcatgctcaaacattaaaaattagagcagaagttttgagccactatattaaaactgctaaggtaagaaaaacttgtgtttttatttttgagttcaaccattcataaatgtttgtaagtgaataaatattcgtgatgctttattcactgtttattgatactggaaaaataagactcattgatataagtcaatttttaaaattggatgcctactttctctgccttttcctttattcttcctgttttcctaccttttcttttatattcttcctcccactctctgagtagctgaattatgtgatctgttttactgaataagtagacaaaggttggattatggtaaagtatgatatttataaaatattggactattctgcaggtgatgaagaaagccataaagaattaagtaggagaatactacttcacttctgaagtgaaccatgtgaagaataagactttatttttaagagaatggtatatgtgatattaccacattgttaactgaacagttattgtgtgacatagataataaatacagcaagagaaatggagaatggatttcaaaggtagttggaaattagaagggtgagacaggatgttctacaaaggataccaagattttattaaaacttgtaacaactctgaatttggttggaggggcagaaagggggagtgagcccttccctctccatcatgaagggtcaaggccggcagcgatgtaacaaaagacaagttaatgagagaaaagcatagcagatttattacatgtgcataggagtcatacaaagtataaactcaaagcagggccaaatggttgatgcttaaatatcttcttcactggggagaggggagttttgggggagggggtacataagagtaagtgattttcaggtaaaatgaatgagcccagagaacgaagtcctgagaccaagtttctctgagctctaggggaggtggcattacaggttatgggagagcgaagggagaagaacatgttaagcaaagacagatatctcaaggaagtatctcagataatctcagagctaccctcagaaagaatagttggggtcgcctatggttgagttaatctttcctagatctggacaagggagaggatgctcagaggaagcctagctgttcatttcaccattgtagattttctttacagatgtgaatctcctccacaaagggcagcttttcagggctatatctgtccgtaggccctctgaatagctatctcaaaatatgtcaaagaagtatattttagggtaatatatttttggtttcctttaatgttaagttcactaagaagtatggtaattgtagccacgttcattcattactcttgtaataaatacgtaactttcctcacatgtgaatgaaagaaggcagaataaaatgaggatatcatgtttacagttattaaaagtcataactctttcctattttccttaagaacatgggagcaattgtattctaacattctatggcactaggtggcagagctagccttctacaaatttgatattttgcaaaagtgtcaaaatatttttagaaattctttgtgatgatatgttaggtaaatactttttttttttttttttttttggaggtggtgttgcgctctgtggcccaggctggagtgcagtggtgcgatctcggctcactgcaaactctgcctcccgagttcaagtgattctcacatctcagcttcccaagtatctgggactacaggtgcatgccaccacacccggctaatttttgtatttttagtagagatggggtttcaccatgttgggccaggctggtcttgaacacctgacctcaagtgatctcccacctcggcctcccaaagtgctgggattataggcgtgagccactgcacccggccaatactggtttttaactaataaaaattaatgattcttcatggattctgcattattattttctgatatttttgttagtttttaaatttacttgtatgttccactcaaaaccaccaaattttgctcaaacctaccactgtcttcatcaaacaatcatttaacttcagttcagactttgaattatttttgacagcacttgccttcatcccaagctctaaactcataattgtttttttctcattgtcccttaaacccttctattctgactctctgccttctatactgtttgttataaaactggcaggtctcttacttgagtattgttatcagtcagcattctccagagagatagaaccgtagcattctgtataaacatgtataaagagatctaaatataaaatgtataaatagattttaggaattggcttatacaattgaagggactggcaagtatgaaatctgtagggtaggccaacaggctggaaactcaggagtttaggcactagtcttgaagcagaatttcttttccaggaaacaccaattttcaatgttaaagcctttcaactgatcaaatgaggcccacacacattatcaagtggaatctcttgatttgtagatgttaaccgcatctacaaaatatcttcatgacaacacctagattagggttcgattaaataactgatactaatagtctagacaagttgacacatcaaacttaccatcacatagatacaaaagaatataagaatatttaaagtatcaaaagaatgataatgtggatacccatgcacccactgaccactgggaattttcatatgcctcttcatatgccacctccttcccttctactgcaatgggaactactgccttgaattttttcttttacagtgtgtatgtttctgaatcatatgttgctgcaaatatatgcttttggattttgtttaaattgaattattccatatttacttttgtactttcataactcagcagtgttacttaatggttttgggagtagctctgttgtagagtatcctatttgtatatatcacaaattattcaatgtactttggattatttccaaattcttggctattatgagccctgctgccataagcattcttgtatgagtctcttggtgcttatgtgacggttgaagccctagaaatacagagttcgtactagcagtgaaattactgagtctctctctctctctctttttttagacaggatcttgttgttctgtcacccaggctgaaggccagtggtgtgatcccaactcactgcatccttgaccttctgggcccaggcaatcttcctacctcagcctcccgaatagttaggattacaggcatatgccaccacctgtggctaatttctgtttttttgttttgttttgttttgtaaagacaaggtctcattatgttgcccaggctggtcttgaactcctgtgctcaagtgatcctcccatgttggcctcccaaagtgctgggattacaagtgtgagctactgtacctgtcccctcgtctctttagctttgttatagataacctccaaactgatttatatttatatatgctcactagcaatgtatgaagatgcctgttgctccacatccatgtcaccatctgatattgtcaaaatttttcattgttgccaattctggtggatgtgaaatttatctcattttagttttaattgcttttcattgaatctgataggagtgaacatcttttctatgttggccatttaggttttctctcttgaaaggtctgtttaagatctttcagcagttttctgttttggtattggtcttttattgtgtgtgttttggtttttttgtttgtttgtttttatttatttatttattttgatggattctcactctgttgcccaggctgtagtgcagtggtgcaatcttggttcactgcaccctccacctcctgggttcatgtgattctcctgcctcagcctcccaagtagctgggattacaggctcacaccaccatgcccagttaatttttgtattttttttttagtaggacagggttttgccatgttggtcaggctggtcttgaactcctgacctcaggtgatcctcccatctcggcctcccaaagttctgggattacaggtgtgagccaccgcgcctggcagtcttctattgatttttgtaggagttctttatataactctagatgctagttctcataagctttgcatgtatcttgctatttgtagcttgtcttaccacttttttcgtattttctgatttacatgttcttaattttagtagtcagatttactgatccttaatttctgtcttggtctgttctggctgctataacaaaaataccgttaactaggtggcttgtaaaaacaaacatttataaacagtgaacattctagagaactgtgaggattaagtccaatatcaaggtgtcagcagattcagtgtctggtaagggcccatttctcataaagcccttcatgttgcaacaaagttccttcaagcattttcccaaacaacatttcctccatattgccctgccaacacaccccactgctacaatatagatgaaggctgttctgggaatttatgtaagtgggatcctacagaaagctattacttgtggttgactactcttgctcaccatgttgttgagattcatccacattgcatgttattgataattcttttattgctaagtagatttccagtgtatggatattccacaatttcttcatcatttgcttattaatgcacatattgtttttactttggcttttatgaataaaactgttatgaacatttttgtggagtatgcattgagttttcttggattatacctaggaatggtggactttctgggttatagattaggaatatgttttaactttattagaaactgccaaatattgttattttccaacataacccggttggttttaccactttaaattgcagtcagcaataagtcttccagttactccacacatcttgccagtacttggtgtttaatttttttttttaatctggcctttctttttgggtgtgtaatagtatcttactgtggttttaatttgtatttttctgatgatagtgatggttgagtatcttttcatatgtatgtggaccatttggatattttgttttgtgatactatcctttcaaatcttttacccatatttttaataggattgtttgtcttatcaagttgtagggatttttttaatgtattctgaatacaaacccttttcagaaataagtattttttcctagtctatgccttgcgtttttattttaatgctgtcttttggttagtgagcagaactgttcaattttaatgaagtcccatttgttatttttatctttgtggttactgtgttttgtgtcttgtttaataaatcttttcttaatccagggtcataaagacattttcctttgatcactcctagaagtattatagtttgaagtgattttttttttttttttggagatggagttttgctcatgtcacccaggctggtgcacaatggcgcaatctcagctcattgcaacctctgcctcctaggttcaagcgattctcctgcctcagcctcccaagtagctgagattacaggcatgcaccaccacgcccagctaatttttgtatttttagtagagatggggtttcaccatgttggccaagctggtctcgaactcctgactcaggtgatccacccacctcggcatcccaaagtcctgggattacaggtgtgagccaccgcacccagccaaattaatttttgtgtctggtggaaggtgtaggagttaaggttcattttttttcctcataataatatctaggccaggcacagtggctcacacctataatcctagcactttgggaggctgaggcgggcagatcacttgaggtcaggagtttgagaccagcctggccaaactctactaaaaaatacaaaaataactaggtgtgttggcgcactcctgtaatcccagctactcagaaggctgaggcaggagaatcacttgaacctggaaggcagagtttgtggtgagctaagatcacgccactgcactccagcctgggcgacagagactctgtctcaatttaaaaaaaaaaaaaaaaaaaaaaaaaagaatatctaattgtgctaactccattcttttctctgtttaactgctttgacattttggttgaaaatcacttgatcaaatacgtgtaggtatatttctgttcctttgatttatttgtctattcttattccaatatctctttgtcttaattactgtagctttgtagtaagccttgcaatctgatagtgttctaatttttttttcttcttcaagattgtcttggctatgctatctccattttatatctgtggaaattttagaagtagcttgtcaatttctacaacatggcctgcttccatttttgattgaggttttattgaatttatagatcactttgggaagaattgataacaacattaagactttcaatccacaaacatggtttatttctgtttaagttttctttaatttctctcagcagtgctttattttcagtgaagcactgttgtatatcattatttctaatagacagccaatgttctgatattattgtaaatgtttttccggctcattttctaattgtttggtgctacatatgcagtcgtgttacctgaaaataaaggcagatttgacttcttcctttctgacttttctacctttaaacattatatttaaaagaatggtagagactggagtaaatactctcttctcccagggtggttaagcccaatcctctgtgagggaacaagaatgagaagctgatttttctggctgggcatggtggctcacgcctgtaatcctagcactctggaaggccaaggcgggcagatcacctgaggtcaggagtttgagaccagctggtcaacatagtgaaaccctgtctctactaaaaatacaaaaattagccatgcatggtggggctctcctgtagtcccagctactcgggaggctgaagcaggagaatcacttgaacctgggaggcagaggttgcagtgagccgagatcatgccagtgcactccagcctgggtaacagagcgagaccacgtctcaaaaaagaaaaaagagagagaagctgatttttctgatccaattaggaattgaggtggatagggttgagttttagctttagttagtttcatataacctctggtcacaaatgactcagggcaaaatctgtactttgtatggtacaggccccttgctgtagtagggaccctgggatctaagtcccagagatctctctctgctttctaacccagctgtcagcctccagcactgacacacagtaaagtaagttccattaggagtgaatcagtggacacagagccaactctaggtttgagactcctacagattctagtctattataccagcccacagattttactttagcaaaatctgcctgtcggagccttcatctttgcctagccttgtagagattcagcgtatgccctcagggaggaaaaactgtttaaaggctgttggttttttttactttggaatttagttatttgtgttctttgtgtccacaactctccagtgtctttaataaaatggttttctaagttttatctgttttgttttcttgccattatggctttaacaatggtttctcatgttgttctacatcttaggcagaagctactagttcagcatgagtttttgttgtttttctttttcttttttttttttttttgagacagggtcttgctgggttgcccaggctagagtgcagtggctcaagcatggctcatcacaacctgtgcctcctgggctcaagcagtcctcccatctcagcctccccagtagctgggactacaggcacatgccaccacgcacctggttaatttctgtgttttttttatagagacaaggttttgccatgttgcccaggctgttcatgaactcctgggctcaagcagttcacctgcctcagccgccggaagtgctgggattacaagtgtgagtcaccatggctggcctctgtttattcttactatgaagtagttatttgggctgcaaacctccataagacccctcccctcttcccttagcactaaggttcacagcaggcattgttgtctggcagtctcttgatggtgggtaaggattacttctatcctgcccttacgctcaggcaatgagtccttcagtgtctctgctttatgcaatgagagtctcttattggaacccccaccatagattaggccctgggcaatgtgtcccatgaagcttggaaagctaaccagattttcaaatgtcctccaagggattgccagctttggtgttcagcttacatctctggattctccttagttttagggccctaagtattccttactttattgctagctttacagtgaattttcataagatgtgtttcatatcttacccaatatttttaattattttcactggaagagtaggtcaaggtgtctaatttaccagacttctggtatgtagtccttactaaattttgaatccattccccctcttcaactccactgacactaatgtatcagatccttctcatcatctctcactgtagtctctgaactgattcccttcctgtatgccaccttctgctccctgatctttccaaaatgtagtacacatccataatatcttacccaaagcatttggggccagatatatttaggaatacacttttttccccagattttagaaaggtggtatagttcatataccatctgtggtatgctcatcacaatcacctccacctcctgcttatgtaataccttgaaatcaaacacacttaatatttttggagcaaaacatgtaattattcaccttaagtgagatcaatgaagtctgtcattagcctcacatcaggttagattttcccacctagtgaacctgagaccacactaccaaataaacaaaactttgacttttcaggtttgagatctcagaattgcagataaagggttgtgaaccgatgcctggcattcagttatatcattctcaaatttaaaaattctccaaatcctccactggagttcttactgcttatgagagcaaatctagcctttaaagaggcttcacatgtaaaaatggccctttctggtttcatcttctggtactctgatacttctcatattcagcttccagacaccttcatgcctttgtgctttttgtaaattgtattccctctttctcatagcccctcactctcaagtgtcatttctggaaatctgaatctctcagacaaagttaggggctgattattctgtagaaccctatatatacttttatttatataaccctatatatacttttattctagaaatatgcaaattggatttgtatttgttttcatgtctcactagactgaagcttcttgataggtctttttcatttttgtatatgcagtctaatatggtgcctagtataataaatgcttaaaatacattcattgaatggttttccagttagattatataaccttggatgagggtttatattatgttttgtgttattaatttattttgtttttatttgttttcttcgggctttcaattaaatgctgtatccacagcattttctagacctggggcttacctggctgtaggattaggacagttgtaaaatgactgatttttagacaggacttgcaggatataagcatcaggcagtatttaaaaatctgggaaattagcaataaatgttatgcagatctcatgggaaagtgctggaaactagtgttaggtaggagttttatgcatacagactgtaaaatcaatgtctcagcacgaatgagggaaaaaggatctggggatttgggtaggaggaagcagaaaattgagagggactgtactgtgaaaggcaggtttctcccttgccctggaataatgggagtactggatgggaaaccaaatcagaatcctggatgttgaccctttattgaaacttgaaacataaagcagaggcttagtaatagttcagtataagggagactgtttactagaaaccagctttcatgatcataccatgtaaacttgataatgagacataaccttggttttcttaatatattactcaactagaggtagatttattcccagagtttggggacaatgccagggtagaacatgtaagttctgttgtgcaccaaaataacttagtgtaaacacagggtactctaaagacagttctcagtaatgaaggtaatatatgctggaacactaccagttgccaagattgtacttgttagtctaaattttcttgtattcatgttgttctttttcatccctctcccccattttttttcaaatcttcagaaactgtatgagctgaataaccttcatgcacttatggcagtggtttctggcctacagagtgccccaattttcaggttgactaaaacatgggcggtgagtaatattctttagttaatgaaaggttagacttcctgtggaaaggaaagatatattcatttcctttgtaattcttattaaagttaatataatgataatcaataaggatttttaaattgctttgtactctattctttgatacctacattttttctccttaagcagtgcactgggtataaggtaatttttgggtacagcttggtgcttagtttttgctccttagagaatcatttttgttgaaacactttcaatatctttgacaacgtaatgtttaatattcaactgatggaaggtatgaatacaaaaaaattgcatttaatcgtaaagattatgcttttggaaagtttgaggcatatctgaatcataggtttcaaaaaaattttactgatttcaatttccattattttttagtgagtaaatcttaagttttttccttaggaataatggaaaactagatgattaacatggaattatttgctgttgctgcacatgctgatattatgttaatcatatttggttctattacttatatgagatcagagtatgaattttgacctctgcaaatttgtgtattttcatatttgagtaacatgatattgtactcaatcttttcaggtagttttcatttatagtttatataagtaaaattttatattcaattaaatttatttatattcaatactattctttaatgttaaagagcaactattttgtttagaatcgattacattttgtacaaaggatcaatgtgtttttaaggttctgggctaaaatcatgactgactttttaaaactttattactaaaatataactttttaattaacaaagtgctgcttttgctttttatagtatctgaagagacagatgtttcccatgaaaaccagtgtagatttctatattggaaaaacattagtatggaaaagcttgtgatcctttttatgtttctcttttctattttatagaaaaaccttggtgtgaagggttttctttaaaaattctttttaataattatggccttattgtcttttcttaaaatttgaatttcatggaggaatggaaatgattataaatatacagttatgaattatatctttaaagttttagggaaaagaattatacgctgtgaaaaaaaaattctatttttattttttgcatccaggctggagtgtagcacgatcatagcttactgcagcccccaactcctgggctcagaggatcctccagcctcagcctcccaagtaactggactacaggcacatgccaccatgcccaactaattttttaaaaagtttttatagtgatggggtctcactgtgttgtccaggctgttttcgaacgcctgatctcaagtgatcctcccgccttagcctctcaaagtgctgggattacaggcatgagccattacgcccagtcctatacttttatttatgatttggtttagtaatgaggtagattttgctgaagttaatttttattttccttgaagatattttcattgcctcccttatgtatttttgtggaaaataataatttttatttggtaacagcttcattatttatctgaataaaacttttgatggtttgtattttaaaatatttcatactgtgctatgcactctgtaattgcttgacatttaatagtgaatgatctagacaaagttccattttcatacagctaacattctgctggggaagaataaattacaaataaataaatgacataaatagcaataaatgctctgaagaaaagtagaaaggaaggcaggacagtactgtgttatgtaacatggtaagagaattgttgataaatgacagttcagtagagacctggaggaattgagggaaccatttatttggatatctgggagaagagaattccaagtagaggtaataacaagtaaaaaggcccagatacattcaaatggcagagtggttagtgttgacagtagaataagctaggaaggtacccggtggtaggagatgatttcaaagaggtggcatgaatcagataatggaggtgctgtttacttatattcagagaggtatagagaaggaccattgtgggctggggttctattttacacatactgtgtttgagttggctagtaaacatccatgtgaaatgtaaggtcagacttagatgtacaagtttaagggagtggttggggctagagagagattgttataatcatcaatgtaaactatttgaagctagatgggattacctaaggagggagcatagatgaaaagccctgggaacctccaggattcccaagtagagattggaaaaatgaggagaaatcaacaaaggaaattacgggtaggacacatttttcacagtcaggtaaagaaaatgtttcaataaaaattgatcacctttgtcaaatgctactaataatttgaataaggtgcaaagtttgagatgacctgacaattggaaaggattggtgacctcgggaagagtgatttcagtagagaatggggtgaaaaactgactggagttgagagaatggtgatgaagaagtgggacagcaagtatagagaatgcttttgaggaattttactgtaaagggctgcagtgtggtttgcagagaaatatggtacctggaagggaatgtgggaccaaagatttgttgtattttgttttgtttttggaaatggcatcaatggcaatatgttttatgttggtggcaataatctagtagaactaaaaaaatgacaagagaatgaggaattataccagtgatatgcttgatgagatgaaagagaattagatttagtaccctagtgtatcagtaagagtttatccattttacgccgggtgcagtggtggctcatgcctgtaactccagcactttgggaggccaagtcgggcggatcacaaggtcaggagatccagaccatcctggctaaaacggtgaaaccccgtctctactaaaaatacaaaaaaattagtcagacgtggtgatgggcgcctgtagtcccagctactctggaggctgaggcaggagaatggcgtgaacccaggaggcggagcttgcagtgagccgagatcgcgctactgcactccagcctgtgcgacagagcaagactctgtctcaaaaaaaaagaaaaaaaaagaaaagatagtttatccattttaacagcagggaagggaacacatttagttacagatgcaggtaagttggtagatttcgtggtgggattcttagaagttctgattgttttgtttcctcagacataaaaaagcaaggtctttagttaaggtggtatgggagaggtgttggagatttgaagaaagaagagaggatataaaagtcatctggagagtgtgagagtgtgttaactaagaaaacgtaataggtttgatagaccttatgtaggatccatctacttaagacttttttttaatcatgaatttaaagtaaaaccagtcagcagagttatgtattctccagccaggttcagatattcagcataagctttcaatagtgccaagagttgtatttaaccagagatgggatttttcgaggcttttgtaccagaagggttaagggtagcacaagaggtgaaagacggaaaatatgagagttgttttattgacagatgaggaaactaagccaagtaaaaggaggaagatgatgaacagtgaaaaggtaggctggtcagtggtttggaagccacagtggagtcaaataatcactggattcagaatgagaaagggagtgcaagctgagggtggtagaagataagatcattggagcagaagtccagaaactaagaaaccagagtattgggagtattctctccatgaaatggcaatcaccaagatttatgataataattttggttcatggattttttttctccaactacaaaaatcttcaagatatagggggaaaatgacttgtagatctataaatgacagtaacataagtgttgtaatctagggttctcttgtttaatatggtagccattagctacatgtggctattacatttaaatcattaaaataaaataaaataaaaaatttagctccttgatcatactagccacattgcaagtgctcagtagtcacatgtggctagtggctatcatattggacagcacaggcatagattttcaccatcacataaaattctgttggacagcacttatcctagtgccttcaatttaatagaagctggaggattttagggagcagggtgagagataatgagctggaagaaattgtgaagagtaaggagcaaagattacacctaacctacctccaggcatatgttacaaggtttataagaaaagaaagggaatgcttagagaaaatgttaaggatagggattttgcagaggatggaccatgaattcaggaggatacagttggaaaggtttgggatggttttgttttgttttgttttaaccgataaagggaatgtaccaaaaagacaacaacattctatgtagggaaaatattaagagcatcaaggaaaaggatgcacaatttcactgttgtattcaacatataattgctattgtatatgttttaatgttcataacaacattattcacatagtcaaaaggtagaaacaacccaaacatctaacagtggatgaatgaatagacaaaatatagtttatacatacagtggaatattcatctctctttaaaagcaatgaaatcttgatacatgctgcaccatgaataaaccttcagacattatgctaagtgaaataaaccagatacaaaagaacaaatactgtataattcctataattccacttatatgaggtacctagagtaatcaaattcatacagacagaatctagattgatggttgccagggatggggagaaatgggatttgggagttattatttaatggatatggagtttcattttgagaagatgaaaaacttttggatatggatgttggtgatatccttgaaatgtccccctgaaaatggttaattgtatgttacgtatatattttaccacagtttttaaaaaataggtttacttaaagtggttgaatatatgagcaatacaaaattggttatatttgaaacaagtattatttaaaaggacatcgtttacaatatcaacaaaagaaacaaaatatcaaacaataagtggaataaaatgtgtaagacctatatgcagaaagttataaaactttacaggaagtcattaacaaagaactaaatagagggagcaatagcccatgttcatggatagaactattagagttctaacaggtttttgaaactgtaaaataaactgaatgttactaaataaatgaatttagtaacattccaagatacaaaattatcttacaaaaatcagttgcatttctgtacattaataacgaactatctgaaaaattaagtttaaccaaggaggtgaaaaatctatacacagaaaactataaaacattaatgaaagaaattgaataagatacaaatgaatggaaggatatcctgtgtttgtgcattggaagaattcatattgttaaaatatccatacagcccaaagcaatctacagattcagtgcagtcactatcaaaatttcaatgacatttatcacagaaatagaaaaaacaattctaaaattcacatggaatcacaaacatctcagaatagccaaagcaatcttgagcaacaacaaagctagagacatcatactctctgattttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtattttttagtagagacggggtttcaccattttagccgggatggtctcgatctcctgacctcgtgatccgcccgcctcggcctcccaaagtgctgggattacaggcgtgagccaccgcgcccggcccatactctctgattttaaaatacactgtgaagctatagtaatcaaaatattgtggttagcataaaatagacatgtagaccaatggaccaaaataaagggcccagaaataaatacacacatttacagtcaattgatcctcaacaaagataacaagaacacacaatggggaaatggtagtttcttcaataaattgtgtcagaaaaactggatgtccgcatgcaaaagaatgaaactggacccttatctcataccatctgcaaaaatgaactcaaaatatacttagtacttaaacatgagacctgaaactgtaaaactactagaagaaaacacacgggaaaagcttcttgacagtggatctggacaataattttttggctatgaccccaaaagtacaagcaacgaaagcaaaaatatacaaaatgggattgcatcaaactaaaaagcttttgtacagcaaaggagacagtctatggaatgggagaagatatttgcaaataatacatctgataaggggttaatatccaaaatacagtcatgcatggcttaacaatgaggatactttcggagaaatgtgttgtttggtgattttgttgttcagacatcatagagtgtaatcacacaaacctagatggcatagcctacaatacacctaggctatatggtacagcctattgcttctagactacaaacctatacaccatgttactgtactgagtaggcagttataacacggtggtatttgtatatttaaacatggaaacagcacagtaaaaaatacagtattataatcttatgggaccactgttgtatatgcagtttgttcttgactgacatgtcgttttgcagcacatgactgtataaggaactcagacaatgtgataacaagaaaacaacccaattaaaaaatgggcaaaggatctgaatagacatttctcaaaagaaaacatacacaagtcccacaggtatatcaaaaggtgctcaacatcgctaatcatcagggcagtgcaaatcaaaaccacataatatatcatctcacacctgttagaatagctgttatcaaaaagccaaaagataactaacgagttttggtaaagatgtggagaaaagggaactgttgtacagtgttggtgggaatgtaaattggtacagtcatggaaaacagtatggagattcccccaaaaataataatagaacaattatgtgatccagcaatcccatttctgagtatgtgtccagagaaattgaaattgatatgtcaaagagatatctgcactcctatgttcgttgcagcattattcacaatagccaggatatggaaccaacctaaatgtccatcagcagatgaatggataaagaaaatgtggtttatatacacaatggaatactattcagccttacatttacaacagcatggatgaatttggagatcattatcctcagtgaaataagctagatacagaaagacaaatgctactgcacaatttcacttatctgtgaaatcttaccaggctgaactcatagaagcaaaaagtagaaggatggttgctgaggggcaggggaaatgttgggtcagtaggtacaaagtttcagttatgtagaacaggggtccccaaaccccgggctgctgaccagtgctggtccatggcctgttaggaaccaggccacagcaggaggtgggcagcaggcaagtgagcattacggcatgaggtccatctcctgtcaaatcagtggcagcattagattctcataggtacatgaaccctattgtgaactccgcatgtgaaggatctaggttgtgtgctccttatgagaatctaatgcctgatgatctgaggtggaacagtttcatcccaaaacctttccccattcatgttcatggaaaaattgtcgctggtgccaaaaaggttagggaccactaatggagagagaataagttctggagatctaatgtacagcatgaggactatagttgactatagttaataagactatgttgtatacttgaacttttctgagagagtggatctttttaaattttatttattatttatttatttttattttttttgagatggagtctcgctctatcacccaggctgtagcgcagtggcacaatcttggctcactgcaatctccacttcccaggctcaagtgattctcctgcctcagcctcctgagtagctgggattacaggcgcccaccattttgcccagctaatttttatatttttagtagagatggcgttttgccttgttggccaggctggtctcgaactcctgacctcaagtgatctgcctgccttggcctcccaaagtgctaggattacaagcttgagccaccgtgtccagcctaaaagagtgaatcttaaatgttcttaccatacaaatacataagaagtaactaactttgtgagatgatggatatgttaattagcttgatagcttgataataatttcattatatatgtgtattaaaacatgtacacctcaagtatatgcaatttaaatttgtcagttataccccagtactgctggtggaagattgattgtaaaatttatatggaaatttaaaggttcaggaatagctaaagaagacaatgggaattggggagataagcacttggcctaacagatgtcaggatatactagattcttggacagtgtatgattcctgcagttttagacatatctaccaatgaaacagaatgaagaacccagaaatacctccttgtttttacaggattctgatacgtgtatgacagaggtggcattgtaagttggtaaagaaatgaggggctgtttattaattggagctgcaaaattggtcaccagtttgggggaaaaaatgaaatcaggccccttgcgccattcacaaaaatccttgtgagatgactcaagggcttaaatgtgaaatgaaaaacttcagttttttagaaggaaaaatatatgtgaatatctctctggtttggcatgaatagatttctggctttggataagtaaggattttttagataagatacagaaagctccaacaatgaaaaaaataataataaattttgtcatgttagagtaagaatttctgttcatcaaaagataccttaaaatggaaaagaggatgcagtgggcggaagatatgtgcaacagttagttgtccaactagaatgtgtccaacacaagaatttgcatccagaactcttaacaacgaaaaaagaaaaaaaatagaaaaattaacattataaatgtattttgtagaggagaggatacacatagaagcagtgaaaatgaatgaactatagcttcccacaacttcatggatgaagctttaatatcacaatgttatatgaacaaagtaattgccaaagactaaaaatgaaataaaagttaaaatggaataaaatttgccaaaaatgaaataaaatttgaggggaatgataaacagaacattcagagtagtggttactggttacctcttaaaggcagtcaaggcaattggatggaagatgagtcatgtgtgttcgttataaagtttaaatccatttaacaaagccataccaggctctaatgataattgagtgtcacaaacaaaagattataattaatctgcaccccgggtctaagataaagtattcatttatgcagttgcacacattcacacatattgtgtgaagatacaaaccaaggtgatgaggaataatctgggagtttgtgtttcctggggtgactgacatgagcgggcattcatctaggttttcccccaaaacagattgtggtggtaaggtggtgttagatatctggtcaggaacatctagaattctgtgggtctcctctttcattaatatcaatgaaagtgtgaagaggcttgcccccatttgtcatgctcttggtgccaaggacatgtagaagtagaacactgtgaagtattttgtccgccccgccccccccacccccagcggtttttggaggggaaaatacagtaaagagactttttaaatataacattataaatatcaaaagaagatttgaaaagaagaaagaaaaggcttctcagttaatagagcttctgagctatcattcaggaaatacctatattaacatctaattagttctttatattcatattcttcctctagtcttctggaaacaagtctctcctaccacaactcagattgaattctatttatctgattattgatttattatgaaaattacaaaatcatgttatagtttgttataacagttctgtgtttcagctgtggcaagattagttacgagttctaagtaatttgtttctcctggtattgtaccaaagtttttgaatgattgacttaggggaaaataaagagcaggtttatcattatccctatgtcacataactatattttgcatatccagatacttccttaagtggtaaagagttagatatacaggcagcaagcaaacatttgcacctaatcttgagattactaatcaagtatcttgaaagtggagtaagagaaaattgtaaaaccgctgttttagaccatggaatatccatctaaaacattaaagcaaaggaccccttgacgttgtattttaaagagggagcgatactgttgagacatttttctaatagagattttctgaagatagtctgcatctttgagcctctgaacaatagatcccaactgtactacttataatactagaaagagtagtggattaggtgtcagaatattcttatctccagaaccagactataagatcctgaaaaacaaggacatacatctttgtgagtgagtgggtaacagagagtattatattctgctgcttgctaaccttgtgatctcagtctcttcatctctaaattaatactcatacttttttgttaatctcataggaaaattaggtgagacttacataggtggaaatgttttgcatgctgtaaaacaacaccaatattttaatatgaaataaagtgaaatctaatgtagtaatgaaatagaaacttcatgtctaaataaaaaaaaaaattttccagtctttggaatgatttgaaaaactatttcctgaaccttttagtgaacaccattgtgggtgactgactttgcttttttttttttcaactccccttgattatttacattgatctcaaaggcacttactgcaaatctgcctctcaagtgtcttacaacagtatcttttagttatgttgtatgtgatatagcactgatcaaagagaagaaaatatcagaaatccaaaaatgtaaggaattaaaggattttacagttattaggactagccatgactagatttatcaagaaaaagtgttaatcgcaaaatttggtgtttatttcttaacattatgcaagaatgatgtttatctttgaggtggcaagggacagttcattaaaatacttggacatttgagctaaatatgaatgcataattttctaaaattaggaaggtgattaataaaaattgattaatttaaaatagtaaacacgaaaatgttataatttattacttagttaattttatgaacatacaaaggatatcttataaataatgaatttggattattaatagacaaatctgattttgtcttatttatatactaccaagatataattaaagaagatataactttgaaattaaaatccatattcacagtaaatacaacttcagttcaggtctttgctacaataaaatgagatttgtaaataacttaggtttttctgtttgttttttagttattaagtcgaaaagacaaaactacctttgaaaaattagaatatgtaatgagtaaagaagataactacaaaagactcagagactatataagtagcttaaagatgacaccttgcattccctatttaggtgagttatgtcactgtgtgttttttgtttctagttgttactcttccttactcagtaatttatgtgaaattcaaggtattttttaaatgtttgtatcttttaaataaattacttcaagattggtaagctgaaaaaaatgactaaagatagttgttaccctgttacctggaatgtattttcatattagattagccttttgccctcaaggtttttcttagactattatgttttcttagagtaggaccatatagtaaaacaatatttttagctgttttagtaatgcttttaaagaatataatagttcgtaatgatgtttaatacattaaggaaattgatcaaagtccttatatagtgaggagatattttagtgtgaattctgaagtagtctcagtgcatattggtattgttgtttacctgaatgaaatgagttgattcactgtggcaatttagcttcgtgctgagacagttctgtatttcgcatctcatctaattaagaatttatctctttattatatatcttgtagtgcttataaattcaagaagtatttaaccagtaatattataagattatttttaacaaaatatgaataatgctttgttaggtgtttgaatgaaaagaagacccaaataagttgttcttttaaataggtatgtaaatcaaacataaggaaaatacatgatacatacctagcatacattaaaatgaattgatttgatcctatgtagagagtaatcaaatgatgaagatttggtgctttctggtcctccccaccccccagattttgtgtttgatgaaattactcacactaaatttcaagatagctatttctgagagtgattacagtgtcaccttgaagtgtttacagtcccagtgactagaagacaaagaagggacaaaggcagttgatacatgcccatttagctactatagaacatcaaccttagtttcccagagaagagtttaactctttagaatattgtgggacaccctaggattgcagagaatggggacctattgtgtaccttgtgttgaaggcagaatacccctaagcacagtagagttagtggccactgcatcccagaatattttgtcctgtttctttgataaacagcttaggatcatagtaagcatgactcttatcagagaggctctaagctggatattaggagaaagacattctgtatgtgctttacatttttaggttgttgctgtcattgtttgttttgttttgttttgtttgttttttgagacagcctcgctctgtttcctaggctggagctcagaagtgcgatcgctgcttgctgcagcctctgccttccaagttcaagtgattctcctgcttcagcctcccaagtagctgggattacaggcaagcaccaccacgcccagctaatttttgtatttttagtagagacagggtttcgccatgttggccaggctggtcttgaactcctggcctcaagtgatccgcccatctcagtctcccaaagtgctgggattgtaggcatgagccatcacacccagcgtggtgctctgtgttttaccatagccttggctgtgcccatacttgcaaatataatttgaggagagaaggaatagggaatttttcaaaaataataccttcacaattcagaagaatgtgtactttttatagtatgaagaacattagactgagaattggcaatcctcaattccacaatgactctacagtccttatttttcaagtcattgaattttcttctttgagccttgttctctttacctagaaatagcatgcataggactagaatcatgttctccttaaggctggatgggagcattgtgatatcttctttcttttcttttttttttttttttttgcgacagagtctcgctctgttgtccaggctagagtgcagtggcacagtctcagctcactgcaacctccgcctcctgggttcaagtgattctcctgcctcagcctcccaggtagctgggattacaggcatgcaccaccatgcccagctaatttttgtatttttagtcgagatggggtttcaccatattggccaggctagtcttgaattcctgacctcaagttgtccgcccacctcagcctcccaaattgctgggattataggcatgagtgatggcacccagctgtagtgatgtcttctaattaacttattttactatcgagaaaaccaagatccagaaaggtagaagacctggctcatagtcctaagacctagttactgacaggtctgcattctgaagtcttaacctagagagctccaattatacctgctgaactctcattttaaaatttaccaattttacgattgctttctttttctcattgaaatatgtttttctcaaactaaatttcataatttgtatcttctagaaaagaaaattaagattattttccattcaaaatgagaaaataagataataggaatccttatgctgtgatttctagttggggaccttcttgtactcttggaccttcttgacatttttccacagtggagacatcagtacaggattgaagctgtgtacgtctgtatatgtgctcaggtacattcatgcactctcatgcacacacagagagaaagttggggaagaaagcactagccaagttggagtttagtagaatcaggaaaggttttctagtggagaatatacctcttctgtctcagcccccgacctgaaacaaagagtaatcatacctacgggttaaagcaaatgcggaaaatgttgaggtacagatgttaattttgagaaaatattacaagcattgtttttctcgtatcttccatttttcccatcatctccaatgactccttctttttttcagttccctttcattttatatgttctcatgatgtaggatcttacgtttcactctcaccgtgtagttctgcttcactttatacttaagccaatttaaaagtatctcattcttgttgtcacctttttctccatcttcactctctagaaattttcctaataaggtcaccagtgacttcctggttgaaacattttatagatgtttctcaagccccatcttaattgtgtgagggttggtgtcaattatttctcctccttgaaattctccacaagtagcaccagtctttcttggtttcccttctacatttctggcttttattagctgctcttactctacctttgtctcttaaatgtattcttgagaggtctcagtccacttcttttctttctttcttttttttatttttatttttcagagacagggtctcactctgtcatccaggctggtgtgcagtggcatgatcagctcactgcagcttcaaacttctggactcaagcgatcctcccaccttagcctctgcagtagctgagactacaggtgtgcaccaccaagcacagctaattttaaaattttttttgtagagacaggatctcgccatgttgcccaggctgatctcaaactcctggcctcaagcagtcttcctgcttcagcctcccaaagtgctgggattacaggtgtgagccactgggctcagccagtccacttcttttcttactctatataatcggagtggtctcattcaggttttttctgtatattgcctgatcttccaaatctagactgaatctgtctaactttgtatatcactgtatattttatatctatctgtatatcttagctatctacttaatccctggggccgtctaacatttttaggtactaaaatactgattcattaagtgagaaaaatctacaggtatctcccattcaacatgtgcagaagtgaattcatcatgtcttcttcttcctccaaacttgatccccatctgatctcctagctttctctaccagtgaccagtcagtgtagtagtattgacactgcggtaccacactacagcctggtgttttaatgcatttctgtttcctcctcctctgcttctcatattctctagtaaaatgtatgtgtctgagggttacccaagaattagaaaacaaaaggcagcggggagggttccaagatggccgaacaggaacaactccagtctacagctcccagcatgagcaacacagaagacaggtgattgatgcatttccaactgaggtaccgggttcatctcactggggcttgtcggacagtgggtgcaggacagtgggtgcagcccaccgagccgaagcagggcgaggcatcacctcacccgggaagtgcaaggggtcagggcattccctttcctaaccaagggaaggtgtgacagaaggcacctggaaaatcgggtcactcccaccctaatactgcactttttccagaggtcttagcaaatggcacaccaggagattagatcccgtgcctggctcagagggtgccacgcccacagagccttgttcattgctagcacagccatctgagatcgaattgcaaggcggcagcgaggctggggaaggggcatccgccattgctgaggcttgagtaggtaaacaaagcggcctggaagctcaaactgggtggagcccaccgcagctcaaggaggcctacctgcctctgtagaatccacctctgcagggcatagctgaacaaaaggcagcagaaacctctgcagacttaaatgtccctgtctgacagctttgaagagagtaatggttctcgcagcacagagtttgagatctgagaacagacaggctgcctcctcaagtgggtccctgacccccaagtagcctaactgggagacaccccccagtaggggcagactgacacctcacacatctgggtagccctctgagacgaagcttctagaggaacaatcaggcagcaacatttgctgttcagcaatattcactgttctgcagcctccgctgctgatatccccacaaacagggtctggagtggacctccagcaaactccaacagacctgcagctgcgggtcctgactgttagaagcaaaactaacagaaaggacatccacaccaaaaccccatctatatgtcaccatcatcaaagaccaaaggtagataaaaccacaaagatggggaaaaaacagaacagaaaagctgaaaattctaaaaatcagagcacctctccccctccaaaggaatgcttgccagcaacagaacaaagctggatggataatgactttgacgagttgagagaagaaggcttcagattatcagacttctccgagctaaaggaggaagttcgaatccgtcgcaaagaagctaaaaaccttgagaaaagatcagacgaatggctaactagaataaccagtgtagagaagtccttaaatgacctgatggagctgaaaaccatggcacaagaactacgtgacacatgcacaagcttcagtagcctattcgatcaactggaagaaagggtatcagtgattgaagatcaaatgaatgaaatgaagcgagaagagaagtttagagaaaaaagtaaaaagaaacgaacaaagcctccaagaaaaatgggactatgtgaaaagaccaaacctgcgtctgattggtatacccgaaagtgacagggagaatggaaccaagttggaaaacactctgcaggatattatccaggagaacttcaccaacctagcaaggcaggccaacattcaaattcaggaaatacagagaatgccacaaagatactcctcgagaagagcaactccaagacacataattgccagattcaccaaagttgaaatgaaggaaaaaatgttaaggacagccagagagaaaggtcaggttaccctcaaagggaagcccatcaaactaacagcagatctctctgcagaaactctacaaggcagaagagagtgagggccaatattcagcattcttaaagaaaagaattttcaacccagaatttcatatccagccaaactaagcttcataagtgaaggagaaataaaatcctttacagacaagcaaatgctgagatattttgtcaccaccaggcctgccttacaagagctcctgaaggaagcactaaacatggaaaggaacaactggtaccagccactgcaaaaacatgccaaattgtagagaccattgatgctaggaagaaactgcatcaactaatgagcaaaataaccagcgaacatcataatgacaggatcaaattcacacataacaatattaactaaatgtaaatgggctaaatgctccaattaaaagacacagactggcaaattggataaagagtgaagacccatcagtgtgctgtattcaggagacccatctcatgtgcagggacacacataggctcaaaataaagggatggaggaagatctgccaagcaaatggaaaacaaaaaaaggggttgcgatcctagtctctgataaaacactttaaaccaacaaagatcaaaagagacaaagccattacataatggtaaagggatcaattcaacaagaagagctaactatcctaaatatatatgcacccaatacaggagcacccagattcataaagcaagtccttagagacctacaaagagacttagactcccacacaataataatgggagactttaacaccccactgtcaacattagacagatcaacaagacagaaggttaacaaggatatccaggaattgaactcagctctgcaccaagcagacctaatagacatctacagaactctccaccccaaatcaacagaatatacattcttctcagcaccatgttgcacttattccaaaattgaccacatagttggaagtaaagcactcctcagcaaatgtaaaagaacataaattacaacaaactgcctctcagaccacagtgcaatcaaactagaactcaggattaagaaactcactcaaaatcgctcaactacatggaaactgaacaacctgctcctgaatgactactgggtacataacaaaatgaaggcagaaataaagctgttctttgaaaccaatgagaacaaagacacaacataccagaatctctgggacacatttaaagcagtgtgtagagggaaatttatagcactaaatgcccacaagagaaagcaggaaagatctaaaattgacaccctaacatcacaattgaactagagaagcaagagcaaacaccttcaaaagctagcagaaggcaagaaataactaagatcagagcagaactgaaggagatagagacacaaaaaacccttcaagaaaatccatgaatccaggagctggtgtttttttaaaagatcaacaaaatagaccactagcaagactatatatataataaagaaaagggaggaatcaaacagacacaataaaaaatgataaaggggatatcactaccgatcccacagaaatacaaactaccatcagagaatactgtaaacacctctctgcacataaactagaaaatctagaagaaatggataaattcctggacacatacaccctcccaagactaaaccaggaagaagttgaatccctgaatagaccaataacaggctctgaaattgaggcaataattaatagcctaccaaccaaagaaagtccaggaccagatggattcacagccaaattctaccagaggtacaaggagttgctggtaccattccttctgaaactattccaatcaatagaaaaagagggaatcctccctaactcattttatgaggccagcatcatcctgataccaaagcctggcagagacacaacaaaaaaagagaattttagaccaatatccttgatgaacattgatgcaaaaatcctcaataaaatactggcaaaccgaatccagcagcacatcaaaaagcttatccaccatgatcaagtgggcttcatcgctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactcccaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattagacaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaagcacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggaatcacactacctgacttcaaactatactacaaggctacagtaaccaaaacagcatggtactggtaccaaaacagagatatagatcaatggaacagaacagagccctcagaaataacgccgcatacctacagctatctgatctttgacaaacctgagaaaaacaagcaatggggaaaggattccctatttaataaatggtgctgggaaaactggctagccatatgtaggaagctgaaactggatcccttccttacaccttatacaaaaatcaattcaagatggattaaagatttaaacgttagacctaaaaccataaaaaccctagaagaaaacctaggcatcaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacagtgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccactatgagataccatctcacaccagttagaatggcaatcattaaaaagtcaggaaacgacaggtgctggagaggatgtggagaaataggaacagttttacactgttggtgggactgtaaactagttcaaccattgtggaagtcagtgtggcgattcctcagggatctagaactagaattaccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagatcaaaaaaccaaacaccacatattctcactcataggtgggaactgaacaatgagatcacatggacacaggaaggggaatatcacactctggggactgtggtggggtggggggaggggggagggatagcattgggagatatacctaatgctagatgacgagttagtgggtgcagtgcaccaacatggcgcatgtatacatatgtaacaaacctgcacattgtgtacatgtaccctaaaacttaaagtataattaaaaaaaaaaaaagaaagaaagaaaccaaaaagggaaaaaaaaacagaaggaaattaagaacatacactatagcatctgcataattttagatactggtattcttcatatagttcatccctatctgggtatgtgaagaagcatcttgattgtgagattattgtggactcctgggcataaatatttggtagacatgggaaaggaaaatgaaacatttgtcagatgagtttttatgactcagtttagttcgtttccagtatgaaaatcatccttttaatgtaatgactgctttgccttatagcaaaccgttagattaaatgtatttaatctattaaaacatacatggttttgattcagaatccttttctattcatgtgaagggaggcttagtacagttgacaaaaacttcagcatttataaatgctgtacatttgatagaagttgccctaagaacaattaaaaggtaaaactcattatgcaaattggtagcttcatttaactattcctcttcaagtatacagagtttgcataatgctatgctttattcattatgtctgcagaggttattatggaaagaatatatccatgaaatatctatagtgcatagaaaaaaggtaaccgctaatgatttcttaacatgaggtatatggtccaaactaatagttttttctcccctaaaaatgagaaccaaaacctaccaatttttgtgaagcttgtaaaagggagtagagtcctatatgctggtaaaactcttattttgataccaccaaatttatctgtagttcaatgtggattaaattataagaagtagaaatgttttctcggctctcaactcatcatcccttgaaaaattgtctcttctgttggtttgcattcaaggtaaaaattagtcagcttggacaatatcgtgaaaaattcttagaataaggatataatttgtctagagaggaatagttggcaaatctgaaggaaaaaattgctttataagagaattattgcttttaaatctgaaagtcattaacaacacttatttgttcttgtcattggagaacagtcttaaggggcttgttgaagaatttggcatggtaagttttattttgctgacgagagcaaactagaatattgtgaaaaaaataatttagttatatgaaacatcataaatattctttaatgtgctttttctaagcctcatttctactttatgtactacaaagatgcagtagctcgaccaagaaagcatattttggctaggtgcggtggttcatgcctgtcatcctagcactttgggaggctgaggcaggtggatcacctgaggtcaggagttcgagaccagcctggccaacatggcaaaaccacgtctctactaaaaaatacaaaaaattagctgggtgtggtggcacacgcctgtattcccactccagcttgggtgacagagcaagactccatctcaaaaaaaaaaaaaaaaccatattttttgaactgtggaaatcagtaaattgttgcagtactctgtactgcttcctattaagtagaagcagaatgtaacagaaaagtttttgtaaaatctctagccctctgtagaatgtgagtatactcttttggtggatctagatatgactcctttttcctgttggagagagacttcttccccttccccatttaatttttaatttaatatgtcaggttttcatgatagtacttttttgttagaagagaaatacttttcttataaccctctgtaatatagtgttccttgcctactgctctctgaaaagcaccctgtttatgatattttcattaatctgtctcctcctcaacagaatgtaagcccctatttgtcttggtttaagggtttatccttacagcatctagaacaaaagtagtcatataataaatgtttcttggttcaactaattatccctttctagctcttcccattgtttcagtgattttgatttaatttctgtttaaacaataaatgtatttgtgtggcatatttgcatgggtcaactccttacccacccctgattttttttgttgttgttattttgttttgtttttggtgcctcagctggcacctagtatttacttagcactgtgcttggtgctaaatatatagcaagagattacaatgggctttgtccctgcctttatagaacttaatatctctggaattacaaaggtccaggatatcattaacctcatgaataatctctcctcttttctatatcctggaagagatgcatatcattgccttgtgccttacattgttagtggtgtccttatcatagttaatgacatttttaaagcatacctaaaatgataagaatcttaccgatttggttttcagtcgtttttgcatatattgaattgttaaatattcagtagaatatagttatttagttttagaaatttctaactcatgtaaaaatgttttcaagaataatagttttgtattcatatttctattcagataatttcaacaaagtccaagtctttttgctgatctgtaggaattaaaaggagatttttcctctcgtttgatagaatttttcttcaatatgtaaggctctgacactgatctcagaaatgcctgttggtcaataaatgtcattggcttttaatatttcaagttttattccattttcctttctttagtttgatttgtcaataatatacattatggattaccttaccctattcttttaattatatgttgttatatattgtatactaaaacagcagtaaagcatcttcactgattttcttttggatttgagaataagctctgaccaaatggcagctagccccttttctttagccagaattacatccccattttccattacctcatttatatatttttttaccctcactcttttatatatttaaaattcctctaaattctttgttgatatgttttctgaagtttactttagaccaaagacttctgaaataaaagagctgggggtggggttgtgttaatttcatccccatgttcatagtgttttctttaagtgccttgtctttctaaaaaaataagaacagcagctatacagatctgcatgctaattgtaaacagaatcagattcccctaacaacagttttaccagtggtgtttccaactgtgaatatttcagtgatttgttttgtaatttttttaagcaggctttagcaggaaagtaataatttcagtaacatttattcaacacttaggcctatatagctgacactgtactttatatagattatctaatacataacagcagttttataaggtaaatgatacttgtattttacaggtgaagaaactgagacaaaggagtttaaattgacttgctgtaaagatacgtatttcattcacagctcaaagaaagcattatggattacattaaaatttggggtatctgtgttcaggttaaaattttgagttcattcatcagtctttcctgtaattatgtgtacaattataacttgataacagttaactccactgataaaactaaaaagtggccgggcatggtggctcatgcctgtaatcccagcactttgggaggccaaagcaggcggatcacctgaggtcaggagttcgagactagcctggccaatttggtgaaaccccatctctactgaaaatacaaaaattagctgggtgtggtggtgggcgcctgtaatcccagctactggggaggctgaggcaggagaatcacttgaacccgggaggcagaggttgcagtgagccgagattgtgccattgcacttcagcatgggcaacaagagcaaaactctgtctcaaaaagaaaaaaaaaaactgaaaagtgagctagtttaagataagatggccattttttcagggcgaggtcatagccttgtaagtggaatcattgttttcttacttggttatttttcacagacactagaataaaaagactaaaaacttgttagggtataataatctttaacttactacaaagattaatttaaatatatgtaaaccatattactttagtacagatttataagttatttaaaatgtttttatgattgtggaaggtttattctgctgcttatattaccagcaggagtcctaagaaatataatgctaagagaatagcactctcctgtcatgactcagagttaagtaaacagtagaatgaaaattgatctttattctacgaggcatgaagcccagagatagtgtatttgtaggtgtctactaaatttcaagttgctgtctaattttggcattttccaaaatctcaaatttttaaaatctgcttcaggaggtcaggtgttctaggcaatgatggcctcccatttagtccagaatagagtctatatctgttgtaggataaaattcattaacttattcttgactggacacagtggctcacacctgtaatcccagtgcttagggaggccaaggtgggaggatcacttgaggccaggagtttgagaccaacctgggcaacacagtgagaccccatctctacaaagaaaatacgaaaattagctgggcatggtggcatgcacctgtagtcccagctactcaggaggctaaggtgggaggattgtttgagcccaggagttcaagattacagtgagctaagatcatgccactgcactccagcctgggtgacatagtgggaccctgtctaaaaaaaaacaaaaagaaaaattaagtaaaagaatccttctataaaccagctctaagagaaggttgtagttcagtcttactgaagataaggcaaacccatctttattcctagatgacctgcaaagtaggtagctcttggaccttacctaccacacaaatgagctaacctggtctttcacaagactctctttaggctgaaattcatactatgtctcttcttgccttaagttttctttttatttttggtccagccacttaactgcctactataacagctgtcatggctttgttagatttgcaagtgaagataatggatcaatgtaatttcatacccgaaaacttggatattgttttgttttttgagaaagagtctaactctgtcccccaggctcgagtgcagtggcataatctcggcccactgcaagcaattcttctgcctcagcctcccgagtagctgggtttacaggcatgtgccacatctggctaatttttgtgttttcagtagagatggggtttcaccatgtcggccaggctggtctcaaactcctgagctcaagtgatccacctgcttcggcctcccaaagtcttgggattacagatgtgagccaccacgcctggcccggatattgtttttaaaacacgtttgttgatcacctactctatgcaaggtgctatgatttgtattgcagaaagtacgtagatgagtagtaataatatgatagtttaaatctgagtacttacgaatgtcaagcattattcttaatgttttacctgtattaactcatttatttgatcgtcacaaaaaccacgagctagatattcttattataccccattttatagattcaggctgagataggagtttataaattgctcaaggtaacacagctagcaagtggtagagctgggccacagacccaagcagttctgacttcagaacctacactaactatcatataataccgcttcttattctctcctctcaagaaacttagttgcccaagttattatgctgtctaggaacttcagagtaaaataaatcagctctctgaaggagagcagaatgggcccattggctaaggcagtttagcattcagcctagttttccaaggttgtatgttgactttcaaattctagttttaatgatattcttctgtgaaaattctgtaaggcttgtctttgataaagttttgggtgtttaaatgaaatgatatactgctttcaataactgagaagccttggtaaagttttattcacttaagatttggtgtaacagttagatgcccagttccttccaggaatcttataacagattctttggttctgaaggaagtggagagggactgaaaaaccagtttaagatgaccacaggtaaaacaaagaataataccactatgaggtttggatattttgtttaatttgtttcaccagaagttttattttgagatgtggcagatgaaaaacattggtcatgttgatggatttgagttgtccaaatgattatcttcacattaagctattcccatgcatagtttgcctcacacatttcaattcgaggttttctttttgcttaagcaaaagtttcatgagctatctttaaaattttaacttcacaaatatattaaggcaaggtcacctctaagcagtgaatatgtattcctgaaaggaaattgttccagaaagtcactagtaaagttgttgattgcaaagatgagttaaagacactgtgagactaagcgttacatacactgtaaaatgaaattagcagtttggactaagctatgcccctgtggcttctgctctggagctgttgaattctcagtatcgggaaaacagccaacagttccttgagtttgttttagtcccacctgttctgagcatgcactaatacttgtaaagctgtccaaactttctgatttgaattgcagattggttgggtttttttttctttgtagtagtaagatcagtaaattagaaaaaaagtaataataaattagaactataattcagatctgtagcacactaaatattctgcatttttgtaataccaatattttgctgattttagaactacataaaatgcatttctggagattttggtgttcagcatatcatatgaagataacactgaaaaattcattcatagatttgtctttataaattgaccatttaaattatgcatgcattatttttgggtttttttttatttttaaaaatgatatgtatttaatactatgggtcatgttttgggaaaatcagcataggatatattattaagaattcagatttaatcattacgtgtgaaaggcacaaattcaatttgaaataacttttattcaatggaagaagcattttctattggcaaaactagaggtttctccctaattttctgtctgtatttttataaataaaatgcattatttggctgaaattttaaaaatatttttttcactagacgttagagcaatcttagattttaaataaattgttaagtatcttgaacatgttatttatgatttaaaatatagctaagatttgctttacattgtggcaaatatttacattttagaaaacaaactttgtatttagtcaacataatttttaaaataactaggttgtggatacacataattttctgcagtaattgacgacagatgaaactacatttataggttcccttttatagttacggtaaaattcattttaaaaactttctgtgtagaaataaattgtgccaagtaatatacatgtaacatttacatttttaagagctgaaaagtacaaagttctgtgtcatttaaattggcgagtgtctctcttcagtcaataggcttgatcatcatctgaactgctcttaaggagtatgacccgcctctgtattcggcccagaaaattccatcttggtgcttgcttctgtaatggcctcctctgtaccatactccatttaggttagaatgtgcacaggcattgtaccaccagcctcctttatgaaagtgggcgcagtttcctttgaggaaaaaatacagatataaatgtaaaagtttcttctaggtgtggtactctgcaatcataaaaaacttattctacctttaatttgaacttcccttactaatcccagttacctttatctcagcagttttaaatgccttcacttacttgatggctgttgcatcaactgcttgaaaaatcacttgaattgcctttttttaactctttgcttgcttacaatgtacttttttaaaaagggggatttaattttctagttagcagagtagatgcaagcagtgtttatatgtgaaagagttacagagggagaaattgggaaggaaagatacagaagaagataaaagtctgaggaaaattgaattgtcaaaataaaatagcaaaaaataatacaaagtaaaataaaaccagcagtcaaatgggtttctgtaaataagacatatgttatggtctatctctcctcttttctcgtttaccagtgtaaaattggttaaaatagagacctgtgtgctgtttgccaaaatacagctggagagaaaaaccagtttgggacagggatgggggagaattgttgggtggaggggaggaggggatctctgtatcaggacgagaagaaacctgggttaaaaagtcaaaagcatatgaaaactaaatttgaaattatgtggatggtctagttgtttctttctaatgaaaatattaatttcccctttgaatcaagcttttttgttattcctatgccacatgtcacagtcatcttggttttccccctcaaagaaatgctcttacaccatgtatccaaatggcttgcatccttcatttcttgcgactctttattcaaatgttgctttctcacagcagattttcctggcgaacccatataaaatagctgccatcccaggccttgctgcccaccactttctattttcttactcagttttatttttgagagtacttattcccacctaacaaattgttttgtctctcctccagtgagtaagctccaaagggcgggaactttgttcactgttatatccctagcacctacaacagtgcctggcacgtggtaggtgttcagttagtatttgttatgaattgtaggcacttgcattttatttccagattaatgtgtttctgttttgctttgtgtttttttcccagaactttgtttttcacatagatcacactttgggattgccttatagaagaaatcctaaaagctatttctttcagtaggttggttgtatttcctgccacagtgaccaaaactgacctttttgaaaagactttagtagcatatatattagtagattctatttaatgcatagaaggtgatgattctacaaagaatgaaagtttttcatacttacctgcatacatatctttatctctgtccagtgtggtgaattgtttaccattatgccacatcatagaatcccctgcatttccctggtaagttcccaggcgcagtctatagaattcactttcaggttccagacgaaagctgctgtattctgcatagacttttttatcactccagtcttctaattcaatcaataacttgtaattatcttgattgctaagcatatagatattttccagtccaagccagtattctccgtcaatgtttccaaaccctttctgttaataagtgaagaaacatgagtgcataaataagtatagagatagtaaacatttttacagagcagtgttaaacattcgatagcataaagatactggccatttaagtggtaatgtgagcttccattttagttggtcacttgcgttttataagccacacattgtcattctctttttgtttgtttgttttttgcttctgatatgtcagtattcatttgcatagctagcttcaaatcctacaaataagacaatgcaaatgagaataaaatttatccatagctactaaaaatattagctagtatactacccagatccttaaaaagggttcctggtctctctcatattcatctaaagagcccaacatttttttcctaatagtaatctttgtaaagtagtaagtataagtcatccagactgaaagggatcatttaaaagtatatcttctgtttcctttttgcaatttaattttgactttaaaaccagagatgagaatcatttttttgacagatgtagataatgaaaaaacatatggatagttatttttaactgtgtgtcttatttattgcatagcatcttgtttcttgcattattgcaagaatggatttgttttacttcccttaggtctgcatcactgatttaccttataattttcccaatttctgaagaagttgacagagccgtctgttcttttctgaataacagtccaacccccagggtccaaactgttttcacaccataactgcattggtccattgctgttttcaggtttaatcatataaatcccactgaccgaatgcccagcttcttttgcttgctgacagtctttgaatggtcctataatttaaatatcatttattatcagcaaacttaatatgagaagagacatgttaaaagtttttaatcaagatttttacctttgtgtctttgtttacagttaccattgtttatcatatatacaatattataaaatataactaaataaaagggtgactccagttctatctggaacattaatttgtttcgttttcatctgttcttttcttttccatatatgtattttttatattgttataatcctaatacatgtagaaaattggattctgtcttaacattttcatgcagctatagtctccattctagctgcataataatccttgacattgatatatttttatccttctatcattggacattgaggttttatggatttttgctattataaaaacactgcacaaagtgtcttcattcttattgaattcattttttaatattataaaaatgctgagggatcgatctactggatcagaggatatcagtttattcatagtcctacataatacccaagttacagttttggaaatttgatttcagtggaacatactagtaccttgagatactcattgcaaatggggtcagtcaaataagttttagaaatgcaaaatattatgtttcccttttggaaattctcaatgtacattcacatattaaagactgaaaagccctgaaataaaccagatgcccaaactcatagaatcttaaatttcccccaacaacacttactaacagcccatgagaatacatttcaggaatgttagcataaatgagtatctaaagagttgtatcaatctgtatgactaatagtaattttctcatttaacctacagttacctggtgatagttgatagatgttctagagatagaacgattaactaaggtcatgtatcacagaagatggtaaaccctagatagacataaatccttgtctaatcccagagtccctgctctgaactgctgtgttgcatgcatttgccctcatgttatttcataattttaggtattctccatttttaatccactaataatttcttcaaattttacaagtgacaacacattttgtgaaattacttttagggtgtctgactcttgaacttgagatttccacatttttggatcaggtgaatatcatccttctccagtgtttcgagccttttttataaacatgcaaaatatattaatggatttagaaaaaagaattaccctaaagatctcttagaacaaaaaatgtataaaaattctgattgtcaaattttatattttactagaaatatgtgagagtttagtcaagtaaagttcttaacaagaatttctgtactataaggataataggattgttgaaattttgagaaatgtgttatctatactttgccagatatgtacagtattccttttgggtcttactgggatagaattaatctcattaggtagttacacaactataacaatagaagggattcttagagactatgatctcttccttgtagattgttccgtgaggacagagactttttttttttttttttacttcatatcatcagtgtttaaacccttaggaaactgtctataattttttgttgattaaatttctcattttaaatacaaggaaattgaaaagtacacgcaaaaatcaagaggacatcagtttctctagtccaaatgtttattatagttcattgatatttttctcttaaatttttaaaaattataatgcaatatccataagtagtacagactagtaaaaatttgagaaactggaaagccttatttatggtgtctttcctgcgttatatttattttaggtattgtattttttagttctagagttgcaatttgattttttatagtttttatttctcttttgagatgccctatctttgcattcgttataaacatattttcctttaagacattgaaaatagctacaaccactactttaaaattattgtcctttcagttccaagtttgctgagagtttttatcatgaatggattttggattttttcaaaggcttttaaaatcttttcttttttaatttcttttctaactagacacatcacaggaatcaaaggctttttatctgcctattgagatgatgatagggtttttctttttgttgtttgttaatacacgaattacattgaatatatatacattttatatataatatctaatataagaacaaaaaagtaatatatataagaacaaaatatatatattagaacaaagaatgtataaaaattctgattgtcaaattttatattttactagaaatatgtgagagtttagtcaagtaaaagttctgtacgataaggataatagttttatccttataagaatttctgtactataaggagaataggattgttgaaattttgagaactgtgttacctgtacttttccagagagagagagatatatatatatatatatatatatatatatatggttttgggttttgttttttttggagcctgtttcccaggctggagtgcagtggtgtagtcatagctcaccacagcctcgaacttctgggctcaagtgatcctcccacctcagcctcccaagtagctaggactacaggcaagtgccaccctgcctggctaattttttttttttttttttttttttttttttttgagagatgaggtcttggtacattgcccagggtggtcttgaactccaggtctcaagtgaactccaggtctcaagtcggacttcagactcccaaagtgttgggattgcaggcatgagccactccacccagcctttacattgattgtattttgaatgttaaaccaactttgtgcttctgggatagactcaacttagtgaacgtattcagagcccttaacactatacccaacaaagtagtcatcatcggtaattgttagttatttcgtttctcctttattcctcatcttaacacataattgtagcttatttaataaagtagcttatttaatgtctgcttatttaataaatttaatatagctcatcaaagatgaatgtacagtcatttctactgcagataaatattactgaaaaacctcatgttctgcaaattcatgcgttaaaaatagtagccaattttagctcttaacataatttgtattcagctgcagttacctgtggcacaaaacattaatgtgcttggaaaaaatcccatgtaaaccagtataacctctctgttttgctaccactattctccttttcactagtcacatatgggctacttcacattatagaaacatgcattgtagtcaagtaggaaggaagggtaaagagcctatatttcagaaaagatgaaatttacagaattttaatttcttatgtgggagtgagatggaaggaaaagtaaattatgactcccaggttcatacttagattattgcgtgtaatgcaggtagtatatttgtatacttacagtattcataggcaaggactttatctttcagtatgtatccacagtttgagcccacttaggaattcagatatgtagatatgaaactatgtgattcctagtaggcatggttcccagaattcccttagttctgcattattctttcaagaaatgtcttttctgcatctactacaggctaaggactgttttaggctcaagggataaagaaacaaccttagagtcaagtggggggtgggagaagtcacaagaaagagagaattccactataatatgacaagtactttgatggagttatgtagcgcacatggtagcaaagtctaagaactagctgagatatctgaggagcattgctcttactttaaaacctattagtattatagttaatgcacacatgaaagtagttttgttacaacatatatatatttatctcattttataaatttgcatattctgtaaatgttatgcttattgcttattctatgaatatcattttcgtaaatgtttactctgcattcatttgagtatagttttgacagtttacatttaagtatatattcaaaggttggacttttattaggttatttgctttgctgcagaatatttagaaacatcagtgttctgaatgttgacagaatatttgtcaagtatcatttgttccatagagctatactcattttttgctatttaatagacactcagatgtttaaagcaaaatagagagttctggttttctgaatccagctttgatttcataagacttcaattatgcaaatttaagattatcttcagctttaattttcaacccatgttttgcagtgggctttgtgtttacagttggatatctgttagacttagggaaatgtagttgaagttcttttccagaacatatggataaaatttagcagtgcctaaagctatttttttctcctcagtaaagatattagatatcagaattcaatatttatttgtatttatttttataaacataccattaacctgtcttagtccagtgtatattgttgatcctagcagaaatattttctcattattacttgaaaatcttatttactttctgccctaaaattagattctctattgtccctatcttaaatgttttcactgctttttctgtaccataaagaacattgcttgaaagaaattaatgacaaatagaaaattttaagctttattcttgagaagccagatttaattcacaggtttgcatattttcagaaataaattgattgatctgtgaatcaggaatttgttcatgatgattcaaaaggtataaactggaattacctttcttttaaactaagcatagtatcaactattttttgcaagagtcttctcaaagcaggcaactggaattctgtacattgaatttgaagaaccagtctctctgttcctcaatttatgtgaggattaaagtttacatagggctaatgaaaccatattaatacctctgatttatagaaagaaaaatgttgaccagtcatgccacattatttcccaaggtgtatttattaagaacccatattttgaatagaacagtgagttaaaaaagaaaaaaggatttcacactttgaatagcagctttactgggagccatctgtaacatatgtgttctttttctgtaaaaagagcttttacaaagagaattacagattacaaagagaatcctttttatgacaggagaaacagtaaaccaattcagagctttcaaattattggttaccaagtaggatcttttgagaggtaaacttttcagttgggttgtgcattaactttcagttaaatatattcaacatttctggagtgggaagtttgagacaaatactttctgaagtgacagtagggtctttctgtaataatatgaattacttagtttattaatctgtatgtttaaactgtatttagcaacccaaacttttaattattaaagaatttatcaattacgttctcataactggctaatacagtcattttccaacagcaccttggcttaactagtttttttgttttgtattaaatgttagtataagtattccattgaaaccaattatacctaaaaagtatattaagaagcattataaataatttgaaaaatgtaaatatttggtgatttaaaataagcctaccactaaaaagcatatttttagtttctaatgactactttccaagtttaactttttttttttttttttttttgagacggagtctcgctctgtcgccaggctggagtgcagtgtcacgatctcggctcactgcaacctccgcctcccgagttcaagcaattttcctgcctcagcctcccaagtagctgggattacaggcgcccgccactacgaagttttaactttttaagcttaccatttatgtcctcatatacctaatatgacaaggaaagacacataaagggaagtgtacaaaatatgcaatgattaatggtggtcaaaccatgccacatcatacacgaagcactttttttttttttttttttttgagacggagtctcgctctgtcgccaggctggagtgcagtgtcgcgatctcggctcactgcaagctctgcctcccgggttcatgccattctcctgcctctgcccgcccccccccccccaaccgcccaagtagctgggactacaggcgcccgccaccacgcctggctaatttttttgtatttttggtagagacggggtttcgccatgttagccaggatggtctcgatctcctgacctcgtgatccacccgtctcggctacacaaagcacttctacctgtaccccctcatttaatcatcacaacaatttattttacaaaagaggcaactggaccccagaaagctttgccagaatccaagtttactgatactcagatctatgcttttacacatggtgaaggaactttctccactcagctctcctacaaggaataaacttgtttttataaatacgctatttgtaaaagagtaattttttttaataaaagactaacccaaaatgcaggcaccaaataacattaatagttaagaatttcattgattgcagcttgtcaggtgtattattacattctcaaacattttgtttttaaggtagagaagaaggtaatgtgtttgaaaaatgttttttatctaaatactattttttataacttcatgggttttttgaggtagatttttcttataaccatttttaaagaaaataaaagattgtcataacatcttttataaaatgtgatatgcataattactgtcttcaccatttttaaatgtacagtttattggcattaagaacatttatattgtacagccatcaccaccatccttctccagaactcttcatcttgcaaaactgtaactattaaataaccattaaacaactccccattcaccctccgcctaacatctggcagccacaattctactttctgtctatgaatttgaccactctaaatacttcatataagtagagtctcatacagtgtttatcttttgtaactggctaaacacctcttaaaatatacattgttgtatattttcaccttatgcatgtggagactttagaatgaccatgtacctccatgtaaagtacagtaataggaatttcttggtgccagagcatacataagtacaccagtagccatccatctttaccctttttgtgcaagcacctaaacagcctgagacatttttttccagacagatgtaaaaataacataagtgaataattgagcacattgtgtaaggaaaatagccagcctatttgttgttgcttgtagtaatttaatttagtaagcatcacagaatattagaatttgaaaaggatattagaataatccagtccagcactctcattatacaaatgagaaaacacaaactggcagtgacttacccaaggtcacataacaaaggtagtggtagaaccaggtgttcttaattccatgctctttcccttatatgttcattaatgtactaattagtatagtaattcttatggtctagcagattatccctttgaatttaagagatccacatttatagaataaaataagtaaaaagttaatgtttacataaaacaaataatgaataacagaaaaagttatctgcccttaatttttgtgttaaagaaagtttcactggggataggtacaccatgttttcattaaaacaaaatgtgtttaagaggacttttgacatactaaatccctaatatgaggtttaattctgtagcattcgtgggtttttttttttgtactaatgctaagtgtataataaaacatagaattggtatgtttcattttgtataaacattttcttagaaaagtttgtcagtgtttaaaaatgtgaatagtgatttctgctagaattggttataccatccactcaagcttcagggatcacatagaatactccatggcagttgtcttcatacttacataattgtatacctcatcagttaaaaaaattcacacagctcaattatgtttatttataacttacgtatacaaactactgataaattatataaaagcttacataaaacaaaatttttaaaggatatcaaaagcaattttttttctgttttttatttctatacccagtgggtcactttatacactgcattttcctttggaaatcaaagggattgaggtttgtttgttgttgttgtagttgttgttgttgtttgagtctcactctgttgcccaggctggagtgcagtggtgcgatctcggctcactgcaacctccgccccccaggttcaagtgattctcctgcctcagcctcctgaatagctaggattacaggcacgcaccaccatgcccaatacttttttgtatttttagtagagacggggtttcaccatgttggccaggctggtctcaaactcctgacctcaagtgatccgtctgcctcggcctccgaaagtgttgagattacaggcatgagccaccatgcccggcgaggatattaataatgataatcatttacttaatttaatgatactctggcctattgctactgtaacttagaacagtataaaatgaacaaatccaatatgatataacgtattaaattactttcatgagggtctttggaatgacaattttaagaagctctataaaaatgtcaccaaatcaactaacacatatttagcaactgcaggtaagacactgtaaccatctaccaggaaggagcttataatatagttggaaagcctcttagttagatgtattctgagtgtatgtaaagataattgataatttaagagggactatacaaaatgtcttatgtatgttacagagagtagaggtattcatggagaggaacgatcacttcaaacctgtaggcgtcaacaagggcctcaaggaggagttgcattttttttatttatttatttatttatttatttatttatttatttggttggttggttggttggtttggcttgagccttattctttgagtaggcagaaagcatgaaaatatttaggggaaaatgagtgaatttgttttattggaacagatggtttttgtgaaggaaactagtggaaggtccgctaggaaagtaggcttcattctttaggaggacattattcttagccagactaagcaaattggactttttctgtttgcagaagcagatatgtgagtagtttaagaagatgaatctgctggcaatgtaaatatattttgatggagagagaaaacagagttacaccagttggcaagctattacacagttcatagtaagaactaacatttgagtgccaggcactgttctaagcactcttcaattgttaaatcttatgcagtaaatactgttattcccatttcacaggtaaggaaactgaggcacagataattttctttcccctaagatcacacagctggtagcctatggagtctctgtcttctagctgctgctgtggatcatttgaatctaaacaagagttctggctctgaatagaaatgagggacatgcacacaagagaccaaaaaggggacatgagtagaattcagtggactgtgtatggggcagctggggaagtatcaaagatgagccaagcttatttggaaatggatgacaacattaatcaaaacagagatgttgagatcaaatggtgaaaagacagttaactgtcttccagaagcattcagaccagcaaggagacagacataaataaataacttcagtgtaatatcatatagaaaacatgtttaagaaatagtcagtgatttggggaaaaagccacctaggtgtgtttgtttgaatctaggaagtcataacatcagaggtattatttgagttaagccttgagatctgctaaattgacgacagataagctgaaagaaggtgtttcagtaaagaaagcagtagcatgtgaggtaatggtgaaatatccaaatgcaaacgtctagctttggttaaatcaggagggagagctacattcaggaatcatctgagcagtggtgatacttgaagccaaaatactctaaagtagaatatcttgaagaaagactttaaggcatagaaggaagaagatgccagtgaaggacctaaagaaataggaagtgaaggaagaatattaaaatgtagaaggccaggaaagcagggctgtgaatagcgaagtggtattcactgacagagagatgaaaccacttcatgatatatttctttctagtctttagtctgtgtttttattgttattgtttaaaattatttcatagtatatgttttatgtcctgccttttcaataagtgaatgagctgcaatttatttactcgttgctttggggcatttgggttttcccttccactctaaggaagcaaatcagcttgtaaaggattctggggaatgagttgtgagaaaatggatgcaagtgtaaaataaacataaaatactgaattcagaaagttagcagtgggtttagtaaactgaaacaaagatgaattattcatctttgctttctggacacctagatcagtgactgacattgaatgcatgaagagagaaagaaatgaaatttaaaagtagagtttggaatcatgcatgatcaatgcaatagtttttttttataataatgaacatttatatttcttaggatacacagtactaattgtttagccttggaaaataggagggataccttttcttgaggctgacggcaagaaggcatggcttttgtacagatgctttcaagataagaaagaacaaaacccaggacctgattagacttactcagtatagtagtagttgagtcatctgctgagagtggagataatgaggtgtaattacagcttgaagagagtgaaagcaaaattttacatgtttcttttgaagaagatgatgtacaagcagcaggaagtaaataaaagaattgtcgggtagcagcgacgacctagctagaagctgataggatggttatggtgcacaggagtggttcggagtggagcatgtacttattcctgtctcaagaatagtagcccctcgatcataagaatttggatggaagactggtttttttcacagaatacattaagtttttataaactcctggaacttcagagctggaagaggagatgtatttaagttcaattcttgatattaataaaaaacaatagaaattttaatgtacatatataacatcgcaaaatgaataagcatttattatgagcattgtttcataaggcataaaaatataaacctcatactcccactttttacagtaagaggtaactcaccttcattgatgaaagttaccggtggtatcttgaaagggcttttggtgggagaagttgccagatcaggtggtggcattaaatctctgggataacctggatccctctgaatctcgttacctcccagcagaccaggagtatactgttggctgttaggaatatgttgtggcaccacctggacaagtgggggagacacatgggtgtcttgtcgggaaaatatcctcaagcactgttcttccaacaaagtgatcatcacagattggttattgacaagatcagtcaaggaagcgtatttcacctctagttccctgtatcttgttgccatcttcaacatttctgtggtgacattgaggattttgttttccagttgggaaagttcaagtgaattatccctcttacggataatctcatgtaataattgcatatagagttgagtaacacgagagttcatgttacggctttcctttctcagcagctttacctcattcacaatgtttccatctacatccaccaccagttgcagaacatctatctcccgcttctgcctggagagcacatccttcaggttttcaaggtccatcctggtgatcatgtctttaatggtacttgcatcttgccccttggtgttgacacagattggccctgttattctttgttcaggtaccaggaatgtgtatgcacatttctttgcttcctctttaccatctgtggcacgagggtatcttctctggtttatttttttaattttgaattgtccacctctgcaatgtccagtgtccactagtaggaagaatagcacacctagggtccaggtaaaagtcttcattttgaaatgaggttgtaaaatgatgtcttttgaaaaacaaatcagtgaaggagaaaaagcaaaaagaattcatattaatctatgttaaagtcagtaatcttaaaaactatctgagggaaaaactgaatatttattggtgttaatagattaggctagaattaactttattaatttcttaaatttaatattaagttgtaatactttggcatttgtttaaagattaggtttcagagaataactcttccagctaccaccttattgtaatcctttttgttccccagtttattgagcagattttggtcagtgtctactctgtgcaaagatacgctgctagtgctgttgaggcttttgagaccctgataagatagctttcttacctttaaaaagctcactgccttaagactatgaaaatggtacacagtgtttgtaaggcattaattaaaacattcttgcctaactagtattaaaattaccaggtgactttactagccaatgttttagattcataccatgcaattccaattaaattgatcctctgtaataaattatgtcatcttcattaaaatgttcaataaagttaaagattttagggaaatctaaacccagatagttttagcatcacatgctttttatttttatagcatctccttttgggattagtgacaggttttagaatgatagaatgctcacagtcattgtgggtaattatatttcctgaactgtaattatatgtactctgagcttatagataattcagcaggtttgttcttctaacagaagtcctactgaactgtattttagtaaaatgttagtaattttctacaaccattaccaaggaaagaaacttgtctgtaattgaatatgaatgtcagagttggaaatgccttagagaccctgtcattcaagaacctctttgtactctgtgcatgttgaaggctaaggccacacaaggattagaaccaggtctagatcggattctctgacccatagtcagtatttatagaagcagcacctatactaaaatatgtgcttagaatgtttcgtttttgctgtagcagatgagaaatacttctttatagtacaaattcttctgaggaaacagtttcaagagccaagactttttcctttctctctagttacctcccacaagagtagcagaagtagaatgggtaaggtatgttcactctgtcagatctactaacgagctggtctattacaggccaccttttcactcttgcgaacttcatacctatctgccatttttgaaggatggcagtggataccctaagacagagcttttctgtccaaatttccacataagtacctgtttcttgatttaagaaaccagctcctaagttgtttatgcctgttgttaataacaacacaataacagtaattaatatttattgagtgcttgttcagtgttaggcactgttttaagccattttcatgttttacttatcaccacaaccctatgaagtagattattatgatccccactttcagatggaaaacttggcatccaaaagttaagtaccttattatcaagagtcacacaggttcatagtgatggagcgagaatttgaatccaggctgaagacttcagagttcatgttttcaatcccctgtatttatgtagcttaacacatgttaactatttgcatttataacactgaagtaatgctgtatcattttataaaggaggaaaatccttgagaagctaaatcactcaaatgggattcaaaccttctactcctaacttttctagacctatgatttttaccctagtcatgtcataaccacagaggagtcttaagtttatgtttcttgtttttcgctgccttttcctggtttatgtcccttttcattgaccggttacttaattatgcaaaagtatttatggataatttttggtagaatttgtgtccacgttctgccagatcatttttttacatctcagactcttctgcggcaatttctttccttctgtatgtattctgtcagctgatagttatatatctaacctatgattatggacccctcccgaaaacaaaggtcatgtcaatgaaatataactcttatgctgtcgtcatgaagactactgctactttcactttctaaaaccatgttccttttttggtatttttcaattgaatagtgtcttcaaaatgggtagataatgaaaataaggcaaatatagatggagtatggagaattattattattttactaacaagagagggaatgaaaacaaaagatagggaggacataacaatctgtatttctatcgaggccttcttttgctgactgatagccaaagcacacatgggtattttttttagctttttatgttttcataccttgctttctgacatatatagaaaatttagaaacagtcatctattttatttttaaaaatagacttttactatgtaggagttacctataccaaaaaccaataaaacatttattatatctccagattcgtggaatttagatatgggttattttaaaaactagggacaagaaataaaagccatcatcctcctgggcacatgcatatcatttttcctatatatttaatttaacttaccactgctaaagtccattcattttaatactagaatggaaactctgagatcataaaattattttacttaaataatatttactatgaaataaactaccaaaacaaggaaaatgcaggaagtaatataaaactctaaaacaaatagaattttatgagcaatattctgattgaacagcttgtattaataccagacacagatttttataaaacagctaaaagcgcatcatccaagactgctgttaggactttgcatcagtgttgtcattgaagaacaaaaaacaccaaaatgctaatctaaattaaaacaaaaacagcttccttgtgtgtattctgccttggctcattgtggttcctataagattaaatcataagataaatcactgtttaccataagagaaagtggtctaaattagcatttaaaggaggcaactaaaagtttagtttttaaataaatataatttttttttaataaatacaaaagtattggcttcactgtcacttaaagcagggcaaggagccacatttcttaagtagtagactagctacgtcaggagtaaagaactggttttaaaaatacatttactgttatgttttctgaaaacattctcttatttaatattttctcacatatgttcagttttgaagcaaaagatccataaatctatgttacctcataaaactttctgtatatgttaaaattttcctaggccccaagagaatgttataaattagttatagaatacttacgtttaaatttaagtctttacttagttgtttttagaagagaaaaaaaagtcttctatgcgttgggttaattttattagtagcttttctcttcatagttgctatattgccagctagtagagagaagaaacgaaagtcaggatttgcctcctttcagatggtaaactcacagaggcatttaactggctgtgtcatgcactgaaaacagcatgaggcaatgaagttaaatttatgaagcattcaggatatgttagataaagaatttctagattgtgaaatatgttctgggaagagacttgagaacaatctaatcccctggatatatttaagaaaaggataaatagttatctgtgtaatttggggttcagattaaatgcctgccttaagacagcgtcagtaagaactgaggcttaatgaagtcctgcacttcccatagcatgcaacaacaaaaaagagagatgacagtatttcagatccactgttgcttggaaattttgttagaatttcttgtaaaatatgtgtttaacagaaatcctgccagcatttacagttttaaatctttaaggaaaggacacaaaagcaaagttggaaaaaattttagctttaccattatttgcttgttcaagattcttaaccattaatatctttaatttttacaaggctaaaggagccccaaatctaacaaacttaagtgtctttggtttaaggcatactattggtaacgagtaattttatctttaatagtttttataatgcatgtaaaaaaagctcccagatagaatattgaaggaaacctcttatgtgtgcttaacaaaattatttctacctaaaatattacatatttttggccttttagtcatgaatttaattacatcttctgggttcttattttctattgttaataccacttacataatgcttttgtgtgtatatcaataacttagcttttccaagtgattccatttgtagcaagtttaatttctgtcatccaaattaaattactattacatgtaagcctggaaagctatttaaaattttgagttggaacaagaaatgccatagattaatcttaaatctgtacaagaatttctgcttaatatttggttatactgtaattgagattttgttgcaaagactttcaactatttttgtatcttagctttgttttatgactacactgagaaatccaacagtttatgtatatcttcagcacacacactgtggctgcaggaagagaaactaattgtgttcacgactatttagtttgtattcctttgtttttaatcattgtgctgtaagccttatacatttaatctgttacttgttaaaatttctttctactgtcactaaagcacttgttttcagaaacccagcatggcatgcatgtatcagtctgtaatcatatacactaaacatcattaaattgaacctcaaataatgcattaaccattgcacagtacttaatgtttttatgtcaagttgcaagataaaacctttttcagatgagataaactgtagtatattccaaaggtctttgtttagtaaaagattctgaaatttctactacaaatataaaatagttatgcatttgctatacataatatttttaaataaaagaaatattaaatacctttttgtgtctgttgattcagtgaatccagaaacttgctgcccttattcttgattttaaaaatcagtgtagaagtttgttcatctgtgactttaatggcagctgcatttttgttttggaccgttgaatccaagctgtaagaaggaacttctttttccttttacaatactaatcaattgaatttgacaagccacctatgtaattttaagtagtatagtggaagttctggtctgtgggccgtctttaatccagcagagaaagcgttgtggctttgctctgtctgccacatggagaaatgcagtaaccagctgcagctgacccagattgtatatacagtacccctgaatagtgattccctctttctcagtagactcaagttcagcccacatattacatcaccaaaaattgctggagactgggggcgggaatctccttaggatttcctctttgtagccttaaataggggggtgggatcagcaggaggttgaatagttttgaacaaggagagattgtgtgcaggttgaaggaagggcaccatctggaaacaaactatcatagttcagcgggcaattataaaacaaacattttagtctgctggccagagatcttttaagttgaataccgaaaaaaaaaatagtgctccacttcacttagaagtagttgcaggctgatgagtttggtttttgttaacaaagaacaagagctagactttgtcaggaggcagccacctaaataatgtaataaatactctttatagcctagaagaatttgtaaacattttactaagttgctaatgaaggttttaaacttacaagaaacttgatgttgttgtagtatgttatgtcttactgtgtaatgtgtcttaagataaaacagcctttatatataattaccaaacataagtgaaattctttcagatgcttaagacttttaaatattacattctggtgttacataatgtcatatcctcctattctacaaaatgacctctcctctctgtaaaaggtcattcttgttattaattgatgtggtgtggtttaaaaacaaacataaccctgaactgagtaaaaaacaaggaagctctgactctatgccagctatgtgaacttagacaaatcactttacctgcctctggcaaggttcttctgctatgaaataaggtggtggaagaaatgaataagtgttgagtacaactatactattgtatttcattaattgaagaaatgttaaataactcagtagctgaagaaacacaaacttaggcttaagtaacttagcttagcacttaagtactaagtagtggaactgggatttgaatctaatgccaaagcattatgccacactctctgtcattgattacctagttgctgtaagctgcttctagataaaacttttgggctttctctacatacctgtgctttcccttccttattgctgtagcttgtgctgtgtttctctttctgttaggccacactgttgatccacatcctttatttaaagtctgagcttattttctacctctttcacagaatcatttatttgaattcctatgccatatataggtataccagaggttgcaaacacaagggcctagaaaggcaaatgctcacaagaagaatggagcaggtaatataaatcagtgaagtaaatcagtagtaagatactggagggaaatgaagtttatggcaagttggcatccttttggttaatttaaagggatctgcctgcaccttctcagctgtgcttgtggccatgaaggattatgagacagtgttgccagatcttcccattattcaggaaaaaagagccatttagatttttcctgtaatacttcctgattttaaaaaacattgggacagatgtgctgccagcttctggcctctgatttgtattatgtatcgtttcttgagcattcagtaattatgttgtagtcactaatggcttaaatctgggaaaaataagagataataaattctttctgagcttttaaactttcagcagtttggagctttctaacttgagcacttagtaatatcactagccagggtaggaaattggaatgacaggtatttagggacagattatggttagatatgttaaattgaaaatgaaagtcaggagctcagttatatggagagatttgaaagtcaccagcaattaggtagtagctaaagctatggaactaagatactagagaaagtacatgtagaatgtaaaggaaggttaatgacagaccatgataccaatttccaggaaaccagcttacaagaaacatgaggaaaaagaagaatggtgggggcttagggggaagatacgaaagttcaaggtagggaaaacctgagaactagacgagaatggttacaatactgcagagacattacatagggaggggagaccaagagagatgttttaagacttagaatgagaaagttattaatgccattgccaaaataagtgatacatacagatttcagattatttagtgtgttgaagggtgactagataaaatttaactgacaaattagtgtccacaatacattaagaaattagaaatccataagaaaaagacaacccaaaagaaaaaatgaacagaaacatttattacatagaaatatatacgtttaaccttattactaatcaaggaaataaaaattaagacacagagagataccattttatactcagaagattggcaaaattgagatggataataccaattgttagcacaaatgtggatcaacagaagcttatataccgtgagtgggagtatgaattgatacagctttgaaaaataatgtgacaccatcttgtaaagttgaatattaatatactttagcacttggcagttttgctcctaggcatgtttgtatatcctgaagaaattttgtacatgtgtactgggagatgtgtataagaatgtctatagcaacatggttgggggtgggatgggagtaactcaaaagtctatcaaataaaatggatgagttacaattgtcacacattagcttgttctcattataaggaattacagcagcatttaacagcgtggacaagtcttagaaacaaaatagacgaagcaaccacagaagaccatatttttaaattttatttaataaatgcttataaatcacttggtatgtactagacactttttttttgagacggagtcttgctctgtcacccaagcgggagtgcagtggtacgatctcggctcactacaagctccgcctcctgggttctcgccattctcctgcctcagcctcccatactagacacttttctaacattacaaatactattatttaatccacacatacaataaaatatgatttttaaagctcaaaaataggcaaaagtaggaatacagacaaatgtcggggaaaaaataagggaatgatcttaaagttcaaggtaatggttacttctggacaggaagcaaggagatgaagtagagaaggaacatacagatagatgcaacagtattgatgatgtcgtagttcttttttaaagtagtttaccccaacatattaaaatattaacatgtaaccaataaaaaagttaatagatattttacattaatttttcatgttaactcttcaaaatcttgtctattttatattcaaatacacctcaattcagaatagacccacgaaacagtagtcacatgtggcaagtggttatattggacagcacagtatagcgagtgactacaggcgagttgtcatctgagtttaataagatggaagaatggcaagaactggcacattagtaccccgctcaaatcccacttcttccttgaagctttctctgatcccatcagcaaggaatgacatttttttgcacagaattcttatgaaactcctgtttaaacttttctgtgctacttttttatatcttctattgctgttattgatgtacatatgccaacatccccgtgccatttccttgaggaatcttttagctctccttagggatgttgtagtcataagttgactggtctttcacaaatgtttattatgttgtttgataacaacaagtgtcacatgtgttgataattttttcttagggcaggagtctcaccatgttgcccagactggtctcaaactcctaagcagtctgcccgcctcagcctcccgaagtgctgagattacaggcatgagccaccgttcccggcaataatttttgtgaaatcacgattctcacacaaatatgaaatgaatatgtgtcagaattttcatttaaattattaaatttataagggaatcaaaaatgtgtcaagggagaattcaaagtaacacacatatatgcaatcaggaacgctgaagtaaatttacaaatagttgcaaaattggtcatcactgattagatcccactggacataattctttggcatgtttatggacaataatttgtattaccagttttcaacagctgtgcagagttgtaaaatagctcagaaggaccaaatgggtgcactggagacaggatacccagtaatcttttttcccatctcaaagtttttcacaattttcctgacacatgtgtatcaaatattacattaaaaatagaacgaagaataaaagaagtgtactattgtatgtttctcttccaaggtgtttgttgaagggaggacaaggatgttatcttgaggcgtgggatcagatttgaaggaagagttgcttagattttgttttataagtaggggagatttaaacatgtatattgggccaggtgcagtggctcatgcctgtaatcctagcactttgggaggctgaggcgggtggatcacttgagaccaggagttcgagaccagcctggccaacatggtgaaaccccatctctactaaaaatgcaagaactacccaggcgtggttgcgcatgcctgtcatctcagctattcgggtggctgaggcacaagaatcacttgaacccagaaggcagaggtggcagtgagccgagatcgcaccactgcattccagcctgtgacagagcaagactctttcttgaaaaaaaaaatggtttaaaaaaaaatatgtatactggctctggggaaggagccagtaggggtgaatgatagtagaggcaacagtggttgtctggaaggaggcagcaacgattgcattcaaaattacagttgagatttcggaagaagagagagatgattcttcctccaagattggggaaagtgggaagaacctcagcttcatttggaacctcaagattcatttggagtcatagggaaataaagttgaggttatctaaagaaaaaaaagtatgataggtgacttaaagaatactgtaaagatttactgagtggaaaatgaatgatactaggatgagtaaaaagattgccatgccaaccttttatgttaagcacctattgtcaaaacattgcacaagattttctttctcttggagtgcaagatagagcaactgccttaaatgagtttgcagtcttgaatagataagatataaatgtaaaaaaaataagtaatgagattttgaagtcataaaagtcattaagtgaatagtaagcacacataatgtatgattttttaatagaatataagtaatttttttttaaattgggctataagtgaaacgtctgagatccagctgtcactaacaggttgcatggcattagacaggtccctttactatctatgtatttcaggttcttcatctataaaaggagaggattagactagacagtgtctgaattcctttcttggaatctgtgagaaaactagagaatattgacaccgaattagataagcaaaatataagatttggataggcagagataagtccagaaaacattttaggtataagaaaaagctgagtaaaaacagggtttatttagaaggcagtgggtatgtcattttggttgcatttaccctgagagtacatgaacatgaagtaatggggtaaaagtaggaaggtatgtttttcttttctctccagctatagttgtctaatacatttcacatgtgcattgtgaactctccagaaataaacttaaataagtgacctttcatgttaaggactagtacaaccaaattttagaggatgtgttatttttgttggtacaaaaagcatggagggtaagaaatagttaacttcaatttgtagtcacatgaaccatttcagaaatttatttgttgatctttaaaatgtaaaacatttctaccagattgagataattttcaaagtagttaagactcaaatgatagctatcaactcaaggcaagagagtaaaaacaaatattaaataatttccctatgtcagtcagtggctgggctgctggctaaattaatatcttcaagttgtaacacaccttggaaaatggatacttgcataggttttaagtctgaggttctcagtttaaaataactctccattatgaaactagtcagaggcagagccaattgaagaactcagctcctttccattaattcccatatgtgctggagtttctaactctagcctcaaactatacttgaaaatgaaatcacaagaagacatttacaaaatagcatattattacaaaaaattggtatatgtctgaccccaactgtatggaaagctaggccccagtaaccatatgttacccaggcttcagtgtattaatagcaatatattttaaatgtagcgtacagtggaatatatctataaacaaccccttccccccttttctttgtcatagtctcccaacctacaactaagaaaacgttcatttatctaattgtatttcaggtatctatttgtcagatttaacatacatcgattcagcatacccatcaactggcagcattctagaaaatgagcaaagatcaaatttaatgaataatatccttcgaataatttctgatttacagcagtcttgtgaatatggtaagtttctaggggataatgccaagccattaagattgctgtaatccagtgatttatttacacacactgatgatcacttttcacacagcaggggacatcaatttcttatttccattctaatgtaaaggaaaataatgcttgttttattttgccatttactatgtagcatcctgtttaagatcttgcttttaaggaatttaagtatttaatatttaaaatttttatttttatattttgcttttctgctattttgcagcaactttctcacagcacaaaggcactaagtatttaatattactacctcacagctatttggccctttatagcacagctatttggccctttatagtttacaaagtcattttctagtcattttctattatctcatttgatctccctgatctattatgtaaatcgttcttacagttttcaattagggaagtatagctgagacccttgagcctcgtgacaattgaccaactttcttgagtcagactatcgagtaaatagccagtttttgtccaacatgtattttatggaatgacaaatatagaaacagctacataagcccaaatgatgagaaaaggcattttttttaatgtttaaatacttccagtttgataggaaataaagttaggctgttaatacataatttttatgggttaaaaaactgagttttacattatatgattacttcaagtgaatttatcttaaagctaacttttgcttcatgcatctatactttttagaaaacctcaaaaacttcctaaaactatcagtgtggagatagaatcttactgaaagttaaatcaaataattccttattttgtccttttctcagtattttaaacatagcatcaagttgtgatgttaaattaatcttgcttgaaacttacaaggggaggagataaaccacatttataaatgggaaccaggtttctttaaaagaaaagtaactgccttcatgtcttctgtttagtttagaatagttcttgatctttttctgtgaaatttctcaaatatatgggactttataattggagctattaaaaaaatacaacaatctatacaaacaatatacaactgtaattttctaaattaccttcagattcacattaaagtttatctcagtaatgtccttctagagttaatttaaattttgctgccatgtggccttaatttacctttaagttattttcagcttaatttttaaagttctggttaagatgtactttatcagataattatttatcaccttttgcctagatattcccatgttgcctcatgtccaaaaatatctcaactctgttcagtatatagaagaactacaaaaatttgtggaagacgataattacaagtaggttggatcttcaaaagtggtttgtataactttgtcctgtcctccacctttctatccctatgtatttaaacatctaaatcctacatggtatcatacaaaggactaatccagtggtttacagcagtaaaggtactaacatgtattacttcttaatcacttgttatgattgagccaatatacaaatacctcatctgttctttttaatattttatctctgtttgtagagagctaacgtttgatagttctaatttaaatttcttcctttcccccatattcaatcattgaatccttatagaatttgtcttttaatagacagaaaaattaatgaaactttttaaaatagaaaaattactcttctttaatgctaagtattgacacatcgttgtttgtttttcattgtttttgcggattgagagacttggtccatcttgtctcaggagaagaaacctttctccaatgtagcagaattatcctcttccctgtattatagcaagttctttattaaagatttttgaggccgggcacagtgactcacgcctgtaaccccagcactttgggaggccgaggcgggtggatcacttgaggtcaggagttcaagaccagcctgaccaatatagtgaaacactgtctgtactaaaaatacagaattagccgggcatggtgcatgcctgtaatcccagctgcttgggaggctgaggcaggagaatcacttgaacacaggaggcagaggttgcagtgagccgagagtgcaccattgcactccagcctgggcaaaaagagcaaaactccgtctaaaaaaaaaaaaaaaaaaaaagattgtttgaaatcatttttaaaatagctgatatccatttttatctccttatatccacagtatttcccaaagatgggagaggaaatttttaaattattaaccctttcatctttcgttgatacagtttacatcaaaactgctgggtttttttttaaggtaggaggataaagagcttatttctcttgaagcttcactcttttcttttagcttcatttgttactttttttaaaaagtttatttagctttattatcccatttgttcgcaagctttcaaattgaattttgcactttcacaaatattttttccaataaaaggtcgtgtttcaaaaatttatcgaagtgaaagactagattatttttcagtgttaatgcattacatagaaatattttttatcttcctttggtaatgattattaacttcctttttccagattttgacagtttttaaaaaattttgtagaacagaattagtcccagtaaatggctatagaaattctggaaaacatctaggaataatttttctaaatgcatctaaaattttactgatgtttgaaaatgcctttattgccatcttctctctcacaccataatagcaacactgtatttctgtaccaattttcagtctacaaaaagtttctacatggttacttacttgaaaatgtatgaagtcaatgaagaagctttttaagactggagttgtttcacaaatctgttgccctaggttgtttttcaagtttgatggtctgtgtcttatacttaccactatttttcccttctctctaattactgacatagaactcctacctaataaatacttaagttttgtccagtgagatgtagaacagatatcttaaaattcaaaatgtgagtaagtagctattagtcatttatctggctcaagaaacttactgaatttaaaagaatttaaagtttattagattgaaatgtaatctaagaaaattttgcacagtttatagaggatggcaaattttttgtgactactgtaaaattataatacaatatttattaaagctagtttttactttgctaaaagggtagacttagccagtgaagccatgaggtagttctgacattctgtaaattgacatatcatataatgccttcatttttgtaggaaagctaatgctattatactggtttttgttttcatgaggagctagaaccagagcagcccttccattacattgacatatatttactaaggttttgttataggccagttactgtgctagttgctgggattataaaaataagatactgttcttgccctcaagaagctcagtctaatgtcagatacatccacaaaacagatgattataaaacatttcaaacagaaccataataaagatatgccaaggatgctatggaaacatagataaggggggacctaacctagctttacctaggaaaactaaaaggaaatatgaacagcttcaggagacagcgtcatctgaggctgaatcttaacaggtgagtgggagttagtctcacgtgaagggtaaggaaaagtatgctggggatggaatgatcaaaggaatgggataagaaacagtgtctttgcatggcgaacgatgagtcatttggtgttattgggacatcatacggcactagagaagacattgtttttctttttcttggagacggaatctcactctgtttcccagtttggagggcaatggcacaatctcagctcactgcaacctccgccgcctggggttcaagcaattcttctgcctcagcctcccgagtagctgggattacaggtgcccgccatcatgcccggctaatttttgtatttttagtagagatggggtttcaccatattggccaggctgatcttgaactcctgacctcagatgattcaccagctttggcctcccaaagtgctaggattacaggcgtgagccaccgcactcactgacagattgtttttctaaaaatgcagtgtgttgcctgagcctaataatttagtgtgtttgaaaaatagagcattttaagatgtcattaaaattattagaaaaaattagaagaaaacattttttagaaaaaatgccttttatgatgaaaaatttgtaaatagaaatggcatgtcacttacaaaaggcctgttttgggcaacttcatctacataggcagccagtatagatattacaaattacatgtcttttgatcagggtgaaaattcttctgggtgattttattttaatactgaacatatctgttcttaatgaatcagcatctctattataatgtggtgctttgacgatgttgtaagcagctggcactcagactagccttcactgctttttaaagatgcctctgctttttatattgctgtcagtttctaggtgctaccaatagcaatgtgattcacccaataagctccctttctgttcctttctattttggtgccattgggaaatggtagttatttcatttactacttttctttcatccactagactgtaagcttcagaaggacaggaataccgtgtctgccgtaatctctattatattccagttctgagcacagtgcccaacacaagtgttcagtaaatatttgtcacatgaatgaatgcagtatagtttgtagcctaaataattaaacatcttcataaaaagaaaaagtctggttaatcatttatctattcaatatatgcattttatattatcaaataactggaatataattaataacctacagtagatttatcattataaatgcctcttgtattattcaattatttttaaaattttagtcagtagaatactaaacagtttttattaaatttcagacagactccgcaatattaagcttcgtgtattacaccaaagcattttctacaactactttagtgtcctgttttctgaaatagcttccactgatagaaatcataatctctttcactgtgaaactcagaactggatatattatcctaaatgaaacttaagtaccatataataaactctgacttaggacagggacttactaggaattttgcaaacaacatttttatttgtatagatctttctgctgaagagttctgtcagctggtttgttagatggttagttttaaataaggtgtttttagaaataatttgcataatatatttaataatacatatgaaagtttctgaatttaaatgtaaagtatcagtgtaagctctaagttgaatcatcatttagtcattcatcaaatatctttaaatgtgttccatggtttggcaactttggggtaattggggagatttttgtgtttttaaatacaactttttaatgtattttcccttcctaatatttcctaaaataaccataagatcagctttgtatgaaagagataagagacttaacatcttaattaaaaattgcccttggccaggcttggtggctcatgcctgtaatcccagcactttgggaggccaagatggaaggatcgcttgagcccaggagtttgaggcttaagtgagattccctgtctcttaaaaagaagaagattgctcttgaagaaaagtatataggtcagattatttcataaaaatgtttttagtttttttgtgagaaaatacacaactttaatcttattttgtcaaatgttaattaatcattgtatgtattttgtctttttaaaattcaggctttcattaaagatagaaccagggacaagcaccccacgttctgctgcttccagagaagatttagtaggtcagtacgtagttttctcttgttaccaaatctaaatcagataacctaataaggaagaatatactccaaagtaaataaaaacttagtacatcttatactgcatgtaaaatttattttgatattaaaatctgtcctttctgggttttttggtttttaatttaaaagttgctggccgggcagggtggctcacgcctgtaatcccagcactttgggaggccgaggcgggcggatcacagggtcaggagatcaagaccatcctggctaacacagtgaaaccccgtctctgctaaaaaaataacaaaaaaattagccgggtgtggtggcgggcacctatagtcccagctactcaggaggctgaggcagcagaatggcgtgaacccgggaggcagagcttgcaatgagccgagatcgtgccactgcactccagcctgtgtgacacagcaagactccatctcaaaaaaaaaaaatgttgctatagtttgtcagtagtgtacaaacaagtatgctacctaatcaaggaaaatagatagatgcaacagatggaaaataatagataagtagttatgaatattcatttttgattaagaatgcactgtcctaggcaatgaaggttgattacactagaaatttctgtggtctaatgggaaagtctactaatttgaataattatagaagtcaattttagtgacgtaattttttcaaatgttcactttaatactagaccaagtattaaaaatgtaaaaatcatagttccttactttacctgttacattgtaatggggatattatgcatataccacaaataattttttaaaaaacataaaattatcattatttaagaaatccctgataagtaccttttttaaaattcccaatataggccttcgcactaagtttcatgtatattctaaaaatatttgatggctaatctgataagatgtgaagtggagaaacaaaccatgacaatgtctatggggaagaatattccaagcagaaaaaacattgcagtttaaatttcttaaatttgcttttctttttattcttaaagtgctgttttgcacttttataatattcttttatttattcccataagcctgaacagtgtcagtgtagatttaatttctgatttgagtgtttgacctaccctacacattctttatctaagaggaagttgaaactaggagtaaagaagtaatgtataaaattaaaagagcactgaacctaggactcagaagacctgtgtgtttagtccagattttgtctgtgatgtgaaagctagtctcttctaattctacttcttcctatgtaaatggagaaaatatttacactgcctctacttagtataagtaagataaaaattaatggattttgtatggtttgggattttgtgttttaggacttagatatatttctcatcttcaagccaattaaatagaactaacatcagtactatctcaaaatttgaaccacatttaatattttctttcaagggactgaaaaataaagtaatcatttgaaaatctctttaaatttaacccttaggtcctgaagtaggagcgtctccacagagtggacgaaaaagtgtggcagctgaaggagccttgctcccacagacaccgccatcccctcggaatctgattccacatggacataggaagtgccatagtttgggttataagtcagcatttttaattttatctttcaaatttttaagtcttttgtaattggatttattgtcgatttattagttcagtagaaaatggtatccttgaatagttttcttttttcttaatagctgttttctgattcagtaaaatgccttgtttgcctaaaagcttttatttcttactttacctgaatttggaaatgggattttgtcaacaatgcatttatatttggggacgataaatgaacattacagagggccatcataaataaaatcaggatagcaatatacctttttaaaagagttacaacctttatatcaagacagtcattgtttgtcttaaccaaaataagtcaaaaataacagctataaaaattattttctttattcctaaatataaagaaaactgactttttgtttaacttcattagttttgcagtattgttttttcaaaatggggacacatgttcacttttgccatgatttctctggaaatgtaataactgttctccaaaagtgaatgtggaaacaattttttaaacggacacgaggcttaaaatgaaattattttaaagtatgctctaattatatagatagatagggccaggtttcctaaaacattttccctaaactgttcatttgaggcttttatggtaagatctgagtatgacagttaggtaaatcttttatgtcctaaatctttatataaagagcagtttttaaattagtaacaataataaaagatatgaacttttttttctgtttctagtttcattcataaaatgaacacagcagaatttaagagtgcaacgtttccaaatgcaggaccaagacatctgttagatgatagcgtcatggagccccatgcgccatctcgaggccaagctgaaagttctactctttctagtggaatatcaataggtgagaaatacttctctgagagggttgcaatttaactttaaataaaaatgttaataaaacttggctggaaaaaaaccccacccacacacagagaaaatttggttaaaaaaacaaagtagcagttaaatatgggatgaagttaataatttgtgatggttttaaaagtgcttgctgtttttaactccagaaggggaagcatttgaagaaggtggaaaaagaacatatgggctggttgaattagttaactgcatgtgatttggatatggggaggaggaagagtgtggagtcaagaatgacttccggttatttgggttaaacaagtataatagttagatgatgatgctattaccaaggtagagaagacagagtaataatctgtgggcagtgaagcgtttgtgaatttggggaatcaggtgtgttttggacatgtttagtccctatggagatgtcaggtaggttgttgaatatgtgaatctggagctcggggataaggtcagatctgaagatatacgagaggtagcatatttataagccatgattggttgagggtacctaaagagagagtgtacataaataaaaaaacattctcacatttagaagtctgattattttttaaaagaaggatgagtcatcaaaggaaactaaaaaggagagatcagtgaagtaaggggaaaaaaacaaaagcccagtagatgaagtatctcaaggaggaggaaagtactgaatgtgtgaatatcaaatgcagaacaagagagctaagatgagaatggggaattgactgggggatttggcaagataaaagtcattggtgaccttgataagagttgcttcatggaagtgtcagggcatggcctggattggagtagatttgaaaatgagaggtgaggaaacagagatagctactgtgaaggagagcagaaaatagagaccatattagaaagggatgtgagattaagagagggatttgtttgtttttacttcctaaacttttaatttttgagtcttctagatgagcattatttcttgttacaattagaaattattcatatagcctgggcagtgtggctcacacctgtaatcccagcactttgggaggcccagatgggcagatctcttgaggtcaggagttcaaaatgagcctggccaacatggcaaaaccccatctctactaaaaatacaaaaagtagcagggcgtggtggtgcatgcctgtaatcccagctacttaggaggctgaggcataggaatcatttgaacccaggaaacagaggttgcagcgagccatgttcgcagcactgcactaccctgcctggatcacagagcgagattctgtctcaaaaaaagaaagaaattgttcatataatagctacttttatttttaaaaagaaataaaggaggaatatgtcttcatctatgattaactaccagattgttcaaggactaagcctattgttactaatatcttaatattggtaaacagccagtagaaggagatgcaaaaggagattgattttctggaacatactgactttcttagcccttgagagttaaaattaaattatttcagagctctccattaccattcagtagttgtttattctgatagtcccctttttatataaaaatacaagtgattaaatgataaaatgttttaaaaagaaggcaagtttgtcacctgaaatacctcttatcaatgttctaagttgcctatatgcaaatactaatctcagtatgaagaataattttgcaaaagaaagaactttttttcagtcaaaaattttctacacgtccatggaatttggcatgccacttaaagcaaaaagtttttaaaattacagctctcaagtatataatattttactctttctcataagtgttataatgagaattattctgtagtttatagcttttacttttcatggatgtccttttggctaccaaaagattattgtttagttattttattgagttacagttagtgtctcagtgtggagacttttctcttttagagcagatttttgcatttgtgtttattttttaattattctaaggctaagtaagtaaacagtaaaagatcattgcatcctagtttgtaaactaagaacattacacataggcatttaccttcgaggatttttgttttaaagctttaacaatatgaaaaaaagaataagtctattaccataagatgataggtgttaatatacacacacgagtttttccctcagctttaacttttacatgcaatattaatctacagtgaaggctttgaaaatactgtgggaaaattaaccagtgcttagaacaatggccttaaacattttctaatgtggtatctatcctagataatcttgagtagtctcacctagctaactaagagaagcatattcactctgagcttcatgcttacattttctacaaataagttatcctaattatgcttaaattttcagtctttaccacatagtgccacaaatcaaaggataatgtagataatgtacaagaccccaccaccaccacgggttacctctggttcttctgaaccatacaatacagaaaattatttcagtgattgttatctcagtttatccaaggatggtacataactagtgccattgcaaacccgtagaagggtattaatccatcgtctctaagagagacgagtctaatggataccttacagcatccattacaggtgtctgatggataccttacagcattagaatttgagtctctcagaaccctgcccgtaaaaaagagtttgagtctctcttcttagaaccctgtctgatagacaatttaacttgacctattaatcatcctaatttttttgagagccagaattacctttaaagtaacatttaagtaaactaagctgttttggactctctaaattcattccccatagtttttttgttggttttttttccccctagctaattgtaaacgttctgtttgaagaccattttattttaactgatcttttggccaaagagaaaattgttgcatttttatagcaccggtttttggttttttaaatttagagattccatcttctttgtctctagagacaaataagtggatttcattaggctttttatacttagggtagtaatggactttaatacaaagagaaaggagtatgccatgaatcgtcaaggattttataattatattggtcctaaattatgacaaacctaataagaaattttgtgttattttatgttctctaatggtaggaaaaattgtttattgacataatgaatttcagctacaaataggcaagcaaaaatgttttatgctattttgttattttaggttgtcgtgtcaactgtattccaatatattgcaaaataaacctaacagcagtaatattagaataaagaattaatatgtggatatgttcatctacaatgcgattgtcattttatgagcatagttaattaatttatttttacattgtgaaatgcaaactagagaggtaattctgatgtttaaaaaataggataacttttcattttaggtagcagcgatggttctgaactaagtgaagagacctcatggcctgcttttgaaaggtaagataaattgtccatttgaactacttggagtttattttgtctgggttaaataatataatacaaattttcagagataatatttactacatatccctaagcgattaagttttctactggtaaaagaaattagaagttgatatttaagtttggatatgtaagtaatgagaatgaatgatagtcttatctctaaatgtttatttggtggcatgacacatgtatttgaattttaatacatttacatttataacttaaaaataataaccgatcatcgacaagtaacctacttacatattcaaaaaattatttccttaagttctggttcatttaagtaattttaaggcatttagtggaatggtcaactttattctctgctgctttgtcaaggacaaaatgatttaataaattttaaattatacaagtaaagcaagttaaggttagaatttaaatggtcataaactcaaaattttcagagtacacttttatactgaaatactctaagttgtgctcccttctccttcctttgttgctttaagctgttaaatctgtcatctgcctgtagcaaatatcatactatattgaggtctaagtacatataagatctgaagaatgtgaccaaacaatgcaaataattatttattaaatgtccattaggattcttatgttttcactgaccatttcagttctgccatttcagactcataaggtatttggcttttgaccaaaacaattgctcccttttttgtatatgaactaagtaactaaatttctgaaaatgcctatattcattactcaagcgggtcatttagattgaatgttaaatgtcatattaatactgaagttgaaaatgtgtaattgcataactccttatcagtcacaatttataaaacaattttaaattaaattttatttgaaatcataaatttcatgctgtttaattggaaaaatagatccttattttttatgtgacttcataaagatttctcactattatgtgattaagattttgtttataagttctacattgcaaagtacttttgatcctttctactctaattatcagtgttcccaacttttgttctctttgttttgcgggataataataagtaaaaacaaattatttttatttatttttgcattatttttcttgcaacctttacttctgatctgttcatttgggtttgcctgaaatgtgaaaaacacaagaattgcctttgacatgttgtctgaatttgttcaaattgtctttccctctagaaagaacgtaaaaccatgagaagttgattatagagtgtactgtaatctttatatttaaaaaatattgattaaccaaattgttttttagattgcttgacttatgactaaccagaatggtggtgtgttaaataatctgttctcatcccagcaggttacttatgaagacagtatttaatgatgttaccttcacgtctcaaaacaatttttttgctttataacaggtgttttgctttgcagacatgtgtggctaaaaaaagctacttttcttatgccaagtttaaaatagtgggctcttagaacattttgagaacagtgaaatgaatgctgcccagcaagattcagacatgaaataatagaaagtgaataaagaactaggatataaagtactactcatggatagtgaacttgaaaaatgtactctgaatgttgacataccattttctgttcttattttctagacagacatcaaatacattgtcttattttctagacagaaatcaaatacattgttgtctttttttctagacagacatcaaatacattgtttaagttgctaaaataatgcttttcctttaaaacatcatttatcaacagtgctttcgggttttcctaggcaaagaagtatcagtatttttatgtgtctgtttttattttttttgtttttaactattatgtgccattttggataagtattaactcatcatttttatcatttattggctttgtcagttaatgtagaaataatataacgcctatattactcagttcatttcttttatttactataaaggataaagaggaaaataaagttttcctcatgagtttacaagccacattgcttttaggtgtcttcatagggacatataataaaaatgaattacttatataaatccgggcatcatatttaaactagaatccaagaagtggtatagaaacgtaagaatttttgaagtatttttgaggttttttttttattatttggctataaatagctctttaattcttttagcagatttgtgaaagtgaatgtatatgtaaatatatggtgtgtactaaatacctctaagtatttctagagtcaatagtagaagaaaaaattttttgaaatctatgctgcatgctttaaaaaagaaagaggaacaatcacatactatccttttgtaagatttagaaagctatattacaagaagaaactattatactgttctaggtattgataatgactgtgtgaataaaagtatatgtaatatatacaatttataatggaatccaacaggaacagattataccattctctcggcccggtgacaagagtggcacgaaatggctatcgaagtcacatgaaggccagcaggtacaattcccctgcattcaggggtcacagaactcccttatggtgttggtgattggcttacatgggtgtggtctgacgttatttcttttctttctcaactaattgatttaaaaactaaacaaattacctagaaaaactttctttccaagatctaatatgaagataaatttcaactattctttctgatccacagagctaattgctaaaacttgcatcttaatgttacatattttaaaatgcttccaagttggtagcctttaaactgcaccagtctttctaatgctgatagtttttgaatgaacaatataaaaatctgcttctttattcataagttgtaatcaaagcattttctttgctaataaatttatatttgatttgtctttttaaaaagtttttcagataaactacaggtcctgaatgtagacgagtctatttcataaaataatcatttgtatatttaaattcatattcattcagttgtttgtctggttaaaccaggtctcttttggactgttattagctgtggaggcagataagggtggtgtattgattgggaacgtggggtttagtggtgatgggtaatcagttcataatacaacaaaataccaaacttcagaagcaaactttacgtcagtttgatggtgtctaatctccgtgcatgtacctccctgaatataaatagctctagcatgaaatttctactggtttataggttcttaagtcactctgaagacacctaaataatcacaaaggaataaactggcaaactttagttttcattgctcttataggaattctgcagctcatgtcaagtcaccagtgacatttttgtcagcatgtatgttttattggctcatgtagaaatcattaattattgtattaaacataggaccttaaatcaattagggaaagatattaaagtgttggttattttgtgatttttttttttttaaaagatacatgaaaaggaaatcttgagttttgggttttttcctttcgtggagagctattaggccataatcacttatccattgacaccatttaaatgttattaaaatgtattgcagaaagctagtttttaaaatatattattattgactttattacttctttctgctattttagaattaaattaagcatgttttctttttttttttttgagcttgtatttttattttcagttttatatatacttaaatacttttaacaaatagaatcctcatttttcctaccaggacttaaagtttctatgtggaaaataaggttgcaacagtgatgcagtgtggcatgttaagaagaagaaaacaaatcttaaatttttaatttaatatttactaaagtgaattactgcattctttctaaattatactgttcaaatatgtaataaagtgtgttttttaaccatctgctgactttaataactttctaatcaactttttgtacagcttataaatttcaagattaataaacctttagaattgtcagtgtcttctcagctctgaataaagtaacaaacttttaaaattaagaataattacattttatttaagtacctacttgatgactattgtagacaaaagctcttatgtgttcttttcttcgttattatagttctgcagaatcagaagatttggcagtacatttatatccaggagctgttactattcaaggtgttctcaggagaaaaactttgttaaaagaaggcaaaaagcctacagtaagatttcatcatattatattttaatacacctctaaaaatatgcaaatttataagactctgtaaaagtactaaaacaattaaaataaaacctgattatagtagacttgaaataatattaaataaggtcctcccctcttatccttgggtcatccattccaagatcccccggggatgactgaaacctcagatagtaccaaaccaaattaccatcatttggaacatgtttctgttcatgtcttccattcacaaatataataccttttctatcttaactaagcacttaagcccacacagtaaccgtaacttttgcagtttgcgatgctatagcaaaactagcatgaatttctttttccttcttcacaatttcacagatacaaaatttgttcttaccatggatcttagcaaccttagcgtctaatttttctttccttaatccaagaagttttcttttcacttaaggaagcagtggggagtgggacacaagggtagcacatatagtgtggagacgctggacaaagaaagggaagattatgtccacagaagcacagagcagaactgtgtgagattttatcatgttactcagaacaacacatgattttaaaacctgtgaattgtttatttctcaaattttccaataaatatttttagactatggttgcctgtgggtaactgaaaccacagataagagggaaaatattgtacacatttgtttcaccatgttttcttaacataaaatgttattatatgtgccatatagatttctgttaaatcatgtgttaagggtgcttaaatcctgtacttttttttacccccattatagttcgtatacaaaattatttcttagagaaccctgaaagtatatcatgaagaagtattttagtattaagtttaggtaaaatagaaaataaagagtaacaaccctaaaaaatggaatttgattgtgttttatcattttatttaaattcctgtaatacagttttgttttctacataacatagaatccaaatattaaatgctttccaaacctataactatattggggggggaaaaaaggaagattggtggaacaaagctcttaatatgtatcaaagaagtttcttcttcctcaacaccagcatagtagtttgactactaaggaacaatttttttccctttctcaaatttgaaatataaaacctttgatatatattcacacttaaagcttttgaagatatgggggcttcatataagtaatcttattttgttgtttatatcacagtaagccaaaggcacatacaaatcaagaatctcttaggcaggctagtgaactcagaattgcatgtcagttgaagcattaccataccttttgtgtgctggatgctagaaatagagcagtgaacaaggtgaggcaaagtgtcttcctcctggattacatttcagtgaggagaaatagagaataaggctttaaaataatgtcataggatacagaatgatggggcaaggagggatgccaccatggcaaaacatttgagctgagatctgaatgaggaaggtgagttagctgtgtgaatatctagagttcaggagacaagaaggcttgtgtagtttacgcattgaaattggggaaggtggaggagatcaagtaagaggcaaaagctggagttgtttgatgataaattaaacatgatgtatgagagaaagagtgaaaacaaagataacttctaggtttggggactgagatgggtgtatgttggggacatttattgaaatggggggcaggtcagtcttggccaagttcagtttgatatgcttattaaacattcaagtggaggtgtcattgtggctgttgaaaaagtatggatcatgaggtcagcagagaggtggcagggagatagatttgggagtcattagcatacagatagatagtatttgaaatatggaactggatgatagattatctaagaagaaagtatagctagagaagaaaacaaggttggagatggggctctgtagcattaaaggtctcccacaaagaagagtataaaggaaaactaaggaactgttatcccagaagcctagcagttacagtacttcaaaaagcaaagagtggccagctgggtcagatgctgttaagaggctggctatgataaggatagaggctttgctaaaattacaatcatcagtgaccttgatggcccaaaagccaaatgaaatgagttaagtagaaaatgggcaaaacagaagaagtagaggcaagatttagagacacccttgcaagaagttatgctgtgaaaaggagaagagaaattggttggtgtctggggagtgaggagatgggtcaaaggagggattttaaaggtgggagtactattaaggttcatttgtataatggtggtagagggagagagattgagaagcaatggagttaattgcaaaagcaaacttctttattttttttttctttttttttttttattatactttaagttttagggtacatgtgcacattgtgcaggttagttacatatgtatacatgtgccatgctggtgcgctgcacccactaactcgtcatctagcattaggtatatctcccgatgctatccctcccccgaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttggattggttccaagtctttgctattgtgaataatgccgcaataaacatacgtgtgcatgtgtctttatagcagcatgatttatagtcctttgtgtatatacccagtaatgggatggctgggtcaaatggtatttccagttctagatccctgaggaatcgccacactgacttccacaatggttgaattagtttacagtcccaccaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaataggaacacttttacactgttggtgggactgtaaagcaaacttctttaaaaagtgagagagagttggaatctagggcataaaaagagagttgagtttgcctttagatagaatcggggttaactattcttttgtagctggaggaaagactgagtatgtgggtctacaaacaggtagttacatggcagtgacaggagtatttgagattaagatttcagaagtgatacagctcaactctgaggttaggactttggttgaagtgaagtggacttgatcattggcacttagaatgtaaagaaactaagaagccaggagcattgtaatagtatattcctgtgtttgtcctatccaggtagcatcttggacaaaatattgggcagctttgtgtgggacacagcttttttactatgctgccaaatctctaaaggctaccgaaagaaaacatgtaagtatttgttctctacatttttagcgtggtttcccagactgttcatggttataaagaaagcagtcctaatgggatacaaaggttttttgggtttgccttgttttttcctatcttctagtccaaaagtttttacatttatttcttttttaaataccatttttccattgcaaatgtcaaaactgcacattacgcttatctattttgacatcaaagctttctcaaatctggagtttcctgttcaatattgttcaaaactattgccttggagtttcctttcctaatcagcaaaatgtggaaatgtgggaccaacatctaaagttctttccacctcaatctctggttcagtgattcttcccaacaatgaagaggaatgatcaattacaacagttactgcaatcactttcttgtgcttcatattacttaaaagaagcctcttttcaccctgtagaattttcctataaatcttttttgcatgctgttttgtttttacataccagtgatagaatctttgaaaggaagaatgattttctatgttgcattaataaaatctgagaggaattttatttctaagtcacatgttttgggggagaaaaattacgtggtttatcctactgaggaaaggtaagccagtgaagaaaaatttaagtcctttttctacttaaaacttaaccaaatgatactgtataattcagagtaattcagagaaactcttctttattctcacagttttagccctttaatcaaaccacaggtatagaaaagaacatttttggtttaaatgaatgtgggaagtaccgtaagatagcattgcctttctttatcagctatacccaccacctgccaccctcctgatcatcatgactcattgtcttgcttttcttcatagtgttagcatatatgtttccctaattaatccatggtttcattttttaactgtacctcagtgggatcatatatattcttaagcactagcttttttgctcactattattatataattgttaagatagctcttgcattgagataaaggacttgagtgaaggatcatggagatttcttcggtgaatatttattttttgtattctggtcaaattgacaataatgcctatataccctacaacatttacatagattagttttgctagaacaatttgtagagttagtactgctgttctcaaagtgagaaaaaggttggattcattcagttcaattaaatccttagcttcatatggaaagtaacttttcacatagccacattgagatacttgctggatagatttcacttagctgactattgtagaaaagtcattattcaaaataaaatggtttttttgttttttgttttttcttagtttcaattagaaaaagtccaaattagagaagttataactgaatttgtcatctaatggatatgttaaatattgttttgtgctttgcattgttgcttgtgcataaagttactagtatattatactttgggtttttaattatatgaggtttctgataggtaatgtatgcaaaatgtttggaaattaaagcatagtgagttgtgagaaaatcttattgagtaccaaggaaattgaccgcatttctcatcttttctaattaaattaaaatataattaaagaataaatttgaagaacaggatagagggtatagagacaggtctatatctatatttggtattaatcttgagatagaaaagatatggcacagaactaaatggaagaaaaaaattttaatcgttttcaaataaagttagaatacaaataaattggaggaaaatatctgctatatgtaagcaaccgaaaaaggattaaaatcaccatttaaacatagcaccacctgtattgttgtgttttggttttggttttggttttggttttggttttggtttttttttttgccaaaatatttaacctgaatcttatgaggaaataatcaaatccaaattgtgggtcattctatgagacagctggcctagattcttaaaaagaccaaaatttggcaggtggagtaagggcagggggacaggaggactgttctagattaaaggagacttgacaactaaatgcaatgtatgtcttttagttgaatcctggagttatattggggaaaaaatttaaaaagctataaaggttattattggaacaacttaagaaaatgtaacatggactttatgtggttgtctcttcaatttcttagaaatgacaattacgttgtgattgtataggaatatattcttgttattaaaagatacatgttgaaatatttagggttcaatgttatgatgtctgcaatttgcatttgaatgttcagaaagatcaaacaaacacaaaaatgtagattaaggatatatggctaatcattgtggcattctcaacttctgtacagtttgaattttttcaaaataaaaagctggaggagaaaaaaaatcatagattaaaatatacctgttcatggcaataaacccagaagtgggacatatggaagtctgtataccttattttagtattctataaagtatatatttttttgcctatgaagaacagtttgtgtgggtagagtgatcaacctcacttactatttaaaaatgcaaattaagggagacactttcctgccattagacaaaaatttaaaagattgatgacatagcattggtcatgatatggggaaacagactgtcatccatggctggtaaaaatttaaattggtattgtttttgtggtggccagtccgagtcagtatttagcttggtaataaccagaaattcctcatctgagaatctgtcctactgaaatttttgaacaagtgcacaaagattatctgtagaagaatatttctataatatttatgacaacagaaatctggaaatacccaaaatacttatcaataaggaaatggttactgatagatgaaaaacacaagtcagagtgtaaatatatcccccattaatacgtaaaaaccaacagcagcaatgacacaaacctctgatataataaatgcatagaataaggtctggaggttgtcacctcaagtgatgattatatctggggaatgtgatgggattcgctggtggttaaagggcatttgcactctagtttcatccctgtttctgaagcagtttatgttgcttgagttactttttactttttgaaaaagggaattgaggtggaagtttttaggcttaagaaaagaatattagaagatcatagtattcatgtcgaagtacattatgagctgtcaaatcagcagtcctgtggtagggccaatttcattcttcacagtagtaaaacttactgatttctttagctttcatatttcaatttcatgttgttatgaatgtgccatgttcattctttttcccatttcctttaatcgtgaagcatatcatacatacaaaagaagataggtagtgtacatgtacattttaaagcataataaataaaatgaacacctgtatactctccacccagtgtgaggaacagaatgttactagaaccgtcaaagccttcccagaggcatccacttcttccctgtcaaccatatccacagcttcttgctgtcctgaatttcttgttaattgtcgccttgtttttctttagtgttttaccatgtacacgtccttatacaatgcactgtttgatttttaaacaatacctgaatggcttcacatacagtcttaagcactagcttaagccaacctgttcttcttttataactgccctttctcagaattaagaaaagaagttgtagctaaaataataataaaagaatggttaactacaaaagtaatagacaggctaagaatacccttcttttttgaaaaatacaagtaagaatattgtcattaagaattatctggttgcagggagctgagatcacaccactgcaccacagcctgggcaacagagtgagactgtctcaaaaaaaaaaaaaagaactctctgatagcactgctgatttattacatcatcagatttaagacagcatagctactaaaatgcaaatgtccttcctataaggagtagtacagtaattcagaaaaaaaacaacagattaatatatcatattcacaaacatgctctctgggaatagggaatagatcagttaggttttgatgcagagttgaagctgggaaggtctggaaagtaggagattatctgaagaaggcatgcctaggatgaaattcagcagtaaaaggccccaggctggctgagaccagcatgaagtcacaaatctcatctttcattaggagaaactgaaaatacactccctaacactgaagttttgctagaataaaccataaattttctgtttccgctaattatctttttttctctcagttcaaatcaacatccaataagaacgtatctgtgataggatggatggtgatgatggctgatgaccctgaacatcctgatctcttcctgctgactgactctgagaaaggtgaattgttagaataactggggcttacgatactgcgtatgtgtttgtgtatatgtatgtatgtatgtgtgtgtgtatacttgtcatatatataatgttttatgcatacatgaagaacttgatgagccaaaacctagtttcactggaatactcaagagagaaagtatttgtgtagttttatctattgggaaatacttctgtcccattatgtattttaataatatttgtggagcttattttctttgctccatgggcatatatgcttgaaaattaaaagcccagctaatccctagagacctaactaggaaaggagggagggaatttgagaatatataccccattgttacttcaaatttttagagacttgccatataggccatactgcttccttcatcaataccttgaaatggattgttattcttaagttctgaaagtggcagagttttcctttaaatatttattctatcacttttaattaaattattcagaaccaatattctgcagtcttatccacacagatctagagatgccacacaattattgtatttatttagatgtattttattctaaagaatatttaagaacaaaattatttcttttaatccataagcagcaaaacagtgactttctgaatatatttggctcagatcactttccaagttaattataatattttacatacagtatatagagagacacttatgaataaaataactggctattgaccattggagtttataaagtagatatgagaaattggaggatgggccatgtataatcacatcatatgttcttcttactctacctgtgactatagtggatacctcaaggctcatcagaaaatatccccaagtggttgcttttcttccatcataacaactgctagctgttgacaagtaccagaaagatactttcagcagttcacaactggaatactatgttaccttttattgacttcacaactatattttgacctctgtttattcagatactattttgtatcaacagatatcccacttttatgtttcagtgttttaagtaaacaagtaagcaaatatgttggaggcaggaaaaaataataccaaaatgtcttctttttagattaagtagattgatttacagaataaatacaccctactcaacattttttttcccataagttattggggtacaggtggtatctggttacatgagtaagttgtttagtggtgatttgtgagattttggtgcacccatcacccgagcagcatacactgcactctgtttgtagtctttttaccctcatcccccttctcacttttctccccaagtccccaaagtccattgtatcattcttatgcttttgcatcctcatagcttagctcccacgtatcagtgagaacatatgatgtttggttttccattcctcagttacttcacttagaataatagtttctaatcttatccaggtcactgcaaatgctgttaattcattcctttttatggctgtgtagtattctatcacatatatataccacagtttctttatccactcgttgattgatgggcatttgggttggttccatgattttgcaattgtgaattgtgctgctgtgaacatgcgcatgcaagtatctttttcatataatgacttcttttcctctgggtagatacccagtagtgggattgctggatcaaatggtagttctacttttagttcctcagggaatctccacactgtattccatagtggctgtactagtttacattcccaccagcagtgtagaagtgttgcatgtttaccacatccatgccaacatctactgtttttttattttttttattatggccattcttgcaggagtaagctagtatctcattgtagttttgatttgcatttccctgatcattagtgatatggagcattttttcatttgtttgttggccatttgtgtatcttcttttgagaattgtctattcatatccttagcccacttttcgatgggattggtttttttcttactgattcgttttgagttcattgtagattctagatgttagtcctttgtcagatgtatagattgtgaagattttctcccactctatgggttgtctgtttactctgctgactgttgcttttgctgtgcaaacgctctttagtttaattaggtcccaactatttatctttgtttttattgcatttgcttttgggtttttggtcatgaaatccttgcctaagccaatgtctagaagagttttccaatgttgtcttctagaatttttatagtttcaggtcttagatttaagtccttaattcatcttgagttgatttttgtataaggtgagagatgaggatccagtttcattctcctacatgcggctagccaattatcccagcaccgttagttaaaaagggtgtcctttccccactttatgtttttgtttgctttgttaaagatcagttggctgtatttgggtttacttcagagttctctattctattccattggtctatgtgcctattttcatagcagtaccatgctgttttggtgactgtggccttacggtatagtttgaaatcaggtagtgtgatgcctccagatttgttcttttcacttagtcttgcttcggctgtggtgggctcttttttgattgtatgtgaattttagaattgttttttctgattttgtgaagaatgatactggtattttgatggcgattgcattgaatttgtagattttgcttttggcagtatagtcattttcccaatattgattctacccatccatgagcatgggatgtgtttccatttatttgtgtcatcagtgatttttttcagcagtgttttgtagtttccttgtagagctctttcgactcctttgttaggtatattcctaagtggttttttgttttgttttgttttgcagctattataaaaggcgttgaattcttgatttgattctctgtttggtcattgttggtgtatagaagcctactcaaaattttgaattcaaagccccagcctccttcccatatcaaaggcataattcacgaaattacatttcaagatgagagcattttcattggatttagttaacagattctttgttttcttcagtttctcttagcatgcctaatagaactacttcaggtagccaaaattttatgaagtctatctatactaatggttttttgcgggggaggggtgagtatgtaaattgtagctgtggccagctttattgtagatatggctttttttcacattgacctaatgtctgtgtctgagttcagcaagtgtaacggtgttacttgactaaacatttggtgaagaaacaattacttcagaaagtgaaaaagttattttgagtgttagaatctcaaggaaaagctgaataatgcttaaatatagttaggctcttgagccattgaatgcagttattaaggaaagaatagaattcagcacaaattgtgaaataaaaagaacttaggtcaatgaaaaaaggaaataaagcttaatttagagcagcctatagtacatggatcctttcttttctcaatttgttttctcaccttaatacatataaccatttaaaatatcctcattatatgtcagtcttgaattaaagtcaatatagaaattacaaaatacacacagcacaaatgaatatctaatttcttaaaagagagaaagttgcctcctagactttccccaagagccctcaacagaactggaaatctgtaataatattgacaaatatcttgtaactaaagactaaaagcatagtctatcaatgttatatgactaatccttaattatactgaatagctagtgtttaagtattaaacatattgaagcattctggcatgttaaaacttaacattaacatctactaatatttaggccaggtgtgggggctcatgcctgcaatcccagcactttgggaagccaaggcaggcacatcacttgaggtcaggagttcgagaccagcctagccaacatggtgaaaccccgtctctactaaaaatacaaaaaacttagctgggcatggtggtgcacacctgtaatcccagcttattgggaggccgagacacgagaatctcataaagctgggaggcagaggttgcaatgagctgagattgtgccactgcactccagcctgggcgacagagcgagactccatctcaaaaaaaaaaaaatctaatatttagatcatctaagtagtaagtattcagaaccaatattctgcagtcttatccacacagatctagagatgccacacagttattttatgtaggtgtatttcattctaaagaatatttaaggagacaaaattatttcttctaattcataagcagcaaaagtgactttctgaatatatgatagcatgtaaatgtgttgcatcgagaactctttattgtattggaaatacaataaaaataggaaatacaataaaatggaggtgttgaatagaattctaaaactgaaaactctagtcatgtttaatttgctcattattatctggcagaattattatgtgtcgtccttacatttttaatatttcccccttattttggataattttaggaaattcgtacaagtttcaagctggcaatagaatgaatgcaatgttatggtttaagcatttgagtgcagcctgccaaagtaacaaacaacaggtaagcatttctcctaattctcagaatagtccataatttgggaacatatgtaaaagagttccaagagaagtaaacagactagttctgaattaactaggagaatggtggtgtttttattcttgttgattacagttaataagatatgaaggtctacatcttagtgaggagctagacagtaatcatgcaaacaagtaacaaaatttcgaacagtcagaactatataaagaaaacaatagacgtatgtgatatagagcaatgggagtacagacaacttttgataacataaggttgggcagcaaagatctccctgaggagatggtattgacaagaaccacaagaaggaacgagctataagaagaggagagcagagtgctgtgtaagggaagagcaagtgcagggagcctgaagctggaacaagcttaaggtgagttcaaagcacagaaaggtagctagtatagtagtcagagtatagttctctaaagggtaaaaattagatggcatattaaattaataaaaattattcgaattcatctttatttgatctattgacaatttgatgtgggtttctgtggtggtagtgaaaccaaaaaccatttaaattttgtttgcttttattttactgaaacaaaaatggtctaattgaaaggctttcagctgcagaagagcaggaatccattgtgttgttttccccaaaccctgttgcacagttagagttgaaccacagattggtagagcagacataaaacacatagccacatttatagaaatttatatagactttttgtagaaccagttgtttgttaaatatatttgaaaatcattgacttagcatattgataatgcagaagtctatggttagcattatcagtaggtaatattgaatatgatgcactatataagcttagaaagcttacagaagtatttttcaccctgtcatatcaggatgtaagttattaccctttcttgataattgaaactaaggctccataatacaaaatgacctacacaggtcacacaagtaaaaaatggtggattcaaactttcttcatcctttaagtccattctttttgtttgttttttgacttttgggttcagagggtacttgtgcaggtttgttacatgggtatattgtgtgtcactgaggtttggtgtataaatgatcctgtcacccagttagtgagcagagtacccactggtttttcaaccgtcacccctctcccaccctccccactctggtaatgctcagtgtcgattgttcccatctttgtgtctaggtgtattcaatgtttacctcccacttacaagtgagaacatgcagtatttggttttctgttcctggattaattcacttaatggtctccagctgcattcatgttgctgccaagggcataatttcactgttttttaaaaatcactgtgtagtattccatagcatatatgtaccacattttctttatccaatccactgttgacaggcacgtaggttgattccatgtctttgctatagtgtatactgctgggatgaacatacatgtgtctttttggtagaacaatttattttcctttgggtatatgctcagtaatgggattgctgggttcagtggtagttctgtttcaagatctttgagaaatctccaagctgctttccacagtggctgaacttacattcctaccaagtgtataagcattcccttttctctgcaaccttgccaacatctgttattttttgacttagccattctgactggtgtgagatggtatctcattgcaattttgatttgcatttctctggcaattagtgatattggccgtttttcaaatgcttgttggccatgtgtatttcttctcttgagaagtgtctgttcatgtcctttgcccactttttaatggggttgttttttgcctgtaaatttaagtttcttatagattctagatattagacctttttcagatacacagtttgaaaatattttctcccattctctaggaatgttggtttattctgctgatagtttcttttgctctgcagaagctctctaattaggtcctgtttgtcagtttttgtttttgttgcaactgcttttggagtcttcatcatgaagtctttgccagggcctgtgtccagaatggtatatcctaggttatctttcagggtttttatagttttaggttttgcatttaagtctttaatccatcttgagttgatttttgtatacagtgtaaggaaggggtccagttttaatcttctgtatatggctatccagttatcctagcagcatattgaatagggagccttttccccattgcttgtttttgtcagctttgtcaaagatcagatggtagtaggtgtgaggcattatttctgggctctctatactgttccattggttctatcctgttccattggtatctgtttttgtaccagtaccatgctattttttggttactgtagtcttgtagtatagtttgaagtcaggtagtgtgatgccttcagctttgttctttttacttagaattgctttagctatttgggcttttgttgttgttgttgttgttgttgttcccatatgaattttctaatggttttttctaattctttgaagaatgtcattggtagtttgataagaatagcattgaatctgtaggttggtttggacaatatggacatttaacagtattgattcttccaatccatgagcatggaatgcttttccatttgtttgtgtcatctctgattactttgagcaatttttgtaattctctttttcttttttaattttttttttttttttttttttttggagacggagtcttgctctgtcttcaggctggagtgcagtggcgcggtctcggctcattgcaacctccacctcccgggttcaagcgattctcctgcctcagtctcccgagtagctgggagtacaggcgtatgccaccacgcccagctaattttttgtatttttagtagacaaagggtttcactgtgttagccaggatggtctcgatctcctgacctcgtgatccacccacctccgcctcccaaagtgctgggattacaggcgtgagccactgtgcccggcttgtaattctcatagtagagatcttttacctccttgattagctgtatccctagatatttttttctttttgtggctattgtaaatggaattgtgttcttgatttggctctcagtttgagtgttattggtgtatagaaatgctgttgatttttgtacattgattttgtatcctgagactttgctgaagttgtttatcagatctaggagctttgggtcagagactatggggttttctagacataacatcatatagtctgaagagagatggtttgacttcctctttctatttgaatgccttttatttctttctcgtgtctgattgctctggctgggacctccagtaagtattatgttgaataggagtggttagagtgggcatccttgtcctgttccagttctgtaagggaatacttccaacttttgcccatttagaatgatgttgctgtgggtttgccatagatgactcttactattttgagatatgttctttcagtgcctaatttgttgagggcttttaacatgaaaggatgttgaattttatcaaaagccttttttgcatcttttgagatgatcatatggttttctgtttttaattttgtttatgtggtgaatcacatttattgatttgcatctggtgaaccaaccttgcatctcaggaataaagtctacttgattgtggtgaattaactttctgatatgctgctggattcagttagctaatattttgttgagaatttttgtgtctgttcatcaggtatattgacctgtagttctgttttttcattgtatctctgctagtttttggaatcagaatgatgttggcttcatggaatgagttagggaggagtcttttctttctcgatttttcggaatattttcagtaggattggtactagctctttttcgtacatatggtagaattcaactgtgaaatccacctatttcaaggcttttttgggttggtaggttgtttattactgattcagttttggaactcattattggtctttttagggattcagtttcttcctcattcaatcttcagaggttgtgtttccaggaatttatccatttcttttaggttttctagtttgtgtgcatataagtgttagtctctgaggattttttgtatttctttggagtcagttgtatgtcacctttgtaatttctgattgtgattatttggatcttttctcttgttttatttgttaatctagctaccagtctatcgatcttgttttttctttcaaagaaccaacttttggttcattgcttttttgtatgcattttcacatctcaatttcattcacttctgctctgattttggttatttctttttttctgctagctttggggttggtttccttttgttttgtttttctagttcctcaaggtatgatgttaggttgttaatttgagctctttctaacttcttgacataggtattgagtctgatatgttgtgtctctgttttccttagttttaaatcattttttgatttgtgtcataatttcattctttacccaaaagtcatttggaagaaagttgtttaagttccatataattgtgtggttttgagaaaacttcttggtattgatttctagttttattgtactgtagtctgaggctatggttggtatgatttcaatttttttgaatatgttggcacttgctttatgcccaagcatgtggttgatcttagagaatgtgccttgtgccaatgaaaagaatgtatattcttgtgttgttgaatgaagtattctgtagatgtctgttgggtctagtttgtcaaatgttgagtttaagtccagaacatttttgttagttttctgcctcagtgatctgcctgacactatcagtggggtgttgaagtcttccattatgtagttatctaagtctctttgtaggtctctaagaacttgttttcctaatctagatgctccaatgttgggtgcatgtatctttaggatagttaagtcttctggatgaattgaaccctttatcattatgtaatgcccttctttgtcctttttgaccattgttatagtctgttgtatctaatataagactagcaacctttgttcttttttgttttccatttgcttgataaatcttgctccttacctttactttgcacctagtatgttgttacatgtgagatggttctcttgaagatagcagacagttgggtcttgcttctttggccagcttatcactttgccttttttgcctgtttacattcaaggttactattgatgtgtgaggatttaatcctgtcatcatgttgttagctgcttgttatgtagacttcattgtatagttgctttatagtgtcagtggactatatacttaagtgtgtttttgtggtggcagttatttttctttcatttccacatgtagcactccttaaaggacctcttgtaaggcaagtctgatgatagtgaattccttagtctttgcttgtctgaaaaggattttctgtttccttcacttatgaagcttagtttggtgggacatgaaattcttagttggaatttcttttctttaaggatgctaaaaataggcccccagcctcttctggcttgttaggcttctactgaaaggtccactgttaacctgatgaggttccctttactgccccttttctcaagctccatttaagatttttttcttttgcattgaccttggagaatgtgatgattaagtgtcttggggatgctcatcttgtatagtatcttgtggggagtctgaatttcttgagtttgcacatcaacttctgtagcaagattgggataatttttgtggatcgtatcctcaaatatgttttccaagttgcttactctgtctccttttcttgcagtaacaccagtgagtcataggtttagtctctttacataatcccatatttatcaaaggttttgctcatttttaaaatttttttctttaatgtttgtctctgttaatttgaaggagtgctcttcgagttctgagattctttccttggtttggtctattctgttgttaatgcttccaattgcattatgaaattcctaggctgggagtggtggctctcacctgtaatcccagcactttgggaggccaaggcaggcagatcacttgaggtcaggagttcgggaccagcccggccaacatggtgaaaccccgtctctgctaaaaatagaaaaattagctgggcatgttggtgcatacctgtagtcccagccactagggaggctgaggcaggagaatcgcttgaacctgggaggcagaggttgcaatgagccaagatcatgccaccgcactccagcctgggcaacagagcaagactcccatctcaaaaaaaaaaaaagaaaagaaaaagaaagaaatttctagagtgaatttttaaattccagaggttcagtttggttctttcttaaaatggctgtgttatctttcaactcttggattgttttactgttttccttaaactgggtttcactttttcctgtatctcactgagcttccttgctattcagattctaaatccaaagtctgtcatttcagtctggttaagaaccattgctgggaacctattgtagttgtctggaggtaagaagacactgtggtttttagagttgctagagttcttgcattggttctttctcatctgtgagggctgatattcctttatcctttgaagttgctgacttttggatggtgctttttgtttttatgtttttgatttcccttcagggtttgactgtggtataagttgggtatagtcaattggcttcctttctggatgtcttcagagaaccaaggttcagcttggcactcctgggctgtgtcctgtaactcccaaggggctgggactgggcccctggctttttcctctggcctcttgaggtcgaccaccggctgcactgggtggaccaaggtgctcccaggctgctggcaaaacctctccatcaggctactggcaaaagcacttcctcaggggccactgttgaaagtgttctggcaggatggtgggggccactggtaaaagcactatggtgacagtcgcccgcaaaagcattccaacagaatagtggaagctacactgtgtgcctgctcccatgggagtggccaaacagggaccttggaaggggccagtagacagtgggacatgcagctcagactcaccccagtcccatgggaaacacagccctgctctctccaaatatggcagttagcaaaggtcagagccacctagaggagtatgaagagccttggtgggtgggcgcctatggccgtgttcctttgcagctttccccacaccataccccctgggctccatgtagacctaagttctgtctctgccagctctccaggcagttccccctggcaactcaaatatccaggaggactatgggatctcctgccactaggatcccagcggtttgtggtgagagtgggccattccacagttactttactcaccccttccttaggagctgttcaggaccaggaatgagtcccagcactccacagccctgtgcagggttcctagcttcttcgctcttcaaccctggttctgcatcatctctccacccactctcagaaaatcggtgattttctctcagtgcatcctctcagaagataggcttggagtatgctggtctactagatactcagatctctcttggtgggagaagctcttcctggctttgcctagttggccatcttgtcccaatcccgagggcatttttttaaaatattgttggagtgggctttgttctctcatagtttttattgtttcaaatatatatgcaacactaatagcagtatttagtaccatttttagcaacctccataaaggacatgaaatgtcatagagcgaaaattattttttgccttgtcaggttagtgtctggggcagaatgaaagaaacagatcaggctttgtctagactaagcctttcaggattcacctcattgctatacattttctttaaatgtaatttagggtattaagactctttttttttcaatctcagattccaagatgaatctagacaatatatacatataccagcttaaaggttcaatttcttttactgtattagtgagtatttctgtgcaacaagtcaaccagacgtgtataaatatttgtttctatacttgcaagaattagaatagtggcaaatttgtaagtagaacctgtgaaagttttagtagaaaactctgactcaaatgcaaaatatcttaaaccacattcaggcaacttaaaaagaaatgaaacttttactttacttaaatacaagtttctttttttttctttgagacagggtttcactcttgttgcccagcctggacagtgcaatggtgcgatcttggctcactgcaacctctgcctcccgggttcaagccattctcctgcctcagcctcctgagtagctgggattacaggcacccaccacaggcccagctaatttttgtattttcagtagagatggagtttcacaatgttggccaggctggtcttaaactcctgacctcaggtgatctgcctgcctcagcctcccaaagtgctgggattataggcgtgagccaccgcacccggccaaatatgagtttcttataatcagacctgaaaatttatactttaagcacttgagcatttgtgttgtatttgatttgtaattcagttatgagtacattggccaacataatttttttattcagaagctgacacttgtaaggtatttatgtttttgcatataataggtttcagagagaggttgctaaactgtgagagctgtcttaaggacagaaaagaccactgacatatgaatacctctcccagtattttggaaaactggttttgaggatttgttttaacatagtgaaactctaataaggaattttgtttttctgtacttattttaatcatgattttacaaataaattcttagtaatgtttgttataaaattatttttgctgattttaaaaatatgcacctaggaatttttgtaatatataatgagaaaataaataatggcaaacaagtgtatctggaatctcaccctaccagagtcatacttactcttgctctcatttattcattcagtaaacgtctactgagccccctgtgttagacaagaaagatattgtctctaccccttctcctgtatagatgtcattttactagaaagagtattaactcattttggtgattttctctcaaaaatgttctagcatgttaattattcataaactattgaagctccttatatcaagttccttttaaaagatacttaagtagaaagattgggcttgcctaaataacaaggaaagataagaaatactcctttgaaaaacaacttttaaactcagtttttaatgcttatattttttaggttcctacaaacttgatgacttttgagtagaagcctgagaaaaaaagagaggtgaactgttgcttctacgtgagcatgaggacctgataaaagagcgccagctataaaccatcctgtgccaggaagagcccagaggctctgtctcagtcgttggagttctcaaccaaaaaagcactaatttcagggaatgatttgagatattcccagagaacaaattggagttgcaaaacaaactgccatgaaccatgcttcttatctcagaactgacctgtggaaaccactgccttaaaagaatgaaaggaaaaccaacatgaaacaccaaatagtgtgtgtgaatcttctggcggtgctgtgcttggaatagatcgtagctaatttgcatttcttttaactttgtaataattttagaggggggaattgccttttttagatatgctttaaaaaggaaaaacatactcttgtggattccatcaggagctggttttgaaccgaggtgaagagacttagcagggattgtaccagcagcccacctgcaaggtttgttctccctctagtagtctgcaacctcactggctttctcacagcaagagtgtaggaatgagaaatgttagtcatgtgagttcttgggtttgtttgggattgggtgggggtgtttgttttgttttggatgaggggagaatttttttaaacactaaacttctgaaatgtagtactgtaaggggaacattatttcctgcaggaggtacaaaggctgtgtgttcatttgccagacgctttttttttaaataggttccagaaaacatggttgtttctaactagggttaaagtttagctttctatatgaattcattgttggaccacagatctgcttaagtaaagagctataatcccaacctaaacttttctgagattttacaataattagatctttttccaagttaattgggttttcccttctcccagtcataggtggtttttatcatcaagacagactgatattttgtcaggatattttcttttacagtgtttgatgtgcataatgccagagttatttttttattattcattttctctctttttgttcaatatgagattcaggatcatatttgtttaaaaggtaacacatagagatgtatgtatatattttgttataagacatacaaaataattttaagagggataaaggtgaaaatatcagattctggaaattttaagtatctaaactttatacttgtatgatttaccataaacataccaaaacatttttctgaaaatttactgtcggtctctgacatgaaaccgtattttgtcagtagttgaccaagcagttttatgagaactcttctatgcaatgatgcatttaatttctaaagtaaatgttgaattattaaaaaaaaagtttgaaggtaagatgccttagaattttaatgaaaaatgacactcaaacaaaggctatatgtcgaatgttataaactcttgagacataatgaattttagcagtggcctagagtaaggtaatgctttgtgactgatatctactaatagacttctgttactttgggcctcacataaaatttctcacattcgtattcttagagaattttatacttttttattataagtattttgcccttgagtccatgaaacttcaatagaaaatattgcttatacaataattagcttaaaatccatccaaaggaaaagagaagagctttttttgagtgttaagttttttaatttagtattctgtttggaaaagatgttaagagttcaaatatgcttcttatgtaacagaaataccattatttctggggtttagtgacacaggctggagaggacaaaagtttcctgtcctgaatgatttttcaattaatgctctaagcttaacccatgttgggtaatagaaagacatagccagcagtattactacgtagaccttgcacatcttacttttgttttgcatttttaaaaatttcttaatttgtttatttctcttcagaaatagcgtttttaacagtgtatgtgcttttttaaaaagtattgtgaatgagaaccctgtggattttttttatttcatttgtttgtcataataagctaacgtagaaatgttgtaggttaaccatatctgtggaaatatgcagttggaagtcagagcctgacatcacatagttttgccaaagggagagagctaagctggaagatgtttttgatactttcggctctaaacattaatggatgtttgcgtagagtaagatagcgttcaaatttggttaatagtttatagatagacttgtggcctctgactgactaaatttcttaacagcacagaagtcgttgtttttctgtctttaaaatttattcattcagaaaattagtcattgctttttaagattattttagcatttgaagcaaattgaaaacagaaaagtgacttaaaatagtgtaggtgaattttttatctataatttaccaaataatacctgataataattcaaagaaaatatgttaccaaaatatattaaatatataggtagttcattcgtgggaagatgaatcttcttattaagcctgccctcaattgtaaataagtgactcaaaaactcaaaatgttcatcagcattcaggtcatttgtttcacccttagccaagaagaactcattagaaattcagttataatttcaatttaagcctgtttatgataagcataatgattggcatgttatatagcctgttgaaaataactacagaatgaccttccagagcactgtttttggcctcgtgcccgctctgttcaggctctgcttgtttttcagaatatgatttttacctccagacagtaagaattgaacaagaactgatcaaacacaccttcctattttgttttcttcactatgtaaatattatttgggcaaacattacaaaaagggatccaaacaatttgagtttcagtatttttttctccctaggcatgtgcttcaatttcaaatatttttttctgtgtggaaaatgccatgtaactattgcactaccttctgtgtggactgtgttggtattggttctttctgtatatcaaaagtcagggtgtttataactgcaaagtttgtataagtggctttattcctcttctagaagatttatgaggagcctaggaagcactattggtacaggaggaaaaaagaatggaaaacatgtttacagactctagctttccttattagcttaaactggggccctcaaagagcagcctgttgatcttttggccaaatgacttgagcataagtcttttatttctttttaaggttaaatcgtaaactgtatacctttactactgaaaacaaaactatagggcatcatactaattgaaaatcaatagtaatgggttccatccattagctttttaaatgaatagatctggtattgatttccttcctgtttttttgaggcacattcctttacaaccagtgtttaaaccaccacgtaatcatcttctgcaaacaaggggtgccagtgttgcctaacagaagataatctttaataaagcaaatcctctgcttcaaaggtttttgaaataattggatccctttttgaaaaggaagatgagtttaactgtgtccaggtggagtaatagtactgctgttgcatgaatagatgatacaaagcaagtgatgaggttggtatgacttctttagtgaccttttagggtttgcttttattttcctctcttttttgtattatttctttcaaacatagtaaatatatgattttacagccaaagtggtattctgttttttctaagctttgagatacaaatattgctatttaatcacattgatgatgaattactttccatgtgaaccttctcaaaatgatttaagtacctttgattttgctcccctaaaaatggcttgtgtctaaagtgacatttttttccctatttggagggttctaatgaaagagatccaggcataaaaactcttttgcttattgaaagcaatttgattacacctatgtttcaggttatagtggggagaaaatttggtcagtgccttattatttgaagagcaattttagggcatcaagtatgacaataatcatgtgccctcttgctcctcttatttcaggagtgtgtgctatccctctctccaccagcttaatctttctcaccccaagtctaacaaagtctttacagaaacctctgtaggtgattgttgcagtcttccttggtttttgagtctttttaaacaagctcctaccctgcttctatccttttagagtaggagattaaaaataaacccaccccagtcaacctttagataagcactcttaaaaacaaatttgaagagcactcttcagccaagttcatttttattttgttgttgatgttttgagcatacatttaattgtaaggccttttggaaaagccctaaaagaataagatacaaccagaaatatttgagttttgttaaatgtactgaaatcttgtaatgaaaatccctttggccagaaatgagatttatttccatttatttttacatttaagtaacactcaaaacaaacaagtagtcacttaacctgccagttattattttcttgaaaatatacaagaaagtaaaaatatctctaatatataagttaaaggaaagttaagagactaagctagttttttcagtgaaagcaaagttggaaatattttgcttctctcagattattggaagacctagagctactggatgttaacctgaatcaagatgttcttttcacatttttttaaagggctagtatgttccagagtaggcaagtagtcattcaagccaaatgaaagagttaactggtccttgaggagtgttagcaaaatttaaattttgaccctggccatttgtactacagaagtgattatgggattaaaagaatacataattacagtgttttgggattgggctcttttttttcttaatagaaaagcagaaacttcataaataatagctgtgctttagataccagataacaaatattgtttcccctgaagatatgacctactagaactactcacatatatagtccaataattactgacttaataggtatggtaaaatagctgataataagtcagactctcaagagtttctgtaccttgattattgacaaattcattgttttacatcctactaaagaacatgtgtgtggggagggggtggggaactggttcacaacataatctgaaggagatcaaacatctgtaaggacaggtacccagtgatgataatatatctgaaaacacaagccatttttattctttatcccaattaacttgaggtactctaatgatgaagcactcgattgcactatgacctccttgagtgatgtgcagcttggttcctctctcactttttgtttctttttaatatgcaaatgtgagtgtgcgatcttcagtgtgtctgcataagctaacttaagatgaatttaagtacagttttctgaaatatttctattgaaataaattacttaaaattatagattgggtgaggatgtttttgttactgtatttgcatttttatcatgaacttttaaggtgcaaataaactttaagttgatttttttcccctttctaaggtagtcaacaaggctattgttggtgcagggaaagctctgaaaaaactttagtcactcttctctagcccaagacaagaatgtgccacctcgcatgtggacaaatggggttgtggggaatagagagtaagggcataacatttccaactacatctcccactctgagtatgtgatacgataggagtagtccccaaagaggctctctttgctaatacataacatttttttctttttaccatttctgaaaacaatccatattcgagaccatggagctttaaattggaagaagtacagaaatacctgtgtggagtctcctgtaggctattgtctgggtgttggttatgcttgagaattccacgttagcttagcctctgcatggtttaggaacccccagccaggaaaagcccaatattttggcaaattataattcagttttcagcagttttctcacctccatagtgccctttgaaacttctcactgtccctttacttgaaccaaaagagaagaatgacacttatttgttggggccaacctgtcattacctcatatagtaccacctttgtcatacatcagtttcccatatatgcagaattttctagatcccctttcctgtttcaacggttgtttgtcccaaccaataccatattgtcttcattactatatagctgtataagttggtatctggtgagctaattgtatgttcttcagaattagcttagctcttcttgactttgtctttgctgtaaattctaggatcagtttgttatgttccatgaaaacactgttgttatttttattggaattactttggatttataggttaatctgagaattcacagttttgaaaaatttactcctttcatctgtacacatgtctctctgttcatttagggcttttaatgtccttcagtaatgttttacagttttctcctgagtagtctcttacattttttattagtttatgtctaagtaagttagtttttctttctactatgaatgtgacttttttgttacatttcctcattgactattgtgtgtaggaatgccattggtctttatgttgattcttatatctagcaaccttgttgaactcccttacctagttataatggtttgtccaaagatctgttggaattatattagtggcaaataagaatagttgtttcttcctttccaatctttgtaccttttttttcttgtcttatccttatttggctaggactccagtacaatattggattagaagcagtggtacaatgccaaagaacttaattatccagtctcctcagaaaacctcagaatataacacagccctagaatgaaccctaagcatgttatagtgtagcccaagtataatctttattgtatttgtaggccaactaatcatcaacttaaatttctcctttttcttgtaaagtatgtttatactgttaggcagaaaataagtggcatttgctctcagccaccacttatcagtcaaaactaagtaaaatggtgggtcacagggatactgcaaaatttagagtatccacgtgtaattaattttcttattctatgtcactgattctcaactggaagcgattttgtccccaggagatattgtcagtgtctacagacatttttggttgtcacaactgggagagggttcttctggcatctagtaggtagagaggtaagggatgctgctaaacatcctatggtgtacaggccagccccccaacaaagaattatctgttccagaatgtcaataatgccaaggttgtgaaatcctgctctatgtgagtgacttattgtatctcataagttgaatatattgagcttggttgtaggaaagaattcggtttatgtttggcaagggactttaacttttccctggaagttaacctttcttacagaagtttaacctactggccagaggagataaattaatagcatgggaatatattcatggcctggaccataatgtgttattcttcaagtatttgttgagctaaaagctacatgtttcaacctaaagtagatttgtggggacattctaaatgagtgcagacctacagaaatgtttgtctacctctgtatggttattccaagtctgaaaagataaccccaatagcagtaggacaaaataggttatcaatatgtcaggctggattatttatttaatctgagctttaataaaaccagaagctatttactttttgttcttatgatagtgttatatccacattataaaaagttcaattaaagaaaactatacagtaaaaaatgcatgcccgacctatcaaattcccatctccaaatttaataaaaacatctatctttgactaaattcctgtaatgctagcctagtttctttcagtctcaggctctgaagaatgatttttcacctccctcaaacctttgcccaatctaagacccttacatatactctagtactgtcagagctaaaagcataaaaagtatcgtccttactccacatagacttgtgatgcattggttacattattttttatttggtcgaattagctgtaaaaatgattataagagagtactttgaacaaatatatgccaacaaattgaataacctagaaaatggacaaatttctggaaactcgaaacctaccaacacaaaatcacaaagaacatctgaacagacctataactagtaaggagcttatagatcagtaatcagaaacctcccaaaaaagaaagaccgtgaacctgatggcttcactggtgaatgataaaacattaaagacaaattaataccaatccttctaaaatttttccaaaaaattaaagctgagggaacacttcctaatttattctgtgaggctaggattatcctgataccaaagtcagacatagacactacaagaaaaccacagatcaatatctattatgagcaatttatgcagaaatcctcaacaaaacactataattttaatttcagcagcgtattacaaggattatataacatgactgagtgggatttattcctgaaatgcaaggatggttcaacatgaaaatcaatgtaatataccatattaacagaatgaaggaaaaaaatctcggtgcagaaaaagtatttgacaaaattcaacaccctttcatgattaaaaaaatgataataacaaactaatagactctacctcaacataaaagccatatatggaaaagccatatatggaaaacccacagcaaatacactgaatggtgaaagactgaaagcttttcctctgagatcaggaacaaagcaagaatgtacactttcaccacttctattgaacatagtactggaaattctagtcagaattggaaagataaaattatctctgttcacagatgatatgattgtatatgtagaaaaccctaaagattacacacacacactattagaacaagtaaatgaatccagcaaagtagcgggatacaaagtcaacataaaagtcacatttctgtatactaacaatgagcaatctgaaaattacaaaattccatttactaaagcatcaaaaagaataaaataggaactaacttaaccaaggaggtaaaatatttgtgcaatgaaaactataaaacgttgctgaaaaaaattaaaggcaaataaatggaaacatatcacctgctcctggattgaaagacaatatcgttaagatgtcagtactactcaaatcaatatatagattcaatacaatccctattgtagtgttttttacagaaatagaaaaccccattcaaaaattcatatggaatctcaagggacccctaataaccaaaacatcttgaaaaagaacaaagctagaagacttatttcctgatttcaaaacttactacaaagctacagtaatcaaagtactgtggtacttgcgtaaaaacataaacctacgggatagagagcccagaaataaaccctcgcatatatggtcaaatgatttttgacagggtgccaagacacccataaggaaaggagtcttttcagatggcgctggggaactgtatctccacatgcaaaagaatgaagttgtatccttacctaacactgtatacaaaaattaactcaaaatgaatcaaagaccttaatgtaagacctaagcctgtaagtcttactgaagataacatagggcaaaagcttcacatcgttgaatttggcagtgactttataggtatgacactaaaggcacaggcaacaaagggaaaaacagattggacttaatgaaaatttaagatgtgtgtcatagacaatataaacagaaagcaacccacagaatgggagaaagcatatgcaaattatctagctgataagggattaatatccagaatgtatagagaactgaaactcagcaacagaaataattcagaaatgggcaaagaacttgaatacacatttctctgaagaagattgccaataaatacattttttagaatgcttaatatcaggactaattagggaaatgcaaatcaagggtacagtgagataccacatcccacccaatgggatggctactatcaaaaaataaataacaagtgtttggtgaggatgtggagaaatttaaagacctgattggattgttaaagctacaaagacagtaaaaggaaatctctgaacctggatgggaaagaacttaaatccctcaaagcccttctgtaaatacaaaaaacagggtttctgttcaatggacaagacaaagttaacagactggtgaaaatttggaagaaaacttttggagtttataagagcaaaagattaatgtcaagaagataacaggacatttttgcaaaataaaatgagaaaactgagctaacggatatgaatagacaatttataaagggaaatctaaatcatgaaaaaatgctcaacctcactagtagagaagtgcaaggtgagagctgtcatgttctatatgttttatcaaattggtgaaaaatagccagataataccggttatggtttggggaatactggaatcctcatgcactcagcagatgagggtataaactgatgaggccatgccagagaacatctggacagtattagggaaatcatgtatgtgtatagagcacaggaataaggattctgatgctggaattgaactgcctgggttcagacgctggctctgtcacttaactagcggcaggacctggagcaggtgacttcgtccctcaatttcctcatcagtaaaatgtgcacagtgtcaaaacccatgtcatagagttgttgtaaggctaaacttagctgataaatctcaagccctagagcagggctagcacataggaaacacttcgtcagtgtgaggtagattagtgtcattgttacactgtaacctactagctgctcttggaatcaggcactgggagtgagattaggaatgaaggggaaattttacatggaacagttacaaaacagtcataaaactagtcacaagagtcaggtctttgcagttacctatgaattaagtcacagtgaactaaggagtgtcttcacctgtttatcgaatatagaaataaaccaggcatattccttatgaacaaactagcaaggagaggaaaacctgaagaaaagccacctgtaaaacaattcccgtggccgggcacggtggctcacgcctgtaatcccagcgctttgggaggccgaggtgggcagatcacctgaggtcgggagtttgagaccagcctggccaacatggtgaaaccccatctctactaaaaatacaaaaattagctgggtgtagtggcaggcacctgtaatcccagctactcaggaggctgaagcaggagaatcgcttgaacccgggaggcggaggttgcagtgagccaagatggcacctttgtactccagcctgggacgagtgagtctaaaaaaagaaacaattcgcatttattattgtttggggtttttggggggggggtggttggtttgggtttttgttttgagacagagtctcgctctgtcacccaggctgcactgccgtggcactatcttggctcactgaaacctccatctcccaggttcaagagattctcatgcctcggcctcccgagtagctgggattacaggtgcacactaccatgcccagctaatttttgcatttttagtaaagacagggtttcaccatgttggccagactggtctcaaactcctggcctcaagcgatccgcccaccttgacctcccaaagtgttggagtacaggcatgagccaccacaatggccttgttttgttttgtttttatagagacagggagttgccatgttgtccagactgatcttggcctcaagtgatcctcccgccttggccttccaaagtgccaggattacacacatgagccactgcgcccagcctattgttgattattaagaggagtatttcagccacatgggttagattgctggaggcccttgtataaaatgcagacttctgaatgccaccccaccagccaaatcagaatctgaggccagagtctgctgcacactaaaatgtgcacctgatttgcccacagcccaagttaaactagaagtaacagttgctgaatttgctttattattgcctgattgtcagacccaagcttttcagaaaccattggcatctgtgttaagctgttgtgggagaaagacagacaagcaagtcgtcatttttattgccagaaactattctgagattttaatgtgaaaagtggaaattttttaattgagttagaagaaaaacctggagattcgtgaacaattaacaataggtgcaatcaatgaaccccctgccagccgttaagccttctagtagccatgttttatgactttatgtaacctaaatcatgttttaacaaattttaaccacaaaagcatggggttagtatttccattttaaaagagaaatgactacacttttgagggtgattgtatctccctggatctttgaattagcctaagaaaatatccaaatatggcctggtgcaatttgaattgagacctctgattctagactaacttgctagggtacagttaatgaagttctgtctcattccaaatcaaaatactgtactgcacttgagtaacaaattctatgtgcttccttgcttttacttaaaactgattcccctcttaaaggaaaactcatttctgtctctctgtttttccttctctaaaaggagccttttattctgtgttcatattggttaaagtagtctccgagtgccctttgttatttgagctgcctggtagcaggagggcttctgcagtcatgggactttcccaggggcacatcttactattgtttgaaagtgacatgaggttccctgttacagcacaagcttattttacccactccctctctctgaactcacagaaaagggaaaaggacagttaggagaacatatcaaatgatgagagtgtttcataacatactgagctgtgcattttgaagcagtaaagaggatttttccagtaacactaatccacagcaatttagaaaccatcagtacatacacctgttcctgaaggcagtcatgagctttccaggctcctttaaatatggaagagaaatacctccagtagtgcctaaaccaaataatctctcttcccttatacttctattgttagagtttaatctttcatgttagccttttttttttcattttttgtcagtgtgcatctcacttttggatttccacttaatctttcatttgtttacagtgcagttgtctcccttcatattttatttagatcagtggttcttaagtttggctgcaatttagaatcacctagcgagtttttaaaagtcccagttctcaggctgcacaccagaccaattctatcagaatctgtgggtgggaggccaggctaggatccaggcattaacaatttttgaaagctcccccaggtgacctgaatatctagctcaggttgagaaccaatatttagattgttggtctataagcattacagagacttttgaacagtggtcctcaaactttagagggcaacagaatccctggaggacttattaaaacacataaattaaaaattggattagaaagggaagcatcagaggatccatcctgagctctgcgtgaatgtgaatggggtcccttcgatatcatgattatatgagttgggggatgggagggcacaaaagaagacaccacccaacccttaggaagctcaggatcttgcaaaggaggtagagctcacacctgggcagcagcaagttttctgagcagccatgaagcagcagagagagcctggggctgacaatgcctttactcccattctgtcagaggtgtttgaaccagagcaactccatcttgagtaggggctgggtaaaatgagacctactggtcatctgcattcccagatggttaaggcattctaaatcacaggatgagatagggagtcggcacaagatacaggccataaagaccttgcttgtaaaacaggttgtagtaaagaagccagccaagacccaccaaaagcaagatggccatgagagtgacctttggtcatccgcactgctacactcccaccagcgccatgggagcttacaaatgccatggcaatgttaggaagttactctatatggtctaaaaaggggaggcatgaataacgaataatccaccccttgtttagcatatcatcaagaaataaccataaaaatgggcaaccagcagccctcggggctgctctgtctatggagtagccattctttattcctctactttcttagtaaacttgctttcactttactctgtggactggccctgcattctttattgcacaagatccaagggccctctcttggggtctggatcaggacccctttcctgtaacagttccatctggggcagatcacctaacctcccctgaagttccatgctgacttctgcaaaattggaacattaacagtgttttgactgcttgcaacagtgtagttactcgcaaaaggattatttgaaaacatccataattccctttccccctccctaacaataacaaaatattttgaaactacaaaaagaaaaaatggttttgtatttgaatgtgttaaatagggccatttcctctccagttcactacagtccccaccactcactatagccttctttttttttttttttttcactcttgttgaccaggctggagtgcaatggcacgatcgcagctcactgcaacctccacctcccgggttcaagtgattcttctgcctcagcatcctgagtagctgagattacaggcatgcagcaccacacctggctaatttttgtatttttagtagagacgaggtttcaccatgttggtcaggctggtctcgaactcctgagctcagatgatccacccgcctcagcctcccgaagtgctgggatgacaggcatgggccaccgcacccggcccctatagtcttttgactgatgtttctttaccaactcaggtgttgtcatgtgatgcctagaactgggcatcccatcttatgaccaagataaaggctggcccttgagcaaagctggtcctcagagaacagaagggaaagatggaaagaacctagccccataatgattttcttgtgctactgaactaaccctacaagagccttacttctggacttttaagaaagaaaaaagaaaaatgggagaaagatagggaagaagaaaaaaggagagaaaggagaaaaaagagaggagagggagggaggaaagaaggagggaaaaagaggaagaagaaagggggaaaaacatcagccacctttaagaattttacatgtgctggtaagaaataatatagcttaaaaaatagatttctgcttgtgtagcccaatttattaatttttaaaactatgatcagatggtattgattagtggtctcaaaataagggagagaaacacctatttcttgtgttattttttattaaagcagggaacaaatgggaccttcacagtccttaaagatgaaatacccccaaaccaaaccagagttcactggcaaagcaaagcagtgtccttacatctcggagggccctgacccgcctctgtcccgaaccccaccagcagcggctctgctagaaagggaacattttgttcctttattgtggtaaaccagacccagggccccgctggttctcaagtcagctgtgaagctgacacactgcctctcagggtcagtttggcccccacagcaggccctggggaagcagccacgccctcagctcccttggggccctgtcttccattccttaacaggaccagcttcttcagagactctggactctcataaacgttgaagccagattgtttccctctttgcttttgttttgatgtatttttaaataattaggcttttactctcaagtattttcattctccatcactggctgaggggcagctctcacaccacactagggcaaggcatgctactatggtatccagtaaacagttgccaaacaaagtcaaaagttctctttggccaaagccaaaatcaagttctcttttgtacttgttgttcttccatctgccctgagctatgtcatagctgtcaaaatatgtcaccccctgcacctccgtgcagggtttaagaaaagcagctccttggacttttgccagcgactttcttgcaacatcttaattatccattttttgcttagcaagtaagtctagaaagaactgcttcttttattcttggaaagtaagtacttgggaatgttcaatgaaaaccagtatgtgctgaactcctgctctgtgctaggttctggggaaggggaggcagtccctgaccaaggggatctcacagtcagtgaggagagtgtcccctgaggtcgctgggaagaagcaacacatttccctgtccagtggcaactacctcctcatcacctaatccctgcgcccggagcacaaactcatcctaagcaaaggcaactgagcagctgttttcctgttcaccccacctcaggtcctcactactttcctaccgataccattctaagttcccaacgcattttgtgaaagtaagtcagtttgattcatcatatagtcattggttctgatgttgtggttctaagcttattttatacattgttatctaatttattctttcttaacaaccctgtatagtagagatacttcttcttgaattacaaccagaaaatttggagaggttgaagaacttgcctacagtcacccagtaaggaggtggagccaggattcaaactctggtctgattctcggccctggtggacactggctttcagagctgtaacttgcagttttggtgcccagaacctgcagcacaaaagctccgcaaatgactttgtgatttattatgaaactcaaagaaagaacaagcttcctactttaattttccttgctaatgacagttttcagctgaagaaatccatgtgctgtcaacatgtaaatataacctttttttttttccaatgtctgttcccgggacagagcctcccagtaggccttgcactgtgctgcatgtggtccctggagttttacagcctcactacagacacaaaacagagtggttaacacaagcaatcctgaattgcataaatgtgctggatgcccatgctagactaagaaagttcttcgtattcaggagaaacactgtggccctgagaggccagggaaggccacgtggaagaggagagtccatgggtgggtaggatttaggaccaggggagaagaattgcaagcaagagctggaaatatacagttgaggctgggaagagctcacactgagaagtggcaacacataaagttggaaaagtaggttggagccaaattgctcaggattttaagtgccagaaggaggaattggagaatggaagctgggagaccaggcaggaaacagctgttctccaggagagagagagcaagggtctgtcccaaagtgggagcacaggtaggaaacaattgagaggcattttgaaggatgaaggctcctctgtctcctgtgcccaggagccctgccctctgctaggctctgggactagtaatgctgattaactgatctgccagtggatgcattggccctccctgatgacccggcacccttcttggagaagagtgggactctggccccctatccctccatgttcaattgcccacatcactcaactcttcctgtccaccacacttaccctcccaagtgtatttcctcatctgcaaaaacagcatgagaaagctcctccttcctaagtttattgtgaggttgaataaggtcatgcgtggaagatgcaaagcacagggcctggcgcttgtaaccgctcagcagatgggaaccgccagcataaatattctgcacccttggtcagctgggacccattattgagagtggctattctcgtctctctctatgaaatgttagacactagcagacagctgaaggtgaaatcaagcaagtttgaactgtggtctctctctggggctccttgtcaggtaagttggacataagcaacttcctaacaaaagagccagaagttgtttcattctgacagtgaagcatgacttcatagtttcttattctataagttgtacagacagacttttcttcctttttgtgtttatgccatgatgtcttggagccaagctatagcagagcccctggataggaatttaggatgcttttggaccccttccatagaggtcaagtcctgggaatactggaagggccttcacacaagagctccctcatcccatccctgtatgtcttggacatagaaagagaggaggaactgacatttaacgacaatgtgctgtggctttgacacgtgtcatgttatgtaaccctcacaccagtcctatgagatagggattgttatctgcactgttgtaagtaaggaaatagtcttgattgaagggccttacccaaactcacacatctagtcatcactgcaaccaacattctgcctcttggtgcccctcgctgaagctccttatttcctgcatactctcctcctcccagggctgctgaggccacatggtaagcctactgctgctgttcctatgagtttcctttttcaatgtgttttttaggagacgaggcctcactgtgttgcaccacctggagtgccatggctattcacaggcacaattgtagcttactacagacatgaactcctaggctcaagtaatcctcttgcctcagccactcgagtgcagggactacaggtgtgtgccaccatgcctggcctgttaccatgactttccaattcagcaaattttctgtaataggatgattgagaggtttgtagttccataatggtggctggctataatgattacctataactatataattgggaataaactgaaacaggtgcaaactctaatcagccccaaataacatcttaatgacaagtagaggacaaattaaatggaagcaaagtcgtaggacagagtacagaaaagcatggtgacaggagtttcttgtctgtctctaaggaagtaggatgggatggagagtcaattcaatttagacagaagctgaagatcaaacaacagaacattttagcttctattttaactatgtattttacagctggattccaaagaagataaataaattatatttgcacctatcatcttttcaaatatctttgccaacaaagtcattcaatatattgagtgtccctgtggtcaagatcttacacatttaatgtatgaaagaggagagacaaggccctgcagcagaaaatctcacaatttgagggagaagaaatgggagcaaggagttgtttaagaaagacaaaatacatacaaagtaatgtgtccgcaagtgggagccatgatagctgtgggtgtggagttgccacatgatgatgttccatggctggctgcctgatcaagcggagcctcaaaggtcatctgtggcttggtagaggcctgggtccagatcgggcccttaacttttaagtttcagaaaccccatgttgtaatcagcccacacaacgttgaccaggcctcaaggaatggactcttgccaaccaaactcccatagtagactgacgggaaaaccagcatgccagttgaagtaatgtaccatcagagacacacctttctaattactatgcaggggacccctttctgctgtgtaccagaaaaactgaattagcatttagaaaactacttgttaaacaggaatcagggtaaaagaagtcttcaggagtgtgtggctcagatcgttggtacagtctggaacatttttgccattccctgacacccctggggaaacactagctagattcttactcttcacctctcttcttctaggctccttacagactctttcatgcctttaattatctttacttctcatcaaataacatgacttattacaacttaccttgtcattactttttgtaatttaatcttccaataaactttgggtatctaatcttgatgtagcaaaccatgaaatcctcagcaatatgtttgcaaaaccaccccaaggatgggttgcatctgcaagtgtttaatctcaatttatattgtgaagattcttatggcttccccttcaaatcccgacaccctttgaccttgtccccaaattccagaggtgctattatccatacagacatatgttatagattccagaagtgctagaagattctggaagataagaggaactgaatttatattgctctgaaacaggatgcacagaaaagcaagtctcacaccactcctctttcatgtctgatgcagcacaagtgtatagacagctcatccctggagctcatgataacagagttccttctagcctacttcagttgtagtcagccctagctactataacaaaataccatagactgggtggtttaaacaacacacatttatttctcacagtcctggaggctagaaaatccaacatcaagataccagcagattctgtttgggtgagggctcttggcttgcagacagccaccttctcactgtatcctcacgtggtggggagagtgagctctggtctcttcctcttcttataaggacactaatccagtaatggaggtcccaccttcatgctctcatttaaatctgccagaggcaccacctcctaataaataccatcacactgggggttagggcttcagtatatgaatggcaggggcacattcagtccatagcaaatgcccaccaggttctgctataccagatattttctattaagtggagaaactgtagatagttttctttttttttttttttttttttttttgagacggagtctcgctctgtcgcccaggccggactgcggactgcagtggcgcaatctcggctcactgcaagctctgcttcccgggttcacgccattctcctgcctcagcctcccgagtagctgggactacaggcgcccgccaccgcgcctggctaattttttgtatttttagtagagacggggtttcaccttgttagccaggatggtctcgatctcctgacctcatgatccacccgcctcggcctcccaaagtgctgggattacaggcgtgagccaccgcgcctggccaaccgtagatagttttcagtacacatacaaccattttggttttgggggcccaaacaaaaggtggtacagaaagtttgttttctaaccagcttattaaatgagtttcaagtacagagtaaagaaaattaatgtaactaaatcttgggacatgattttactgaggattgtccagggtcttttgaggccgcaattagagatgagaccagacctttccattcctcatctgctctgctggactccagagcactgccttcctccaaaaaggaaaattagaaacaaattctcaagtggtttgatagtaattcagcccagcaaattttactttccattaaaagtcaccagctgtcatgtgcttagctttaaatggaaataacttgctctcaaaaaacatttttcagttgatgtcacttgtgagttttattttctcctaatgaaaaatggatttgcattagtgcaactttggggacaggaaacccctggatggaggcctgagctggtgatctgcccctgccctgaggaaagctaattaccggccggccagcgtggaagattgatgctgcggtcaggaggggactttggggaacagaggggaggagtgttgataatggtctgtcttctttgcagtgagagtccccacggtgcttcttcctttaaaaaaaaaagaaaagaaaagaaacgtaaaaaatgcttttaagtgttgagattttggagagggcagtgaatattttaacacgattaatgttttttagggaggcagcccttctcagcctctaatactcccgtgctcagagcctgtcacatctgaggcctcatccctacagagctctctgtggaagaagactctctgtggccctccactgtgttcaggtgcctcccagaatctcttgtcggtgacagctggaatgatctcttcatgaccctcaagaacaaaacaaagagaatctctcgactgaagctccttgaaggctgaactagtcccttacgcagtcctgcctctgtggcacctcacaggagagccaggacactcaggagccccctgcagtggtcctggcagacagaggaggcaggagggcaacgcctagaaccctcggctttccctactgggagcccctggtcagggtgggcagagcagactcttgaagagtcattccagcaggggcctgacccactgaaaagaatgaatggagagaccagagacactgggagctggtggaactgggaaacagagaaagggagaagccaacagccacaacattcacaggcccccagactgaaagctggcagtgtacttaaaaccgtgtccttaagtgggctgtcttgcctcaccggtcccctacatacatgcacacgcatgcacatgcacacacacacaggcatcacacacccacctctggggcactgtccatgaatacagcagcactcaaacctggggctatacccaagtgccatcccagcctaggcaaagcttccctcaaccccctgtctccatgctcacagaaagggcttagaagtgtccaagaatttttgaataatgttcttgacagacaccaaagctttttcctcctccagagcgtggagggctggggctgcccccagggaagtctcccctggcagctcctgtctgagcagctggggccagctccaggaacactaaattctggctgcgtttccagtcaaggccgggttactttagaatccctcttctccccccttgtcttttcaagcaggagccagccaaggtattcgtcatgtttccgagctaccctgctgcttgatttatgtgcacgcagggctgggacgaagatgccagagcggggtgaaggctaaccccgagggtgaggggaagtggggtgctggactctcccgtcaccccaggggccactgaaagggtccctggtttttgtatcaactgtgttcagctcaaggttggagaccatgtggacgccacagccccgggagcagaggaacagagacaacatgctctccagctctcttgctcttgctctcttttttgtgtctcacactgtgagatcttggccataaaaggaatgaagctttgcttgccctctcactgggcttctcctaaaagggctttccgaaaaatttccagccttctccttcgggacactggatgtggtctctttggccaaagagaaaacgagtaacagacgaagcccttgcagatgaggaggccaaaaccgaaatgttaatcacctcgaaatatgtgcactgctctctccagtgcctcgcttggctctcctcagaggatctttgatgggggattttccccctgggggtgggggatttgccatcaatatttgggaacacgtttgagggtccaacttgcaatgacaagataattgtcattcagtgtctaacgtgcctgttgtggtgactctgaatggttgaaatattgattgcagctcttggttaaactaatactcctacaacactcccataaaagctcaagatgctgtcatccaaaatgaataaaaatgcctctttttattccactgcatatgaaaacatgagatcattggaatatatttagagtgagatttggcagcctatacatgtttacaattcttggactcaaagctctaacgtgaatcggaggcactctttttcgtcttcgccttcttttctttctctaagaaggtgaatgctgattccaagagttcataatcccttttcttcgtattacccaaagttaaccttgctaagagactaatgacatcctcagttccaatggccagctagaaagcctgagccttgacgtgttaatgcaatgattcaaccactgacgtggctcctcaccatccatcacccaaggcaaagcctccactgggcttgagaagattatccaaaagtcctgccgtttcctcaagtctttgaaccatgactgggtctgattctattggatagaagtctgcaatgccttagggtcaatgactcttgttattgcatagattttggtttctttctgaaggaaagcatggaatccttcctactccaggaggaaggcaggaacagtgtggaatcaacacagatgctgcctgtgctctccttccttgtactacctcatctctaaggggctggtgcttgaccctgactgcacatacgatcatctggacagctttaaaaacactgaggcctggtccccaacccccagcgattctgattatattgatctagggcacgcctgagcaccaaaagttttttaaggtgttatactctatcttatttatgtattttgttttttgtttgttttttgagatggagtttcactcttgtcacccaggctggagtgaaatggcacaatctcagctcactgcaacatctacctcctgagttcaagcaattctcctgcctcagcctccctactagctgggattacaggcatacgccaccacgcccagctaatttttgtatttttagtagagacagcatttcaccattttgcccaggctggtctcgaactcctgacctcaggtgatccacctgcctcggcctcccaaagtgctgggattacaggtgtgagccaccacacctggcccctaattatgttttttagaattaacgtgcagagaaaaaagatttggaagaacagtcaccaatatgttaactatctccaagtaatagaattgagaatttttattcacttatgtattcttctgggtgtcctgaaaaattttttgcagcaaaggacatttcaacgaaacaaattgatagtataaaggaggggaaatgctattttccacttaaaaggaaggaagttcaggatactcaaaatagaactcttcatctccctccctaacctgactctcttcctgcatccccagttctgaaaatagcaccaggttctcaccagcccacgtcccacaggcatcccagcctcctaccttccctaaacccattcatccaattacttactaagtctccacatgcagcttccttcatacttaaatttcctgactcctgttcacacaggtgccacgcccactgcctctcagtttgggtttccactaccttgcttgctaccgatggggctaggctggctcctcagcatgctctccgcctccatgcgggcaccctgcagccgtggtgatcttccctgaaacccacatccgctcctgccacgggcctgttaaaaacctgcagtggggctgggcgcagtggcttatgcctgaaaccccgcactttaggaggccaaggtgggcgaattgcctgagatcaggagtttgagaccagccagggcaacacggtgaaaccccgtttctactaaaaataaaaaaaataaattagctgggcgtggtggtgcatgcctaatgccagctattcagctattgaggcatgagaattgcttgaacccgggaggcagaggttgcagtgagatcgcaccacttcactccagcctgggcggtacagcaagactgcctccaaaataaataaatacgaataaaaacccgcagcggcctcctcatttccagagcacactggagcaacttgcatggcttccaaggccctccgtgatccgatcctgcccaccttcacaggctccggccttgcagcccttgccctgcaccctcccacccaccatgagcaacagctggaggtccccccccatgcatcattgtctccctgactcagagcctttgcctgtgctgctcccgtgcttggaacgcccttgccttccccatcctgtttcccccgggtcacccctgccactttaccggctcctcaacacagtctcttgcgtgctcctgcatgctttcacgcctgtgtctttgcttagcgttggtgattcctcttgtctttgtctgtctccccactgctgtctgacttcctcgagggccaggagctttcatctgtgtccaggcactgcccatactgcctagcatctcctaaccactcagtaagcgagttaaggactgagtggataatattgattctttacattcatgcagctctttatgatttttctaagtactttcttatgtgtgtttgcggttgggttttgtgcccctgaacttgttttcagcagtattgcctgcaccatctgcattctcacttgaggctggcagacaggagaggtggtgaaagtgaggtgcagcatgacccggaggggtcctgctgcccaggtcacacagctggtgcctggaagacccaacagccctccgtctccgcctgtgttctcccccgcaccccatgtctcccatatgctggctccactgcgctggatttggagactgtgctggatctggagtctgcactgggtagttgcccacaaagagatggagattgtcagccacttcaaatcctggcttcccccttttcctgtcatgcttttaagccaggagatacaaagaggaaaccacagctcttgagatgagctactcaagagcatgcagtcttctaccatcaacattttctagagacgaagccgactcagtttgtgtggatttcgcctctctggaggaaacacaaattcactaatcccttccattttaatcaagcctgggagggaagggctgccaggggatcctttccagaacgtagtcagtggggaaaatgcagagcccctgccttctgactcaccggccagcagaccacttcctgagacggtacatgaggcaatgactgaaattgtggctgtggctctgccaatcagccggattcgggagatgtttctctgaggtagaatgacattaaaagggccctgtccctggcacatctaaagtgatcctcacctgagcctttcattcagtctcactcagagagggcttctcagctactctccacccaagcagggccagaggtgcactttcactacccttttcccgagaaggtaccagggtgggggtgggagagactgggaggactaccccccattccccgatttctgctcagattatcctacaagctagagtgtgaagccctgggatagacactgccaccacaagagcagaaagtcatacagctgagctcagtaaactcttaaccagcagctaccatgtgccagatattatgctgagagctgatcagatagggataaattagacatggctggccaggcgcctcacgcctgtaatcccagcattttgggaggtcaaggcaggtggatcacctgaggtcaggagtttgagaccggcctggccaacatggtgaaaccctgtctctactaaaaatacaaaaaattagccgggtatggtggcaggtgcctgtaatcccagctactccagaggctgaggcaggagaatcgcttgaacccaggagacagaggttgcagtgagccgagattgcaccattgcactccagcctgggcaacaagagcaaaactccatctcaaaaacaaaaacaaacaaacaaaaaaattagacatggctccttgaccaggcaaaagaatgcacacatatacacaaccaatatgtccagaagatagtgaagagaggtacaaatcaggtgctgtggaagttcaggaaagactgtttccagttgagaattcgagaaaggcttcttggaggagctggcattattttagctggaacttgaagtgagggtaaaattggggcagaaagaattattgcttgagggtttggggggatggggtggtaaagatagtaaaggcttctcaagctgcagtatctgtgattaggttgactcacatgaaattgctgatagtctatcggtattgacctacaataacaccaacttcagatggtccaacatcatacttcctgggtacaacatggaagtgggaaaacaccacttgtagagaaaaacccaggccaaagaagttcaatgtctgtcagcaactggtaaacttacactaatttaaccttttaataatgtgttgacagagattgtctagggatggcattttctactttctcaaaacaggactaggccgggcacagtggctcacgcctgtaatcccagagctttgggaggccaaggcaagtggatcacttgagatcaggagtttgagaccagcctggtcaatatggtgaaaccccgtctctactaaaaatacacaaattagctgggcgtagtggcgggcacctgtaattccagctactcagggagctgaggcaggagaatcacttgaaaccgggaggcggaggttgcagtaagccgagattacgtcactgcactccagcctgagtgacaaagtgagactccatctcaaaaaaaaaggattggtgttatagtttgtctattgtccaaagaccagttctattagtctgtcctcatgctgctaataaagacatacccaaaactgggtaatttataaaagaaaggggtttaatcgactcacagttctacatggctcgagaggcctcgcaatcatggtggaagccaaaggggtagcaagacatgtcttatatggcagcgggcaagagagcatgtgtaggggaactcccctttataaaaccatcagatctcgtgagccttattcactatgatgagaacagcacaggaaatacccacctccatgattcacttacctcccaccgggcccctcccatgacatgtggggattactacagttcaaggtgagatttgggtaaggacagagagccaaaccatattaccagtccaagtgagactttgcacttcacaactggactgaatttacaagtcacaggaaggcagtattgtaccccgagtccgaaatatttgagtctacattccaacaccactgcatatgaactgtgtgatcagcttcataactttctgaggcttggttttctcacctggaaaatgatgacaaaaataatacttcccttcctcacaacgtagttgaaatgattaaatgagatggtgcctgtacactgcttaacacaatgctggcctataggcagcacccagtagctgtttgcagggtcatcatttatgtcaagagcacaatgagcactgagggatgaccccatgtccacgagtcacaaaaagagttgcatctttgcgtcttagagccatagtgtgtttcgatggaggcagcaggacggtcgcctatttgagcacctattttagtcttaagtagaaaagggagaaagaagatacaagaaaatatgtgatgcttgagtttctcaggttagaaggacaagaagctccacatgatcccattcagccatttagttgctttcagcctcagagcaaaccttctaaggaatttcatattcccaggtctctcctggcaggcacgcctggctcagaggtagatttttttttttttttttttttttgagcaaaagggtttctgcaaggtaccaagtcaaccaccctggagtggttcccaggaaagcagtggtgatggcttgggcaccagaggctcgggaaaaacaggtgctcggctttccaggaaaagaaatcttggccactcagaggggaatctgaaaccagagaggtaaggtagctgaagcgcatgtcccaaccaagcctgggacgggccaggcacctgggcaggactcctctctgctgcaccaggcgggcgtggacgcttactttcttggttcccgaagcactctcctgctggggatggcgacagtgaccacccttaggaagactggcttgcatcagtacggatttttaagcaatacacagcattctaaagtcaatagggtttgtgatgggcgctgctccgagtaaggaagcgggtgtgagggcacagtctctggcagcccctcctgactgctgcctgtccttggtgaaccgaggggaggcagggcgtgcaggggccggctctgtctttcggttcccagggctgactcagcaggcatcttcccctgtgtttctcttcatcttccctcccctcccttctaacaggagttggtggagctgagggcagggacaagttttaaatgctctgggatggcgccgtctttgggaaaagagagccttgtaaaagccccgagagcagttctctctgcagccctaaaaattttccctgcagcttgaatttttcattcaagtcaccatttccagtcctgccgacaagtcagaaaatggctctgaccgggagcaacagcagagacagagggcggcccagagacagcgtggtctgatgcagggacaccttggagccatcccagagccctggggaccagttcacgctgtgatattggttcctccctccacaatagaggcaggcgcaggccagaaatcctgccacaccggagtggagcttcaggcctcagcacatgaggggtcttctctttaattccctgtcatccgcacgcgccccctgctgcccctcacctcgcctcatccagggaagctctgcagacttttccctctaacttcaaagacggcatcagccgccacttggtcccaccatgactgtccttgaggcacaaaactaccaggagagattagttctgcagaagctgagagagggtccggtccacaccaggctctcctcattcagaaatgagtgaatgtgcaggcccaactcaaggacctcaaactgtaggggagaggatgggaggggagcacaaggaggggccccatggggtcagacaccttttcctaaggtgttcaagcactgtctgtgctggcagcagccccaggaggtgatatttcagttgaaaactggaaaggagccagggtaagggcagtgtatttgcagaagaccaggaggtagaaattgtgactgctttggcatctgggtgaaaacaggaagtaacacaaaatgagcctggaaaaaggatgggagcaagatcagaaatggactcacggttgggcacagtggctcacgcctgtagtcccagcagtttgggaggccaaagttggaggattgcttgaggccaggagtttgagaccagcctgggcaacatagcaagaccccatctctacaaaaaaaaaagttttaaattagtgaggtgtggtggcacatgcctatagtcctagctactccagaggctgaggtgggaggactgcttgagacaagaagtttgaggctacagtgagctcaaacagtagagtacagtagagccactgtactctagcctgagtgacagagcgagaccctatctctaaaaagggagaaaaaaaagaaaagaaatggcctcatatgtggtggtgtgctggtcaatgtttaacaggctgtggacagggggtggggggggcgagtgctgatttgtaatgtttgtaccagtttctgtggtgttaatattagaatacctcccattgtggttgacttcactctaccaatggtttaatatctggctcaccaaaattcctgcaaatttaacaatcaacttgcaagctgataagggctggctcgaacacgcctgcatcatatgtcacctgttaccttttcacccacttccttgtcacaacatccctaagcagtccttggagggaggggaaccacattaatgaagtcacttcaggctgttgccacaagtatctcagtctcactcacctccccctgcccatggctgttccttctttctgtccctcatggatgcaggcatggacatttttcctggagtttcataaaaaccactcacgtaaggcatttatagtgtagccaacttataaaaacaaagaaggttcacatcacagcaatgctactcacatcaaatgaaatattaaacaccctattaaatttttccttggccattgacacaatcctgggctttgatcttctgccatattgcttttcccccatgctctccaaccttggttgacccttttctccttgacactcccctcaaaatgcttctagtccatcatagagagcaatgcggccctccctagccacctccgccccaagtcctgtgtccaccctctccaaccttgattgacccatcttcccttgacactccctcaaaatactaccatggagagaatgtggtccctagccacctccacctggtacacagtcctgcactgttcatgtcatattcaaggcgctgcaaatctgtagaattcccaggcatggagaggaataccaactactgtttacacctggctcaatgcccatttattaatcttatgcatttttaacaatcatcactccttaaactatgaacattactctaaatattcacacactacatagctagtacatcaaacacgtatttcaaacaaggtccgatttcacacctattagaatggccaaaatccaaaaacaccaaatgctggcaaggatgaggagcaacaggaactctcattcattgctggtgggaatgcaaaatggtacagccacattgggagacactttggcagtttctataaaactaaacatactctttctgtatgacccagcaatcatgcctcttggtatttacccaaataaattgcaaattaatgtccatttaaaaaaaaaaaccgcacacagatgtttacagcagctttattcataattgccaaaacttggaatcagccaagatgtccttcagtaaatgaatggctaaactgtggtatacccagacagtgaaatattatttagtgataaaagcaaatgagctgtcacgaaaaggcatggagaagactgcaaagcccatatactgtatcattccaacgatatgacattctggaaaaggcaaaactatggagacagtaaaaagaacagtcgttgccagggactaggggtgagggaaggatgaatagatggagcacagaggatttttagggcagtgaaaatattctgtgtgatactgtaatagtggatacatgtgattatacattttcccaaactcatagaatgtacaacaccaagagtgaatggtaatgtaaactatggactctgggtgatgatgccgcgtcagtataggtaccactgtgatttgggaagttgacagtggaggagattgtgtgtgagggcagggcatatatgggaattctctgtattttctgctcaactttgctgtgaacctaacattgctctacaaaatacagtatattaaaaaaacaaaattggccgggcgcagtggctcacgcctgtaatcccagcactttgggaggctgaggtgggtggatcacgaggtcaggaaattgagaccagcctggccaacatagaggaaccccgtctctactaaaaatacaaaaactaaccgggcgtggtggtgcatgcctgtagtcccagctacacagaaggctgaggcagaagaatcacttgaacctgggaggcggaggttgcggtgagccgagatcatgctccagcctgggcaatagagcgagactccatcttgggaaagaaaaaaaaaaaaatcatgaccaggtgtggtggttcacatttgcaatcccagtacaggactttgggaggccgaggcggagggatcccttgagcccaggagtttgagaccagcctggacaatataaaaaagacctcatctcttttttattttttgttttagttatttatttttttcagacagagtctcactctgtcgcccaagctggagtttagtggcacaatctcagctcactgcaaccttcaccttccaggttcaagcattctcatgcctcaaccttctgagtagttgggactacaggcatgcaccaccatgcccagctaatttttgtgtctttagtagagacagggtttcgtcacattggccaagctggtctcaaactcctggcctcaagtgatacacccgcctcagcctcccaaattgctgggattacagacatgaggcaccgtgcccagccaagacttcatctcttaaaaaaaacaaaaaaacaattagccagatgtggtggcacaagcctgtgatcccagctactcaggagactgaggtggcaggatcacttaagcccaggagctcgaggctgtagtgacccatgatcacaccactgcactccagccagggtgacagagtgagaccctgtccctttaaaaaaaaaaaaaatcatgaatttagcaaattggattttcacaaatatttagcttgattgcaaacttaagcaaacacctccaaccaaacatttaattaaattcataaagagcagctcctcttaactactttaaagatattaaatatataaaactcaaaaaaagtcatgattctgaactgtttaatacccttacagcaaagcctgttataaaagtgttaatacagtggatttcgctttgttttttatcctaagttccacaccttcctggggtgccaattttgacagcttcctaggatttcagtgatttttaccaagtactatttttaccttcctagggtttttaacaatcttaccagaccacaagaagaagaaaaagaaccacctcgaactgctgggattgcagagtctgggtggttgaacagttgattctgggtaaggatatgaggctgggctgcaaagtccaagacgattcaaataaggggagctcccttttcatcattaaaccttgttacttcactaagacttttaaagtccacaccttttggaaaggtgtctgggttttgcaacattgaattttccccctggaatgagatgagttcacatctcacttggcagcgttacacagtccattgccctgtcatcatgatatattggtgacctgggctgttagattattaaaaacgtgtgtgtcctcattggtgttgtataataatttgtaggggccatcgtgaagtttcatcagctaagggaggaggcatggagtccgtgaagtttgtgcttctctccaggcccattgggaacacatgagggacccttctttacccagttgtcatgtgtgacccccaggctgagaaaccctgtcctaggacagtgcctacttttcccccaaacaaatctgctgactcagagttccctgcatttcttctttcctgcttacacagcagagacaaacacagatctatctttatatacagataagcaattaacagaaaaaacaaaagacctgttcataggaaatgccctacttatgaaagtcaatacacagtcaggtgtggaggctcatgcctgtaatccagcactttgggaggccaaggtgggcggatcacctgaggtcaggagttcaagaccagcctgggaaacaaggtgaaaccccgtctctactaaaaatacaaaaattagccgggtgtggtggtgcatgcctgtaatctcagctactcgggaggctgaggcagaagaatcgcttgaacctgtgaggaggaggttgctgtgagccgagacggcaccactgcactccagcctaggcagcagagcgagactttgtctcaaaaaaaaaaaaaagtcaatacgaatgaacatatcccattagatccagcctccttttaatctccaaccacttctctgtacacttaaagttttttgaggattgtaatgaatccagtctgtctttagctcagcctgttccaattaatgtccaaatgccaaggcgtggctccagagcgcccttggtttgactcctttgtcctggcagtgctgcacctgacttcctgaaaacatccttacctcctggcaacaagatgttccagacccattctgattgtttcctgcttcaagatatggaatcaactctcctccaaataatcctggttccttttaatggagaatgctattaaagatcacaatctgagtgctggctgcatgtgagcgtggagcagggaaggtggggaaacggggtaagcgtgctgctttggtggcaacagagacagaaacatatttacttgtaaggttgtgttcatactactctttccaacttaacacagcgtgcctggtgggttccacccacatttctcacagtatgagccttcagaggccactaagaccttctccatgcagacctaaataagaagccataaattcagcctttaccttttctccccatcccttcctgtcaggggaaggaagctggacagagattattttctgactagcagaaacagtgccaccactttactcttgtaagaaggctgccctacaaggatttggttttcaactgctttctccagcatatattctatgggaatgggggtgggtgcatgatcaactttgtattttgcacggacgcccctgtagctgggtcaaggctggatgacaggacagaggtcaggacagagaagcaggaaggtcactcaagagtgggctgcagggccaggcgcggtggctcacacctgtaatcccagcactttgggaggccgaggcgggcggatcacgaggacaggagatcgagaccatcctggctaacatggtgaaaccccgtccctactaaaaatacaaaaagttagccaggtgtggtggcatgcgcctgtagtcccagctacttgggaggctgaggcaggagaatggcaggaacccggggaggcggagcttgcagtgagccgagattgtgccactgcactccagactgggtgacagagtgagacgccgtctcaaaaaaaaaaaaaaaaaaaaaaaagagtgggctgcggccgtccagaatgagagccttgaaccagggaggcagcagtagaggtggagaggaggacatggagctggggattatttggtgtctggacagaggagatcaaggtgcatcccatgtccctggccctagtctccaggtggaaggaggtgccagcccagggagagaacagtgggagacacagacacctgaagggcctggagtcagcttggttttgaccttgagcttgaggtgtctccattcagatggaaatatccagctgtctgttggatgcatgggataggatgtctaacacaaaccacaggccgaggaagctcccaagctcaggcaggtggtttggagctgtctgttgccaaggagtattctccagaggccgtcaacagcttgggttgtttgcttacacggcttgggaagacttggaggcacttctcattctcattttgtgtgagtccttgccaggaatccctggtgtttttacttaacaccagagttccaacccaaattagcaaacggcccaggaggtgggactcagagagagggctgaccatgtctctccactgccagctctagagaacaaggttggggacctagaatctaggccacagaggcttctagagcaagccctggcgattccaaaagatggtctctgcctcccagggtttcctggtaggttctggagtgtctggagggacagtaggggtgaggaatagaggagggtttgcagaggaaagatcttctcccacctcccatgcagcaattttggtggtgctgtgggggtgctgtgggacgggtctggcccaagcaccacctgccccccaagacttcgccttggccagggcagcatctgggccccacccgcagagaaggcaccaccgcctccctccctcggagcatccgcaggactgtgctcatctgggagtgttgtttgaactgcagcctgttttcactcagggtctggacgtggcaacttggatcctggttgtttacctaatctagcgttgggttattttttcccctttcctgattgcaagaaagtgccaaatgtaatcagctgtctgggcccatcgctgttctcggctctgagccagagaaaatcagacctagagaaggatcgttcccaaggccaaaagctcacccaggggccttgttcccagccttctttctcacctttccccagtagggacctaacctcgagagttccatctcctcctggccccgtcacactccaggctcattcccctctcccagcctgagctcatactctctcccctgctgggggtgcccttcccatttccttacacctcctgggaccccacctgtcctcacagctgagcttggccgtcattgcttccagcccacagtgactgggtcctggtcaccgctcaggaccaaggtagaatgtgaccacaccctgccttccagcagcttctgacacaggcagcggcgaacgtgtgcgttaacaattacagccccaactggaaggatgagaaattcctcttcggcatttagagaacatcctcgagccgacttcgctgctgtcttcctcaggtctcccaggcacttctgcctgccacctcactgccaccccgccgccaccgacagcacagcctctcttccagcctgggtgggggtgtgggctagagttccagctgcctcctgaagttgttgggaaatgacttaaatcttccttgctcactagggcttggaagtgaagtaagtcagacatatgtggattaaaccttgtgatcaccaccgaccagcgcctagagaggatgtgcgacacccgcctcgctgcgtgggagcatgcagtgagatcatttgcacaaagtacttagcatccagcacacggtacttcctcaataggtctaagcgggcatttctgcatgtattacattccatcctcagcccaaccttcataaggaaaacaagaccagctcatgcttccttccgttctccagactgacgtgcggtagtgcaatctcagctcactccagcctcaacctcctgggctcaagctagcctcccacctcagcctccccagtagctgggactacaggtgtgcaccaccacgcttggctaattttttattttacgtagagatggggtttcgccatattgccccggctggtctcaaactcgtggagtcaaacgatccacccaccttggcatcccgaccgctgggattataggtgtgagccactgcacccagcctctgttctcttcttcaagcacaaatagatgcatgcactgctccgcagccttgtgctctaaataagtagggttcacaggtgaggtcttttctcatggccaaattgtataaatgtaggcagggaagagggcaaaggttttcagagccagagacggcacagaagttcctagtgatgtctggtacgtgtaactgcctgtcagctggtggatgggaagctgctgtgtgagcaaatatttctcttccttcccttcctcgaccttccattcctccccacacaccccttccaatctcatgggtctcctcaccagtgctggcctccctgcccctccaaaacatacctgaagaaataattccccccaaaaagaaaaatgtgtgtacaaagatattcatcacaaaattatttataaaatgagcctcgatcttcaactattgaggaacaatttaactacagcataaaaaatgttatagaagactctacagatgtaagaatgcatcaacatgaagacaaatgtctcaaaacacatttataagctggttctaagtaaaataagcagaacataagattgtttataaacactgtgattagaaataagtaaaaaaatgtgtatttctctgactaaagttagaaaggggcacagataaatgaaaacaattgtgtaagaggagtagaaggggttatgcattggcatgcttttaaattcccttaatgttactgcaaagttatgttaataataaaaatgtcatataaaaataaaaatgccagtcctctgtcctattccaagtaagttcatgtcaagatgatcatggcttggagttaccttcccctggttgtatatttggatctgaaagaagcctcctgggaaggagacctcttaaatttaagaggaaactctaggagatgaggtctgggacagggcagagtggagcaaggtctctgctgcctcagcacctggcatgtgccctcacagggcggagaattcgggcaccgggggcccaggtggccatagaaggcaccacagttttctgggctcctcctatgggccaggtgcccagcagtcaagaggtaaattagagatggtacccaatcctcagttgccccattccatgggacacacagagagaccagggtcagtccaagctacagtgtgggttaaaagggcaggaagcgagtcactgaggtctcaaaagacaaggaggggccagacatggtggctcctgcctgtaatcccagctctttgggaggccaaggcaggaggatcactcaaggccagaagttcaagaccagcctagccaacatggcgaaatgctgtctcgactaaaaatacaaaaattagtcagatgtggttgtgtgtgcctgtggtcccagctactcaggaggctgaggcacaagaatcgctggaatccgggaggcagaggttgcagtgagccaagatggcaccattgcactccagcctgagtgacataacgagactctgcctttaaaaaaaaaaaaaaatgctagcggtggtggctcacgcctgttatcccaacactttgggaggccaaggcaggcagatcacctgaggtcaggagtttgagaccagcctggccaacatggtgaaatcccatctctactaaaaatacaaaaaattagccaggcatggtggcaggtgcctgtaatcccagctacttgggaggctgaggcagaagaatcacttgaacctgggacgcggaggttgcagtaagctgaggtcacaccactccactccagcctgggcgacagaccgagactgtctcaaaacaaacaaacaacaacaaaaaaagacaaggaggattttgtctgggtaggacccatgctgggggtcggggtgctttaggggagaaagcatggactttgcatcctcagctgagatcccagctctatcacttactacccaggtaacctggagcaaactattaatattagttttctcgtctgtgaaatgggcatttaatgatctctacctgagtattaattctcctgtgtatgaagagaggtcatggatctgaaagtacagtgcctgcacctggcaagtactcagtacatgttggctttcacacttatttttggtggaggtggcaggaaacccaggcagcctgttccaagtccacgatgctcccactgaaccacgtggtaggaaggacagaaaaaagtgctatgaatcaggacaaaagacactagagcccaggcgcgggggctcatgcctgtaatcccagcactttgggaggctgaggtgggtggatcacctgaggtcaggagttcgagaccagcctggccaacatggtaaaaccccgtctctactaaaaatacaaaaattagctggacgtggtggcaggcacctgtaatcccagctactccagaggctggggcgggagaattgcttgaaccccggaggcagaggttgcagtgagctaagatcacgccactgcactccagcctgggcgacaagcaaaactccatctcaaaaaaaaaaaaaaaaaaaaaaaaaagacactagagaccccaggcaggttccaggagaccccagggtgtgtgcagcccagaaaattcctctgggaattgttctttcttccagttttacccagtataagtttgcattttaacatcaccatctgtgtcagtagtcatgccacaagaactctaactgttcccagagctgggtaatatctctccaaaggatttgcccttgggtttgataaaagtcgaggggagtagataggtcaccctgcgtaagctctctgatcaagagcagctttgcaacctgtttatactaaatgtggcaacccaacacctaaactgaaatgagtagctagaaggagtccccatgtgtgtcctctgccttgtgacaggaagaacactggattaggatccaggagcctggagctgggctcatgtcctggtccttctgggtagtacatgccctcgggcaagtgccttgatctctctaggctgcagattccatcggcacgatgagtgcttcaggcttgatgagcggttcttgcctcatctacacattgggatcacctggagacctattaacaccacatgaaatgatgcccagacatccagagagagcataacattttttaattttttattttctgaaacaggggcctcactatgttgcccaggctggactcgaactcctgggtttaagtgagtctcccacctcagcctcctgtgagtagctgagactgcgggcatgtgccaccacgcccggctcagagacagcctaatctaggggtgagaccaggacatgggcatttctttaaagttctctagatcatcttttttcaaacttggttacacattggagtcacttggggagttgtaaagactgatgcctgcgtcccacccccagagagtctgacataattgataaagtgggaggagcctgggcattggtgggtttcaaagctccccaggtgatcttaatgtacagcaaaaacgcctctcagctggaggcatctcctcagcaggcctgcatcacactggctgccacttcctcagtcttgtcagactttcattcctgctcagaaagacatcccttgagaaccttgagtagaatcaaagccaggagcggccagggatgcccagggcagcttgcaaagctgaggcccctgcaacgggccggtgcgccctggctggagtgatgcaggttgggcgcttgctgtcctggccaccccaggctgaatgagagtgctggctgcaaacagggctcgtggggccgtgtgtcccaggccatcatccctccacaggagccccggaggcagctagaagggcgagagcacagaaatgctgttccttcagaagatgtgggttttgatcttggtctgaatcctgggtgagtccctcatcctctccacctattaattcatttttatacatgctttgcaccagtattgatcaagcactgtgctgggccctgagggaaagaggagttggacacgaggcctgctctcaaggagccaggtatagttgttggtgctgggctgaaggtggcttgctggaggcgcggggggcaggggtggcgggggtgcattttagcaaaggatcagaaaaggccagcagtagaaaaggccagcagtacacgtggaaggctgcaccccaagtgtaccatgtgttcatgtgtgtgttgtctggggcaaagtttccaggaggagaatcttcaggccaaggagcagactgggcaaagacacagagctgtaaaaggcaggaccgggatgctgcggagggaggcacagacaaggacccagccacacctcatgtgtgatgctaaggctttcgagctctgtcttggggacccaacttcccaaacacatgatcctgagccaaataaggtcacagtcgcaggatcaacagcgcttcccagtctgcctccacccgctgttatgggacgcccacgtcaataccccattatcctcagagtcctcggggttgtgtcaatgcatgtcgggacagtactgtggtgcctgccccacccctgctgtgcctcctcccattccctgcaaagttgtctaccaccgagcccagggagggacacgggggcactgtgggtggctgctgaggcgtctccatgctagacttctgatatggtttggctctgcgtccccacccaaatctcatcttgaattgtagctttcataattccctcgtgttgtgggagggagccagggggaaatacctgaatcatgggggccgcttcccccacactgttcttgtggtagtgaataactgtcatgagatctgatggttttatgaggggaaacccctttcgcttggctctcattcttctcttgtctgctgccatgtgagatgtgactctcaccctctgccatgattgtgaggcctccccagccacgtggaactgtgagttcattaaacctctttcatttgtaagttgcccagtcgcaggtatgtctttattagcagcatgaaaacgtactaatacagcctctttatgtgagcctctgctcagctgccctgtgctcctgggggctcagggagcacccatggaaaccattccatcctttttgtcttttggtctgattccccagaggcactcaaagccacctctctctatcagacacccatgccctgccttcttcccttaggacgagctctccccaaggaggctccatggtccctcctggaaatggccccggcatccagaatctggagacccacacatatttttgaccatggggagcacccaagaagccagacagtggtaccatctgttttcctttttagattaaaataaagaatggaaagttgaaaattcatttgtcatccttgagcaggccatgcccctgcgcatcaaggtttgagactgagtggcggcgtcacctccacagcagcaccttagctgttagcacttcacagcttgaaagggtgttcactgacgtttcctcaggagacgcacagctaacgtatgaggcaggaatcgttatcgttcccatttcacagcaggataaattgaggctcagaaagatgagacgatttgcccaggttgcacagctaggacaaataatccaaatcgaagttttctggctccaaaaaactggctacatcaaagtgctgacagcattttttaaactatgaagtgctactcaaatggcaagcattaataattattattatttccacctcctgcagcttggcttaaagccccggtgcagcctgcacttcagacctgctgcactgcacacacacaccccctgccacccacccctccctcaggaagagtcaccatcagaagtgggcagagctatgagactctcatgcacccaagatccagcccccaacaaaatgtgactccccatctggtttcacatgcatctttgtactttctggctgtcctaactccggcatccatcgttccaaaagaagtgtgcagggagtggagtgggactcacatgggaaggacgagagcgtccagcctgatctgctatgaggctcggaggtgacaggccctgggggatgctgctttgggcatctcagtggcccagggccattcaggcttctgacttctttgagtatagcctgagtgcttcccccacagtttgcctttgccaggatgtgaattcctgttccgaaagtgttgggagagatggggtaatgcagaagacagggacaggaaagagaggggaggttctgaggcttttggaagtcaaatactccctaggaaacatttcaatgtataaaagactgagaaacatatggactgaattttcccaaagaatacacatggatttaaaaattaaagggcaaggaagggggttggatttttttttttctgattgggtgttttttcccccaaaagtacattttggggaaattttactggaagccaaagcacttaaaacatcctaacatgttaaccagacttgaggcatccatgtgacccaacaccctacatggcatataagccaagtgtcttccccctccctgccactgagcccacacccctgcttgctctccacccaggggctgcacatccattggcagaggaaatggtgaccacaggtattccaccggccaggtggcacacctcgactgcggccccctgggggctgcttgcctgggttcacccactatgagctccagaatgttggttaaattcaagtggagtccagtggctgacactaacctctttcctgacctctctgggcctcagtttcctcatctgaaaaatggaaatgataatagcgcttatctcatagggttattgagagaattaagtggggaagtaaatgataaatgcttagaactgtgacttgcaaaattttaagtgcttgccactcaaaaaatagccataattattatttataatatatacatatatatgtacatacacatatatatatgtgtgtgtgtgtgtatatatatacatatatgagtacctagagtggggctcttttaactcaggattttatgaggactgcaaaaggattcattgtcaatttattaaatattaattgagggcctactgcatcagtcaggatgagctaggttattctgtaataacaaacatccccactatctcagtaactcacagcagcaaagtccctttcttttgtttgtgagacagagtttcactcttgttgcccaggccggagtgcagtggtgcgatcttggctcatggcaacctccacctcccaggttcaagtgattcttcggcctcagcctcccaaagtagctgggattacaggtacccaccaccatggccagacaattttttgtatttttttagttgagatggggtttcactatattggccaggctgaccttaaactcctgacctcaggcgatccacctgcctcggcctcccaaagtgctgggattacaggtgtgagccaccacacctggccagcaaagtccgtttcttgccaatgctcgctgtccatctcaggttccaggggctctgttccacctgctcctcactgagggatgagggctgacaaagccccaccaccctgggaggtatcacccatcaataacaggacgaagggggaatcagagcaagtcacacattggttcttaaacgttcctgctggaagtaccaagttactttaattttcatttcaggaaccaaaccaaatcacatggctgtcttagaggagtagggagagtgtaattctgccatgtacccagaaaggggagcactggaaatagcagcagagaacttcagggagcaccacaaatcagcaactgctttagacactttgggatatatcagtgaaccaaacagactcctgccctcatagagcttaccttctagtgaagggagaaagacaataaaggtaataagttgaaggctgcaattttattttattttattttattttatttatttatttttgaggcagagtctcattctgtcgcgaggcccaggctggagtgtaatagcatgatcttggctcactgcaacctcccctcctgggttctggcaattcttgtgcctcagcctcctgagtagctgggattacaggcatgcatcaccacaaccagctaatttttatatttttagtacagacagggtttcaccacgctggccaggctggtctcgaatcactgacctcaagtgatcttcccgcctaggcctcccaaagtgctgggattatagccatgagccaccacacccaccctaggctacagttttaaataggatggtcagggtgggccccattgagaaggtgaaatttgagcaaagacttgaaggaagtgaaagggtgagccacaccaatatctggaggaagagtgttctagatgcaggggacagcctgtgcaaagcccaaagcctggcgtattccacgagcggtggggagggagggaggaaaggcaagcatttgagagtgagagagaggccaggcccagcaggacttcatagctgaggacgtgggcttctaccctgatgtgctgaagggccactggagagttctgacttaaggtttaaagggataactggctgctgtgtggagaacagactgcaggggaagcttggaaaccagttaggagagaaatgctcgttcagccattctctgtggaaagaacacacatgacccaattctctttggcaggtttgtttgttaaccctgaaatggctggcacttggtcagccttgctggcctctccatgccaggctgtctgtaggcacagtcttgggcaaatgtgctctggctgtggggtcaggatgtattctgtgctactcatgggtgaggggtggctagggggatgttgcagggtaaggacattgttagtttaaagccttttgaaaagaaatgtttcttactgcttttttttttttttttttttttgagacggagtctcgctctgtcgcccaggctggagtgcagtggcacaatctcggctcactggaagctctgcctcccgggttcacaccattctcctgcctcagcctcccaagtagctgggactacaggcgcccaccaccacgcccagctaattttttgtatttttagtaaagacagggtttcatcgtgttagccagtatggtctcgatctcctgaccttgtgatccgcccgtcttggcctcccaaagtgctgggattacaggcgttagccaccacgcccagcctcttactcctcttattttctgcctggatttaaatcagacacctcccctagcaaaaacaaaaaactccactttctcctggaaaccctattccctgtcctcagcaacagaagcccaagacctattgagtcacatggcaatgtcataacctgcatcttatttaggatgagaaagaatccctgcgcagagagggtggcctgtgtccactggccctcaatgaatatgtatttattgcttcttcctaaggggagtgtgaagggaggagaaggacgtgggctagaagcctggctcagtgtctagtcctggttctgccactcataataactggcctggcttttgtagaacactttcaaatgcaggatctcactcgaggctcacaatagcactctgaaagaggtgatgctgttatcctcatctcaagaagctaggtgacgtgacacctggtaagtgagggaggcgagatttaaaccaggtttcctgcctctaaagcctaggattgtttcaccacatcacacagccactaggagcacccccaccccgcaacataacctgagttactcctcccagtgagcccctcccctgtgaatctgggctggccctgtgaccagtttttgaccaaaagaacttagtggaaatgatataatgtaacttctgagactgggccttaagagattcacagcttcttataagtctttgtcagttgaaatgttccctcttgaaaacatgctgtgaggtaagaaatgtaaccatcccatgaccatcaatctgagaggaagttcaagccacatggagggggagaggctacctgctggagcaccgaagcttcagccatgcaaatgaagccttctaggccagccaagccaccagccaaatacagccaagtaaatggccccagccaataacgtggagaagaagagccacccagctgagccctgcctgaatccctgacccacagaatcatgagaaaataaaatgattattgctttaagccactaaatgttggggtggcttgttacgcaacaatataaatgatcacaaccccttcatatgggaagagatgagcaatagtcaacttaattccttccttccccctctctccccttcttccttctctccttccttctttccctccacaaatgtttgttaagcacctacaacatgccaggcgctgtgctagatgctgatacaaaaatgaacaaggcagtcactgcccttcaggagcctaatatctagtaggagaggccctgtgtacacacacgtatacaacaaacaggatcatgagaaatacaaagcactcaggggtactcagtttcaccgaacacaggtcagtagaggcttcgcgaagaagatgctacttgttgtgtggcaggcactgtgctgagagtcagttatctgaactgtgagctctccttcactccaccctcagctcagcagtgcaagctacacttccataaacatgccttctgtatcatcacatgagttattcagatattgaatgtgataaggccaggccagatctacctagtacacatcaatttaaggatgccctgatccctgcccactctgcccccttgatagaattccattggcaaacactcttaaaggacttttgttgaaccagctataaaccaatccaaccaagtttttacctggacagcatttcttcatgttgaccttgaagatgtaacaagagtctttgttaaggtccctgctacagtccagaatctccttgagtataaacctcactgatcctccagtctggtgatgactgtattattaaaggaagtcagaccatttcctctgctaaaggcttacaaattacatatttagtaatcttttcagaagattttgccaaggtttggttgtcaattttggaatctacctctttttccatttttaaatttaaactttaaaaaatggttgaattgttttttgaaagttgcttcaatgtctgccggtctcctggcacctgctgctttctccaggatacctcaaagaggaccaagcagagtttgggtatctttgcagcctctctccatgctctgggatgtatctgaaccaattcaaaggtgcaggacacgctcttcctgtgtaacaggatgatttctcaaagtattaatgtgagtgtgttctcactgaaatgtcctggtcctaagattggtgaaagcaactgggtccctatgtgttccttcccatggggaagttttgcacaaagaggccaaaagcagaagtacctacttgattatctattcctggtgttggttgaaagagtatgataaatatttttagtggcaattggaagagtaagacagaactccctgaggcaaaaaaaaaaaaaaaaaaaaaagagagagagagagaaaacatcaatcagagtgggagggagtgctaaggaagtggtgagagctgggttgatggctgcatggtgccctggggatgggcataggcagcagagtgccccatcccagcaataattttcacaccccacacatggcattgagacagaaccttcaagggaccactctgggtttggacaggacaaagtggctctgtcatctactaagatccacagccataatggcctggaactgtgtgaccttgggcaagttcctgacctctctgggccttggttcctcatctgtgaaatgaggatggtagcattccttgtctcaggattattgttaggattaaatcagttgatacatataaatacttagaaccatgcctagcatgtagtgttatgttgttgatgatgatgattgttttaaggtgcagcccccgaattctggagaaaggagagagccttggtaataatttaaattgggtttcctgccaagctggtaaggaagttcaaggaagactccaagctggcacttggagtcagtttaagtcaacttgaagaaaatagagaaatgtggctgggagcagtggctcacgtctgtaatcacagcactttgggaggctgaggcaggtggatcacttgaggccaggagttcaagaccagcctggccaacatgatgaaacctcgtctctactaaaaatacaaaaattggctgggtgtggtggtgcatgcctgtagtccctgctactcaggaggctgaggcacaagaattgcttgaacccgagaagcagaggttgcagtaggccaagattgtaccactgcacactagcctgggtgaaatgcctcaaaaaaaaaaaaaaagaaaagaaaagaaatagagaaatgtgacctttcttgcacacttaaatttatgaaccaatattctcaacttctccactatctcactcctgtatcaggttacaatgtcctgttaaaattatgttttatatttcagggaacagagagcacctgagtgggctctgtcatctactaagatttcccaccttcccaaagcagccggtctaccctttcttattcatcatattaatcttcttccaaacaaaactgtgatagaaaggcttcctgaagatgtctgtgtcctaatctccagaatccatgaatgaatgtgttgtgttacatagcaaagaggatgtagatagaattaaggaatgcagagagaattaaagttgctaatcagctgcccttaaaatagggatggtggcttgggttattttggtggatcctatcacaagggtccttataagtgggagagggggccaggcatggtggctcacacctgtaatcccagcactttgggaggccaaggcaggcagatcacttgaggtaaggagttcgagaccagcctggccaacatggtgaaaccccatctctactaaaaatacaaaaactagccaggcgtggtggtgtgtacctgtaatcccagctacttgggagactgaggcacgagaatcttttgagcctgggaagcgaaggctgcagtgagccaagatcatgctactgtcctccaccctgggcaacagagcaagacactatctcaaaaagaaagaaagaaaatcaggagagggaaacagaagagggaaagcccaagagatggcagagtggaaagacatggcccaacatttctggctgtgagaaagcgaggaaggggccataagccaaggtacatgggcaacctctagaaagctgggaaattcaagggaacagattatcccttagagcctccagaaggaagggatgcagccctggtgacagcttgattttcagtccagtgagacccatgtcagccttctgacctcagagctgtaagattatacatctgtgatgttttaagcctctaagtctgtggtaatgtgttttcacagcaataggaatgaatagacaaaaccaccaatatagaaacaataatcaaacaaaaacacttgtttttgcaaagctcagctttagcttttctgaccctgttttcgaaagttcttatctttctcctgagctcgtcttttcttctctgcccctggtcccagaactgatgcaggttcttttgcactaagagctctctaagaagtgctgtgtttatttaaacatgtccctctctttcatggaagtcattgctggtatccgctgggcactcccttttctcctcacatttcttgtctttgtctctggagtcacgccttcctttcctctggactttctgaagtcctgtcctaaggcttggtgcgtgggactgactagttaaaatctagtgccaagtgctcagaacatcaagacacaacaaagtcactcaagatccgttgggcagaatctcctgaaattgctttttttttaagatctaaaagtcaagtatcagtaattctataaaagttcaacataagaaaagagaagacaggcaaataactacaggtgtgaaaaatatactacagaaacagaaacaagaacaggtgtcatggtggagggggacaaatacataagaaaatagtaatgagaaatgctatggagaaaatagtggctcacacctgtagtcccagcacttagggagaccaaggcaggagggtcacttgagcccatgagtttgagaccagcctgggcaacatggcaaaaccctgtctccacaaaaacatacaaaactagccaggcatggtggtgcttacttgtagtcctagctacttgggaggctgaggtaggtggattgtttgagcccaggaggtcaaggctgcagtgaaccatggttgtaccactgcactccagcgtgggtgaaagagcaagactctgtctcttaaaacaacaacaaaaaaccctcagccctgcaatggggcacacctgggagcccctttggattgggtggtcagggaagggccctgggaggcaatgacctgctgtgttacgctcaggaggttggccaggaccccgtggaagactcagggagccagcaggggacgctaggcaggggaggacagggcccagtccctctgtggctcactcactctggagtgggtgtggggatgtgctggcagggccagtccaggagcctagttaaaggggggtcctgtggtagcccatgcatgggatgatggtggcctacagtgaaaccatgatggtgggctggggaagagtggaagtacttaggatggggaagaagcaggacttttggtgattgagtgtgttggggcaggagcaggggaggaagagggaggtgaaaggggtgactctggttcactattaggggactggatggttgtgctactctgcaacacaaggaactctgggaaagggggagattgggtggccagagacgtgcggagatgggcatggaggagctcacaagcagcagttctggaaatgaatgctgagcatggcagctggacgacaaggtggcccaatggcccgtgcctacagtctgcacacccttgggtagtctcctgcccttgaatctgggctatgctctctggttttcatggacgctaagagggcacagtcacctcctcacaagatctgccatcagcactttctgattttttgtgcttggtcaagattaagtctagagtagctgcccccagaaggagccatttgaaaagattattgaggattttccaacactctgcttccagaagaattagataccccacctcctctggtttaatccagccttttggggttggctccacaggtgatttacataggaaatacgtgggactcctccaaggtagaagtttttatggttgcgcctggcagccttcactgaccctcatccacatagacaagtggccacaggtacactccactcagtcaccccacactccagaggccttgggtagactttcatgtgttcacagacagatgtagcttttcacggtcttcacattcacacgctcaagtacaaggtcagtccctgccgatgcaagttacaaggaagcacaacctgtgctagggcagccagtgcatcccttccagctggccaggagccctcagcaggcctgaaagctgggaggagaggtgcccagctaggtggaaacagaagggaaggtgcaggactgtgggtgatcctggcagctggcttgctcctggaaggccaggtgggacatctgcaaggtaagggcctggaccctgggcagaaattgtaagtctctggtcttcaaggcctttaggagatgagaatgttgaagcctccgtcttaccaactaaacctctcggtaccaagagggcctggcctgcaaggtagaaaccaaaaccccctctaacacacacacatgcacacacacacctctaaacattcaagtgtacagatgctagcactgtactagcattgtttctgcaagcctgagagaagctgagctctgtttccattctcctctcacatctgcctggtgggaatgctctaagagggggttcccagactttgttgcacattaagatcaccagggaaggaagctttcacaaatcttgatgttcaggtcactgctcatgccaatgaaatcgaatatttgggtgtaagacccagacatcagtattaactggtgactcctatgtgcagccaacttcaagaaccaaagatctttgttggttttttttttttttttgagacagagcctcactctatcactcagactggagtgcagtggcacaatcttggctcactgcaacatccgcctcccaggttcaagtgattctcctgcctcagcctcccaagtagctgggactacaggtgtgtgcaatcatgcccagctgatttttttgtatttttagtagagacagggttttatcatgttggccagctggtctcaaactcctgacctcaagtgatctgccctcctcagcctcccaaagtgctgggattacaggcgtgagccaccatgcccagcccaaagacttttattcatcatcacacacaggcctgtggtggagatttttaaaaattgaggtgaaattcatataaacttactcattttaaagtatacaatttagtggcatttcgtacattcacactgttgtgtaaccatcacttccatctagttccaaaacattttcatcaccctaaggagaaaccctgtacacattaagcaagcattcccctctccccctctcccctcagtccctgccaaccacaaatctgcttctgtttctatggatttacctattctgtgtatttcatataagtagaactagacaatatttgacattttgtttctaacttctttgcttggcataagttcatccatgttgtagcatgaatcagtacttccttcttatggctgaataatattaccctgtatgactaggacacactgtatttatccatttaaccgctgatagacatttggattgttttcacctttgggctactgcgaataatgctgctttgaatattcatgtacaagtctttgtttgaatctctatttttgattctttggggtattctgggagcagaattgctgggttatatggtaatttgatgctacttttttttttttctagacagggtctgtctgtagcccaggctggagtgcagtggcaagatcatggcccactgcagccttggcctcctgggctcaggtgatcctcctccctcagtctcccaagtagctgggaccacaggcatgtgccaccacacctggctaattttttaaaaaaaattttgtagagatggtttttccctatgttgcccagtctggtctcaaacccctgacctcaagtgatccgcctgcctcagcctcccagagtgctgggattacaggcgtgagccacccacttctggctgatgcttatcttttaatgaactgccaaactgtttcccacacatgctgcaccattgcacattcccaccagcaatgtacaaatgttccaatttgtccacatccttgttaacactgtctgtttttcatttttttattattatagccatccttgtaagtgtaaagtggtatcttattgtggttttaattttcatctccctaatgaggaataatatcgagcattttttcttgtacttgttaactatttgtatatcttctttggagaagagtctattcaagacccagatactttatgcctcctaatcctcatagcaccactgagaggaaaggattgttcacatttttctagatgaagaaactgaggctgagagaatgccccaactccaattgatgacagaaagcaagatctgccgatgcttgaaattcataccatacacacgccccaaatattccagtgtgcagatgcttgtgccaaatgagaaatacagtcaaaaagctacagggggctgggtgcagtggctcatgcctataattccagcactttgggaggccgagatgggtggatcacatgaggtcaggagttcgagaccagcctggccaacatggtgaaaccctgtttctactaaaagtacaaaaattagccaggcatggtgtcgggcacctgtaatcccagctacgtgggagactgaggcaggagaatcacttgaacccaggaggcagaggttgcagtgagccaagatcattccattgcattccagcctaggtgacaagagcaaaaattctgtctcaaaaaaaaaaaaaaaaaaagctacagagtgtggaggaggaggggtaagcacaaaaaaactggagcccctgaggagctcttcaggtagagagggagtggggttccatatgggtttggagtgacagagtgagagagagagatacagtagagagaccaagtgtgagtgccaggaaccagcaaggcatattgaaggagatgcatttttttgtcaggcctgtttctatagcagagaaagacacagttggcatgttcagcggggggcccagggtggaggtcactcaggttttatgctctggactcctttgtgccctgagaatttcccaggcttggccacaatcagctccagctgctgattctgggatggactcagccacagcctcacccaggtcacacaaatggaagtggtaagtcgatgctccgcacaggcagctgctacagctgcaggaagcctggaggtgtgagtcgatatttctgttagactctcagtttcatcagaaatcagtgccagaaaatggctttgcagctgtgtgtgtgtgtgtgtgtgtgtgtgtgtgtgtgtgtgtgtgtgtctatgggctccaacaccctttagaagcctatctctgtactttgaactctaagaggtgcaaagtgagattgaggggtaaggagggatgagggggaaggagttctgatgatctgaggctggaggagaaataaggaccagagccgccctcaggccttggagagcagccttcacctctggaaatgatgccgaaatatttcagcctctctctcctggggtttcctgtttcctatttggtctctggtttccaggcaacacatgaatacccccaaactcctgaagtgtatgggtctccaaatgtccttcttcctctaaagctcacatctgtaatgagtttcccatctgctcagtcgcccagggcagcccatccattctgctgtctccagagacaaaagcaatcgaagatgcttgtggtttgaggtgtgtgtgtgtttctaccctccccccaaccctgccactttgtaggtttctccagtttaatgagtcttcctgcaaagtcggtttggctgaattgcattattagggtggggagcaggcaggagatttagggtttgctgatttgatgcagtaaagaactgagtctggcaggagcccagcaatttagaagaaaagtgggggaataagccctaaacttgacccactggtgagctattggctggctttctctctctctcaggagagagtggaggggctgtcttcaggaactctggtgggcttcaggggacttgaaacttccttagattcatgataaactggattcatgattcactcccaccagattcagagaacctggtggcagtgaagtataaaattgaagggggcaaaattatggggaattgcactaatttttgtgtttagtataattaatacatagcaattgcattaatatttgcataataatagtacttcaaggcttagaacaacagtccattgtcactcttatccagctctgagctccagtctcaagggcaacctatttttagttttaactattggtaaaaatttaccttggagaggggtgtattagtctgttttcacgctgctgataaggacatacctgagactgggcaatttacaaaaaaaaaaaagaggtttaatgcactcacaattccacgtggctagggaggcctcacaatcatggcagaaggtaaaagacacttcttacatggcggtggcaagagagagaatgagagccaagtgaaagcagtttcccctcataaaaccatcagatctcatgagacttattcactaccctgagaacaatataggagaaatggcccccaggattcagttatcttccaccggctccctcccacaacttgtgggaattatgggagtataattcaaaacgagatttgggtggggacacagagccgaaccatatcaaggggcaaagcaaggtgactgaatagaatctcccagtaattgtccctctgcaggaacatcaaattgaacaactatccacacaaaaaagcaccttctgaagagctacagatgcactggagagggtaggaaggacaatctcacattgcctaaaccacccctaccccaaccccaggcaggacggtaggagacagaaactgcctgcttggggaacagaaagggaagtgagtgtgaaactttgaattagaacttagtgccagccccaccacaatggaacaaagctccatgcagagctcctgcagcctgaaattccaggctggggcccacagagggagaatttatacctagcccagggcagaggggaatctaccgcccaggcaggaggagctagagtccctgtccacttgatcaccaggaaactaaagtggcatcaggacccaaataaacttcagtggctggcaagcaggctttagaaaccatggtccttggatgagacccagtaatgtgctggtctgagaggccattggctgaaaagtgacccagtattcagaggtaaagccagctggacttcctgggtcgagtggggacttggagaacttttctgtccagctaaaggattgtaaacacaccaatcagcgctctgtgtctagctaaaggattgtaaatgcaccaatcagcactctgtgtctagctaaaggattgtaaatgcaccaatcagcactctgtctagctaaaggattgtaaacacaccaatcagcactctgtagaaatgcaccaatcagcactctgcgtctagctaaaggattgtaaatgtaccaatcagcactctgtaaaaacacaccaatcagcactctgtataatggaccaatcagcaggacgtgagcggggccaaataagggaataaaagctggccaccagagccagcagtggcaacacactcaggtccccttccacactgtggaagctttgttctttcactcttcacaataaatcctgcagcatcactctttgggtctgcactacctttatgagctgtaacactcaccacgagggtctgcagcttcattcctgaagtcagcgagaccacaaacccaccaggaggaaaaaacaactctggacgcaccacctttaagagctgtaacactcaccgcaagggtctgcggcttcactcctgaagtcagtgagaccacgaacccaccgcaaggaataaactccagacacatctgaacatctgaaggaaaaaactccagacacaccatctttaagaactgtaacactcactgcgagggtccacggcttcattcttgaagtcagcgagaccaagaacccacaagaagggataaattccagacacagtatgacatcagtggtgtctgccacaaaagtacccatgtcacccctccctcagctccaggcagtgcagttcagagagactccctctacttgggaagaaagaagagtacaggagactttgcctgtgaatctagtgtcagttttgccacagtaaaacaaaacacagggctgaacccccacctggacatacttctagacttgtcctgggacagaagggaatccatcaccatggcaggaaaaacccaagtcccagcctgcttcaccaccagctgaccaaagtgaccttggcctttgaataaatatcagcagtattaaggcagtagcagctgcaggcattgagctagccctggtactgcaccggtcagggagactataggctttggtatgacctagcatagtgccagctgcagaggccatggatatgtccatgtcagccctcccccaccagggaactatctctgattttccagaactacatcagggttggcgatcttggagtctgcaagactcatagtgaaacttggcttagggccctctctactgcaaaatggctgcactgaccacaggtttagtgaactcaacaggtggtcccttttgaattattcgaaggctccctgaagaacagatacaaacaaggccagacagtgaagactggaataagtatctacttcatcaatgcccagatattgatgaatgtatgcaagcatcagaaacattcagaaaatatggtctcactaaatagactaaataaggcaccagtaatgaccctggagagatggagatgtgtgacctctcagccaaggaattcaaaatagctgttttgaggaagttcagtcaacttaaacacacacacacacacacacacacacacacacacacacacacacacacacacaaaattcagaaatttatcagagaaatttaacaaaaagactgaaaatttgaaaataaatagaaatcctggacctgaaaaatataatacgatagatcaagtaaaaaatgcatttgacatcttcaacagaagaattgatcaaacagaagaaagaatcaggctatttgaaaatgcacagaggagaaaaaggaaagacaaacacgagaattaaaaaatagcttcaaaagagcaaatgtaagagtcgttggccttaaagagggagtagagacagaaaaaggggtagaaagtttattcaaagaaataatatcatggagtggggagaagaaaaaaaataatatcagaaaactttccaaacctaaagaaagttatgaatatccagttacgagatggtcaaagagcaccaagcagattgaacccaaataagactcaagccatataaaaaatcagactctcaaagttaaacaagaaaaagaggatcctaaaatggcaagaaaaaagaaacaaacaacatataaagaagctccaggccaggtacagtggctcacacctgtaatcccaacactttgggaggctgaggtcggcagatcacctgaggtcaggagttcaagactagcctggccatcatggcaaaactgcatccctactaaacaatacaaaaattagctaggcatggtggctggtgcctgtaatcctagctactcaggaggctgaggaagggagaattgcttgaacctgggagttggaggttgcagtgagcagagatcacaccattgcactccagcctgggcaacagagtgagactctgtcaaaaaaaaaaaaaaaagctccaatacatctgtctgacagtggacttcccagtggaaatcttagaggccaggaaagagtgggatgccatattcaaagtgatgaagaaaacaaaaattacaaactgagaatactgtatccagtaaagctatctttcaaacacaaaggagagataaagactttgtcaggcaaacaaaagctgaaggaatttatcaccaccagacctgtcttacaagatatgtgaaaaaaagagttcttccatctgaaataaaaggatgctaatgtgcaaaaagaaagcatttgaagatataaaactcactggtaaaactatgtacatagccaggctcagtgcctcaagcctgtaatcccagcactttgggaggctgaggtgggtggatcacttgaggtcaggagtttaaggccagcctggccaacatagtgaaaccccatctctactagaattacaaaaattagccaggtatggtggcgggcacctgtaatcccagcttctagggaggctgaggcgcaagaatcactcgaacccaggaggcagaggttgcagtgagccgagatcgtgccactgcactccagcctgggtgacagagcaagactctttctaaaaaaaaataagtgtgtacatagacaaattcagaataatatagtaattgtagtacgtaagctacttgtgtctttagtatgaacactaaaagacacacctatcaaaattaataactacaatttgttaagagagaaacaatataaaaagatttaaattgacaacaaataatcaaaatgcagagggggatggaggtaagtatctttttcctctgtctctttttttgcaatcaaaattaagatgtcatcttaataatttattatagctaaagataagcctttaaaataatttactacagctaaagctaagtctcatggtaactacaaagcaaaaacccgtaatagatacactgaaaaaacaaggaattaaaatatactaccaaagaaaatcgcttaaaccacaaagaaaaacaataagaaaggaagagaggagttataaagaaccaggaaacaggtaacaaaatggtagtagcaaatccttacctgtcaataacaacattgaaggcaaatggacttaattatccaattagaagacacagagtgactgcataggttttaaaaaaaaaaaaaaaagtcccaactatatgttgcctacaggaaactcccttcacctgaaaagccacacataggttgaaagcaaagggatggaaaaaggtattctacataaatggaaaccaaaaacaagcaggaatagccatacttttatcagataaaacaagcttcaagtcaaaagctctaaaaggaaacaaagagagagaagatcattatacaatgataaaaggatcaattcagcaagaggaagtaacaactgtaaatacatatgtacccaacactgaagcacccagatatataaaataatattagagctcaagtgagagatagaccccaatataatgataattggtaacattaacactccactttcagcactggataacatctagacagaaaataaataaagaagcatcaggcttaatctgcactatagaccaagtggacctaacagaaagttacagaaaatttcatcgaatagctacagaatacacattcttttcatcagcacctggaacattctccagtatataccatatgttaaaccacaaaacaagcctcaacaaatttttcaaggtcaaaatcatatcaagtatcttcttaagccacagtagaataaaactagaaatcactaacaagaacaactttggaaaccatgcaaatacatgaaaattaaacaacatgctcctaaacaactactgagtcaaagaagaaattaaaaaggaaatagaaacatttcttgaaacaaatgaaaaatggaaatacaacatactaaaacttatgggatatagcaaaaacagtactcagagggaaatttatagcaataaacacctacatccaaaaaagtagaaaactttcaaataacgaacctaatgatgcacctcgaggaactagaaaagcaagaataaaccaaccccaaagttagtagaagaaaggaaataataaaaatcagaacagaactaaatgaaatagacactaaaaaattacaaagaatcaaaaaaccaaaaagttggttatttgaaaatataaacaaaatcaataaattactagctaaactaaccaagaaaaaaagaagtcccaaataaataaaattagaaatgataaaggagacattacaactgatatcacagaaatacaaacgatcggccaggtgctgtggctcatgcctgtaatcccagcactttgggaggccgaggcaggtggctcacttgaggtcaggagtttgtgaccagcccagccaacatggtgaatccctgtctctactaaaaatacaacaaattggctgagtgtggtggcaggcgcctgtaatcccagctacttgggaggctgaggcatgagaatcacttgaacccaggagggagaagttgcagtgagtcaagatcctaccactgcactctagtctaggtgacagagcaaaactctgtctcaaaaagaaaaagaaaaaagtacaaaagatctttagagactattatgaaaaattatatgctaacaaattagaaaacctagaggacatggataaattcctagacacatataacctaccaaaattgaaccaggaagaaatagacctgaaaagaccaataacaagtaatgagattgaatcagtaataaaaagtttcccagcaaaaaaacccaggaccagatagctttattgcaaaattctaccaatttttattaaatttttttagaaacatgatctcactctgtcactcagtctggagtacagtcgtgtgatcatagctcactgcagcctcaaactcaggctcaagtgattctcccacatcagcctcctgagtcactaggactataggtgcataccataatgcccagctaattatttttttgtagacacagggtcttgttatgttgcccaggctggtctccagctcctggcctcaagcaaccctcccacctcaacctcccaaaatgctgggactacagatctgagccactgcactcagcctacaaatcatttgaaaaagatttaacaccaattcttctcaagttattccaaaaagtgaagaggagggaattcttcctaactcatgctatgagaccagcattgccctgataccaaaaccagacaagactacaacaacaaaagaaaacttcaggccaccattctttatgaacataaattcaaactttttaacaaattactgccaaatcaagttcaacagcacatcaaaaagataatacacatgatgaagtgggatttatcccaaggatgcaaggatgtttcaacatacacaaagcaataaatgtgatgtatcacattaacagaatgaaggataaaaaccatataatcatctcaatagacacagaaatagcatgtaataaaatttaacattccttcatgataaaattctcaacagattaggcacagaaggaacacacttcaacataataaaggttatatatgacaaacccacaactaacatcatactaaatagggaaaggttgaaaccccttcctctaaaaactggaacaagacaaggatgtccattttcaccatccctatttaacatagtattgggagtcttagccagagcaactaggaagaaaaagaaaggacatccaaatttggaaagagaaaatcaaattgtcccttattgcagatgacataaccttatatatagaaaagcctagactccaccaaaaactgttacgactaataaacaaattcagtaaagttgcaggatacaaaataaacatataaaaatcagtagtgtttctatacagcaataataaatgaactgaaaaagcaagaaatgaaccccatttacaatagctaaaaaaaaaaaaggaataaacttaaccaaggatgcaaaagaccttcacaatgaaaactagagaacactgataaaagaaactgaagaagacacaaacaaatgaaaatacatcccatgctcatggattggaaaaattaatattatcaaaatgactaaagcaatttacaggttcaatgtaatctctatcaacataccagacattcttcatgggaatagaaaaacaatcctaaaatacatatggaaccacaaaagacctcaaatagctaaagcaatatatatagaaaaaaaaatagcaggaggcatcatactacctgacttcaaaatacacgacaaagctatagaggtatagtaaccaaaacagcatagtattggtataaaaacagacacatagaacaatggaacagaatagagaatccagaaatccacatatttaaagccaactaatttttgacaaaggcaccaagaacatacattgggaaaaggacaccttcttcaataaatggtgctgggaaatattgaagaaggacaccttcttcaaaaaacggtgctgggaactatatgcagaagaatgaaactagacccttattctcaccatatacaaaaatcaacccaaaatggattaaagactgaaaagtaagacccaaaactataaaaacgctagaagaaaacataaggaaaatgtgcttcagcccattggtctaagcaaagattttatgtctaaggcttcaaaagcacagctaaagaaaatagataaatgagactatattaaactaaaaaccttctccccagcaaaggaaacaatcaagagagtgaagagacaacctacagaatgggagaaaatatgtgcaagctactcatttcgcaagggataacatctagaatataccaggaactcaacactaaaaaaaaaaaaaaaccactaaaaagtggagaaagaatctagaattatagacattcctcaaaagaaaatatacaaatgaccaaagaatatgtattgaatagcaggaggcatcatactactgatgaatactattgaatatgaaaaaaatgctcaatatcgaccaggtgcagtggctcacacctgtaatcccaccactttgggaggccaaggggggcagatcacctgaggtcaggagttcgtgaccagcctgaccaacatggtgagaccccatctctactaaaaatacaaaaattagccagacatggcggtgcacacctgtaatcctagctactcgggaggctgaggtgggaggattgcttgaacctgggaggcagaggttgcagtgagcagagatcatgcctctgcctaggtgacagagtgggactccgcctcaaaaacacactctatcactgatcatcaaggaaatgcaaaccacaattagatatcatctcaccccagttagaatgctacaatatggtttggatatttgtcccctccaaatctcatgttgaaatgtgatccccagtgttggagtagggcctggtggcaggtgtttggatcatgggggaatatgcctcatgaatggcttagtgtcatccccatggtgatgagtgagttcttgctctgagttcatgcaagatctagttgtttaaaagtgtgtggtacctcctccctctctcacttgctcctgctctcaccttgtgatacaggtgttttgtcttcaccttccaccatgattttaagcttcctgaggccctcaccaggagcagatgccagcgccatgcttcctgtacagcctgcagatctgtaagccaattaaacctcttttctttataaattacccagctagcaatacaaattactggcattatagcaatgcaaaatggcctaataccagctcttatcaaaagggcaaaaattaacaaatgctgatgagaatgcagagaaaagggagctcatacactgttgatgggaatatgaggtagggcagccattacagaacacagtatggaggtttctgaaaaaactataaacagaaccaccttatgattcattcagcggtcccgctactgggtatttatccaaaggaaaggaaatcagtatgtcaaagcggtacctgcacccctatgtttattacagcgctattcacaatagtgatgatatgaaaccgtcctaaatgtccatcggtggatgaacagataaagaaaatgtggcttatatacacaatgaaatactatttggccataaaaagtaaaatcctgtcatttttagcaacaaggatggaactggaggacattctgttaagtgaaataagccaggaacagaaaaacaagtatcacatgttctcactcatatgtgagagctaagaacactgatctcatggaggtagagagtagaatgacaattaccagagactgggaagggtggggagataaagagatgttggctaatgggtgcaaacatacagttacatagaaaaactaagttctagtgtttaatagcacactggggtgaatacagttaacaataatttattgtaaatttcaaaacaactaaaagaaaatatttgaaatattcccaacacaaggaaatgacatatgtttgaggtggtagatattccaattaccttgacttgattgttcattacacctcgtattcgtgtatcaaaataggacgtgtgccccagaaatttgtatgattattatatatctttttttttttttttttttttttttgagatggagtctcgctctgtcacccaggctggagtgcagtggcatgatcttggctcactgcaagctccgcctcctgggttcatgccattctcctgcctcagcctcctaagtagctgggactacaggcacccgccaacacgcgtggctatttttttgtattttttagtagagatggggtttcactgtgttagccaggatggtctcgatctcctgacctcaagatccgcctgcctcggcctcccaaagtgctgggattataggcgtgagccaccgcgcccggcctctattttcaaaatttaccttcatatttaaaggctctgatctatttttcattgcagactttttttattgacttccaccataaaagataaggatttctctctctctcttttttttttttttgagatggagtctctctctttcacccaggctggggtgcaatggcacaatcatggctcactacaacctcaacttcctgggttcaagcaatcctcctatctcagcctcccaaatagctgggaccacaggcacatgcccccatgcctggctaatttttaaatttttggtagagatggggctgccttatgttgcccaggctggactcaaactcctgagctcaagtgatcctcctgcctcagcctcccaaagtgctggattacaggggtgagccaccacacccagttgggatttatctcttacaacaacctcccctctctcccacacacatagacacacttccactcttccatctcacagtaagttgtatggcaatatataaaaatcaagattcagtatttgtattattgctaagtaaacactgttcctagctgagtcttgtgatgtcagattacattttctttcctatacagagtcttcacgtctaccctacccccacattcagaattgccttttttttccattgttaaacaatagatgttggcaaagatgcagagaaggcccagcacggtggctcacgcctgtaatcccagcactttgggaggccaagatggctggatcaccaggtcgggagatcaagaccatcctggctaacacggtgaaaccctgtctctactaaaaatacaaaaaaattaactgggcgtggtggcgggcacctgtagtcccagctactcaggaggctgaggcaggagaatggcctgaacctgggaggcggagtttgcagcgagtcgagatcacaccactgcactccagcctgggtgacagagcgagactccatctcaaaaaaaaaaaagatgcagagaaaagggaacacttatacactgttggtagggaagtaaatcagtacaacctccctggaaaatagtatgaagatttctcaaagaactaaaaatggaactaccccctttgatccaccaatcccatgactgggtatctttcccaaaggaaaataaatcattttatccaaaagacacctgcactatgtttattgcagcactatttctaatagcaaaatcatggaatcaacctaagtgttcatcaacagatgactggattctaaaatgtgatatagatacaccatggaatactactcagctataaaaagaatgaaaccatgtcttttgcagcaacatggatggacctggaggccgttatcctaagtgaaataactcagaaacagaaagtcaaaaaccacatgttctcacttatacgtgggagctaaacaatgtgtacacatggccatacaaagtgaatcatagacactggagactccaaaaagtgggagggtgaggaggcgggtgagggatgaaatattacctattgggtacaacatacactatctgagtgatgagtacactaaagcccagactataccatcaggcaatatatccatgtaacacaactgcacttgtacccctaaatctataaggacaaacaatacaatcaataattttgaaagacaacaaataattgccttttttgtttgctttcttttctatgtacccatcactcatttttctcagaactgccccctcacccctccgtgtaattagatggccaggtaatgggccacttttttcctctgagatatccctcccccagccacagcctcctgctcttatctggctctgagagctcagagctgccatctcagaacttccctttgatcttattctggagattttcatccctctcctgagctgcttttctccccatctttctctttctttgttcacccctgcattttggtggagctcctgttccagtagtttcctgggaaaagggttggggggttggaaatcgttttaaagtcttacattctgaaaaggcctttagtctgtctttataagatttcaagtttaggccaggctcagtagctcatgcctgtaatcccaacactttgggaggctgaggcaggagaatcacttgaggccaggagtttgagaccagcctaaacaacatagtgagaccctgtctcaataataataataataataataataataataataataataataataataataatgagatttccaagtttggctggggattgaattggagaaagacatgtcctgtaattttgaaggtcttctacctgccaatgctgcaggtgagaaacctcatcccattcccattactgatcttaatatgtgacttcttttctctacaccaccggctactgggattctctctttattcttgatactctgacaattcaagattcggtgccttggtgagggtctgttttcatcgttcttgttgggtattctgtgggtccttcgaactgttgatttatggcctcagtgctgaaaatgttttttatagtagtttattgataacctctcctcagttttctctggtctttcccactgaaacgtcttcagtatgatatttgacctttcttattttccatctctttttgttcgacttctttggagagttccatgaattttttttttaacttattattattatactttaagttttagggtacatgtgcacaatgtgcaggttagttacatatgtatacatgtgccatgcttgtgcgctgcacccactaactcatcatctagcattaggtatatctcccagtgctatccctcccccctccccccaccccacaacagtccccagagtgtgatgttccccttcctgtgtccacatgttctcattgttcaattcccacctatgagtgagaatatgcggtgtttggttttttgttcttgcgatagtttactgagaatgatgatttctaatttcatccacgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatagcagcatgatttatagtcctttgggtatatacccagtaatgggatggctgggtcaaatggtatttctagttctagatccctgaggaatagccacactgacttccacaatggttgaactggtttacagtcccaccaacagtgtaaaagtgttcctatttgtccacatcctctccaggacctgttgtctcctgactttttaatgattgccattctaactggtgtgagatggtgtctcattgtggttttgatttgcatttctctgatggccagtgatgatgagcattttttcttgtgttttttggctgcataaatgtcttcttttgagagaagtgtctgttcatgtccttcgcccacttgttgatggggttgtttgtttttttcttgtaaatttgtttgagttcattgtagattctggatattagcactttgtcagatgagtaggttgcgaaaattttctcccattttgtaggttgcctgttcactctgatggtagtttcttttgctgtgcagaagctctttagtttaattagatcccatttgtcaattttggcttttgttgctattccttttggtgttttagacgtgaagtccttgcccatgcctatgtcctgaatggtaatgcctaggttttcttctagggtttttatggttttaggtctaacgtttaagtctttaatgcatcttgaattgatttttgtataaggtgtaaggaagggatccagtttcagctttctacatatggctagccagttttcccagcaccatttattaaatagggaatcctttccccattgcttgattttctcaggtttgtcaaagatcagatagttgtagatatgcggcgttatttctgagggctctgttctgttccattgatctatatctctgttttggtaccagtaccatgctgttttggttactgtagtcttgtagtatagtttgaagtcaggtagtgtgatgcctccagctttgttcttttggcttaggattgacttggcaatgcgggctcttttttggttccatatgaactttaaagtacttttttccaattctgtggagaaagtcattggtagcttgatggggatggcattgaatctgtaaattaccttgggcagtatggccattttcaggatattgattcttcctacccatgagcatggaatgttcttccatttgtttgtatcctcttttatttcgttgagcagtggtttgtagttctccttgaagaggtccttcacatcccttgtaagttggattcctaggtattttattctttttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcgtctgcaaacagggacaatttgacttcctcttttcctaattgaataccctttatttccttctcctgcctaattgcctggccagaacttccaacactatgttgaataggagtggtgagagagggcatccctgtcttgtgccagttttcaaagggaatgcttccagtttttgcccattcagtatggtattggctgtgggtttgtcgtagatagctcttattattttgagatatgtcccatcagtacctaatttattgagagtttttagcatgaagcgttgttgaattttgtcaaaggccttttctgcatctattgagataatcatgtggtttttgtctttggttctgtttgtatgctggattacatttattgatttgcgtatattgaaccagccttgcgtcccagggatgaagcccacttgatcatggtggataagctttttgatgtgctgctgaattcagtttgccagtattttattgaggatttttgcatccatgttcatcaaggatattggtctaaaattctcttttttggttgtgtctctgcctggctttggtatcaggatgatgctggcctcataaaatgagttagggaggattccctctttttctattgattggaatagtttcagaaggaacggtaccatttcctccttgtacctctggtagaattcggctgtgtatccatctggtcctggactccttttggttggtaagctattgattattgccacaatttcaggtcctgttattggtctattcagagattcaacttcttcctggtttagttcttgggagagtgtatgtgtcaaggaatttatccatttcttctagattttctagtttatttgcatagaggtgtttgtagtattctctgatggtagtttgtatttctgtggaatcggtggtgatatcccctttatcattttttattgcatctatttgattcttctctttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctctggcttttctagttcttttaattgtgatattagggtgtcaattttagatctttcctgctttctcttgtgggcatgtagtgctataaatttccctctacatactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaagaaaatgtatattctgttgatttggggtggagagttctgtagatgcctattagatccgcttggtacagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttagcattatgtaatggccttgtttgtctcttttgatctttgttggtttaaagtctgttttatcagagactaggattgcaacccctgcctttttttgttttacatttgcttggtagatcttcctccatcctttcattttgagcctgtgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgctgcagtttcttcatagccttgatggtctttacattttggcatgattttgcagcatctggtaccggttgttcctttccatgtttagcgcttccttcaggagctcttttagggcaggcctggtggtgacaaaatctctcagcatttgcttgtctgtaaaggattttatttctccttcacttatgaagcttagtttggctagatattaaattctgggttaaaaattcttttctttaagaatgttgaatattggcccccactctcttctggcttgtagagtttctgccgagagatccgctgttagtctgatgggcttccctttgagggtaacccgacctctctctctggctgcccttaacattttttccatcatttcaactttggtgaatctgacaattatgtgtcttggagttgctcttcttgaggagtatctttgtggtgttctctgtatttcctgaatctaaatgttggcctgccttgctagattagggaagttctcctggataatatcctgcagagtgttttccaacttggttccattctccccgtcactttcaggtacaccaatcagatgtagatttggtcttttcacatagtcccatatttcttggaggatttgttcgtttctttttattcttttttctctaaacactccttctcacttcatttcattcatttcatcttccatcgctgataccctttcttccagttgatcgcatcggctcctgaggcttctgcattcttcatgtagttctcaagccttggttttcagctccatcagctcctttaagcacttctctatattggttattctagttatacattcttctaaatttttttcaaagttttcaacttctttgcctttggtttgaatttcctcctgtagctcagagtaatttgatcatctgaagccttcttctctcaactcgtcaaagtcattctccgtccagctttgttccattgctggtgaggaactgcattcctttggaggaggagaggcgctctgctttttagagtttccagttttctgctctgttttttccccatctttgtggttttatctacttttggtctttgatgatagtgatgtacagatgggtttttggtgtggatgtcctttctgtttgttagttttccttctaaaagacaggaccctcagctgcaggtctgttggagtacccagccatgtgaggtgtcagtgtgcccctgctagggggtgcctcccagttaggctgctcgggggtcaggggtcagggacccacttgaggaggcagtctgcccattctcagatctccagctgcgtgctgggagaaccactgctctcttcaaagctgtcagacagggacatttaagtctgcagagattactgctgtctttttgtttgtctgtgtcctgcccccagaggtggagcctacagaggcaggcaggcctccttgagctgtggtgggctccaaccagttcgagcttcccagctgctttgtttacctaagcaagcctgggcaatggcgggcacccctccgccagcctcgctgccaacttgcagtttgatctcagactgctgtgctagcaatcagcgagactccgtgggcataggaccctccgagccatgtgcgggatataatctcctggtgcgccgttttttaagcccatcggaaaagtgcagtctttgggtgggagtgacccgattttccaggtgccatctgtcacccctttctttgactaggaaagagaactccctgaccccttgcacttcctgagtgaggcaatgcctcgccctgcttcggcttgtgcacagtgcgtgcacccactgacctgcacccactgtctggcactccctagtgagatgaacctggtacctcagatggaaatgcagaaatcacccatcttctgtgtcgctcatgctcaagttccatgaattttatattccaactctctcactaagtttattgtgactatcatatttttcatttccaagagctacttcttgttctctgggtgttcctatttaaaaaaaaaaaaaaaaagcatcctttttatttgatggatcttatctttcagaggatgatgacaactgttttaaagtttcttactgtaccttacatcatctttgtttcctgaactcctttgcagttctgtttatttgtgcatttgctttgggccctctcttgaacattggaggctgtctggtatggataaaaaaaatacataagccaaacaaaacaaaacaaaaactacacataaataaacctccctggctgggcctggtggctcatgcctataatcccagcactttgggaggctgaggcgggaggatcacttgaagtcagttcaagaccagcctgggcaacatagcaagagcctgtgtcttctaaaaataaaaaaattagctgggcatgacgatgcatacctgtagttccaggtattcaagaggtagacatgggagaatcacttgagctcaggagttcaaggctgcagtgagctatgatcacaccactgcactctagcctgggtaacagagtgagaccctgtctcaaaaaaaaaaaaaagtataatataaatacatgctcctctttaagaaaaaaaatagaggttttcttttcagtaaagtgctttgctgggtaaattcattagtgtagaattttaaattccaaatcagactgcattttgctatgcattgtattttctgttctttggatcacctgacacccaaagaatagtaagaaacttcttttgaattaaaatttgtttttaatataagaaacacattgtaaactcactggtaaaagtgagtactccttgtacatctccatcagagctcttaagtgcattgtcagtgggcagtaatattttgaaaggaatctttttctgagcagtaggtctcaacagtttgcttaaaatattcagtacaccatgctgtaaacagatgggctcttattattctttgtttttttttgtttgtttatttgtttttgagacggagtcttactcttgtcacccaggctggagtgcaatggcgcagtctcggctcactgcaacctccacctcccaggctcaagcgattctcctgcctcagcctccagagagcagctgggattacaggtacccaccaccacgcccggctaatttttgtatttttagtagagacagggttttgccatgttggccagtctagtctcaaactcctgaacttaggtgatccacctgccttggcctcccaaagtgctgaaattacaggtgtgagccactgcacccagcctgaacactcctattcttgaactagtcaccaaatttgtgaaattttgtttaaataattacaataatcataaatctacagggaaataaaagattaatgattcaaagtgatgtgaacctttcataaaaaacatggttttcaaaactcagcgcatggccctctcacataagaataattctacatattctcctactgctgcagcagaggggtggttgttttaaataaagtgatttctgaacattttccctaaaatctgaacacagaaagtttgttgttttcttaccaatggctttctcctcctctggtgaccccaggctatctgggtggttgagtggggctgctctaagcatggggacaaggcacaagggctgttgggcttctctacagagtggccaggccgagacctacctatttcgttgggagaatccagttttagtagctataggtcttttctcctgggctggccagtttttccagagaatcctctgatctcccactggaaagtagcagctgggctgctcagaactgggtgaaagagggtccctagggactcaggacacaggacgggaatttcactctatttccttgatttcaatgcatgcttttctcctccctctgctgggcttagttccctggaatccaggtctgtctgtcctgtttctccagagaatgaacttcctgtgtcccacaaggggtgaggggaggagaggtgggctctgagtgtacgttatacagacttcacgccttcctgccctctcctctgccttctgagggagatggcacctgcctccgcttccttgcttctcacaggccccttctacttactccattttgtcttcgaaagggttgttggcatcacttatctttgttcttagaagttgacatgttttttcttttttgagacaaggtctcattctgttgcccaggctggagtgcaatggtgtgatcatagcacactgcagcctcaaactcctgggctcaagcaatcttcctgcctcgacctcctgagtaactaggactacaggtgctcaccatgatgcccagctaatttttaaattttttatagagacagagtcttgctgtgttgcccaggccagtctcaaactcctggagtcaagtgatcctcctgcctcagcctcccaaagtgctgggattgcaggggtgacccaccatgcctgtcctgcaaatgttattaacagcatcttaaaatggttgatcttttccagaaggttttcagtttactttgtccagatccatcagaggaattactatctgggactatgaccttacaaaaggccttactatggccttgcaaaagctatgggcttataaaatgtattttttaaataatcagacttaaaagttgaaattactccttgatctataggctgcagagtatgaaagcaacattactccttgtacatctccatcagagctcttaagtgcattgtcagtgggcagtaatattttgaaaggaatctttttctgagcagtaggtctcaacagtgggcttaaaatattcagtacaccatgctgtaaacagatgggctccaactattccatttatagagcacaaacagagtagatttagcaaccctcaaaggcactaggattttctttttctttttctttttctttattattttttttttttgagatggagtctcactctgtcacccaggctggagtgcagtggtgcaatcttggctcactgaaagctctgcctcctgggttcacaccattcttctgcctcagcctcccaagtagctgagactacaggcgcccaccaccacgcctagctaatttttttgtatttttagtagagatggggtttcaccgtgttagccaggatggtcttgatctcctgacctcatgatccacccaccttggcctcccaaagtgctgggattacaggcgtgagccactgcgcccagccagcactaggattttcagaaaggcaaatgagccttggcttcaactttaagtcatcaggggcattagccctaaagaagagagtcagcctgtcctttgaagctttgaagccaggcattgacttatctagctataaaagtcccagatggcatctttttctagaaacaggctatttaacctacattgcaaatgtttttggtgtagccactttcatcagtgatcttagctggatcttctctggataacatgctgcaacttctaaatcagcacctgctgcttcaccttgaatttttatgtgatggagatggatttacctcatgaacaaatctctgctagcttccaagtactgttctgcagcttcctcacctctctcagccttcatagaattgaagacagttagagtcttgctctgcgttaggctttgggttaagggaatgttgtggctagtttgatcttctgtgcagaccagtcaaactttctccatatcggcaatagggctgttttgctttttaatcatttgtatggtcactggaatagcacttttaatttctgttaagaactgttcctttgcatttacaacttggctacctgtctgacacaagaggcctaagtttcagccgatctcagcttttgacctgccttcctcactatgcttaatcattcctagcttttgatttaaagtaagagatgtatgactcttccttccactcatacactttgaggtcattgtaaggttattaactggcctaatttcagtattgctgtgtcttggggaataggcccaaggagggaggaggaagggacagagagagagagatggggaaatgactggtgggtggagcagtcagaacacatacaacatttatcaattaagttcaccatcttgtatggatgcagtttgtggagcttcaaaactattatactaaagccaggcactgtgatgcatgcctatagtcccagctacttgagaagctgaggcaggaggattgcttgagctcaggagttcaaggtcagcctgggcaatataacaaggctgtctctaaaaaaacaaacaagcaaaactaacaacaaaaaatcacactgataacatcaaaaataactgatcacagatcaccataacagataaaacaataataaaaaagttagaaatattgcaagaattaccaaaatgtcacacagagacacaaagtgagcacatggcaccaatagatttgctcaatgcaggtttaccacaaaccctcaatttgaaaccaatgcgatatttctgcaaagtgccataatacaaggtatgcctgtattgaataatgcaatgttcaaatcttctagcaaagtgaacagaactacacagaatcatgctttgaaattgccaatttaggaaattatatttgttttcaaaacttgttatttcttggaactccactcataggatttgttaaaagtgtgtataaaaaatacataaacctattaatattattttatttgcaacaataactcatagaaccaagtagagccacaaacatgccctcataatattgcaacagctatacacaagcgagattatgtgatgaccacgtctctcctatgcattcctgtgcccattcccaacaatgtccaccttaaccttcaatttggagttgtcagcattttcctgctccaaattttgacttgaagtcaatggagtccttcaaatcggaaatttccctatgttgattaagcttcagtgctcatagaactatcatacttttgcctgttttatcaaattcatttttctcaggttttgggatttgaaaaaaatatatgatttcccaaaaaaaaatgcccagaagaaatccctgcatgaaaacactaggccatgatctttgcctgattgctaaaggaagaatcttgttaaacgaaataatatcataaatgagaacgtgcatgggggtagtgaaagcaatgggttaggccctggttgctgcctgttagaagagccctggccctcacacacccacagcccaggcacgatgtgatgtaaccctttattatttcccaggacatctcagatctgttttcctctgaaatattaggactcacatcagccctttggtcacagttaacagtgcatcatttacatctatgtgtgactttgtcactctgtggcacccaagtagaaagaagaaggtaaaggcacattagaagaatccattctattccctttctgctgtcctagctgtcaaatcagcagaaagcttagacagaccgtatgtttactggaagggagggtagagccccagagaggcttcggactgagacctgttctgccttctgtctggaaagggaagaaattcctccaccagaagcaacaagagttgggaagcagagatcaaagaaagcaggcaatttctgcaggaagggggaagggaaaaagggagggaagagtgatgggtcccaggcgggggcggatttagcatgaaactaatgaagcttcagcctcagcacccctcgcttgcaaggacccttccaagttcctgggtgaggcccctagaaattggtttaaaatttgcaaaatttggaaaagtgagatatattaacaacaatcaagactacagccatgtgtggtagcacttgcctgtagtgccacctactcagaaggctaaggctgggggatcacctgaggccacgagttcaagatcagcctggacaacctagtgagccttccgtctctaaaaaaataaaaataaaaaattaagactacaggctgggcatggtggctcacacctgtaagtaatcccagcactttgggaggccgaggcgggcggatcacctgaggtcaggagttcgagaccagcctggccaacatggtgaaacgctgtctctactaaaactacaaaaattagctgggggtggtggtgggcacctgtaatcccagctacttgggaggctgaggcaggagaattgcttgaacatggaaggcagaggttgcaatgagctgagatcaagccactgtactcaagcctggatgacagagcaagactcgtctcaaaaaaaaaaaaaaaaaaattaagaattaagactacagtcttttccctccctgacatccctcagtcacacttcctttcttgttgggtggtatttggagtggctgtgggcatttttaatctctatctaaggagaaattgagttgagagtatgttcacttatgtgatttgcagtcactttcaagtatagtttctagcagcccctccctcagtcaaggaatggcttctaggggcatctccattgtctactgtattgacttaataccaaaggtcctatccaaatataaatgtgactttcaatacctggcaccggaagtaggtgggaagtggaacagaaagaatgttgaaaacatatggagtcagaagctagtttgtagaaaattctttcagctatggtaaatgtaaaaggcagggttcgcttttcactgatgtctagtcaacattttcttcttccaggatattcccccttgctgtgactatttttttttttcttttttgagatggagtctccctctgctgccaggctggagtgcagtgatgcaatctcggctcactgcaacctctgcctcttgagttcaagcagttatactgcctcagcctcctgagtagctaggactacaagcgcccgccaccatgcccagctaatttttgtatttttagtagagacggagtttcaccatgttggccaggatggtcttgatctcttgacctcgtgatctgccctccttggcctcccaaaatgctgggattacaggcgtgagccaccgtgcccggcctttttttctttctttctttcttcctttttttttttttctgagatggagtttcgctgttgttgcccaggctggagtgcaacggtgcaatctcagctcaatgcaacctctgcctcctgggttcaagcgattctcctgcctcagcctcctgagtagctgggattacaggcatgcactaccacgcctggataattttttgtatttttagtagagacggggtttttccatgttggtcaggctggtcttgaactcctgacctcaggtgatccacccgcctcggcctcccaaagtgctgggattacaggtgtgagccaccatgcctgacctgtcgtgactattcttaatactgctgcgaatacaattataaacgcactgtacatttatttatttgttgggattgaaaaaatagaatgtatgaaattcttgagttaaccataaacctatagcaatattacagaaatttttgatcaactatgctggaaaaaacactaaattatctttctattatttctatagaaaatggcactacaaaattgttggcatttgaagcggtcatcaaagagtaggcagacagaagcacatggaaaaatattatagaagtgtatcagttaataaaaacgtgaattttctggattttgtgatgtttgtggtatttgtcagcctttaaaaatttataacttgatgtcatctattttctcattctaaatatttacttttatattcaactttgtatttttttattttgtgttatttttcttgaagagatctccaaattatataagcttcagacttcacaaaacttgatctgtgcctggactgtggtgtggggcccagggatttataccaacagccattcttggccctcagcagcctctagggtccctagcccattctccaaagtccgcatcccagccctcatctcaggccctgagagccatcaacaacataaggctgaggaactctttgcttctctggggagcaggagggtgggtgagccagtgagacatgcatttgctggattagacctctggggacttttcccccagcaaagtcctgcctggcagggtggttggccattgtgtcagtacccaccaccctcctgtgaagggtgagcccctggcccttgtggcctgggctgaggtctcaaccaccagcagcagtacttgaggctgagtctgctgtagactttaaaaacaggactggtggccagacacagtggcttatgcctataatctcagcattttgggaggccaaggcaggagaattgcttgagcccaggagttcaagaccagcctgggcaacatagggaaacctcgcctctagaaaaactttttaaaagccaggcatggggccaggcgcggtggctcactcctgtgatcccagcactttgggaggccgaggtgggaggatcacttgaggtcaggagtttgtgaccagtctggccaccatggtgaagccccatatctactaaaaatacaaaaattagcaggacgtggtggcacatgcctgtaatcccagatacccgagaggctgaggcaagagaatcgcttgaacctgggaggcggagtttgcagtgagccaagaaggtgccactgcacttcagcctgggcgacagagcaagaccctatctcaaaaaataatttttaaaaacccaggcatggtggcgcatgcctacagtcccagctactcgggaggctgaggcctgcttgagcctgggaagccgaggctgcagtgagctgtgatcatcccactgcactccagcctgggtgacagagcaataccccatctccaaaacaaaaacaaaaacaaaaacaaaaaacaggaccagcaggaatagtctgctgtggattgggacccctgaatgttccagagggatttaagtgtgcggaattcagacgtcttccctgttgtggctggccttcccgcctccccagccgtctgcccgaatgagtgcttactaatgagccagagagctctgagccggcctgtgtagggcatccatgcagggctccaggggcccctctcagtgaaacaacatgactgtgaaaacaatctgctgctcttcttcttcaccctgaccttgggtcattctggcgtaaaagattactttgctcccagcctcggggaagtttttgtacaattagctacaactcggcagaaagaccctgcagagagagccctggggtcaccaactcaagcatgaaaggacactgaccccgtgtggtcatgtttggaggtgcagcacggggagagaggaaaggccccggcacggtcctttggccaaacgacccctgcaggccctccctgaccgaccttgctctgtccctgctcacttcacaagaccctggggagaggacctggccctatcagggcctgctgactcgttctcccctggcgaaatgtccccaccaggtgctctcaactctggggtatgacttcacaggccatttgagttcagatgggtaaggcgtgtaggaaatgagctcaaagggtaggatggattttgatggggtaagaagagagtgtttctcactcacccaaagcactgagcacagtgtcccaaacataatgtggagtaaacacgcgcatgcacacgtgcacttcaggtgcaggagacagcctaagcaggggcaggcaggcaggcaggtatggaatgtgcatggagggctggagagtggagctgcttttctgcggagatttcaggttaggtggagcactgagctgaattttctagaagctggattcctaagccccagttctgggctctttctctgaccacacagctgtgtagaaggaaaggggcctgagttctgccatctgggctaggagtcggtatagagccagccagttgtagcatttctgattccatctgaattcctaacacatcaaaatcagattccattctggacattcgtttttttgttgacgctgtgattgaggtctcataaaaagaaggtgccatgcctaggacaaatgaggaaggagaggctcagaaaagttaaatagctgtgtcttaagtcacagccactcagtgtgtgaaaagccaagctggggtttgaacatgataaaaatacaccatggccgctgggctccaaagtgcaacctgcagcttctaaaggaactaaaacctaacttgtttccttctcccccagctcaatccactctccccgctgtagcagagccatcgcctcaaggcaaattgcatcccactgctcaaaactgagcaactcttctctggtctcaggataaaaatggtatgtgtgtcttggcttcacagacctccctaacctcaccccttgctctcgccacatcactcgccattcttccctcctgtgacatggaacttcagccttggttccatgccttggcctcccaaaatgctgagattataggcagttccctaaacagccagcctctcagatgtggaggaccttgatttgtaaacaaatcaccaggggattttgataaaatacagattccaattcaccaagcctggtttgggggtccaggttctgaagctctaagaagctcccaggtagtatgaatcttccaggtccacagaccacaggtgagtaaagaggtgctaaacacaccatgttcccctcacctttgaccgccaccaaacttcctttgatctgaaacttttctccttcctccccaaggccccctcctgtatctttcacccgggtggtaaggctacttcctctccaggcctcagcttaggtgctgctgcctcccggaagtactcttaacccctttgagaatgattaggtcatgtcttatctgttagagatgcaaataatcccagcactttgggaggccaaggcaggcaaatcagctgaggtcaggagtttgaatccagcctgggcaacatggcaaaaccccatctctactaaaaatacaaaaattagccaggcatggtgatgcacacctgtaatcccaactacttgggaggctaaggcacaagaatcgcttaaacttgagaggcagaggttgcagtgagcagagatcgcatcactgtactccagcctgagtgacagggcgacactctgtctcaaaaaaaaaaaaaaaagaaagaaagaaagaaagaaatgggtgaaacgggccaggcacagtggttcacacctgtaatcccagcaccttgggaggccaaggatcacttgagaccaggagtttgagaccagcttgggcaacatagtgagaccctgtctctacaaaaaatacaaaaattagctgggtgtagtggtgcgtgcctgtagtcccggctactctggaggctgaggtgagaggatcaccagagctggggagatcaaggctacagtgagctgtgattgctccactgtactacagactgggtgacacagtgagaccctctcagaaaaaaaaaaggaaaaagaaatggatgaaatgataatgataggtgggatttgtcttaaaatactcaagaaaaaatatgggaacaggtacatgaaacaaaaatggcaaaatgtcgatcattttgattgttgttgaagctgggtgatgaatatgtgagagctcattgtactatcctctcaatatttgtgtttgtttggaagttttcaaaataaaaagctttaaaaaaatttttaatagacatagggtcttgctgtgttgcccaagttgctcatgagctcctgggctcaggcagtcctcccaccttggcctctcaaagtactgggattacaggtgtgagccaccatacctagccagaataaaaagcttaaaaaaatgaagcctgagataagtgcctctcccatgtacccccttaggcgactgtcctgtctgcccccaccctacagcacgtatcgtactgcctcatgagtgtatagtttttcaagggctgagattgtactgtgttttgttcatttttctacaccagcccctagcacagtggttggcacagagtaaattctcaacatatttttgttgaatgattgaatgaaaatcctgccaggttatgttagttggcagaaaagaagcaaatcattgaaaatgtatgtcgaaatgaaacaacgcatattgttccaccttatgtagagctgtgctgcatctgctcctggaatcctctgtaaaggtcactgtgtcccaaggaagattctgtgtcacatgagagaatccatttaaatcgttaagaagaaagcaaatgtagacactggaactctgccatgtataaggaagaagggtgaatgggtatgtgatccaaaggtgttgaaaacagagagtcattcattcaatcaccaaatattggttcactgtctaagcttcagctttgcctgcaacgctggagactacttctccaaagtagttacttgcatgagattatatgaatggaagcctgtgtatattggccaaatgaatgaggcagaagtgggttttgcggggggtggggtgttgtttgttttgtgcagggataccccaaaagaaaggggagagaacagggcagtgggcgagatggtgagatatctaggccccaccccagtgggaccaaaggggtaactcagagctggaggctaaagagctgactttgtaagacctggggtgtcagtctaatgacagtctgaggcaaccccaggaaccccaggattcgagaatgagcccttcttggctccactgcccatacacatctgctcagacccagtactgctttaatgttctgaggtctctgggtgaccaccagcagcaggcgacagggaaaaaggcctgggttttctggcctgaacaatgggatgaatagggataaacattgacaggcatgagaaataaagtgggaagagcaagctcaaaggagacatagtgtgttcactcaccaaggctgttcaccagagaagcccctttcatgtaagtgagagatacgcttgagaaaaccaaaagagagactcacctgtttcccccaacaagcttccaggtcttgttatcctcagaagcaggaccaggccgggcacggtggctcacacctataatcccagcactttgggaggccgaagcagatgaatcacctgcggtcaggagttcaagaccagcctggccaacatggcaaaacccgatctctactaaaaatacaaaaattagctgggcgtggtggcgggcacctgtaatcccagttatttaggaggctgagacaggagaattgcttgagccccggaggcagaagttgcagtgagctgagattgtgccactgcattccagcctggacaacagagcaagactctgtctcaaaaaaataaataaataaataagaagcaggaccagaggttggagctctaaacagaatcagaaaatcaaggtgggtttcagagtcaggagagccacagcatcaagggaatacagccacatcatggcaagatgaaaatttctgaggctgacagtaagaaaggtgaagtaggctgggtgtggtggctcacacctgtaatcccagcactttgggaggctgaggcacgcagatcacctgaggtcaggaattcaagaccagcctggccaagatggcaaaaccccgtctgtactaaaaatacaaaaattagctgggcgtattggtgcacgccagtaatcccagctactagggaggctgaggaacgagaatctcttgaacctgggaggtggaggttgcagtgagctgagtaagctgagatcgcgccattgcacaccaacctgggtgacagaacgagattctgtctcaaaaaaaaagaaaagaaaagggggtggatggaattctttgatggcacatccctgactcagagtggtaaaactcacataccgatgaccttgtgttcagtcttattcatttctctatgccaggtccctagcacagtgtctaatgcaaaggaggtgccgagtcaatgtttgaaaaatcaatgaatgagatgaatgcacttggaatggtgttgatttttgctttgcctccaagctagaacaaataattgagctcactcgtatccatgttatcattactatccaggctactgtgttaatatagcatttaataactcccttgttctcccaaactttagggaaattgaagcttcagtaatgagggaaatttttgcttgattgttttctgtgggaagtcaaccacagctcacatctggtgccctccatgaagtcttcatcattaacaggattttgtacattttctcctttctgtaaatccagaccttggagaaagagatcctcctcatctttccattaagaggaagtttaattgcatctagactctggttggttagggcttgattttaggtgggcaaagcagacttcagcaaaataggcagagccaagagaggctcctgttgtttgggtcgctgtttttagcagtgaggaaagaccctggggctagaaggatgattggtcactaggtgtgaactacacgttggagatttcatctgcctgggacctagcagatgtccccatgaggtcttctttgccagctaccccatcctgtcttccagagaatgctgcatccagaggtctcttgtcctcttttgctccctggaccttattacttgatcatctagctcccagctatgttccttccactcccatccagggctactgacttccactctataagcagtaacagactggtgcctttcaatcaatagtcattcatttaacaaacatttattgaacccccaatatgtatctagcactgttctaggcattgggaatatagcagtaagtaagataggcaaaattcctaacctcatacagcttatattccaatggggggaatataatatatatatatatatatatatatatatatatatatatatatatatatatatattttttttttttttttttttttttttttttttttttgagttggagtctcactctgtcacccaggctggagtgcagtggtgcaatctcggctcactgcaacctctacctcccggaatcaagagattctcccacctcagcctcccagctagctgggattataggcctttttgtatttttagtagagacagagtttcactatgttggccatgctggtctcaaacttctgaccccaaatgattcactcacctcagcctcccaaagtgctgggattacaggcgtgagccactgcgcccagccaaaaaggaatgctatattcttgctaaacaaatgaacatgcccagaatttctgaaacaggatgcacagagcatccacctctaagagaggatggttcactccaacactcccctctctggccagcaactcgcaacaggcaaagcctgaaccaggggagccactataacaataagcaccgcaacagtggctgactttagtcacgtgccctactccattagccctcagaacagtgtaatgaccactagcattagaccattttgcagaagaggaaacagaggctaagagagatttaataacttggccaggttcacatagctatgctttggcagcgctggaattggaacatggtgaaatcctgtctctactaaaaatacactttgccctgctgctacacttttcagggacagaaaaggaaaactatctcaagagacaatgtgcaacgctgaaatggtgaaggaaaagcttttggggtagtgaaggggagcagatggcctgattcccccccaccctaaatagggtgtgtgtatgtgtgtgagtgtgcacagaaacacagatgcacatacatgaccacacatatgccccgagccttccaaccagaatccacaggcagcaccatctccctctccatagcctttgctgatccttgttcctgaagctagaaagggaggagggcccctagatgagtgtctgaggggcatgtcctcaggacagctctacttagtgacatttgtaagaccagtgctacagttatttcaagcaactatcatttcccttccaggataatctaagatgtgatttttactaatgaaatgaaaactaacactgagcatctattatgtcccagtcactgtgttaggcccatttaaatatgaattatgtattgtctctgactttaaaaggctcaagagagcctgccaactcctgactccaacctatttagccatattgcttgtgcttgtgcttaatttctaaattaaattggaatttcaaggaccctgctgattggcaagtggaattactaaatgatatttaacctaagtgaagttgaacatctcacgacttctggatggcaaggagaagatcaaggagaagtggaccaagaagctggctcttcaaatagccccacccttaccttcaggaaaccttatgtctgctgaactgggtgggagttctggcccctccttccactagttgtcacaactggaatggttaaaagcaatgattcccaccagaatggctaaaatttgaaaactgacaatagcaagaggagcaccaggaactgtcatgcattgctgccaagagtgtaaggtggtacagctactctggacaaatctttggcagtattcactaaacaggacacacatatacattatcagccagcaattccatgcctaggtatataagtaaagtttgtgcacatgtgcattaaaagacatgtataagaaggttcatcatagcacttttggtaacaaccaaaactgaaaacaacccacatgtctagcaagagtgggatggataacaacactgtggtgtatttacacaagggagtactctaagcaagaaggataaatgggctgagtgcagtggctcacacctgtaatctcagcactttgggaggctgaggcgggcagatcatttgaggtcaggagttcgagaccagcctggccaacgtggtgaaacctcgtctttactaaaaatacaaaaaaattagctgggtgtggtggcccatgcctgtaatcccagctactgggggaggctgaagcaggagaatcacttggacctgggagacaggttgcagtgagccgagatgacaccattgcactccagcctgggcaacagagcaagactctgtctcaaaaaaaaagaaggatacttggtctacagacacatgctactatgtgcacagctttcctaaacatcatgttcagtgaaaaagtcagataggagaaaaacacagcggcatgaacccatttacatagccatttatataaagttcaaaaacaggcaaaagtcatctatgttgcttttaaaagccagggtagaagttacctttgagaaagactaagaagatagagattgggagggttaggtcagggtttccgggatgctggtaatgttaacatttcttggcctgggtggctgttacatgggtgtgttcactttgtgatgatttattaatctataaccttatgacttttaagcttttgtgtaaatatattcctcctataaattttctaaaaacaattaggctacatcccaaaagacaagggatagagatataacctaaaaagtcagatatggtcacaggcccaggggcaaggggaggtgaggtttgcttcccaggatccccagtctcccaatatttaccaaagggacttgtgaaaaaggccaggaatgggaaagggggtgtcagggcctttgaggtgggtgggccaactacccagaactgccttggccatactgcatgactctaggcctgtaagcaaggtttctgagaggactggtctcccatcccttgccctcattcacatccccaaaagcaacttttgcccttgggccaatgctaattttctttctgaaatgatcatcagataaggttagatgcttcatatggcctcagttcttctacaaagaaaggtcaatactagtcaggcgcagtggctcacacctgtaatcccagcactttgggaggctgaggcaggaggatcacttgagctcagaagtttgagaccagcctgggcaacatgatgaaaccccatctctactaaaaattcaaaaaattagctgggcgtggtggcacatgcctgtggtcccaggtactcagaggctgaagtaggagggaaaaaaagaaaaagagaaaggtcaacacagataacccaatcaaaaaatacactacaggtttaggccaggcatggtggcttatgcctgtaatcccagcactttgggaggacgaggcaggtagatcaccgggtcagcctggacaacatggtgaaaccccgcctctactaaaaatacaaaaattagctgggcatggtggcaggtgcctgtaatcccagctacttgggaggctgaggcaggagaatcttttgaacccaggaggcggaggttgcagtgagccaagatcgtgccattgcactccagcctgggcaacagggcgagactctgtctcaaaaaaaaaaaaaaaatagactacaggtttaaacaggctcctcaccaaagaggacattcaattggccaagaaacatatacaaagatgctcaacagcattagttatctgagaaatgaaaataaaaattaaaaccgcaatgagaaaccattagacttcccccagaatagccaaaatgaaaaggactgacaataccaagtgttgggatgcagtgcaactctgtatcttatccattgcctgctgggactgtaaattggccaatcacttggtaaactgcttggcagtatccaaacatacccagcagttttactcctgggaatatacccaacagaaatgagagctgtgtccacatgttgaaacatccagaagagaatgttcacagcagctttattcttaatagccaaaaattggattcaacccaaatgtccatcacaggagggtgaataaatatattgaggcatattcatacaatgcaacacaactcagcaatacagaaaagaatgagatgctgcagcacacatcagcctggatgaatttcccataatgtagagttaagagaggccagacgtaagagcacgtactgtgtgatcccatttacatgaagttctaaataggcaacaccaatctatggtggtacaagtcaggacggcaatcctttgcaagattgtgaagtatgaactgggacgaggtgctggaaatgttttgtgtcttgggcggtggttacattgatgtatatacatgttaaagtccatctagttatacacttaagatagtgcacttcagagggcatgtgagttacacttcaataaaaatgtaagtttaaaagaaaggaagaagaaacaaaggaagaaaggaaagaaggaaagaaagagaaggaataagtgaaaggaagactggcaaaattctgccctctcatatgaaaaatggtatagcctttctagaaaataggcattttcttaaaaagttaaaacttcacctactatttgacccaacaatccacttttaggtatttatcctagagaaaggaaaactaatttgacataaaagcctgtatataaatatttatgccagcattgctcatacttgtcaaaaactggccacaacccaaatgtctttcaaactgttaggtctatacaataaaataccacttagtaaagaaaaagaatggatttggggctgggcgtgatggctcacacctgtaatcccagcactttgggaggccaaggtgggtggatcaccagctcaggagatcgagaccatcctggctaacatggtgaaaccccgtctctactaaaaatacaaaaaattagctgggcgtggtggtgggcgcctgtagtcccagctacttgggaggctgaggtgggagaatggcatgaacccaggtggcagagcttgcagtgagccgagatcacaccactgcactccagcctgggtgacagagtgagactccatcaaaaaaaaaaaaagaataaaaaagaatggactactgatatatgcaacaacatgcctgaatctcaaatgcattacactgagtaaaaacccaatctcaaaaggttacatgctatatgattccatttttatgacattctgaaaaagacaaaaatataagaacagaacacagatcagtagttgccagagtttaggaatgggggaaggtctgaatacaaaggggcagagtgagagaaatctttggggtgttagaattgttctgtatcttgcctgaggtgatagttacaaaagtctatatctgtgaaaaatgcatgcagtgtacaccaaaaagttaattttactttatgcaaataaaacatttttcaagtaaaagctggctggacatggtggctgaagcccgtaatcccagcactttgggaggctgaggcaggcggatcacctgaggtcaggaattcgagaacaacctggccaacattgtgaaaccccatctctactaaaaatccaaaaattagccaggcatggtggtggttgcctgtagtcccagctacttgggaggctgaggcaggagaattgcttgaactcgggaggtggaggctgcagtgagccaagatcgtttcactgccttccagcctgggtgacagggtgagactctgtctcacacacacacacaaaaaccaaaaaccaaaaaacaccccaccatttttcaaataaaagcaaaaaaaaaaaaaaaggaaaagaaaaaccatcaaacacacaacccaaaacaaaactctgccccccgtcatgggctctggccatccttcctccaagctcaagcaggaagagcagatggcagaggcctttgaggactaggataggacctggttgagagcagacattcatgagcttaatttcttatcctactgttcatgtggctttggaatgaccatggtcctgtgaaatgccattagctcactgtccattcttgtgtctttgccttttaatccttggacctcaccactcagaaatagctggagctgccccaactccccaaggaagaacttgctctctgacatcaagccaatgaagagtccctttggggcacacaggagaacttatcacccagtagatccttcttacccataacccatggctcctcccagctggtggggccagggccatgagctgttattcatccacatagagggaattatggaacagggccttcaaggtcccccttgatcatacagtgcccgccatgcccccacagggtcatggcccattgcacctcagcctatatgcacatgctggttgcttagctcagaactcctttctctttcccaaggctttgcccctgccctcctggaatgtcaccctttctcccccagatgtggcactatctgttaccttggcttgtagaactttctacacccaagttctactgattctttctcctaaatacccgcaaatgatctcatccttgcctgcttcagaccttcaggctctcttgcccagaccattgctaggcggatagcttctgtgatgccctctctgctctgaccccacacctcttcaattcccctcctcctaaaaaccccttggttccttacctaggcaggcacacaagaacctggccaggcccttgctgcttttcctgatccctactccttcccagacacgtcctcaacactcctataaaacctggccacttggggctaggcacggtggctcatgcctgtaatcccagcactttggaaggccaaggcgggtggatcacctgaggtcaggagttcgagaccatcctggccaacatggtgaaaccccatctctgctaaaaatacaaaaattacctggccatggtggcacatgcctatagtctcagctactcaggaggctgaggcaggagaactgcttgaacctgggaggtggaagttgcagtgagccaagattacaccactgcactccagcctgggtgacagagcaagacactgtctcaaaaaaaaaaaaaaaaagtctggccaccggctcttccactcctccatgtctctgttcatactgatccctctgcctggagtgtccttccctcccctctgtccacctagtaaacccctcattttctttaggccctactccaatccacctctctgtgaagcctttcctgaccacagtgccctccattcatctgccccaggaacattcattcattccacaagtagttatgccccacctatgtgctgggaattaggacagttaaggaccctgctcttggggagtacattcatctgggcaagactgataatccttgctatatcatcctgtataatttcagaatgattaaggtgaagggctgcagaatgataagacactcatggcggccttgctgaggggatgccaagtaagcagatacctgaggagttcctcctaaccctccgtgtcctgagcactctgcattctttttttttttttttttttttttttgagacagggtcttgctctgtcacccaggctggagtgcagtagtgtgatctcggcttattgcaacctccacctcccaggttcaagcgattctcccacttcagcctcccaagcagctgggactacaggtgcgtgccaccgtgccaggttaatttttttaggctggagtgcagtggcgcaatctcagctcactgcaacctctgcctcctgggttcaagcgatcctcctgcctcagccttccaagtagctgggattacaggtgtgcaccaccatgctaggctaatttttgtacttttagtggagacagctgtcaccatgttggccaggatggtctcaaactcctgaactcaggtgatccacctgcctcggcctcccaaaatgctgggattacaagtgtgaggcaccgtgcccggctgtgagcattctgcattctttatggtctctccttgggagggttgtgagacttaacaaataaaaacattgcataggacatacttataccaaaaaattgttcttgaaattcaaatttaatgggaccacctgtgttttatcaggcaaccctacccctaggactcactgccctgtgagttcagagaaggagcaccctcagggcccagcactgtggctggctgcagtaggcactcaataaacactaaaagaatgagccattaagcagatgcatgagcagcacttgctaagttgtactgtattttgcatttgcttgctgactccccacctgcatcgcaagcccctgcttgctgcgcaggcagtgttagatggcatcctctgtacctaatgcagcctgaggagtggtttagggagaatgtatctgcctcttaccatctattagtgcctcccctactaccccaagtaataatcaaatatgaaaaacaattttagaatgtggcaatatatgtaatgacatggaaactgagaaacattttctcaatcatatgtacatgaataaaaacacctttggaaaactttgctatatttataggctgcagtgtataatctatgaaaaaactgcttccatctagtgccctagctacccctttccaaccagacagcctctacgaaacccttcctcttttggaatcgtggagctggcaaaaagagctgaccagtagatgtctgttatacaaatgatggcagaattttactgtgattctgggcctatgtgtcaatcttcccactggactgggatcctgcacaggccagcaaggtgtccttattgtccccaggcccagcatgcagcagcagctcaggaaatggggattgaaaatctatcaagagccacatctcatagttgacgttaaagcttccccgaaggaaggctggttcaaatgcacaccccatgttgccctctggagatcagcaatcccatcaaggcccagcccaaaccacacactggcaagcagcccagaaagggtgtggtccaactgccccacaagtcctgtgaataagcccggtcttcactcccagttcataaaagggccactgtcccagggcagcctcagctcctgttggtttcaactcagaaggagaatgttgttgcttgagcctcttttgagctttaaaaaggacaaggaaaggcactgtacggagtgttttacttttgacttttttttcatgactacaaactgttggatattgaaaaccttgcatttacttgtgaattgccagtctgtgtttgcgtatggaggaaggtaagatttgcagggctggaattattttcattttccttgtaagtttctccagtacttagcttttcattgagcattctatatttatttctgtgtcattatgtcattctttggtgcattttataacctgtgatgctgaaagctgccttccttcacattgtgggctagagtcagatagggcaatacagtcacacagcatccaccagaagttagtgccatggaacacagtcctgaataagcacaccaatttgctacaagaatgatcacagaaagactgtgtataatagtatcaaagaataattcaaagacatagggttaattattagggcaccatttacttgaatacaagggaaaccaaaaatagctttatttcatatatcagagccaaaataagaaataggaaaagaggagaaaggagaaaaatgaaaaactgcagacgtgtgaaagataatgaactttgccttttcttgagtaagctgctgattagcaggcagctagctaagaaggccagagggtgttctgcccttgacatctggatgaatcatcaaagaggataattccagttgcttatggattctccaggagcccttggagtggaactgtgctgtatctgtgacaagttccctctgtgtcacatgtgcctgggtcctgggagaacacctccatctctgttatgcctctctgccctatgacctttatgtaaaaagtctcaatgtaagcagcctaaatgtctaacttaaaaggaaccagctaaacaaacctcagtataacctcagcatggaataccaaagatctttttttttgaaactgagtttcactctgtcgcccaggctggagtacaatggtacaatctcagctcactgcaaactccacctcccaggttcaagcgattttcatgcctcagcctcccgagtagctgggattatgggtgcccaccatcacgcctggctaatttttttatttttagtagaagcggggtttcactatgttggccaggttggtctcaaactcctgacctcaggtgatcctcccgcctcagcctcccaaagtgctaggattgcaggcgtcagccaccatgcccggccccaaagatcttttaaaaatgttgtgatttaagaaaatgttgtagtaaaaatatgtaataatgtagaagttgttcatgatataccattaagttatgagtttgtggggacacactcattccatagcattaaatctgtatcagtcaaggttctctagagaaacagaaccaataggatctatgtatacatatatctctagaaagggacttatgagaaggtattggctcacgtgaatatggaggttgagaagtcccacaatctgctgtctgcaagccgaggacccaggaaagctggtcgtataacctgagagccagagggccgatggtatagattgcagtccagatctgaaggcctgagaagcaggggtagcaacggcaggggaagatccatatcccagctaaagtagtcagagatcacatattcaaccttcttctacatttttgttctgtttataccctgaacagattggatgcagtccacgcacagtggggagggccatctgcttgactcagttcaccaattcaaatgctaatcttttccagaaacaccctaacagatatatctagaaataatatttatctgggcatcccatggcccagtcaagttgacacataaaattaactgttgccataatccagtggggagaaaatggtgcctgaacatgagcagtggttgggtggctggaaggaaggagatggattgagaactctctagcagccacagttggcagaacttggtgctaatcagaggtgggggtgagaaaaatgagtctaagacaactgatgattttggttggatgactggtggtcacattaagtgagaccctttctttctttctggtttttttttttgtttgtttgtttcttttttttttttgagatggagttttgctcttgttgcccaggctggagtgcaatggcacgatcttggctcaccgcaacctctcactcctgggttcaagtgattctcctgcctcagcctcccgagtacctgggattacaggcatgtgccaccatgcccagctaattttggatttttagtagagatggggtttctccatgttggtcaggctggtctcaaactcccgacctcaggtgatttgcccacctcagcctcccaaagtgccgagattacaggtgtgggccactgcgcctggccgagaccctttcttgtgcattgccatggtgaaaataccagcctggtattaccatttctttcaaagcgttgctaacatctctgaaaatcctagcacactcccttcagtggtcccctgtactcccttgcctgagggatctccctgcctacatgccatgcctccttatttcacccatgggccccagaggggtacagcagccatcagtgaggtactggttctttctccctgggcttatagtcccactgtgttgagtaccttgtcttcctctgttcgggtcacctccctgtgccacaaacatctaccttccaggaaaggatcacaaactgtaggactgaagactagatttcaacccatagatgtctatgatttggcctgctctgtgtatgtgtgtgtatacacacacacacacacacacacacacacacacacacacacacttaaatgtaaatgcctttgaaggagggaccaggctctctggtatgtcatgttccctcaacccttctggttgcctcacctttggcctgctttgctcatttcccttcatgcctgacagccacaggcttctgtatgtctaagccccactggaaggaaagatgtagggggtctggtccaccaaggggcagcatctggaccaacagggcactggctttcttccttgtcacatctttctcatccttgctcacagcaggatgagcgcttggagagatggctggcttcctacagaaggttaccaaaagaccaagctatcttcccttgaaaataaaacccaattgcctgtatattagattgaactatataaaattgtccatgttcaactttgccctataaagatgacaatttcacatgattcaacctattaacatggccctggcttagtcgctagtaggacaatggttctcagccttggttgcaaattagaataaactggaggttttaaaaaatacccttgctaggacctcaccacaagactattaaattcaaatttttgcagatgggggcaggcatagagctatttaaaaagctcctctgggctgggcacaatggctcaagcctgtaatcccagcactttgggaggccaaggcaggaggatcgcttgaagtcaggagtttgaggacagcctggccactgtggcaaaaccccatctctactaaaaatacaaaaatcagccaggcatggtggcgcacgcctgtagtcacagctactcgggaggctgaggcaggagaatcgcttgaactcaggaggcagagtttgcagtgagctgagattgcacctctgcactccagcctgggcgacagagggagactttgtctcaaaaagaaaaaaaagctcccctacagccagactgataattgtcctctagcacatccctcggccagccatgagaaaggctcaaagagccttctgctgaactccttaccacattatccatcgatggtagaagcttcctggctttccaagcagggtctcaaagagaagtctgaggaacccagaacttccatgtgactgcaattacttcatgcattgaattgagtcaataaaaaacagcttccatcacaacaaaaaaaaaatgtgtgttaaataccaatatgcctgtggtaccatcctaggcatattacaaaagtattaccttgtgggaattagcaatctggaatttgcaattctctctccacccaatcccttgaaaagccatatgtggcattagagaaattcataacaaactggaaaatgtcaaagatgtggccctggacatttactgaagcgtatatgccacaacaaagtgtacactttggggtagttaaacaaatttctatagccatacatgacagttaagtgatacacagctttgagagccataactcctctgcatttcttactaactctagaaatctaacatatccattaatgtatttttctttttgcttttactgtgcagatttaaagaacaaaataaataggtaaatatattttcagaataaaaaagaaaacatcccgtattacttttgggggtgatgaaaatgttctaaaattagattatgttagtggttgctcaactctgtaaatatactaaaaggcactgagtatattttaagcaagtgagttttgtggtatgtatatctcaataaagcttttcttaaaaataatattgctagagtgaaaaaataaccgaaatattcccaccactttcagaatccacagcccgaatgtctcagcagagaagctgggtgtgctgtgtatgtatgtagcttatgatgctgtccctgggacgtgagttgtttgctcagatggcattgacaggggtgccacgtgatggggtaagtgggcagtccgttgctataagcaagaggcgggctgggagtagctctgcagatctggtggcaaaatgaaagaaaggagttttccctgttaggaaagaaatgcagaagcagctgtccacagacagcccaatgcagagaacaaacctgcctgggaagcagctgaggcagggcacatgctcctggaaggaaacagagagatatgtgtgctcctttactcgctagcctttcccgtcaccctctccccaggctcctggcaccttggaacagcgtgagctttcctagggctcctctcgacttgcttgatgtagaattaatttaattagtttcagagggatccatcatggtggctgtgttgcctaggttaaaagaaactctgtgtgtgtgtgtgcgcgcgcgcgtgtatgcatatatattttgccttcgtgtatgcaaaagcaccttgagacaatatcctccttctaacttgggattgctggactgttattggagtcctagggcttgacaaattggcagagacttggaaattctgaaacagtttaaggaaaatgcttacaatgatgaaggaaccaagaaataagtctctggggctcaattccctgctctgtagtacatgttctcaaaccttcctttcaagcattgcatggctaccatgggccatgtgcagtgttagtgctacagaagacgcagatgtcaatacaacccggggaacggggtcagacagatccccaaagacttcaatacaccccaccgcaagacagttacaaataaagtgctgggtctcagaagccaaggaaagcatgtgcagttgttgggaaggctatgaaaggcttcatgaacaagcagcactgagagctgtataacatttttacaggtgggagtgaggtggatttcctggaggaagaatcaatgtgatcacaaccatgagggcagggaaaggacagcaagtgagccccttaggttggaggataaggaattagcagaaaatggtcctgaaaaggtgactatggcagtaaatgccaagcacaggtgtccctattgaattccgcaggccacggacaagcctctggtgggttccacactggggctaattccaagattggggttccacattggggctaatatccatccttctgctaaggatgcctaccacccttggctggagggggacagccaaattcctgctctggttttaactcagtgagcttcaacacatcaatgtggagaaggtacttcgtatgaggcactctacaagtgggaataaagatgaaatagtgtatgtctttaaaaatccttgcagtttgggaacaaggaagaagggcaaagaggagattagacaacgacatgtagaaccatacatcgtatgagtggtaaaaggagcatcacaagagtcttgacaaagtgctcagacctccttaattggggttcctgccagcttctcaagaatgggaaccaggctttcttcatctctgcatggtctggtagctcagtgcctggcacttggtagacattcattaaatgaatgaatgtatgcatcagtgaatgaatgaataaacaaacaaatgaacaattctcctgtcacgcaggatctgctgaagatggcggctgtaagttcacagagcactgcctaactttggttcatattgttcctctcttctcctacctgtattttgctcacctcaataccagcccacactgttttcctggactgtgattctttcagtgatcacagagtctgtgctgcataatttaagtgtccctattccttgcagctgcttcctgtgtgctagtcatgtaaacgcccttcttaaatgattgcatccctcacaatacttagaatatattgactgttgattggttggaaaataatcccgtacaggcggagggggcagaaactgacatcatggagtgtcaggcacggtgctggtgctatgcatacactcaacaagggcctgggtaatgcaacatggagaagggaaaactggggggcagaacaattttgtcgtctgaaagcctttcacagagaggccctgaacccatagctctccttctctgaggacagaaaaggaggaagtgtgtctgtcctgcagtatgtgggatggatagatggatgcgaaattaagcactgaagtgggttgcttggagaggcaatgactgccccctgccctcacctgaaaatccttaaagacagaagggatcatccgcccaggaagctgaggctgcaggataagctggccttttcctgaacagtgacagttggagcgttcaccctcactgtccttgtcagagttacaggcaagaaaggagaatccttttggataaagtgtcttaaaggaactgttgatttacccttttgctttatggtctcctgatgtagtgagcaaggttcagggagattagctaactgcaggcagactgatcttcctgtgcagagaaataaggtagattctcattatcttccagctcattttcccaagaattatgtattctccggccagaaaacgacctccaaacctccaaaccttttcaactacacgcagcaaaaagctaatacaatgccttctgcatttgactgtacgtctcctgcagtgattaatgctgcctccctaactacattgtccggagcaagtgtcaagcccaattatttctctaggatctcctgatagtaaatgctcagcaaatatacagacgaataacacctaatcatacacaataatcttagagtactttccccatacatttcctaacttaatccttacaacaaccctgtgaagttattaactcccattttccagttaaggaaactgatgctcagcaaagttaactggcacatccagtatcatacagccagtaagaaagaattctgttcagtacgccttactgattaaatgaactatgtggcctgaagaaaaagtgtcagctcagtctttccccatcacgcatcttattccatggagtaacctgcattatatttcagggtcaggcacactaagtttgcgctttagtatatggtgaataaatggatggacacagtggcggctctgtataagtcagctgaaagcaaacaaagggaaggcagaatctttcattcacacgatttatccgcgcccactgggtgcactacggtcgggcattggcgacccaggagcgactgacctgccctcatggggcttacggtccttagcaaaaaacagatgtaaaacaactaatattacagtaaatgaatcataattttgtgagatgctcctgaaagtatgtagcaggacgctccgctctggtccgaatgaagagccatttgcactcagtgtggaaaggctagcctttttctgggcaaaagaagcgggggatacatttagataggcagaagttccgagcagaagtcaaggcaaattaaaaaggcaacaggaggagggaaaatgcttctcacaaacagaactcgacctaggggaccgcaactctccagtcctgctgcttggctgcctacctacctaagaaaagcaggaaagaaaaagagaagacggggtgggggatggaggacaaatacagaaaaagaaaaaagagcgaaggaagtgagaagtgagaggccagtttatgtaagcgggcagggcggcgcggccggcaggagaccggcgccggcgccgagggagttaagcggacgggcccggtatggaagaggttaaggggggcagtccggagcgggtccggtaggggccgcctactgggcgggggcggggccgcgccgagcgagcgctgggattggccgtcgggcaggcgctacgctaggacggtaccaacagccgggggcctcggaggcgggggggtgggtgtgggactgccgctctgcgcggcgagaggtggcctgggaatggccgggccgggggtgggccggagccgctgtggcggcggcggcggctgggggcggtgagcgcggcgtggggctgcccctccccggaggcggcgggggcggccggggccgcgccgcaccgcaccgcgcgggcggccatggagcgagcctagggcccgacaggtgagtggcgcgggggcgggggagggcgcgcgacccccgcccccggcgcggcgggcgggaaaatgcggaccggcacgcgggcggggcacggtacgtagcgcgcgccgggctggggccgcctgggggcggggcgcctccctgaggggccgggcaccgggtgccctgagccgtccccgagtggctgcgggcgggtcccgggcgagggcccgaggcttcctgggagacccgctcgggccgcgtgtccctgtgtgcggtcgcggctgaagggacgcggcctcggccgccacgtccctggcccacctgaggcgcgggcccacctggggccgcctcaggctgccagaggtccttctagtgaccgtctctcgtccccttgcgcggtccccagaggcgattggccccggtgcctctcttgtgttccccggagcgcccgttgaggcagcccagggagcgcgccctcgcggggtctttgctgggcccgcctcgtggccgggaagcgcgagtgacctgcaggccggaggcggaaggcggggcaaccgtgcccggggcccgcggtctcctggggtcctgcgccgggcgctcgcagaagggcacaacttaacgaatgctgtgttagccctcagtgggctgcgcttgagatttcatttccgggtgtgacggccccgcgattaagagcggaccgatacgtttcccttaatgatgaatgtgaatagttgtcgagctgcgtccttgattgtgggttctgataagagattcattctaatctgacttctgttaacctgccagtctccggataagaagagaaggggtagaaggatggattggagggaaagtaggggtaacagggcttggttagtcttaatggaattattagtccttttaaagaccataccatcattgggatggataaggagtttctaatttgggaaaatgagagttgcttgctattgcgacttgggtctagtgccagatatcagcatcttccccacccagccagcttccctctggaggtttgatttctcacttggaagggaagtaggaatgtggggttttttttagcctttagcctttaaactgtaggactttataaatctataatctggtacaaattactattgccatttattagccacgcctatgttttttgcgttgtaaattcttgcaaaaatttcactggcgttgatttctaaaaatctggttagagatctcagtgttcttatgtattacaaacattccttgagtttatgcaggatctttgagctaagcttagagcacttcctcaaatatgattcgttatcacgactgtctgagaaactgaggtacaaatggtaaagatgctaaattatttgcccagactcatagccaatctcagggagatttaaaatcaatgtattctattaataacttttctaaagtttgcaaagatgttggactttggcctctcgaaccgtacaatggaatcagtcagcaggagtccctttcccatttgaaattacttatcaaaggagaatacaaaggcacacacaagtataattcagactctcagcctcactcatgataaagtgcagtgataaatatggatacaggtaaaagatgatcaagacatcttggagttcacagcgtttcttttctgtgtggtgaaaatgtgacattggtatgctctattcgtttctctagaactggtaggacagtagctatgttttggtgaatgaatggaaactagaaaacacatacactgcttttctttttggttcttaagattagagaaaaaacacatcactgcttctatcatctttatttttataatcttttatatcatggaagtattttatgttaaattgataattccttgacttttagttcattcccttgatttccatttgtagattccagccctttcacacagccttaaagtttctgcttcttatctcttctgaattttaaattcctaaatgaaactttctgttccttcagttttagggcagacttcagcttcccacactttgtgtgtctatcatttcattggtgtaaaaccctaaaatcatttcattagtgtaaaaccctaaagccagatacttcagctgttgaattgataactttttaaaatagctaaccacagaggttgtcttttggtgattgccacaatctcataacagaagcaggagggcgttctttgtattctgtaagaatacataaaaagacagttggtcgggcgcggtggcttatgcctgtaatcccagcactttgggaggccgaggcaggcggatcacgaggtcaagagattgagaccatcctggccaacatggtgaaaccccgtctctactaaaaatacaaaaattagctgtgcatggtggtgcacgcctgtagtcccagctactcaggaggctgaggcaggagaatcgcttgaacccaggaggcagaggttgcagtgagctgagattgcaccactgcactccagactgctgacagtgagactccgtctcaaaaaacaaacaaacaaacaacaacaacaacagaaggagactgtcttctgaatctgactcttagtccttctgggactaagtgccaggtggttttgtggattgggatggggaacacagttacaatgaggccctacagtttgttgtaattgttacagtaatctgtgtatctgtgtatttttctctctgcacctgacagtgcctgtatgtagaaggtgcacaataaatattcgtcagttgaatgaataaatggaaaacagtatgagggaaggggaaatattctaatgtatatactaaattatttagttcctctttttgtcaaaagaaaaaaaaagcgtagaaaatgtgtttcggattactgttcaaaatattctgtagaggtgtgttatttgcttctgtgattatatggtgttctaaaccacctggagcctggcagtagcctgtgcaggttccagtcaagtgcagcttcacaaccttgctcctacagtctgttctggctaggctaattgggcagttggattgatagccagtgtttttgcattaatagaagaacttagagctcttggcaatggccatgtcaatagcattgacctgactgcccttgtcccttattttgacggtggaagaggggagttatccctttttaagagtacttctccagcagttccttcttctacacctacatatatcttcctgttttccttcagctgtctctgtaaccccaagtactaatgaattctttaacataggcctgggctgcagaacagaagcttactttgctattgaaaccagcttctgactaacttacaatgtcagcatgactgctcgagctgcctagaagagaaaataatgcaaagatctcacttctgatttggtctttcttaccaaaaacaaaagaagaaatgcctagcttgggatgtaaagaatctacatgacagatgggtgcgtctgtcatcccagtgtgagataagagaaaaatgtaagctgatgcagaagagaccttgagctttggtgtgtgtttaaggtctgtactttctggcaagataacccctttagagaagagggtgctaacttgggcacgttataaaggcaggtcaaggaatatgaaattatgaatgtgtaaagaggacagaaccaagtacagagggaggcagtgaagtctatcattccatgctctcaaatgttaactttctgctttatatacatagcaatgcctcatttacctaatgttggggagtaaggtattatatgtgaaaattttattttagctataccttttgtggaaaaatttttacaatatatgctttggttattattactagcatactggcagtagttgagtgaggctatgagatgatcgaaaaatgtagtttgttgtccactgtgctttttgaattattgaatctacttgagtcgattcagtagtcagtctttgtcttctttcagtggtggaaagctgctcttttgctgctgttagtatccttgctgccctcttttaaatttgcagcttcttatctgtggagtaggagcttcctgacattgaatgtaaaacagctaaattggcttagttatgttctacctgctcttctccaagttttagggtatgaactttgtaaccacttatttttgttgcccagggacgtttttgtttgtttgtttcttatcgttggtgtagatagtgaacgtgtgctctgtataggtgcatttatgttcctgtagttttctgtaaaaaaaaaaacaaaataatatggaagtacttactcgtgtgggttcttgtttcagaaagcactgccaataatacttgaagatctgatttcagccctgtcttgtatcatccttgggcagtgtgttagacaacctcctttcttccttttagcatttccaaattgtctttactcttaatcccagccgatactaggaaccaggttggcaatagcagtggccttgaaaggtggaagcaggatatacagaaggtggcaactttaaattgagtgtatataattggtatacatattcgctatttctgcatcttttatatactgtatacttgaattcattgtaggacttatttccccctgtctctgaaagaggcagtctttaaaccagagagttgccagtttagaagaaattcttataaccctaaaggtctttctcctttgcccttctctccttttattccacaaacacttatcagatgcctcttacaggccctgcacagtgctaagttacttggaagtacaaagcgtgagtaaaatctatcccatcctcaaaaaacacaatatattagaagagacagatgtgccaaaaaaaaaaaaaaatgtgtgtgtgtgtgtttgtgtgtgtgtgagttcatagtataacagagggatcatgcctggagccacctagccataatttcagcacagatctgtttgaggttctcctgcttctgagagtgatctcctgtgtgggctgtcagcttgacgtaccatagaacataaggctaaaaatgcgaggtctattgttgtataaagtttatgtggttttccaagaactgtagtgaattgaacactaaagatggaaagcatatgaaaagctgaaggaaaatgttataatatttgtaatgccgtatttcaacactatacaggaattaccttctataatctagccttaaatggtggttctgtactgacagttgtgctgtgaaatacctggaacttgggaagtgtcattatacctggcttatttaaaggaaaatgcaaattgttactcatttccacgtagtgtcaagattactgcgtgtgttggttttttagaacagaactcgctagcagtatgagctaaagtttttttctttttcatttttcaaggaagagggttgccctaaatcaaggtttaaatgggacaggttgcagagattgattttttttcagttcacttattgaaattattcagttattgcctatttcatttttactttcacatccagcaagaaagactaccttaatgcttcattaatgcctggtaatggttttagttgccttccttcagagggaacttgttagagaatttcatataagtgattctgagtttacagatgtaaataaatgtttaaatggaagtgaaaacagtaaggaaaacctgacacttggaccaatttggattatgtaagaattagattttctacacctgtactcttaagttactcttaaggcttatcttaagggctttagcacatgaaaagctgtcatctttaaaacacagaactaattttccaaactgaaaacagttgtgaaaggcattctattttagcctttttttgtgaagtgggataagttcatgcttcccatctgtttcagttacattgagtgtggtagaattgaactttgtagagaagggaaacaggttggccaaattagtgacagcctcccagtcttctgctttgcatgacactcactctgaagatatctatttgcctagtcttatctacctctcaaatttaggcaagaatttggctcagaaatacaagactactaattactactaaactcttagtaatgcaatgtgtggatttggcccctcactatgtaactgagaagacaacattatggtatattgattccaatgagggttttctttgtcatttttctcctctctggaggtcatctgggtttttgatatggtgataatgactagcaagtgattactgtgggtcatccaggcactaatcttagcacaacacatgtagaggtctcattcttttttttttttttttttttttttttgagacaggatcttgctctgtcacccaggctggaatgcagtggcatgatcttgattcactgcagcctcagcctcccgagtagctggctcattcatttttaacaaccctgtgagttaggtaatagtattcttgtttcatttttttatatgcagaaactgagacccagagaggtcagaagttaaatatctttcccaagacccacattaggtggtaaaggaagcatccaggcctaggcattctgaatccagaggacatgcttttaacccctctgctacagaaagcttatatttaaaataagaaggtgaattaagaagctatttcttaagtggataattagcacagaaaagaagaaaaaatatctatagatactgattaatgctattacttagtattagtttttatttttagttgaagaccctcatgtgaagatgaaaggaagaatagcatgctgttgtggcaggcagcaaagcaggagtgggctggttttcccagggtactcagcatttactgagataataaacatgtaatgctgtttaatattggaggttttgactttctggacatcttgactgtcacacaatactaaaagacttctgaatgctcttaattttacttatcactgccactaaccatcagtagagacatttatttctagggaacggggtgtaaactcataacagttaataataatatgcacagtgccctactgtcactgctagtgaaaaatcaaaagggcagtataccagacagcccacggtaaaagcgtgtgtgtgtctaactttttttgcactaaaagatgtgatttttgctatttatgttttggctgaagtacaaaagttaggctttataaaccggacatgtgtcagtgtgtgaatgtgtgaggttagccttgattgctctgcataagtctaagtagggctctgaagtatgcaagtggattttagtaaatgatccagttgagaatctatttcttcttgtggtacctttaagagactttgttaattatgtatctttctaaatatatacaatgaaaacagaaaaatataaatgacatgtaacttttataatgagtgtattgctcctagaagccattaataataatttacaaatatgacctaacaatttatcaaaccaatttttatttgcacttaatggttaatttagtgattactccctccctgagataattgtttttagtcacgtaatttatttccctatgtcttctcccctggtatttttactatccccaaaaggagttgataggagcagaacagatgtgagaatgttgggttttacaaactacctcaaaataatagtgggttaagacaatgatttgttatttctttctttctttttctttttctttttttcttttgagacagtcttgctctgtcaccaggctggagtgtagtggcgtgatgtcggctcactgcaacctccgcctcctgggttcaagcgattctcctgcctcagcctctcaagtagctgggactacaggcatgtgccaccatgcccagctaattttttgtattttagtagagatggggtttcaccatgttggccaggctggtctcaaactccctaccttgggtgatccgcccatctcacctcccaaagtgctgggattacaggtgtgagccactgcgcccagcctgttatttcttataattatataggtcatctggtctcacgtgttcctgctcaaatggtataggctggggtcacaacagtgactacattctgccagaccacaactgggactggaatgtccttgaaagtgtcatcttcatgtctggcacttcacctggggtgaccaggatagccaagggttggctggacctctctccatatagatcacttggcatttggtagtcttagcttgagcttctttacatggtagctagatcccgtgaaagtggaagctgccaggtctcttaagaccagggcccagaactggcacacagtcatttccacaacattctattgtcaaaacaagttacaaagccagcccagattcaaggggaggaaaaacagactccacctctttctctctctctctctctctttttttttaataatggagacagggtctcactgtgttacccaggctggtctcgaattcctgggctcaggcagtccttctgcctcagcctcccaaagtgttaggattacaggtgtaaaccagcatgtttggccctgactccacctcttgataggataaattgttagtgtctgtctttgcagacagtctacaaaaaattcaaattcaagtcttacctcctatactcaccaaaccttcagagttttagtcaaaccaataattaccaaagtattttgttaaaggatccttgtagttcctactcaggatcaagggcaaagagattgtgtgcataaatataattctataccagttaagaaatcctacccctttgcctcagatctcttttgttgttagtcctctgcatgaagcattcttactaagcatttcctttgtggtgctttgcatttacaaggcatgttacattctacttaagtcataagaacctgatttgaccattaaattagaaacacaagaagtgaaacttatgtttacttttaccataactttcacttttagttgctatgagcagaggttggtatttatttcttctctatgacctcagaggtagtattgtgagcttgtcacttaatcagagggtgattcaaggggacacttctaataaggcttggaatctcattggtggcttgtaggaccctctagtaaggtagtaagcgttaaggccaggtgttctcatgttccttggcagccacatacattgagatttatcacatgatctgtagacccccacaccaacatgcttttctgtaaatgttcctccaccatcagccagatttttttttaagtacaatttccattgtatttttctccagagaatggtctgtcttcagtctttaaggactcagctccttacacgggctttggtgggggtcgtggggcagcacccacaggtctaaatcggggtaggggtgttcggtcctcgtgggcttcatgagattgattcctgactactttgctgtgaattgcacaattcacacagtaatgtagcttcacaaacagcttgggaagcacataggcattgaagacgctgcttcagaaatgtccctgactgctgtggcctccactatatttcgaatgatgaatttcttaatggccttgtccttaggcacgcatcaggcacagttcatgcagcgaatggctgcacgtaactgtggccctttttgacatgacttttgttccttcttttctttgtcatcttggaggcatggaccggagaggagattcttgaaagaagactttacattaagacctcactttttttctgtggaatctatatctcttctcccaaaacaacttcatagtcttacgtttgcccttatacaatatttatcaaatgagtaggatgagtgtgtttgtgtgtgtgtgtgtgtagaatgaaagtgaattagccggctgggcgtggtggctcacacctgtaatcacagcacattggggggctgaggtgggcagatcacttgaggtcaggagttcgagaccagcctgcccaacgtggagaaaccccgtctctactaaaaatacaaaaattagccgggtgtgatggcagacacctgtaatccctgctacttgggaggctgaggcaggacaatcgcttgaatccaggagttggaggttgcagtgagccgagatagcaccactgcactccagcctgggtgacagagcgagactctgtctcaaaataaaaaaagaaagtaagtaaattagcctccgtagcaagccccatatagctgatggagctcaggttgaaaccagggttcagtgggaaaattccttgtaaaggtctactttccagaactccaggctgggagtttatgccagcttttcatgtgaaaactatttacagatatgccatttgtactgccttttttatatttaacacttttaaagttatgttattaccttgagtttgtttgttctttgaggtagtttctgttctgcataacagaaacattaaaataaatgaccgtaatataactggacattgttgcactgtttgaagcatgtatcggaggagctgagggtgtgaaatagagcaggcacattcttctgagaatgttagtgaggtttttcgtgaatagtttgaatatacccagtgaatttgcgtttatttccttagtgtctgaaatggggaatctttggaaaagtccagtttgcacaatatagtatactccttgtcccaaataaaaaaggaagattatatggcatggaaaccctgtctctggtactttctcctctctcacatataaaggagtgaaggggatcattctaaggagccaagattctgaaaggagaattaagaaccatatgcaataaggtattatacaaggccgaatgtagttaagtactggccgaaaggagggagaagttactttaagagtgtaaggagggacgaaaaattgccttagagatggccttggagatgagccttgaaaggaggctcagactttatcaggaggagattggaagaaatgttaagagaaagaggaattttgagggactacagtgtaaggaatgacagaagcaaagagcacctacacatcaagaggaggaccatagcatgttcagttgatccattgtggctaaagctgagaagaggaacaatgggagtgatgtctaacttggaagctatttaggatacagctttaatgccttgccaaggaatctagaatcaaaggtggttgagtgatttgaaaaatgattttggctgcattatctaggctggattggagaacctggaggctcaggcatcagttctttctgtggtccaaaagaaggtgatgagcactgaagttggtggctgtggaaatgaaagacggctgtaaagaacaatgacaaattgcactcttactcattccaccaggatgtggtgactgtaatcacaaacatgaaaacttgtttagtctctttttttttaacctgccctcacttagaatctgcagaaggaaatagtgaaataatagaacccttcagttcccttaatatgaatttatttcttgtttgcttgcttgctttctgtatgtcggtctttttttttttttttttttttgtgagacggagcctcactctgtcgctcaggctggagtgcaatggcacgatctcagctcactgcaacctctccctcccaggttcaagctattgtctcctgcctcagcctcctgagtagctgggattacaggtgcccaccaccacgcccagctaatttttgtatttttcatagagatggggtttcgccgtgttgtccaggctggtcttgaactcctgacctcaggtgatctgcctgcctcggcctcccaaagtgttgggattacaggcgtgaggcactgtccccagccagttcccttaatgtaaatttctaacctagctgagtgagtgaattgtttatggccctgaattgatgaatgtgttcgtctgaggccgcttcaaaaggagaagttttgaaataagtttcaaaacttaaaaggacacaaacttggattgtgggattggaccgtttttcttatctgaattttggaactgttagaacttcttattgcattgatgataaaaacaaaacaaaaaaccacagctctaacctttgtgcaaaatgtttggatgtgatatatttatatagcacgagggggaggattttcttcattctaaatgaatgagcaatacgattaaaagtttatgggttggtcgggacagtggctcatgcctgtaatcccagcactttgggaggctgagtctggcagatcacctgaggtcaggagttcaagaccagcctgaccaacatggagaaaccctgtctctactaaaaatgcaaaagccttagctgggcgtggtggcgcatgcctgtaatcccagctacttgggaggctgaggcaggagaatcgcttgaacccaggaagcagaggttgtggtgagccgagattgctccatggcattccagcctgggcaacacaagcgaaactgcatctcaaaaaaaaaaaaaaagaaaaaagtttatgggttaaccagactttagtcctgaaggatgttctgtagaaagtaaaagcctatgaagctgacccctttgtgccagaattgtattgcatttgtagctagtggcatctggagatgctgaagaagtgattgtcaatacaactagatttccatattgccttttatctctgcagcctgagaagtgtactgttgaacaagcacttgaaaatgttgtgtggtttaggttgcattagaactagcaaaaatctctgaaatcttctctgctagcactgctgttatcagtaatcacagggaactgttttactgagttccacaccaaacttgataccatcacaattacattttagatgcacttgaattgcctttgtttcagctaatagtgttgtgtaccctgggagatgatgatgaaacaaaacaggtggcagggaataattagaatttgaaattaactctcactttctgcttccttcatgaacagaaaaggagtggttaatcactgagaataaacttcattcagctggcccactgcaaagtgttgccctcagaatacattgctctgataagctgcttttgattgtttccagttgttattaagggagcagtatcacgtttaagtgggagtgtcttagcctgaatcatttgctctatttttttgtattggttttattttttggattaatggtttgagttgttaaatgaattggagagtgaagcaacatcctgttatcttcttgtcatctttgtcttacctcagtgctgtgctgtctgcaggcatagagcagagcaagcctgtgcatgtttttaaatggccttatggagtagaaagcaacctctcaggatgcaagtgagacggaattgtatgttcttgacacccttgcaaaaatcttgtatttggagccttttaacttaagaattgcccagagtgtggtcagccccatgctagaaggagcagttctttatgtctgtgacatgaatatccttgttatatgcttgaccattccagacgtagtagtgctgccatagtaccaggctttattagttttctggttatattctgctaatagctagatggtatgggcatatttttttccctttacttaatgtacccagttttgattatccatggtttgcaggtattttaattttgaaaaataattggcgaaggactaagtagaaatatgtgtctggggttgtatttaaatacatgagcagcagatatgacacgtccaggatcgctgaatacttggactcagagacagctattactctcctctgcaccctgtggcattttatttatttatttattatttttttttattgatcattcttgggtgtttcttgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaaacatctgtttaacaaagcacatcttgcaccgcccttaatccatttaaccctgagtggacacagcacatgtttcagagagcacagggatgggggcaaggtcacagatcaacaggatcccaaggcagaagaacttttcttagcacagaacaaaatgaaaagtctcccatgtccacctccttctacacagacacggcaaccatccgactcctcaatcctttccccacccttcccccctttctactccacaaaaccgccactgtcatcatggcccgttcccagtgagccgttgggcacacctcccagacggggtggtggccgggcagaggggctcctctcttcccagcaggggcagccgggcagaggcgcccctcacctcctggacggggtggccggccgggcggggggccaacccccccacttccctcccggactgggcggctggccgggcagaggggctcctcacttcccagtaggggcggccgggcagaggcgcccctcacctcccggacgaggcggctagccgggcggggggctgacccccccacctccctcccggacggggcggctggccgggcggggggctgacccccctacctccctccaggacggggcagctggccgggcagaggggctcctcacttcccagtaggggcggccgggcagaggcgcccctcacctcccggacggggcggctggccgggcgctgatccccccacctccctcccggacggggcggctggcctggcgggggctgaccccccacctccctcccggacggggcggctggcctggcgggggctgacccccacctccctcccggacgggttggctgctgggcggagacgctcctcacttcccagacagggtggctgctgggcggaggggctcctcacttctcagacagggcggttgccaggcagaggctctcctcacttctcagacggggcggccgggcagagacgctcctcacctcccagacggggtcacggccgggcagaggcgctcctcacatcccagacggggccggcgggcagaggcgctccccacatctcagacgatgggcagccgggcagagacgctcctcacttcctagatgggatggcggccgggaagaggcgcctcctcacttccttgatgggatggcggccgggaagaggcgctcctcacttcctagatgggatggcggccgggcagagacgctcctcactttccagactgggcagccaggcagaggggctcctcacatcccagacgatgggcaaccaggcagagacgctcctcacttcccagacggggtggcggccgagcagaggctgcaatctcggccttttgggaggccaaggcaggcggctgggaggtggaggttgtagcgagccgagatcacgccactgcactccagcctgggcaccattgagcactgagtgaacgagactccgtctgcaatcccggcacgtctggaggccgaggctggcggatcactcgcggttaggagctggagaccagcccggccaacacggcaaaaccccgtctccaccaaaaaaatacgaaaaccagtcaggtgtggcaggctgaggcaggagaatcaggcagggaggttgcagtgagccgagatggcagcagtacagtccagcttcggctcggcatcagagggagaccgtggaaagagagggagagggagaccgtggggagacgggagacgggagatgggagacagggagggagagggagagggagacgggagacggggagggagacaggagacgggagacgggccgggagagggagacgggcagggaaaggggagaggggagagggaaaggaccctctggcatttttaggaattgttgtcttaccagaatgagaaccaaatactggtggtttgggatatgcaaaagtcctttatggattttgaaagttaaaaaaatgaaagttaaacaattatgtatagcttgctcttttgtttttgttgtgtttttcctcattgttttggttattaggcatgtgtagccaacctcatggctcctagatggcttgcattccaattaaaatagaaatatttgctttaaaattttcagtgtatgtggttcttgcttattagtgtcacaggatccttggggtgtcactttgccagtgagaaacctctgtggccgtggtgccttctgcctgagtagtgcttgtgcccactgggctcgttctacccactcagccttgcaggccgtgctcagctcgtactactggcctggatcttatacctgccaagggcaagccaggtgcagagcagcaaggggtgtgtggacaagctagcatggggtctggccactgtacacagccacgcacgctggggctgctgtggtggggtaggcagctccaagcataagcacagctgccggttctgtgtgagtctgcagctggaccagagtatcacatgcagcttctgctgcgggtgcccatgtctggacaaggggaacatggtggcatccagaaacttggagacaccaggaacctcagaaccccaaagaggatgtcacagccctggctcggggagaccctaggtctgagctccacaaagggccccagctcttctctctttctgattgcctaccacatggtgagcagggggtgtgtttcagccctgtttgcattacagctctttcagtcctgccatttggtgggttctgagttcttgtcccatgccccacgctgacaactgggggtgagcaaagtggagaggagcttcactgagcaatagaacagctctctggagacccaaagtggatagctctttctgcagccatgttgttctgatgagagtctagctttcagtggagaggagacccacagtgggtagatcccttgtgcacgcaggttgtccggatatctgtttgagtctggctgagtgcagggtttttatgagctcagaagagaggaagtgtgtgctgattggcccatgggtggccatgggtgggcccagaaaaagcaccataagttctcactgtggtttgcggactcttaaccagaaccgacagcccagcccccatgcttcaggccatccctggcttgaaggtggggcttcactggggacccatccctttccgcccaggagcctgcctcctgccaccattcatgtcatccacagtgcccaagctgtttgtaccaagggatgcctgcaggcctacactgagccatcctcagtcctcccttggcctccctcccatgctcattggtgcccaaagtccggagtgggctgagacagcaggggcctggtgtatcagcactgccccaaccacatatatacaggtcacgacatcacctgggctttgccacaattttgctccaccccagagtgggtgcggggagtggggagaggccaggcagcaggagtggcattttggagcctgtgggtgtagctgtggctgggtggctgcagctgtacccaggaacacggggcccctgctccaccatcttggaagagggcagggctcccacctgttcccagctccttccagctccgtggagtgtgcagccctggccatgcctctcccactgcagctggtgtcttcgcagcagctgctccagttgggccactgctgccatcattaggtccttctccagattagttaattttaaattattgaaccttcttgagctcaagaatagaaagcctaaaagggtgagtcatatattagaggcttacaaaagattcaggggtggaaggacagaatttttgatcaaattttgctttgtacttgggcttgcaggaactgtggaaggtgcatcagtgaagaaatggaccaatgtgtataatcatggaatctccttgctaaccatcaccaccagctctccttaatacatgagcaagagtgggtcaggggagaaggaaaagaggtcaacatgaagctaaagcagcgagtcgtgctgttagcaattctccttgtcatttttatcttcaccaaagttttcctgattgacaacttagatacatcagctgccaaccgggaggaccagagggcctttcaccgaatgatgactggcttgcgggtggagctggcacccaagctggaccataccttgcagtctccctgggagattgcagcccagtgggtggttccccgggaagtgtaccctgaagagacaccagagctgggggcagtcatgcatgccatggccaccaagaaaatcattaaagctgatgtgggttataaagggacacagctgaaagccttactgatacttgaaggaggccagaaagttgttttcaaacctaagcggtaagttttgatcttggaagctgcatgtgctagttggttgattcatttaacttgggatttatataagatttattttgtcatcttctcttggaagtctcttcagtaaaataagaggggtagactagatctctaaagtcttttctagcacttaacatgaatctacctttatagtatcatatagaatagtcttcctgccctaaaaatcctctgtgttctacctactcatttttccctctctgccccagaacacctggtaacccactggtctttttactatctccgtagttttgccttttcctgaatgtaatatagttgcaatcacagaatgtaagccctttcagattggcttctttcacttagtaaagtgcatttaaggtttatacatatctttttgtggcatgatagttcatttgtttttatcactgaataatattccattgtctagatgtaccacagcttaattatccattcacttactgaaggacatcttggttgcttccaagtttggggcaattgtgaataaagctgctataaacatccatgtgcaggtttttgtgtggacataaattttcaactcatttggatagataccagaagcataattgctggaccacatggtaagagtacgtttcattttgtaaaaaactgctaaactatcttccaaagtagctgtaccattttgtgtttctaccagcaatgcatgagaattcctgttgctccacatcctcaccagggtttggcatcagtgtttcagatcatagctgttctaatagatctcttatttctttcacctgttttaagtaaagaattgggccattttagttaccttagttaactaaatatgtatgttgttcatgatccctttggacttcctagggatctacagagataatttgtgtgacaattctgtgatacagttaattatttttatttatttatttatttctctacacaagacagcttggagggtatagttaattttctaaaaatgttttctgagtgtatgaatctgaattaggttaacatcatgatggtgatttgtattcttttgccgggagttagttaccaatgaatattctcaaagtttgtaatgtctgaaatcttttgggtactaaacatttttttcattcctcagtagagcttttgaaaaaattataacatgactttagatttctttctggagtgggagaagaaatgtagggaaaagatggacaaaattcaactccctttcttacccaactattagtaaatgaaaggcagtcagagcatgaatgtatagggagcccagaaatggaagggatcactgttggtctggaactgggaaatatatgtcagtgatgtggaaattaggaaagttaaaacatttggtagactttcagagaataaaaatttgactggggctgggcgtgatggctcatgcctgtaatcccagcacttggggaggccgaggtgggtggatcacttgagcctgggtgatgtagtgagactctgtctctataaaaaaataaaaaattagctgggcgtggtggtgtgcacctatagtctcagctacttggaaggctgaggtgggaggatgggaagattgcttgagtgcgagagtttgaggccgcagcaagccatgctcgtgccactgccctccagcctgggtgacagagtgagacctgtctcaaaaaaaaaaaccaaaaaacaaaaaaaaaccgtggttatgtgggcctgggatctaatttctgtaatgcacactatttgccagggattacactaagtacttttgtatctcttaatcctttaaacccttatacgaaggtttaacctttttggacaatttcagttcttatttcctgaataagaaactgaggttcagagagtgtaactaacttgacaaggtcacctcacatcaatcagtggtacagaagtttgaacccatatttgttagagttgtaaacagcttgtattctgccacacacatggaattctctaagtttgtttgcttcccataagtgatgacgtggagcactcatcatcaaaaatcgcatttagctttgaagtttggtctttgacttcttggcctgagagataagcagcataaacagagtaatggaaaaaggcaaactaaagacaaaaataaaatttgtatataaagagatggccgggcacggtggctcacgcctgtaatcccagcactttgggaggccaaggtgggcggatcacttgacgtcaggagtttgagaccagcctggccaacatggcgaaaccccatctctactaaaaatacaaaaaattagccgggcgttttggtatgtgcctgtaatcctagctactcaggagtctgaggcaggagaatcacttgaacctgggaggcgaaggttgcggtgagctgagattgcaccattgcactgcagcctgggcaacaagagcaaaactccatctcaaaaacgtaaaataaaataaataaagagatgagttgtgagcattttgtgtttaaataagaggagatctggctgggtgcggtggctcatgcctgtaatcctagcactttgggaggccgaggcgggcggatcacctgaggtcaggagttcgagaccagcctggctaacatgctgaaaccccgtttctactaaaaatacaaaaaattagctaggcacgtgcctgtaatcccagctactcggaaggctgaggcaggagaatcgcttgaacccggaggcggaggttgtagtgagccgagatcacgccattgcactccagcctgggcaacaggagcgaaactccgtctcaaaaaaaaagagatcctcatcacacctaccacttgtacactggagaattgaaggggagttgggacagcaggaagtgtgttagaagacagatattcccaagagcgtgcagtgttagaccaggtgctttgcaggataggcctgaaatgttcagacaagatataagtggtgggaggagaggccagactgatgagtaggggaggtagtaacagataatgcataaccttagtcacttcttgcttcatcttatatctcttactaccactgcagccttctcattacctccctcctccagaccatcctggaaaccacttccgttcttccccgttcttccccagaagacttattatcactatgttccccagctttaaaacatccagggacttcccattgcccaccagacaaaacccagcctccacagcctaaggtcaagcccctgactgtctggtcctcctctctatactcagccttatcttccttttgctctttgtttctgtcaaactctggccccctgctcccgcatcatctcctaaacagcctgtgtccactcccagcaacagggcactctcttctccaactcagcaaggttttttttggcccctgccataggtgctaactctcttagtcactgcacatactgacctgtgctgctttatatcaggaaatatcacaggctggggaaagtggttgtaagtttaagtgcttgcagaaattgactccagtccctaaacacccagcaaaatgctgttctgacccccagggcttcagaggctatttatttagtcctggtgtaagtgcaaattaatgtccttggtcatactctgatgtccttcagcagaaggataggaatgatttattggcagttactgtatgaattttgctgctctgtcagtgacttaagatggatcactctctggtaagagaagaatctaagtcctttctctgaaagccacttgtggttttaacatttctggagcctgattatccatgtcctgctctcagagatacaaggtgtgtgcagtataggtagatgatatatatgggaatagagtgacacttttatttacacattttgccttacattataagtaaaggtgattttttttttaatgtagctatttccattctagaagtaattgattttcacaggcaaaaacagcagttatgttggaaaaagaacaagaaggcaggggcctagaagcgcgtagaagtgaatgagtaatctcaggaagtactaaaagggaccttggagatcagctagtccaactgtccattttacaggtgagaaaaatgagatccagaattctgattttccatatttcacataaccaaaacatgagctgaggattcaggcctgacttcagtgtagttcttttgattcttattccttttctcttccctccatcttttcctctcctgcccactcccaaagttcctgtattcctctaagcttttgcattttactctgcgcagcctttagatggattggaaagctctctaatgtttcactgaaaggaccatactgcacttcaccacataccttcctgtggctgccctgaagtactaaaaataaagtattcaaggatagcctacatctgtagtagaacagtacctgaatagtgtcagctttttgctgcaggggtatttcaaatttgacttttaatttagaggtagctaatataaaccttttaaaaaattattcctaagtaatcctttgcactaggaacaaacaaacaaaaaattacatttgggtatattgaccatgctaagaagaaactggtgcccaaccagaaggtgatacatggctgtcttctaacaaatgcttcatcattttgccttgaagatatattttgtggatatgatttcactttatattctaaggtcatttaagttgaagttcactgccttttatagtactgttttccacttccctattgctgttttagcatgagagagccaactatccttagtggaacctctcttctccacatcactctcaatttatttctatttcataggtccattgtaaagcctaaaaggtctcctttagattcaggaaatgcaggagaccaatagagaggacataggtgaattaagtacttttttcttcctaattaacagatttaaattctatcttttaaaatggttagtagaaagaaatatgccagtcttcattatcctttgcttatgtcatacatgtgatagaaaatcatcagaatgcagtctgagatgaaagagaccttagaaattacctcctagtccagcccctaatattgtaagtaaggaatctgagacccagagaagagaaaggttttgctcaagcttacccagtcaagtaatgacagccacaccaacctcccactgccagtccaggactccttgtagtacgtcatcataaacttaaaaaaaaagaacaagaatggttattcaaacaacttttttcaaaagcgctgttgccttcccattaacaaagattgagttatatcagactattttcccccaaatttaaatttctcttataagctttgccacagccattctggtaagcaaaagttttttgttttttgagacagagcctcactctgttgcccaggctggagtgcagtggcacagtctcggctcactgcaacctccgcctcccaggttcaagcgattctcctgactcagcctcctgagcagctgggattacaggcattcaccaccacacccaggtaattttggtgttttttagtagagatggggtttcgccatgttggccaggctgttctcgaactaccgacctcaggtgatccacccatcttggcctgccaaagtgctgggattacaggtgtgagccaccgtgcctggccagcaaaagttttaattacacatttttcttcatttcttcaggtcagtctaataaacattttagtagacatttattaagcaccaactatgtgcttaacactgtgctggcaatacaaagacagtccttgccttccagaaaactaccttttatctgtactaaaactacatcaaaagccctttagtggggcaaaaatgacagcttccatgttttattcttagaatgattggtgacgtagatagagaattctagtttccttctctacctcatcttcattccatctaccggcaattcatgctaatccacagttgtttgcagggttgacagagaaggtgactatagcagaatcaggcttgctaatgggtgtattctaccacttgtgctgtcacctgttactggtgtaatccacgtatacatctgtgcttcccattcactttgcaggtatagccgagaccatgtggtggaaggggaaccgtatgctggttatgatagacacaatgcagaggtagcagcctttcacttggacaggtgcgtatgatcacagcagcttatgttcattttgtttgctttcaaaaatctttcttggagaggactcgtggactccttcagaaggatgcaacactaataaataacttgttatcgattttagatagctaattgactagttccattaaacttgtatgagtctcataatttggttggcaccaggaatactgaagtattttacttccatgcttctttaggtcatttcatttctggcctgctctgttattatcatcagtgaagatattcttggtaaataaactttgaacttaaatctctgaattgaactggtcgttaattgggtctagccatcctgttgttttgttatgtatttgttttaagtaagtaatgctgacttatttccatgtgctggaaacatatagcatgaaatatgagttttattattctttatacaaactatgcacagcttcaaaaaccagaataattacaaaaggaaagggccaggcgtagtggctcatgcctgtaatcccaacactttgggaggccaaggtgggcagattgcatgagctcaggagttcgagaccagcctgggcaacatggtgaaaccccgtctctactaaaatacaaaaaattagctgggcgtggtgacaggcacctgtagtcccagcttcttgggaggctgaggcaggagaatcgcttgaacccaggaggcacagcttgcagtgagccgagatcgtgccactgcactccagcctgggcgacagagcgagactctgtctttaaaaaaaaaaaaaaaggaaagaaaatagatgtgaattataagtttgtaagttaactaggaaaattctttttttttctttttcagcaggttactagtcaggaaccttgcagctgaactgtctggtatcccagttactctgctgaccagctctttcataaggccatattggctgactttaaaagaaactgctaacaatatttgttttaaaaaattaatttatgactggatgcagtggctcatacctgtaatcccaacactttaggaggctgaggtgggcagatcacttgagcccaggagttcaagaccagcctggacaacatggagaagccccgtctctactaaaaaaatacaaaaattagctgagtgtggtggcgtgtgcctatagttccaactagtggggaggctgaggagggaggattgcttgagcctgggaggtcgaggctgcagtgagctgtgatcacaccactgcactccagcctgagcaacagagtgggaccctgtctcaataaaataaaataaaataataaataaattttttttctgagacagagtctcactctgtcctccagactggagtgcagtagcctgatcttggcttactgcaacctcgacgtcctgggttcaaacagttatcctgcctcagcctaccgagtagctgggactacaggtacgcaccaccacacccagctaattttttgtatttttagtaaacacggggtttcaccatgttggccaggctggtctggaactcctgactcgaggtgatccgcccacctcagcctcccaaagtgctgggattacagacgtgagtcaccacgcccagcctaaaaatgaatttataaggaaaccagaaaaaaaaaggtgaaatgtttgtctttttctgaattaggattttgtaaacataaaagcaataacttaaaaatcacaaattcaatagtcttgactaaataaaataatgaacttatatagcaagagacaaaatttaaaagcaaacaacaaacggagaaaacacttgaatctaatgtaatctgagtattaatagccttaatatgtgtttatacaaatattaatggtcttaatatgtgtttatacaaacatatgtatgttaaaactctattagaaaatgggttaagagtataaacattgtcaattgctaataaatatgtggggtggggggaggttcatcctcaccagaaatttttaaaaattcagatgagatactgtttttacctgttgaaaatggcaaagcttaaaaaaaagataatactttattgggaggaatacattgagattcatatgctgcttatggcattgttaattgtttcagtctttttgttaagaaccctagcattatatatcaaaattaaggataaatatatcaacattaaggaatgttcatatcctttgaacaaataactgcttttttatacacatatctaagacatttctaggaactaccctagagaaagaatacaaaattcaaagatatatatacaacagtcttagctgtagcattttcaatagtgggaaaactggttgtaacctaaacatctattgatatggaaaagcttagatatgtgtgtacaataccatgaatttttgctgccccttttaagacctagtggtggacagttggataaatccttctcctcacttaatggcacactagaatcaggctttccaagaccttatctgtttgcctcttttcttcgtccccaactcccttcttcctatcctgtttgttggaaaccaacaggcataaagttcctcatttctgtaccagtgttttgtattgcccaacacactaagttttgttgatatatatgtaaagtgatatttcattgttatttcattgttattttgtatttccccattactggcaaagtttatcttttcacagcaggacacctatttgttatcttagagtatttgtgtacttttgatgttaactaactataatgtttcagtttgtgacttgggctttgggagtcttgtatttaaaagtccttccctacctcaaagtctgaaagatgttctcttgccagtcgccctgtcacttttgttaagtgccaccgtagccagcctcaagtgccacagtaacattgcccctcaatgctaaactggctgctgttcttgggcttggcaattttcaatgggaagaaaaaatacttcccaatctaggctgcgtttgtagtcctaggtaccagggaggctgaggtgagaggatcacttgagcccaggagttccaggctgcagggagctatgatcatgccgctgcactctggcctgatcaacagagtgagactcaaaaaccaaccacccaaacaaacaaacaaacaaacaaacaaaacacacacaaaaaacccttcccaaccttttccatttgtggatcttgatacttttctgctttgggttgctgtttcttcattacagtcagatttaaccaccttcccttgcctctgggggtatctctggatttctatgttattttgacaaatctgttgatcttgcctttgtggcttttctaagactgtgtttaggacagaatcagcagccctaaacaatagccatttgtaaaggctttctaatgactggggaaaaggttcatgatacaatgatgagtacaaagcaagatataaaactgcatacaatataatctcgattgtatgtatatacgtaagtgtgagtgtgtgtttatatacccacacttaaagggaaagcatgcttatatgccagaatgtcagcacctgtaattatttctgggttgtggaatcataggtgatttttattttcttcattgtaaattttctgtgtgttccaaattctgcccctccaacttttgttcagttggtgtatattttttagccaggaaatttcatttttttaaaataaatcattgttttcaaccttttagattattagagatatcttcaaatgtctctatatttaatttgctctgtgggcttagccttttagatcagtctgcttttttttttttaaccaacatgctgttttatttaaagatttgaacccatatatgagtttgggtcccattttttttctaatactttcctaaaatctatttttaatttttattatgaaaaaatttctatcatacaaaagtagaaagaatagtataatgagcccatatacccactctgtagatttaaaaagtgttcacattttatcagatttgtcttattctttttgctgaaatgtatattaaaataaattatacacaccttcacattaaattcctaaatatatgtacctctaaaaaattaggtttagctactagctaaaaaccctttacacatttgacatgatgaactgtaatttttaagactgttacttaaaaaacatcccctaagatttttctcttctgttcttcaatcttccaaaccaggattctgggtttccaccgagcccccttggtagttggcagatttgttaatcttcggacagagatcaaacctgtcgccacagagcagctgttgagcaccttcctaactgtaggtaagaagattgtagaggacatttatataggggaatgattaataagttaaaatggggcattgttgagcaagctggctcatgacttttaggaattgaagaactcagtggaatacaaaagcaaatcagacaaccagctctcaggttatttgggaaaatgaatctaaaggagatggcaggaaattgaaattttcctgtatactttgtgttgtctgtgacatagggagtgaggtcatttagtgatggtgaaagcaggtgattatttccttctgctttctcttagagctattagtaagtctcaaactcagaatttggcctaaattggttattgtttgtatatcattggctcagttgtttttacatatataatatgtttcctcaggaactgtctcccatctccttagaattgaggaaatcttaaggcaactctttaggaggctcagaaattattttgtaaggttgtatttggacctggaagatcaacaggcctactccttctgcaagggttaacctataactcattgtgcctggaactggctatgttgcccctggcctctgttttccattatcttaactctgaggtaagagatctgagctaaaattctcactcctgttgttgtgagcaagatgagaatgggaagaattcaaaagtgcggtggtttcttgtttccacctcttcaccttgactctttttcagtgatacagtgctctgcattagggcatgactgttgaaacagacattgcaagatgaacttcaccttgcttttttttgctagagtgagtggatttacatttaaaatgaggaaaaactgaatatttaaaggacttatgacagattcatcattcagaatttcaacttataaggcttgggctatacttttcttatagataaccaaaagcatacaatgttagatattgtatcagatatttgtttcagatattttctaatcacctttggttgttcagttttatgtttagcaagcatgaattcctggtgggtgctgggattgagggaaagagtccaagaagaagaagccagggtacctgctcttcaaaggctcacagatggtcaactcacacattgtatgaagtgtgggtaagggaaaagcagaggatttgtagaggaggttattaacacttgaactgagtattgaagaaccagtatgagttaccaaggcagcaaagaggaaagggcattggcaaaataatgggaatattaatgagaacaagggcataaagactggaaagtaataggtagagggatttggctggaggtaaagttcttaataatcgtctgaccttagcataaccttgttgttattgttgtgtttttagactttattgtttttagagcagctttaggttcacagcaaaactgagaggaaggtacagagatttcccaaataaccgctgcccgtcacatgcatagtttcccccattatcaacatctcacatcacagtggtacagttgttacaattgatgagtccacactgacacatcataatcacccagactccatagtttacattcccattcactcttggtgttgcacattctgtgggtttggacaaatatataatgacatgtatacatcattatagtatcacacagagtattttcactgatctaaaaatcctctatgttccacctattcatcattctccacccctctctccaatccccttgcaactactgatctttttactgtctgcataattttgccttttccagaatgttacatagttgaatcacagtatatagctttttcagagtggtttctttcacttaataatacacatttaagattcctccatgtcttttcatgcatggcttgatttatcatttcttgttattgctgactaatgttccattgtctgatgtaccacagtttatccatttacctattgaatggcatcttggttgcttccatgtttgggcagttgtgaataaagctgccataaacatctgtgtatagctttttgtattgacataagttttcagctcttttgggtaaataccaaggagtgtgatttctggatcatatagtaagagtacatttagtaagaaactgccaaattgtcttccaaagtggctgtaccattttgcattcccaccagcaaagagagagttcctgttgctcctcatccttggcagcatttgatgttgtcatattttggattttgactattctaatctagtaggtgtatctcattgttttagtttgcatctccctgatgacatataatgtacagcatctttacatatgtttttctgtcatctgtatatctttgctgaggtgtctgttaaggtctttggctcatatttaagttaggttggttgttttcttactgtcaagttttaggagttcttggtatggtatggccgaaagtcctttgttagatgtgtcttttgaaaatattttctccagctggacacggtggctcatgcctgtaatgccagcactttgggaggccgaggtgggcagatcacttgagggcgggagttcgagaccagcctggccaatatggtgaaaccctgtctctactaaaaacacgaaaattagctgggcatggtggcacacacctgtaatcacagctacttgggagactgaggcaggagagttgcttgaacccaggagacagaggttgcagtaagctgagatcacgccactgtaactccagcctggtcgacagagtgagactccatctcaaaaaaaaaaaaatattttcttcaaatgtataacttgtttcattctcttgatgcaatttttaaaatgtattattaagtaagttggcctataatacaagaataactaaaatctgtgtagccccggcaacctacccaagtatgttcacactgttactttatctgatccttttgacaatagcatgcaataagtaggtgaggtgttacccacattttatacctaagagtggaggcttagaagtgtctaatgactttcccaaagtcacaaaactactaattgttagccaggatccaaactcagattttaagactctaaaatctttcattagcttatagtctttatttattcagtacgactttatttcacttctgtttgacaggtactgagctaggtgctgaatatgcaaaactgaatgaccttcttatcttcaaggatctttgtctagtgcgggagccagacatgtacaaaggggctatggactgttggggtgggggtgggaatagggaggtggccaagaagttatggccaggtgataattcgtgaaggtgatattttaaccaagtcttaaagggaaaatagcagtctcttaggtagatacagtgggaaagaatattttaggtttgtatttaacattttttgtgctatagatacctttggcagtctggaaaagcttacagatcctttctaaaaataaaggttttaaatacatacagaaattaaaatacatagacttataaatgaaaccaataatattgaagtataatttcagtatcaaaaattttaaaaagcaaatttagatacagtaatatgtgctttgttatttaacacattaaataagatctatcagattagtcactactgtgatttcaaactatgattataaatagtattttgaggttatctgcaacaatgctagtatgatatgaaaaatccgtgatttcttgtagagacaaagtcacatgtaatacaaatatgacggtttgctccctgccatcataatagaaggaaatgctaatttttagtagaggttagtgaaaataaagatgtaattttgttcccatccagcttacagaccctatgagttgaccctgttccaggtagaggacagagcctggacaagggtgatgagcaatgagagaagagcaacaagctcaggagactgtgctgtttagctgaaggaaaggatgtgtgggggctggccagtgaggaagacagctggtcaggacagtgtcactgaagggcctgtgtaccatgcttaggagtagagactttctctttaggcactagaaagccattaaaagagtttgaatatggaaaaatcagatttgaatttcaagagcgaattgtggcagcattgtcaagggtgcattgggaaggggagaatcaagagctgagagcactctgggagtgttgtgaattcatatgtaataagagaactaaagcagggacagggaatagaaagatttaagggctattcaagagttggaatggaaagaatttggtgaacatttgggctgggagagcaattgagagagaagaaaaaattaagaatgactcctaggtttctggattggatgacaaatgattagtggagctgttaactattttaggaatgtagggagaggagcatatttagggaggtggagcagagaaagataatgaatttaatcttggatattttgtttccttcacaggcacatccaggagtaagtgtagactaatcatttaggagctaaagcctacagtttaggagaaaaggcttggctgaagccatagacattcttgtcacagttggtagttcacccaaggagagcatggagactgagttgatcagaaaaccagtttttaaaagtttggcaatccaggaaatagaggttcagagcctcagctcatggtactgaaacagggatattgaactctggaaaggtagatcgaaccatgttattaaaataagtagctggcatcgattggtgtctgacaatatgtcaggcactgtgctaagcattgccatggattgcctcattcactcttcacaactcagtggtggaggaggtactattgttgtctccattttacagaagttgcttagagagactaaattacatgcccagagtcttgcaatctcatcattaaactagtctaaatgttaaccccaggaacctgacctcagaccccacattctcccttctagttatgaagattcttacttaccaaactcaagagtttggattgtatcctataggaaacaggtttcctataccaggcagtattttgtttgttttagggctttacatttttatttgaatcagtaatggattcacacaattcaaaattcagggaaattcaggccaggtgcggtggctgacgcctgtaaccccagtactttgggaggctgaggcaggaggatcacatgaggccaggagtttgagaccagcctggccaacatgatgaaatttcatctctactaaaaatataaaaattagccgggtgtggtggtgcacgtctgtaatcccaactacttgggaggctgaggcaggaaaatcacttgaacccgggaagtggaggttgcagtgagccgagatcatgccactgcactccagcctgggagacagagcaagattatgtctcaaaaaaaaaaaaaaaattctgtgaaattcaatgaaaaattttctcgtctgtctagttccttcccctttctccaagtggcaacctttaactagtaatttccttatgtctttttgtatgaaatatatatatatttttttatttatctctaccattttatacaacatatggcacactttgcatacttctgcatcttactttttttacttaatagattctagaaatctgtatcacatcaaaagagcttcattgttttgttgtttcacactgcaaagtgttccattatttgggtctaccataattcatataaccagaattttattggacttaaatgttgttccaatattttgtttttacaaccagtgttgcccagaattaccttgtatatatgtcaggggtccccaacccctgggctgcggaatagtaccagtctgtggcgtggtaggaactgggttgcacagcatgaggtgaggggtgagcgagcattaccgcctcagcaccagctccttgtcagatcagtggcagcattatattctcataggagcacaagccctattgtgaactgcacatgtgaaggatctaggctgcacgttccttatgagaatctaatacctgatgatctgacatggagcagtttcatcctgaaaccattcccacccagtccccaacccctgtctgtggaaaattgtcttccactaaaccagtccccagtaccaaaatggttggggaccacccatatatattatttcacacatgagcaagtatttctagaaatgggagtgctaggtcaaaaggcacgtgcattttaagttttgataggtgtggccacattatcctatatagatgtttaaccagtttatattcccatagaaatatataagagtgactctttctgctagcttcaccaacaatatgttattaaacttttggttttgtgtatttcatatgaagcatctttttgtttgagagctatttgtattttctgttaactgtctttgcatatcctttgctcattttctgctgtgtcattggtcttactgacgtataggagttcatccctagggcatatagtcttttgtgacatgagatgtaaatactctttgtcgaattttttttttttttttttttgagatggagttttgctgtgtcacccaggctggagtgcagtggcacaatctcggcttactgcaacctttgcctctcagattccagtgatcctctcgcctcagccttccgagtatttggaattacaggtgcacatcactgctcccagctaattttgtatttttagtagagacagggtttcgccatgttggccaggctggtctcaaattcctgacctcaagtgatcaggagttcacttagtatgatagttgccaaatggtgattttttttttgaaatgctctctctcagcagtatcaccaagtgatgatttttgtatttttatttttttgagacagagtctcaccctgtcacccaggctggagtgcagtggcacgatgatggcccacagcagcctaatctcctggtctcaagcaatcctcctacctcagcctcctgagtagcttggactacaggcatgagtcaccatgcctggctaatgtttttacttttagttttatagagacaaggtttcattgtgttgtccaggctggtctcgaattcctgggctcaagtgatccttctcccttggcctcccaaagtgctgggattacagatgtgagccacagttcctggtcatcaaatgatgatttttttcattctatcgttgcttctagacctattagttgtcattctgttgaagggtagaactcccctgcctccacacattcatgtgcttatttatatcaccatgaactcactatgagctacaatttatgaccattataattatttggatgcttaaactgttccacatttggccggtgggaacctctacaaactagttcctgtgtcattttggaatggtcccatcattctccaagcactttcttgcaactggcataacactgtggtccaggatcattaaaaggaaccctagttccttttttttttgagatggagttttgctctgtctcccaggctggagtgcagtggcgcaatctcggcttattgcaaactttgcctctcaggtttcagcgatcctcctgcctcagccttccaagtagttggaattacaggtgcacaccactactccttaattccttttaatgtggtactaaaatggtatttaggaactaccctgtgggcgctaggtgtgctcattacttcctgggtgtcattgtttccatgttctcttgaaggacagaggtgggaaatatatgtatatgtgtgcatacatacacacaagatacatctgtatctttttctgaatctgtgtgtattaaaaccatcaattcaggcctggcgcagtggctcacacctgtaatcccagcactctgggaggctgaggtgggtggatcatgaggtcaggagttctgagaccagcctgtccaatatggtgaaaccccatctctaataaaaatacaaaaactagctggcatggtggtgggcgcctgtagtcccagctactcgggaggctgaggcaggagaattgcttgaacccgggaggcggaggtttcagtgagccaagatcatgccactgcattctagcctgggcaacagagcgagactccatctcaaaaaaagaaaaacaaaaaacaaacaaaaaaaaacacccatcaattcaaactagtatttccaattctaattcaccactgcaggatttatcctggctttctctctttctgtatgtttaactctcttctccactggtgagaagcctggttactgttacactcagtctgtctacttatttgctcaacttccccccttcctctatacctacccctctatgtaaccaaactcttggccacacttggcctagtacatgacctcttttgccctcccctgggcactctggccaagatctcagccctaatgaagaagaggaggatgttactttcctttaattaaagtgagttcaggccgggcgcggtagctcacacctgtaatcccagcactttgggaggctgaggtgggcggatcacctgaggtcaggagttttgagaccagcctgaccaaatggtgaaaccctgtctctactacaaatacaaaaattagccaagcatggtggcatgcgcctgtaatcctagctactcaggaggctgagacggaagaattgcttgaacctgggaggcagaggttgcagtgagccaagatcttgccactgcactctagcctgggcgacagagcaagactcagtctcaaaaaaaaataaaatagtgagtttagaggccagacatggtggctcatgcctataatcccagcattttgagaggctgaagtaagaagatcacttgagtccaggagtttgagcccagccaggccaacatggcgaaaccccatctctaccaggaaaatacaaaaattagctgggcatggaggcatatacctatagttccagctactcaggaggctgagatggaaggatggcttgagccccagaggcagaggttgcagtgagctgagatcacgccactgcactccagcttggatgacaaagccagaccctgtctcaaaacaacaacaacaacaaaaacaaaacaaacaaaaagtgaatttgaaggatactggtgatggtagttgacaccagagagtgagactgggtagaaaggacacaggaggcaagggcaacttacttttgggtgtatatccttttgtactttttaaattttttttacaccgtgtgcttttttattacctatacaggaaaataaatgtttgaaatatagtaaactcagggtctttgttttcaccatgcttatttacttagctactctgttctgcattatttgggagagaacttggagtcttcgttatttccttaagtgtatttggctcctttctgtcctttaggaaacaatacttgtttttatgggaagtgctattactgccgagaaacagaaccagcttgtgctgatggagacataatggagggatctgtcacactttggcttccagatgtgtggcctctgcagaagcaccgtcacccatggggcaggacttaccgagaaggcaaattggccaggtaaatgctcctatgagccattacttaattctcccctgtgcctagccaggtgccaactctgtaaaggagccagcagttctgtccaagagtgaaaagaactgtggagtcaggggcaaaccggtaggtaggaactctgtcttctctttgtgtgtaacagtgccaggtacagtgttgtcactcagtgctgtgatgctgcttgtctccaggtgggagtatgatgagagctactgtgatgctgtgaagaaaacgtccccttatgactctggcccgcgcctcttggacatcattgacacagctgtctttgattacctgattggcaatgctgaccgccatcactatgagagctttcaagatgatgaaggcgctagtatgctcatccttcttgataatgccaaaaggtgagaccagcaggactgtccttgtcagggaggggtttctgtatatgaaagaagggcattttccagagcatcctggagaatatccagaatgcaattgataggcaacatccttcttttttccacttggagtctttgctattggtacctgtccttctctccactctcagggatctcagtacttcaaaaaatggaaaagtggttcttccaaggagtctaagactctatgagcctcttctcagacaactggaaaaccagggttattcatttgttactacctacatcgttctttcttggctatgatatttggtgtttagaagcttgagaaatacagatgtaatagagtgtggaatttgtcgttaaatttattctatccaaaggttcctgcaattaaaaaattaatttatttggtaggatgttttgctatttttgtgtttgtctaggtccatacttttgctgtcatgggaagaagagctgttgcctagtgtggattttatatataacaacaagttacttttatcttgaataaaaaatgtttattcattttgaataaatagaatgtccttatttttttaggcctgagctatttggagagcacattgtatttccatttcatattctgcattctctgtggtggccggtttagtgccacactttttttttttaagtttttttgagacggagttttgctctgttgcccaggctggagtgcagtggcacaatctcagctcactgcaacttctgtctcctgggttcaagcgattctccaccctcagcctcctgagtagctgggactacaggcactcgctaattttgtatttttagtagagacagggtttcgccattttggccaggctggtcttgaactcctgacctcaagtgctctgcttgcctcgacctctcaaagtgctgggattacaggtgtagtgccacacttttagttgcatttaataaatatttactaaatagaacgcttccttggagtacagaattttccaggccctaggtcactactgttaacattggttgttggaaataagctaagacatggctcctcagcaaagagtgcttgggcagcatttgctaatgatgccaccatcttatactgaacaccaggcgcctcatgctttgtgaaagatggtgatggccacagaaaatgaaaaaccagcaaacactgcctctccctctaccccattacagcaaagcacatagcactcatcctgtgatacacatgatacttgatatttggtgtatatcaaaatagttgctttgtccactcgggccgctataacaaaatcccttagactgggtaattcataagcatcagaaatgtattgcttacagttttggaggctgggaactctaagatgaaggtgccagcagattcagtgtctggtgagggcctgtttctcagatggtgccttctatgtgtcctcatatggcagaagaggtaaacacgctccctctggcctcatttataagggcactaatcccgttcatgtgggctcttccctcgtaacttaatcatctcccaaaggccctacttcttaatactgttggactgttgtaccagggattacgaatttgagggggacacaaacattcagaccatagcagttgcctttgccttgaattactggaggacctacactgtactaagggctaccagactctagctattaaggtgagcctctggaaagattgaaaggttgacagttttccagaatcagttctccttttctaactctgaattgctgctaaggtaatttttgcatctgctgtgaatcagtttcctcagcctgtgtgaacagtttttccaatttgaatctgtacttatacttacttgtagggaataggatattgctaatttgggagtagaataagtgtgacttctttttacaagtaatggtcatctgcttgtttgtgggaatctaatataaatggcttttatttctctctggtccttaaaacctttgcaggcttaggggtcttcaagttctccctttggtctgtgaactccgcactgtgtttaccatagttatgctccagcaccttgtgatatcttggcaggaaaatgtcccttgtaaatgagtatatttgttgtcagatattttagtacaggctgttagggatcctgtgtctaattggtcatgccccgcttgttttcaatttaagtgatttgagctgctggagcgtgaaattatctaggatcacatttgagtttcatatagaatttgctattgctttgatgctaagaagagaacagtacttccacctaattcactaagttttaatttaattttcagctttgggaacccctcgctggatgaaagaagcattcttgcccctctctatcagtgttgcatgtaagttatgcacagcaaatacatgtgcctgcattgccttcttttccaggctcaggtaacagtacatccattttcttggccctcaaactttctgatacctgagcagtgcttttcatacttttccaacctagaacctctggacatcctgaaatgggatatcagggaaaggtgaaggcagataacccaaagctcagaattcatctcaaattttgtatgaatagaagattgtatgtatacagtaatacatgtttggtttaatagcagaatataatcacccacactccccaccccactgccaaaaaaaaaaaaaggagtaaaatctgtatgcctggttactacacctggttaccttgtggttttaactcctctcactcacccatcacataccacctggggtttacatatttcagtttgaaattgtctaaaccaaaagtaactttttccataaataataatttattttggccaggcacagtggctcactcctgtaatcccagcaatttgggaggccaaggtgggtggatcacctgaggtcaggagttcgagaccagcctggccaacatggcgaaaccccgtctctattaataatacaaaaatgagccgggcatggtggcaggcaccagtattccagctacttaggaggttgagacaggagaattgcttgaacctggaaggcagaggttgcagtgagccgagattgtgccattgcactccattctgggtgacagagtgagactctgtctcaaaaaaaataaataataaataataattggtttttttaaaaaaactctgtattagagaacagagaaattgaaaaatgagtcaagaaaatgagataaagtctaagctctaagaagcttcttttcatcattcctgaaataattttattttactattttattttttattttattatttttttgagacagggtctgcatctgtcacccaggtaggagtgtggtggtgcgatctcagctcaccgaaatctctgcctttcgggtttaagcaattcttgtgcctcagcctcccgagtagctgggactacaggcacctgccaccaaacccagctaatttttgtatttgcagtagagacgggtttcactatgttggccaggctggtgtcaaactattgacttcaagtgatccgcctgcctcagcctcccaaagtgctaggattacaggcgtgagccaccgcgcccgaccatcctggtgtaattttagagcacgcacatcaagaattagctgggatccaccttgcttggctacacagaaaaacaagttcaagagcaccatttaatactggtcagctcccagcaacatcatatcacataagactgccatagcaactggtctcttaatcttctttctttttttaaatgacaacaaaattctgtagaaagtaacagtttacccaggctgtccttcattgtctttattaatgataggaagcagtgatatatacaatcaagaattgtgtgtttgtctttgaagatgtttttgtggtagtagttttatcagtctggttcaatcaggagatagcaaagacatagtgtgataaacagaggtgtttaatataaagaattttttttttttggagatggagtcttgctctgtcacccaggctagagtacagtggcgcgatctcggctcactgcagcctccacctcccatgttcaagtgattctcctgcgtcagcctcccaagtagttgggattacaggcgcccctcactgcatctggttaatttttgtatttttagtagagacggggtttcaccatattggccaggctggtctagaactcctgaccttgtgatctgcctgcctcggcctcccaaactactggcattacaggcgtgagccactgcgcccgacccaatataaagaattattaaattccaataacaggagtgactataaaagggctgagggagagtacccaaggaaggacaaacttggaaggggatcccctcccaatgactggagtttggacttcagtggagaaggtttagctcagcccaccagatagcagagaagtttgctagtttgcaggtgctgagcaagccagaagcaactctccagagtgcaggtggggtgtacattcaagccacagctggtgtcatgacatgcagaaggagagagagaatccagtagaaaccttctgtgctgcaagtgaggcacacacgtgggccttcagagggaattggggccagggtgagcagatggccttcaaagctctggtttccatgttgagagggcctcgggagagttatccccaggccaggctaaggcttcaggtcaccaaggacccacaccttctgggagtgtggctagacaggtcttcagtggatgacctctctgcctccccaacaccaccattgacccacagaagcatttggagagccccttcaccctgcagtgtcccctttgcgccctctagtgagaatgctttaggggaaagatgcttaaaggaatcccatccgtcgtagcagagcacattttgtttttgtttttgttttgttttgttttttgagatggagtctcgctctgtcgcccaggctggagtgtagtggcacgatctcggctcactgcaaccgctgtctcccgggttcaggcgattctcctgcctcagccttctgagtagctgggattacaggcacctgccaccacgcccagctaattttttgtatttttagtagagatagggtttcaacatgttggtggggctggtctcgaactcctgacctcaggtgatccgtccgccttggcctcccaaagtgctgggattacaggcatgagccaccgtgcctggccagcagagcatattttgaagagtgaatttggagctgagaggaagtaacataataacttagtctcacagaggaagctctgatgctctgggcatttgtaatatatttaagaataaaaataactgtactccgtctgtgcctgtttgtcccttccatgcatgctttatgcagcagtctttcttaccttttaaattgctgcacaacaggctgccttttacagaatcagacatttctgcatacccagtaattcctcctttacccacagagagctaagaacttttcttctcagattttaaataaaagatatgctatagttggtgtcttagttcgttttgtgctgctgtaacaggataccacagactgggtaatttattttattttattttatcttattttgagatggagtctcgctctgttgcccaggctggagtgcagtggcgcgatcttggctcactgcaacctccgcctcccaggttcaagtgattctcatgtctcagcctcccaagtagctgggattacaggcatgtaccaccatgcccgggtaatttttgtatttttaggagagatggggtttcaccatgttgcctaggctggtctcgaactcctgacctcaagtgatctgaccccttgggcctcccagagtgctgggattacaggcatgagccaccatacctggccagactgtgtaatttataatgaacagaaatttattggttcacagttctggaggctagaacgttaaatatcaaggtgccagcatctgacaagggacttattgctgtgtcatcatgtcacatggcagaaggcaaaagggcaaagagagagggcaacaaggggctgaactcgcctttttttttttttttttttttttttttgagatggagtcttgctcttttgcccaggctggagtgcagtggcacaatcttggctcactgcaacctccacctcccgggttcaagtgattcttgtgcctcagcctcccaagtagctgggattacaggcacctgccaccacgcccagctaatttttgtatttttagtagagacggggttttaccatgttggccagcctggtcttgaactcccaacctgagggcccacctcggcctcccaaagtgttgggattacagatgtgagccaccgctcctggccttgaacttgccttttaataacagcattagttccacccatgagggcagagcactcatggcctaacgacctcttaaaagactctaccttgatactgttacaatggcaatttcaacatgtattttgtaggggacagacattcaaatggtagcagttggtgaaataaggcagataggtatccttaaaataattttttccgccaggcgcagtggctcacgcctgtaatcccagcactttgggaggccgaggcgggcggatcacgaggtcaggagatcaagaccatcctggctaacacggtgaaaacccgtctctactaaaaaatacaaaaaaattagccgggcgtggtggcgggtgcctgtagtcccagctactcaggaggctgaggcaggagaatggcgtgaacccgggaggcagagcttgcagtgagccgagatcacaccactgcactccagcctgggcgacagagcaagactctgtctcaaaaaaaaaataataataataattttttcccagtagaaattattttagacttcagaaacacatgaggaagaaggaagtttatagtacccattaacgtctaaggattaacgtctaaggatcctcttgttaacactgtagtgtacttcattccaatccatgtatgtgtattttgttttcctacagatttgaagtgaaacaggtttttcctccaacctcttccccccacccagcatcatatcataggcattttcccattccactaaattttcaaaattgtttttaacagctgcatggtattcctttcaatggatgaaccataatttaactatttcccagtcgttagacattcagattgttcaacatttttcctgttataaacagcactgcagtgaacatgtgtgtaaatctctgtatatatctctgattagttacacagaaacaatatcaaaacatagtaatgtggcttactcattatgtaggggtaattctaaagcaaaaattatttagttaaaggattttacctaattattttttcacttttgtctgcctagcaggctttcaactccgtttgataatgagaagttttatgtaccttgttctataactttttctcccagcattcgggtgtccacctggaacagactgaactacctaaagaatggtgtgctaaagtctgccttaaaatctgccatggcccatgaccccatctccccagtgctctctgatcctcatctggacgccgtggaccagcggctcctgagtgtcctggccaccgtgaagcagtgcaccgaccagtttgggatggacacagtactggtggaagacaggatgcctctctcacacttgtaattctcgacacaaaataagtgaaacttctttttacaaagatagagaaacagcacaatcaattccaaatggtatgagatggattggaagtggccagcagcaagttctggtgacgggacagagtggccttggatgtctttggtattttctgtagtagaaactaaagcaaagaccacaagtttcagagcatggagacattcctgctgaatcgccttctcacctcctcggcaattgctcattctagggttgggcatcatagttggtcagtcttaattcccatgccaaaggacaaacaggtgtgacatttggatagatgaatactgggattggctctggagcatgtgttttgagttgaaccttgcagtcctttctctacgcccgtggattttgtggaaacactttgcaatctctttgtcttttttttttttaccagaactagttacattggaatgcttactgtcctacagagtggcagcaaataaaaccttgcattccatcaagccaaaatagcacactctgttagaggagatacatgtttaagatagaattggagggaaggacaaaaacagaaaaatgtttgggcttttaagccattgggtagtattgttttgatgatcttagaggagggaagaagagagagagacccaatggtagaaccagaatcagggagatgactgaactactgaaaaacaggttcccttgtatttaggatcttaaggtgtataaaaagcaaacatgactttgcacctaagtaaattctgcattctcatagttgtgtcccaattaaccaaaaagttgtctctagagaaaatactattacaatctaagcatgattctctgtggagactaattttttccccttttgccaaaagcagtccttcccaaattaacaaagcaaactgaaataataccttgaataacaggttgcctgtggtctctgtcatcctcgtttctcttctgaaatgaatttccacctctgcctttaaggcatttttgtcactgaagctgctgttcccaagagatcggcaacctttttgtccctttctcataagaaagggacactcctacaggtgagagtgtataccttactctctcagataagtggctggacttatcttgtgatttggggccatggaagattggaaacaaagattttaagccttcttctttttttcttttttcttttttttttgagaccaagtctcactctgttgcccaggctggagtgcagtggcacgatcttggcttactgcaacctccgtctcccaggttcaagcgattctcttgcctcagcctccagagtagctgggattacaggcgcccgccatcgtgcccagctaatttttatatttttagtggagacagggtttcgggtttcaccatgttggccaggttgatcttggactcctgaccccaggtgatccacctgcctcagccttccaaagtgctgggattacaggcatgagccaccgtggccggccaagattttaagccttctgagccttgaaattgaggaggttaaaaggaagagccttaagattttgatttatgtcaaatcctaattctatcattcagtcttgtttggagttctgaacccatgatgttgtattatgcttctttctcctcttagcactctcaaatttcaggtttgtaaaacacagtttttgttttgtgttctggcaaagtgatctcaacatgtaagtagttgcagtaaaacacaggggcaaaggaagacaggcctgatgtgcccactcatctatggactcagagctgtgtgctttgctcctgcatcttgttgaggtgctgttccagctttgcatttctgtcaagtagaggcgaatatataaacagtgtggttgaatacatttaatgccagccattggaaactagttttaggcaaccactctcaaaaacagctttagaatttatgcccagttttcttgcattgaaagataactgagtaataacctgtaactatttttaaatggcatgaaattaggaaacttttgtacattttatatacattttgagatgaacagaacaatgggctgagttataaaaagcgtgtattgaatttaagaagacagactagcacaaaacacagaattcgtgttaaccaaaggaggcattgatttcagttttaaggctactcagtgttgtgtgtccagggaaattcacagctcagtatgagaataccttggttagtgctcacccacaagcttccaggagccagctgggaggagacaataggaagagatgtcatctctgctctccctgtaaatgttagttgaactaagttatggatttgtggtctttcaaatacatgacgcctttagtatgccacactgaaatgaataagaagtcttctgaaactgggaacttcataacattgaaggcagaagattctgctaaggaaaaaagcaggcaggaaagaaaatgtctcatcctttcttgaaagcatttgcagaaaatatatcatttcattttattcccatctgttttcaaactcgtgatcttaaaaggcattctgatgataaatttagaattttcatctataaaatttagaactctaatccataaagttagaattgagctaatagagtggtatgacatggcactaaaaatataaatttttgttgtaagtcaggattggagtaagctggaaaagtatgtttaggcaaatcttggagaaaaccaaccataaacttacagctctaaaattcagaaagccctaaaatttcaaacactgtttgaaagaagaggtgggggccgggtgccgtggctcatgcctgtcatcccagcatttgggaggctgaggcaggcagatcacctgaggccaggagttcgagaccagcctggctggctagcatggtgagaccgtctctactaaaaatgcaaaaattaacagggcacggtggcatgcgcctgtagtcccagctactcgggaggctgaggcaggagaatcacttgaatccaggaggcgaaggttgcagtgagctgagattgtgctgctgcactccagcctgggagacagagcgagactctgtcttaaaaaaaaaaaaaggaggtgaatttttttttaagttttgtaacactgtcctactttatttattagaatctaaggctgttacaatcaagtcgttgcagggtttggatcagctgtaagttaggtatgcctaccaaacatccaaaggtagacgtggagacattttaatactacaaaactaggaaaatcagaactcatggccatttcctgccctcctccaacttgttaaaacatgtttattctaaagttcgaatggataaatttgagtataaaggttttgttataaaactgttctttagtgtaaggctgcattgtgggtttgggggaaatgtaaataattttctgtgtaaaacaaattcataggatctgatttgctcagagtattattcaagaatgtattaataaggcattgccccctgtttgcactcagggttaatatgtcaaatgaaatttaagaaggaaatggaagaattcaggtacattaattgcatattattttgggaaagatgagtcctatacgtggcaatttttcaatgtcatctgaagccagcattatcttccaaagaaatcgatcttttttttctaaaaaaaaaaaatgcttttgccttcccttcccttcccatccgccatatttcttcagcctttcttctcgatcacccgtgtattctttgaccagtaaatgaccacacctcaatgatggtaaaacagcatcatcagtaagctatcttatatgcctcatcctgtgagtttgagcttcaggaaacatgagtaaaagtatatgtaatgtatatagtcgtatatgtattctagcaagaaaaacatatttattttgacaaaggggaacactgactttctgaaggattcagaaagaaccttagtgaaaggttctcagtctctgagagtggaccctaattaacataaagaccattcatcagcgaataactactgagcaactctagtgtgccagcacaggccagacatactagtgagccaggcacatctggccttgggaaactcatcctacaggggaaggccagtttttttcccttcaattcctcaagtctgggtggtgacaaggtaggggctaggtactggactaccacaggtttttaggaactaaggtgtttctcataaacacaaaatgttgggtgaaactgggaacaactactcagaagctcatttatttgcttaaatggaaagtgtgggagccactaccctctcttttgatctgccaaggatttcctctcagagctgttgcacagacagagattgtacttggtaagataccaaacaagacagatatggatctaaatttctaatgtgttctatgggtttcaattctgaaaaaagaaaatgaataaagattttaataaatattgatatctgatcttttcctcttctttcccccttcaggatatttccagtggttcctatttcagttcccttcctgttaggggacagaagaagattacatcttttgtgaccacttaaacttccacagggatagtttcacagtacctggtggattagacctttaaatttcctcaccagtcttcaaacggttcatactagattgtaactataccaaaattttctatgggatcattgttaggtgctttttgtatatttaatagttaactccatttttgcagcttccttagaggtaaagaattatgaatcctgaagaacttgtcagcacactacaaaaaaggcaggaagagaaggccagttgccctagtagtacttcttaggacacctagatttttaacttttgaaatagaatccagcatcataaacctcaaccaggtaactgagcaaagctcttaagatttttattgggccaggcaccatggctcatgtctgtaatcccggcactttgggaggccaaggcccgtgggtcacctgaggtcgggagtttgagaccagcctggccaacatggtgaaaccccttctctactaaaaatacaaaattagccagcttggtgcatgcctgtaatcccagctactctggggaggctgaggcaggagaatcgcttgaacccgggaggcggagagctgggattgtgccattgcactccagcctgggcaacaagagtgaaactcagtctcaaaaaaagaaaaaaaaaaaatagctgggtgtggtggcaggcgcctgtaatcccggctactcggaggctgaggcaggaaaattgcttgaacccagcaggcggaggttgcaatgagccgagatcgtgccattgcactccagcctgggcaacgagcgaaactctgtctcaaaaaacaaaacaaaactattttatttgcagcatatttgtgctagtttttgtcatttgtacatgaatacatgtgggaggctagtagagcctggtctgtgtatctcactgactcaccacatacaaattcttttccaggctagagttcaggattcatttgcttctcaagcatatcagaacgactggtattagagtttgaaaaaggtagctgggagtagggagggcggggctctgttactgggtaattttacctagtatgtttgcttattagactgatttttagcagtcgtcattttgtaaaatagataggaatggtcatagccactggatttccatgggtagggttttgtaaggtaagttgcagtataagccccaaggaataatggtattaaatcacaatttgtgagatatttggtctgtcatcagtagatctgtgggccattgtgctgcaagctgtggtataccattgagatgatagtgactgtcttttccctcaaagagcctgcagtctagacctggcagaaaaaaaaaaaaaaaaactgcttgtgaggcaccaagtccctcaggaattatataaattaattgcagtgagaataagaaacgggagaggatcatggaggtggggattgggagggattgggttaggcagtacctacattgaaaaagtggagattgatccaggcttgacgagaggtgtgtatagaacccctgactccggaaatgcagaactatttgcttagtggatacagggccttctgggcctgtattttcagtatctgggtcaccagaaatatcgcttcaggggtttctcattgttctaggaaatgtttgtgtgccctgtctcttgaggacattctcagtccacctcaagtgctgtgtagatgttaaaggaacatagatgagctgggaaacattcctgtaatgtttctcatgcagggttatttaaatatggagacttgcgtttgttttgtttttgagaccaaatctcactgcagtgcccaggctggagtgcaatggcgcgatcttagctcactgcaacctccgcttcccaggttcaagcaattcgcctgcctcagcctcccgagtagccaggactacaggcgcatgccaccacgcccggctaatttttgtatttttagtagagacggggtttctccatattggccgggctgattggtctcaaacacttgacctcaagtgatccacctgccttggcctcccaaagtgctgggattacaggcgtgagccaccgtcccaggccgagacttgcttttgacccagtgtttccaaggcagatggttctgattgccttcagtggggttgggaagatgtctgttgtaaagctaggtcatactcagatgacatcaataaaggtgttgtgtgccaattttgccttaggcttttttttttttttttggattgacagtcttgctttgacgcaggctggagtacaatggcacaatcatcgctcattggcagcctcgaactcctgagctcaagtgatcctcctccctcagcctctcaagtagctaggattataggcgcgcaccaccacacgcagcttattttttatttttatttttggtagagacaaggggtctagccttattgcccaggctggtctgaaactctggcttcaagccaccctcctgcctcagcctcccaaagtgctgggattacaggcatgagccatggctccctgcacagaaagaccttcttaaagtgcaggttttgattcagtatgtctggggcctgagattctgcatttctaacaagctcctgggtgatgccagtggtggggttctggaaccgcccttgagtagcaccgtaatgcttgctaaagaatcatagttgtctgtagttttcccagcagcctctagatgtccccgtcatccatgagatactgcttccagaactttaaaacgagcacagcctccaaggcctgagacggaaaggagtatttattgaaatactcaagagacgtatctagaaactggtgtttggatttattgtttctacacgggactgactctttggtgaaaaagtgtttacctcttttttttttttttttggaaaaaaacggccaggcgcagtggctcacgcctgtaatcccaacactttgggaggctaaggcaggcaggcagatcacctgaggccaggagttcgagaccagcctggccaacatggcgaaaccccgtctctactaaaaatacaaaaaaaaaaaaaaagcgggggcgtggtggtgaacgcctgtaatcccagctacttgggaggctgagggggaagaatcgcttgaaccggggaggcggaggttgcagtgagccgagattgcaccactgcactccagcctgggcgacagagcaagactccgtctctaaataaataaataaataaataaataaataataaaaatgtcttgaaatcaagttggttgtcgaagaacttcccagctaacctactttatttacaatgggatgctaaatccaagtcagaacatctcagaaatgagcaggtagccctacataaaagttccaagtacagataattctttccacaacatcttaaaacttggattgttttaataaactattgttactattaattttttcaccataaattcacttataaaccaccagtattaactaaagccatccttgcctcctgtgtagaccacccagagcctcctccatggctgggtagatacaaaaataaaactggccacgtattgagtgttgatgatgtgctcattgaatgagctcatttaatcttcacagcagccctatgaggggactattttattatccctttttataggtgaggaaacaggcatgggacggttcagtaacatccatggttgcacaaatagaaaatggtaatcactatattagactgccattcagactcaaacgacatttgttgagtgagttaattttttttcttttctcttttttcttttttttttttttttgagatggagccctgctctgtcacccaggctggagtgcagtggtaccatcttggctcactgcaacctctgccccctgggttcaagccattctcctgcctcagcctcctgagtagctgggattacagatgcgcaccatcacactcagctaatttttggatttttagtagagactgggtttcaccatgttggccaggctggtctcgaactcctgatctcaggtgatccgcccgcctcggccttctaaagtgctaggattacaggcgtgagccaccacaccctgcctaattttttttggttttccaataagcactgtggtgtatgtgctgttaactgtctccggtggactccgcaagctcgatgtacacagtgctgggctggtgccatggctgctactctatgaaaagtttttgacatcacactgaatggctgagacactataaacattttacttttcaactcaacctcgtgtcctagcaaaggtgctttatctagtttctgtagctgttcgaatgaaaggcacaaatttggtgagctgctgagaatggagcagacctggcacggtgtgatctaagagactggggtgaacagatgaatcaagttgcctgtgacatttgtgagacacggtgctagtattcaccttactgtctggagggcccaacctcaaagccactaaacatatgacattagccaagtcctctgatctctctagacagcagttttctcctaagacaagacggctttttggcttggctgaagtaagccaggtgattttaaacaatgcattaagctcttctgaaatctaacagccttgttccatgctcctcgctatggagaagagagcgctgagggaaagaggccctgtagtcttttgccaatggtgtcggatgggctgctcagtcccagcacttgaaagttgcaaacctagtcaagaaagtgcacacagtacttcggatttttatgagatataattacattgacatgacgcctcatgatttacccatgactcggggggtttccaaactccaaacacctccagactggagcccgtcaatcagcttcctcttgcttttcgtggactcccactgtggaaacctgctggtgttttgctgcggtttcatttccctctgcggaggagccagggcaaccttggccagacaggcacctagctgtgcccttctttccagggcctcttctccactcagctgactcccctggcctgcctaacgctcctgactgagacggttttccggcttcctctaacaggttggcgggaagttgatctgcaaacgcgaggcaaagcaggagtgtccttattcggtaggcctctgatgggccaccagagccgtccgaaagtcctagcggagtgattgacagtggccatttcaaagcctgagttcaccttctttgcaaccacaatcacgacccagaataaactgcttcctggaagccggctagttgcacctggcctgaagtcagtctcgggactgcctctcaggaccccagacagggtttcgggttcccgcctgggtcacgtgtacggaggctgccagtgcgcactcagcccggcccgccggtcgccacagcaacaccaatcccgggttcaagcccgcctaggaagtgcggtccccgcctgaccgccccgggcttaagggagcctggctaggccggcagccggatggtcccgcagctcggggccggccatgcttcgcggtccgtggcgccagctttggctctttttcctgctgctgctcccgggcgcgcctgagccccgcggcgcctccaggccgtgggagggaaccgacgagccgggctcggcctgggcctggccgggcttccagcgcctgcaggagcagctcagggcggcgggtgccctctccaagcggtactggacgctcttcagctgccaggtgtggcccgacgactgtgacgaggacgaggaggcagccacggggcccctgggtaagaccccgtccccacggtccgccgttcgctgcggagcagagtgcgatccgggcgcggctgtggtcgcctcgctcctgtccggggcgacatctgggcccgcagtcctgctctgctcagccgccggtaccggctgtgggcgggggcagcctccgcggagcagggagccccatcaccgcccttgccccacccgcgtcccctgcgcacccccctggcgcccggcttcccgtcccccgcctcccctgatccctgcgctttccagattctctcgcaccgcctgtgccatctcccagcccaccctggcgttattcgaaggtgttgctcttgacagctctagggaacgtccgctgtggacatgcctggtgactgccgtctcccttgctgcttttggacgcagggcttgaggaccgacagtgggccgagtcggggctgggagttagaatctgagttctgggtgtccctctgtccctgacaagttgtgtggcaaggttgccgcatcactgtagagcaccggatggtctcctctcggtctcacagctcctccttttccaggctggcgccttcctctgttgggccagcggtacctggacctcctgaccacgtggtactgcagcttcaaagactgctgccctagaggggattgcagaatctccaacaactttacaggttggaccccgcatggcttcaaggggctagggatctgtggggaggggaggcagtccaggggaaatggttagatgcaagggacctttcgtcatcctgcccagcctcccgacaagcaggaactgccacagtctgactgaagttttgagggagtaccaaatgcttgagtcagggaagcccctttttagcctctagcttaatagcccaggcaaactgagctgtttgtcaggcccagagcaccttgtttcactctaaacagaaacagctacctctcagagggggctggaactatccagagagaactgatcagaaattctgggttgtgattaaaagtgtccctttcttttcttttttttttttgagacggaggcttgctctgtcacccacactggagtgcagtggtgcgatctcagctcactgcaccctccgcctcctgggttcaagcaattttcctgcctcagcctcccgagtagctgggattacaggtgcctgccaccacgtccggctaatttctgtatttttagtagaggcggggggggggggggggggcgggtttcaccatgttggccaggccggtctcgaactcctgaccttgtgatttgcctgccttggcctccaagagtgctgtgattacaggcgtgagccactgtgccatggcaaccagtattttctaattagtttgggttgcttgatttgcatatcgcagttgatttgcattttcactctcacaaggtgatctttggccccatgttctgaaacctgttcagacatttgcaaaagcttcctctcttttccccaggagcaatttcttgcccagagttctcctgatcccaggtccttcaatctccataaatgaggcccaccccagatatttaggtcacttaattggccaaaatgccaataacacagtgtgtttagggacacagtctggctcaggacagaagataggactacatacaggtcaggaagtcttaatttggatcactgctgacttggataagaccctaggtagcaattagcaagttactttctgtcctcaacatgccttttgttcgacaagggcctggatatccaaattgttctggccagcggattggagacccctcctagtcgtgcctcttccttgctggcaaactgaagagtccttcccaagtgtccgtttcctcagctgtattttattttattttttttacttatttattttgagaccaagtcagtctctgtcacctaggctggagcaatctcgtctcactgcaaactctgcctcccaggttcaagcgattctcttccctcagcctcccgagtggctgggattataggtgcccaccaccatgcccagctaatttttgtatttttagtagagagggggttcaccatgttggctaggctggtctcgaactcctgacctcgtgatccgcccgcctcagcctccccaagtgctgggattacaggcgggaaccacctcgcccagccagtttcctcagctttaaatgggaataataatgcctgccttgcagaattgtgaagaccaaatgtaaaacacttagcccagttctgaatacagagaaaaaagcagcaaatgttaattttcttctatgtcactactacttttggagcaatgtgtgatgccctcaatgttttatcatagaccttgacctcccaaggctccagaatacctgctctgggctggcttaaggtgttcaaccaattgatcctggatttggaatgctcacccacagctggccgcacaccctgcctgtctgcactgtggctcctggtagcgccatctccaaatcctacaacctcacgtctgacaggaggaagttagacctagcagaaggctttgcacactggagctgctctcaccaagtgttggctgaattgaatgagaatgaataaaatcaggcttctccataaaacagggagccctgaaaccaagggatgggagcagcctcaggacatgggggacagggttcctccctagacaggtctgtgccaactgttctgggtatctgcaggatctttaggaagggtgattccactctccctgagtcccatcttgatttcccaaactcttcaaaaagtagtccttgaggctgggcgcaatggctcacgcctgtaatcccagcactttgggaggccgaggtgggcggatctcgaggtcaggagttcaagaccagcctagccaacctggtgaaacccgtctctactaaaaatacaaaaattagctgggtatggtggtgggcacctgtaatcccagccactcgggaggctgaggcaggagaatcgcttgaaccagggaggcggaggttgcagtgagctgagattgcgccactgcactccagcctggtgacagagcaagactccatctcaaaaaaaaaaaaaaaaagaaagtagtccttgaatcccttctgctacaaagtctgccctctggcttcttattctaaggccaaacaggaggagtaactgattccacccgagagagattcagagttgcttggtttcttggctgttggctgttgtggtggatgggcctgtgtgtgccttttgctgtgactacctctttcctgtccttaggcttagagtgggacctgaatgtgcggctgcatggccagcatttggtccagcagctggtcctaagaacagtgaggggctacttagagacgccccagccagaaaaggcccttgctctgtcgttccacggctggtctggcacaggcaagaacttcgtggcacggatgctggtggagaacctgtatcgggacgggctgatgagtgactgtgtcaggatgttcatcgccacgttccactttcctcaccccaaatatgtggacctgtacaaggtgaggccgaccagggctggggtgaggcctctgtgctgggagggagacccttctgccagcccttccttgcaaggaaatgggctctggagaagcctggggaggtggggacaggtggcagaacctgtgacagagccactccgtccactcctcacagaggcccttagcatgtggaagagactggcgttccaaacaccaccccctgctctgtccccaaacagccacactcgagaggctggacactgcgcttaagcagggacgctgcatgttgatttttgttgtagaagtagtgaaatgtcacagactgcagtgtagaacagagaaaagcaaaaactgtcagactctccacacggacacacccttgtcagctaaggagaggtagcattttatgtgctgcctttggtgcggaacctttccccaggctctttgtcattgtaactacgttggacagaaagttgtatatcctgcctttttaaaatttaaacaggcctattggccggacatggtggctcacgcctgtaatcccagcactttgggaagcctaggtgggtggatcacgaggtcaggagatcgagaccatcctggctaacacggtgaaaccccgtctctactaaaaatacaaaaacttagctgggcgtggtggcgggcacctgtagtctcagctactcgggaggctgaggccggagaatggcgtgaacccgggaggcggagcttgcagtgagccgagatcgtgccgctgcactccagcctgggcaacagagcaagactccatctcaaaaaaaaaaaaaaaaaagaaaacaggcctatcctatcttacctgattttttcatgtcttcccgtatcagcttattatataccagcaagtggatggacagaaatttccttggctgttctgccattttgggtttcttctactaattcagccatgtagtattgaaaacataccagaagagcctgacagaattgactgcacctgtctttggctttgttttaatatttggaatgtgttcacctgggaagattatgtcagcgtctgaggacagaggctgcccgcgtctcctggcagtttccatatggctttggagggcaggggcaggctgagctgggcctttccgggcagaactgtctggcttagactgtggcaagactgctgcagccccagcttccctgctgtgaaaactggcatgtgcatagccctgcacctcacactttcccccacaaaggtgcacccagtagacagggagtgtgggctctggagtgggagctggccctgaataatatattccctgcccatttcgatgaacattgcaaagaaccatcttttcacttgagggtttactgtcttgcctggggcaaggaaccctccacagcttgcaggagccaagttggatgttggttaggcccagtcagtccttcagcaggcttgctcccctgagatctcggcccagccagggtgccagtgggcgctctgcacccgggagttcagggcaggggactgtggctgcctctgggcacatgagcctctctttgcccatcacccctgtatgaaagctcaactcctatccaccccctgggaatagaccctgagcttaaacagggaagttgcgcctggatgtttttgttgtagaagtaatgaaagtttgcgggtgtgtggacattgttagctcctggatgggatgtagtcctggagaggagagagcagggctggagcaggggccccttctcaagggcagaagggcttctccccactcctttctaggctgtctcctagtccccaagctggcttcaccttgtttagctttcaaccctcagggtgcttgagaatcacctgggagctggtcagatgcaaatgtcctaggccctccccaagagcttggatttgataggttctggcggggggcggggggtggggaacccagccccagggggtccattgcacatgcccaggggaaaccacgccctcaaggccggaggtggaaggagtcaccacttccccagctgctccctatatcccgtgcaggagcagctgatgagccagatccgggagacgcagcagctctgccaccagaccctgttcatcttcgatgaagcggagaagctgcacccagggctgctggaggtccttgggccacacttagaacgccgggcccctgagggccacagggctgagtctccatggactatctttctgtttctcaggtgggttctggggaacaatagtcaggagggctgggggaggggaagatactagctggcagtggaggcttccacacgcccccaggttcagaacctttcctcaagaaaaaacagcacaaactctggtacagaaagcagcagccagctgtggtagctcacgcctgtaatcccagcactttgggaggccaaggcggccgggtcccttgagtccaggagttcaagaccagcctgggcaacatagtgaaaccccatctctacaaaaaatataaaaattagctgggcgtggtgacatgtgcctgtagtcccagctactcgggaggctgaggtgggagaatcgcttgaacccaggaggtgggggttgcagtgagctgagatcgggccactgcactccaatctgggtgacagattttttgaaacaaattcccaaggcaagcctggttagagaacggcatagtctcccatcaagtccaacacggccatttcttccttcagccttggaagtctgtttcttctccgattatgagaagtcatcactggcttaaaatccagggtatacgggttgagaaacccatgcttcctctgagtacctgtagttcagttgtgacgctaccatgcgggacccagtcactgaatcactgcactgaggttcctgtgctttcactgacatctttgcgtgaagccaacttagaaataacttgtccaacctcatctttttgcggaggctccaactgggggagtcctgtgtctgttacaagtcaagtttgggcccttgttgacccaatttgaaggcttcacaacagctcgagcctcggtaggagtcaaactgagtgctcccttcccaactccactccggcctcgccttccccaggccagcacttgcttgctgggggggtttcccaagctgcagggctcactttgtgaggatggggaagttggtgaggggatgctgattttcatcctagcttggggagtgtggaggggtgaagggttgagctgtggagggcagatctagtttcggtgtggattcacaagaggaagtgaaacagggtccaggcgcagtggcctgtctactaaaaatacaaaaattagctgggtgtggtggcaggtgcctgtaatcccagctactcgggaggctgaggcaggagaatcacttgaacctgggaggcagaggttgcagtgagctgagatcacaccattgcactcccgcctgggcaacaagagagagactccatctcaaaaaaaaaaaaaaaagtgaaacaggtttaagccgttgctgggttgggatttctgtgtagtggcgggaagcccttcctggtctgcaggtgaagctgtggagacttaaaatgcattgcgaagtgggaggggagtggggcgcccagggtgatttttaagaggagagagagatctcttgcatgatttgggtgcccagaaccaggaggtgaggacaatacattcttccagttagttcttattcccacgttctgtactatttcccaccttcggaggcagccgggctcacctctcctcctgttacagagagtcaggtgggggctgcaacatgcagatgagcctgaacagaggagtcacctgggtgctctgtggtttctccacctgagccctgggtcgggcagtccaggggaccctctgaaccaccgatgcggaagccagtccttcccacggcacggagcaaagcatggtgacccagcctcgggcctccctttcgcttccacagggatctcccttgcgctgagtgtcttcctcctccctctccccgagacaggggtctcccggcttcaggtggtgccggccacacagactctcccacccacttctcagcttggaaaacctcacctgggccgtgattgcctaacgtgacccggtgaccctgcagtctccaggcaaatgttatagcctttgtagtattttggccgtcgacctgacagcaccaccctccagctgcctgtcctttcccccagtgacccagcctgggtggactgtccgaggccatgtggttgtgggcggggtgggggggggggcctgcgggaaagccgcctgccagactcctccatgccacagcagggtggggaggtcccccaggagcctttgacaaggatgtaaaggacacattaaaaagatgtggccttaggttctagtggctctggtgtgggcctgtgcccagcctttacgagccagaggttcccccctccagccgagggctgggctgacatagtctgtgcccaggctgtccagggcagcagcctctcaacctcaagttctcaggtagtccagcgatggctgggaggagacacactgttgatattggagtctctggacttgatttctataatgagcttcagttaatcatccactgtaataaggattctagggcatgaaagaaaagcacagctgattcaaactgctagagtgaccaagtcatactgcacgaaggaagagcagcagtttaattctgaaataaatcctaaacctgctgtttgaagtgagttgccagtggctttgctggcttcctcctggtggcaggagagaggaggtgggagctgaagcagggagttgagtgtggtgctcagagcctgtccttcatccgggccagggaattggggccggtgactgggcaccaggaaagtaacattacttcgcccacttctgccaagtatagaaggctgcaggaatgggctcacgtggcaggacaggaacgtggaactctgcgatcggagctgctgccctgttctcatgggagctgtaaagtgacaagggtaattaaagcctgtttcctttgtgctgttgtcaggaaaaggatagaaaggactttgaaaaattacagaactacacaaatagaaattatttgtggagtcgtggtgggccttgcgctccagcccccagtgtctgttggctgcctgttgactaatgagaggacagcttagattggtccagtcctgactttataaatgagaacactaaggctcaaagagatgactgagtctatgtctgttctttaggaaagatgtagcagttagcatggggtttgttaccagtaacaaccagttctctggtgaggcctgaagtccccttcctttggggtcttagggataagggctggtgagatcagccctggcaggggctggagacgggggatgagggctggttgagagaggtgccctctggcccctccagacttcccagcgatccaggtcagcagatgagctgggaggctgtggaagggaattgaggtgctccagaaagacagtgtctgtctaaaggtagaacgctggtgccagagtggtggtcctgaagatgggaggggcggcgcgtagagaggggccccaggttatgggtcagtgggtgagattaaagcctctaaagtggtggaagaaaagggactttggctatgggacaaaacaggagagattgagaagggtggagatggtgcagacacatgtgcagagatgtccctttatttactaaaggctgagtgcctgatacgcacatagcactggggttacagaaataaacaggccaagcttcctgccctatgtgatgggacctctctttacccatgtaagcaccttacagaatggagaaggccctggagtccatgcccctaggatggggtgagggagtatcactctgtggggtttcacagcaccctggatcctgccttccagcccctgccaaggtaaacagtgctgcctgcctcctgtggggaatgcaggatggggcaatgccctggcagcagggtcttgcctcagctgatgcaactgtggctgctcctgtgtgcacagatcatgtgcctggaaggccttcctgcagcaggggcagtgtcagaaagtggaagagtggtgtgagcagcttccccggggaaagcctggctgagcaactgaccttgagcaagcactgcagatggcccttgttcctgccgggctcctccagctgggagctctcagcccctggtaaattctggcagtgaaagacacattagcacctccccctacaatgaggcacctagctagacaacttggctgtccgggcttaacctgcgtggcagggaaggacgcctgcccagccttagcctctacgcaatggtggaggcagggagggagagaaccacacagctcccctcatttcccagcagcccccatggagcctagtcaacagggtgtggtcacaggctaaatgagcaaagatgtgagctaatatactggtaggtgtcatgggggctttcagagctgggtaaggagggaaagagatggagatactggttccccactccttaacctgccacctgccttccctgtcctttaccctccctcattctgctggacctgaggaaaatgcaagggaggctaggcctagtggctcatgcctgtcatcccaacactttgggagactgaggtgggagaatcacttgagcctaggagtttgagaccagcctagggaacatagtgagacctcgtctctacaaaaaaattttaaaaatagggccgggcacacctgtcatcctagcactttgggaggcgggcagatcagctgaggtcaggagtttgagaccagcctggccaacatggtgaaaccctgtctctactaaaaaaattagctgggcattgtggcatgtgcctgtaatcccagctacttgggaggctgaggcaggagaatctcttgaatccgggaggcagaggctgctgtgagctgagatcacgccactgcactccagcctgggcaacaagagtgaaactctgtctcaagaaaaaaaaaaatagctgggtagggtggcatgtacctgcagtctcagctacttaggaggctgaggtgagaggatcagctgagcctggggaggtggaggctgcagtgagccaaaatcacgccactgtactccaatctgggtgacagaatgagactgtctccaaaaagagagaaagcacggggaagtgcaagtgcattgatgtggagctgggcaaggacttggtttaaggagctggtggagctggctgaggctgcagcccagggaggggaggagagtgcagtgaggtgggggagaagtatgcctgggccgtggagggcggaggaaggccaagtctccactacctctgtcccagcttccctgctggtggctctacggttgcatcttctctccttatcccctttctccctcctatctctaacccaaatcactttctgtgcttcagacccgtaattccagttgcccagtgatatcacaacctgagagagatcacaggcaagcaaaaaacactcaaacgtgtgtaaaaccaaactttcatctccacctttccgtgttccacctctgttaagggggacagcaagcagcttgaggctaacgcttgttctttgatgacctcctttcacttctcacatccatcagttacagggtttttcaattgtgcctccataactaattcttaaatcctcctttccatcccttctccatgatccataagctcaagtccatgcaaatggcagacaaagccctcctcaccttagccagcctttcatgcctgtgctcctctggcgcacccaggcctagacacttcccttccttgccaagtgtctgatgatcactacttggtctttatttgctcagaagcctcatcctccctctgaagccttctccttagaactcagtcactcctccattagcgcttgccacactgtcctggaaccgaatacacggatgcccctcagaccacacagaagaaccatatcttaccatcttttcatgctccctgcacttagcacagtctcagtaagtgtgtgtcaagagggaacaagagagaatgggtggcaaaactggacagtgtcttttctgtgcagacctttgggttgtgaggttgtgacaaggtctcctggaagagagagaaggtccacgcccctcagcctctattcttccaggcactaatgcattggtttcagcggtgagataacatatatggaagctaaatataaacaaatgggttaacaagctcttgtctctttcagtaatctcaggggcgatataatcaatgaggtggtcctaaagttgctcaaggctggatggtcccgggaagaaattacgatggaacacctggagccccacctccaggcggagattgtggagaccataggtgagtaactgactcaatatgcctctggtgagagccacagctggtgataattaatgtgtttgttggaatgtgtgtttatgaagcagacagggtacttgggaacacagagggcagactataatcatctcacattgtcaaccctgggtgggcacaagaaaagtggtaagaaagcctgagctccttttctgggaatgcttggaaatagtagtttgcactggccccaagaacaggcgcagtggtctctgaagcctgagactctgagtctcactgcaagactttacctaaaggagacacagctgtagagttcttgacatacgctgcagacagcactcctggagttgagagatgagatccaacctcacccagccccttcagtcggggccaggtgtggtggctcacacctgtaatcccaacactttgggaggctgaggcgggcggatcacttgagtccaggagatctagaccagtctggccaacatagtgaaaccccgtctctagaaaaaaaacaaaaattagccaggtgtggtgctgtacgcctgtggtcccagttactcacaggctgagatgggaggatcccttgaacctaggaggtggaggctgcaaggagcccagatctcaccactgcactccagcctggttgacagagcaagcccctgtttcaaagaaaccaacagcaacccccacccccgctaaattccagctaggttcagtcctaggtcagactccatgtaactttggtcttgctttcagacaatggctttggccacagccgtcttgtgaaggaaaacctgattgactacttcatccccttcctgcctttggagtaccgtcacgtgaggctgtgtgcacgggatgccttcctgagccaggagctcctgtataaagaagagacactggatgaaatagcccagatgatggtgtatgtccccaaggaggaacaactcttttcttcccagggctgcaagtctatttcccagaggattaactacttcctgtcatgaaggctagaggaagacttcctggaactgcctttcttccactaacaggaccctgggacctgtaggagcaccccgtttgggactgtgaggtgtttgagggtgtggactggcatccagcagccactaacaaacacacaactggtgtgtaaaaggcaggccttacattagaagccaagccaatcctttttcttttttttggaggtcccaccgagatagataggaacttggattgctgaattcaaaaacagagcccattcttaagatcacttggtgccttaaagacacgcattccaaagtggaatgtggttgaagaaagtgggccaggtggttgaagaaagccatgtgggagctcagcaaatcccaagggcttattatgacactccagatggtctccttagcatctcagctcttctgcaaggaagagcttgggtgttaggcctcagaggctgtagggtccttgggttacagagccggggagaacgaagttctgtgacccaggggtggagaatacactctaggtttgcaggctggtgggctttcaaattggtacttccagaggaaagccaagctgcttctgttgtgagcgaatcagccaagagcctgaggctgaagggaaaagtacacagaggaagatattttacaaaccaggtcagtgtaggccaagacttatggtctacagattttggcgggggaggggggaccttttcaaagacaatagggggtcttgacatgtttgttgtatgtaaagatgataagattaaaatttttgattttcctaaaatccttggcgtactttctgtttctgagacctagcaaaatttcaaacaaacactgggtaatcctgataaggcctggcagagacagggcagatgctggcacacacggagctggcagggtatgtgactggtctgcctgtctagtctgtttgctttgggaccacatcagtgaagccaagtcatgccaacctcctactgaagagactcccatagcacattgctcttatatatgaaaatgttcactcctgtactctcagctataaaaagaaaagcagtcattctgaggattaaatggcaccgtgtagacatgtagcactgtgcctagacacagtgttcattatgtgcctttccccttttcttggttcttctcccatgcctctggaataacacaggtcttttttccctatgttttttatatattaattat

SEQ ID NO: 36284 - DNA, 285104 bp, Homo sapiens; identical to SEQ ID NO: 36283

SEQ ID NO: 36285 - DNA, 334016 bp, Homo sapiens
tccaaactgttcaaaatgatgaacgaagatgcagctcagaaaagcgacagtggagagaagttcaacggcagtagtcagaggagaaaaagacccaagaaggtaaatcgccggaattaggaatgtctgtgtataaatatgtatgtgtgtgcatgtgtgagtgtgtaatatcagcaaggctatggaaaccgtggagcattatgagtaactgtagacgataacagtgccaagccttgctttttaaagaggcaggtgcaaactgctgctttttgagaatagtaaaggagccatggctcataatggatacactgactggagcatggtgaagtgaatagagataaggtgtgttccacatgtggattactgaggaccgtggccactgatggattcttctggtgttaactgggtagagagagtcgttttatttttagtgtgtaaaaggaagagtgttaagcaacgtggattgtgaagcaaaaggcagatttttggccagatgcgtttgctctatgatgatcctgagatggctagacagcaaaagccttttggtttcatgctaagtgtattcctcctaaggagaaaagactgctgtgacaggagaaatatcatccccagcatgatatttctttggcttgcttagctcctctgcagttttcccagacattagtgtgatagctctttcaataataagaaaaacagctaaagatgttatggggtgggggctcttgggcacacaaagcagtctgtaggatttcttactgtggcatacattcccacaccctcgattttcatggaaatgatagcagcgagaaacagtgggaaaagatgcaaactattcagccccacccaatgccagcacttctttctttatggcctgactccttctggtaaactgttgcagcctcacagagcttccctgagcctcacctctgaaagagatgctctataaataaattctcctaaaatgcatttatttcctggagcaataatatgggcaggatattagatatgattgtaatgtaaatggctttcaacattagatggttttggattttgaataagcagattgcaaaaaataataagcatgaacaaatgaatatttttcattttgctaatgaagttgcattgtgtttcaaaattctagatgtctagtgtactaaatgttttataatctaaagattgtaaataatttgcaacctctgatatttaaaagatcactgtatcagcaaacaagggagtagtatatttgtatggtatcatgcaatttgatagaaataagcatgtgatgatttttaatcatagcgtagagatagtgatacaatctgataacaggcaaaaggataattcagggcaagcaggaacattggtagaatgtccttttccttttgtacctaagcattccagatctagaccttgagggcatttttatagagtgttagctaattgaacaacataaaaaaagaaaaagaaaatagaagagagagcgcgagcaagcaagagagagggaaaaagaaagaaaaaaaggaatttttgttttaattcacattatcatttcaaaatcccgtattttctctctaaagtccctgtggtgctttagaaacaatatactcaggactattaaaggggtggagaatgaatcttgagatttttgagctctgaatgatgatactaacttcacatgaccaaagccattttaaagtctttgaggaggtagagacaacgaaatcatcctatgtaataactatcatatctttaagctgaattttctcaaataaatttattttaggagtaagtctttttccaaacttgcatccaaaatgaaagagcaagttttgaatgtgtgtgtcagagcaccatgaatattgagtgttaaaaggagtttcacctaaaagaaattgcttttgaaaaaaatgctaattacataatagattaggggacgcacacacataaacacacacatacacatccctcagcttgcctagtcagtcagacataagtgggtctgaatctcagttctaccctttaattttgtgtgtttggagcacatcatttaatttctcatttaatgaatccagggattcatctgtaaaatgagaataattatatatagaatattttatgaggattagaaataatgtatatatgattatttgaacagtatttaaaacatatagtcaatggcaataactttcaggtgttattctcttaaatggaatttgtttattgcaataagccttttaagagaaaaatctgtttatacttttgagagaggcagaaatgacagaatccaatattggtgctttgcaaaggctagtagtcatttttcaaaatgtcaaaagttatatgctataattggaaacttttttatctcaaaaaatcattgagatttacataaatgtaccttaggtctttatattattgtttcacattattttgcacagcaagaaacttacattttcatatttaaacactagaccattaaatgtgccttgatgaggacattaatgataaagagataagtatccctaataagcataaaagctgagaaagcaaaaattggagtaaagtcaatgtcacatcacttcaattcggttgtttgtttttctactagaggtttacattgaatctgctgtgggattctacttaagcatccaggactacggaccaccaagctcactatggcctgggtgtggatctatcctactgaatcatattccttgaaatcatgcgtctatctctagtaaatacgtaacagatgggctgtaatttacttgtttattctgtaccttccaaaagtacctcttctgagggacagagctaaagggtcttttgccaccagacctacaatgtgagaaaacaagctcaaggaggaatttatttatgtcaaaattttactgagtgtgttgagaatagaaattctttgagctttacttaaggttgtctattttggcttcagtaagggagcttgtcggtgctctccactcagaaaccacaaggagtacactggtggttgaacatgatgggtttatgactcattgccgcgaggaggatacacatcatggggaaccgtgggggcatctcagtaaacgggtgccaggaagaatgcacaggatacgggcttcagttgagtaatttgaaagagggttcaagagactggtggctcactctggggatggggtactcccagaaagcaggaacaattctacgattgtgtatcccagtaagtcttatctacaggagaacaggctagagcgttactaaagctatagttgtaaggaggcagtaatctcatttggcaagagagggagatgtttggtattttgtgtcttggacaacgtctttgttttgtctgtgttcagacatgatatgggagtggtgttgttttggttttactctgtcatggtcagagtggccttgtctgatgctgatgctttgagaaattttttatgttcaataggagaacactgaggcctagctgatagtaccaggccccctcctgtgggtcagtggctgcctttctcattctccagcttgaacacaaagatacctttggagagagagagaaagacttgtttattattggatactctttagtacccaaagaaaataaattgtaggtagtaatgttgttaaagtagtcatgaaaaccttcatctgatacttccaacaaagttttcttagggccaagatatttcatactaacagatattgcccaaggtgcagatttgggattgatgttctagtggtggttcagtggcgaagaggaaatgggggctattctaattctcaactggaatccaggactaaaaagaagcattggtagctatgtgaaatgtatccgtgtaagacagctttgagcctactctaaatcccagacaactctataaagatttttatattttttgaggcagggtcttattctgtcacccaggctggagtacagtggtgtgatcatggctcactgcagcatcaacccacctggctcaagcgatcttcctgcctcagcctcccttgtagctgggactgcaggcatgtgccaccacagctggctatttttgtttttttaactttttgtagagacagtctccctaaggaacccaggctggtcttgaactcctggtctcaagcaattctctctcatcctctcaaaatgctggcattacaggcatgagactataaaacttattccactattccactattttgacagattagattaaaataatccaagaccatatttttgtgtgcagctccacacactttccaattttgtagcaataacatagcagtggatttatactaaaagaggctgtaggagattttggtaatttacataattggaaatgggaatgcccaagcatcaatcacaggtgacagccatctgaaaccactaggcttgtgagttcttctaaaacaagtacatgagtaaatggtttactaactgtttttcccatttagtggaataatgatatgaagataaaaataaaatatcagcaccattattttcaacagagtagtaggataaaatggctttataggataccttatatttattgaagatgctttgatctggatcactaagatattcataagcattgcaaaatattttgaaggtacacacacacacacacacatatttaatggctgtttaggccactgcctaaatagagagatgaaggaggaaagtgttgccagatgtgtggttaaaatgttgtaccatagaaatgtgaatgaggtacatattaaaaggtttatttttatagcagccaaagaaactatgccctttttagtgaaatcaggtagtagatccaacatttgggtgtccaaatagtattggagtcaattaattttgaatttaaagttgatgccttatctagttcactgatatctagacaggcttccatgtataatttattctgaataatatccctatttcttcagtctttcaaataacttaccatttgccctttataaaataccaacttataacccaaaatagcatgtgttgcctgaagacagtaattccccatcactgaaggtatttaaaatgaccatctgtcagggatgatggaaatttttattggaaagaaaaataccttataacctggtattctgtgattttctttcaatgtcttcctctctgtttctatttactcacttttatgatattaattttttcactgataatttcatgtcttagtaataactaatttatcctttttagagcagcatatttcaaagtgctgtctgctgacctcaactaccagaattacctgggttgtctgctaaaataattcacttcttaggacccacttcagacctgctgtgtatcagaacctttgaggatttttaacaggctcccaactctttcttatgcatactcaagtttagaaccattgtcttagccaggtgcagtggctcacacctgtaaccccagcactttgggaggctgaggcaggaggattgcttgaccccaggagtttgagaccagcctaggcaagatagcaagaccctgtatctaaaaaaataaataaaaataaaaaattagccaggcatggttgtacatgccagtagtcccagctactggggactgctggggacacccaacccccgagggtgaggtcatagtaagccatgatcttgccactgcactccagcctgcatgacacagtgagactgtctaaataaataaataaatgaataaatagatagataaataaataaatgaatggaaccattgccttagaatgtggtcaacagtcatgaagttgagttatcttagaaagaagaatctttaattttgattagatgtgttagtttattacttggctcttacagtaacatttgtttaagtctagatggcagcagcaatgacacaagaaaattgagaacaacatttcttttaatcttactcttatgtctggaatctagaactgctttcacatgctatcttatttgatcttcagaataactctcattgcatattattatcccagtttcatagatgagaaactggagactcagagactacatacagatggtgctgaagagaccatagacatttttcctactgttcaactaataacatattttgagccatttctcctgtggaaaccaggtgtaaggtagtcttctgtgtctcttgcaaagattctgtggttatcttctaagatatcctcctgattcttccttccagtgttgctgccattttgcgtcagttgatcacatttccaaaaatgctcactcttatctatgggaataacatggaaaagtaacttctttcatggctatctatgatactctcccaagcagcattcccaaaagaagggaaacttcttttgcttccattatgttttgtgctatgttgttgtagatgtatccatcagtccatgtagacaacatgttggactttgaaaattcacaaaaatgtaagaaacaaaacttaagtaaacagctgccttcatgtggcttaggcatgttaaattaagccaccataaaaagttcaccctactttcaccattttagctctaattattctcttgagaaaattttgttagtatgatattctcagtagttgttctattaaaagttcttttccatacactcttttctgaagtgttggaggtttctttttccttcttgataaagtttctaaagagacatttgattgcacattaaaatagacttgaaattttaatctgtatttgtttctgtcttgtcctgattcagagcatgctaaattataaatatgcttacagctttacttctgtcttgcttgtactctgttctaattcctgttggaggcagaaacaaaatcactgcctatttttatctcattggacactggtcggatacatcacaacaaataaagttaccatttcaatttccttttactagatagagcagagatgggattgctacccagggagacaatcttttgatagaaaaagtttaaatttttatgtactcgagaccaaataaatatgatagagtatttctttttctttgaaattcatgcctacatcccaacccgtagggagggtcatttttaaaaagctgcagggagaagggaaaatatgttctagataataatataccacagtctacagggtgagcatcttcttagtcatgagacctggtttttattcatgtttttctgttaactcacagacaactatcatcttcttccacacactaatttgtgtttgtagtcattaagacaaagaccttgatttctagcatttgcttaatgaaattcagtttctaagaatcagcttgttttgctcagtttaatttaggtgtttcttccgaacacatgggaaagttcccccaattcaacaattggtattggtttgctgagtgtatagcactgtgttaggtgctatggcatggctaggctaaaagccaatgattgacacttacatggaattcataatctgagcagacatttctatctaagaaaaaagtaatgagcaatctacagaaatattataggtatactcacacatattataagtaaaatataaatatgttgtgcaattgccaaaaagaaactctacaggattctgtagaagggcaagagatcagtgtaattttgttagaagagtaaaccctatgagtgggtgaacagtagtacagagccgtaagttatggctaatgtgtgagtataaaggaaggggatacacaggcattctggatgcaacagcctcaggcatataattccaaattacagtaaagattaggaaactgttgagtgatttgttgcagtgcagagccataaccattgtgagtggactctgacatggttgtccttgtgctttcagccttagccagctgcagcttgcattttggaatccatcttgttttgatgactgagcctgtgtccttctcctattatatatatatatgtttaatcactcattttacctgtgaaaatttgccccatatctctgtttatagattatttctgcaatcagtagtaaattccaataagtaagcctccaaattaacaagacattcgaatctagtagggacaatttttgaaagtatctaaatattcagccttctgcctttacctgaaagagatgctggtatggataacccaggattgcaattatctataacacttatacaggcactcataatactttgcatagcagctaaaaactggtttgtccctttgggtttttattttattggtgatcataatgttatgctagtataacattactaaggtagtccactttgcaggctgactttgagtttgctctggatcttctgttggattttcagatccttgaacaagaaatttgagactttcccctcctttccatttcctggtctggccacaggtttctgtgcagtcttctttgtccattttaactggcaaacagagtgactcatgaccaaccatttcacttctggccacctttcacatcctacttacaaaataagcacaattatagccagtgccacttcaaagaacacacatagttaaaggaataaaggggtgtttttgaaataaaactatagaaacagagctaagtgttagggtctgtgtcgatactaaaaatgggaagaaattaaaaagaaattgtgaaccattctagaatgtttcacccagtgctagtaagtggtacctttttataagtattttaatgtaataatataatggttactgtaattctaatatttgacaacattcttaataataagtatttctatgtggccaattgagcccagtttaggtgggaggtattctagtttaaaaaaaatgaaaacttaaattcaaaacattaggagaactatatatgagaaatttagtattttctatgtcaagattttggtcctctttttgtataatgcttatccctaaagaatccctttttcagatgttctaaatgcttgcccagaattcagagggtatggtggcgggatgcctttctctcttactccatagcactgtcttgtaataagtgcagaggggtggcaatacacccaatggccaataatttaaaatgaaaatcaggaaggaaagaaattagaataagtatagatactttccattattttagtagtttagagatgccattagaactgctagagatattcatactgctattaaattaatgtgaatgtctgtcttagtacttttgggctgatataacaaagtaccttagagtgagtagtttaaaaacaacagaaatttatttctcacagttctggaggctaggaaattgaagatcaagccatcagctgatttggtgtctgatgaaggccccatttcctggttcacagatgatgccttctctctgtgccttcacatggtggaaaaggcaagacagccttctggggcgtcttttatatgggcactaattccattcatgaagactctgccctcattgccaaatcaccttccaaaggcctcagctcctaaagccattgcattggtgattagatttcgacttagggatcttgaggaagacacaaacattcagattacagcagtctgctttaatgttctcccattcagttaaacttgtattagattgtgtatagcctggcatgcttaaatagtattttctgtaaagttgacacagtaaatactttcagtgttctgtgaagtcagtcaaattcagaagactagccctacatatgaatttgatctatgtatatgttgttgccatgaactatagtacatatgtttaataattgtctacgtgatttattcttggcttgatctaccacatattatcatttgtgtagaaaaggtgttcaaaagagactgtataaatagcctataaacatcagttctgttcaatgtgaagaggaaagagttatcataatggttcatacggcattcttataggtcattcctctgtcccaataaagtacagagactgtactttgagaattcagaaattggcaacactttccacacagtctatgattcatagtagggactatgaagagccttaatgtgaattagccatttgtttccataattttagattattctgaaaagagcatttaaatagcattgataaaatgttcatgagtaacacattactatactccaagactcagaataagttcatatactgaggtttggggatgagtggtgactggattttggtttgaatgcttagctatttagggcatagtgctaatctagccaccaatatcccataagagccagttatcttcatttagtgtcaaaggcatacacttcattcttaactgaagagagtagctgatcaaactgacacagcaaagcagagtactgccagatgtgtgcacacccaactacgttaccaaaattaacacactgcgattatcccagagtcacttatctcctaatgtgtgaaggaattctggtcctttttagaaggtcatatgaggggaaatgatactaatagaatgacagtcaaataggggtcttctgtggcattgtgatgaagtctacctcaatcaaacccgtttgaacacatgatgttttgttaaataaatggaacaatttatttatagaaaaattatttattagaaaaaatagttcatcccattggaattgcatttttcaatgataataataaatagtagttaatattcattgagagattagtatatctacatgccagtctacatagagttctacatagattatctaattttatcttcacaataacgtgatgagtagatagtttatgattccatattaaagatgacactgatgtccagatgggtttaaaaaaacccttcctgcttgaatctacatagctcctaaacgagctatcccaggtcaaactgaccactctgcttatctccaaacccctgtgctatgtgaatacaacaatcttttacacaattcaaataggattaagaattaaagaaataggagttttgtttatgtcccaaacctgtttcactcatatgccttcgctgattggtcaattggtcaatgaatctaaaaagcttttttttttttttttttttttcccaaatacggtttaaaacagaagtataaatccaaattagaaaagtttttttatgtagttgttgactaagattattagatgctttcagaatattcaagccagatgtgaattctcagactcagctgtggaacactgaagaatgaagctttatagttggtatttccatctgcacttcaactgtatttgtcaaatggctgacacccttagcatagcctctctaatataagggggaatttgttagtgagttcatgttgcttgtcctaattcaaaaggtcactaatctatcatgtgctccataatctcattacacagcagggacctctttccagttgttaaagaaccagtaggactgattggcctattacatggggcagtcaggcatttgtttactggcccatctagaaactggtgctttaaactgtttttttggatgggtaggaggtctgttccatctggaaccttggtacctcttccagatgaccctgccccaagtggcttccatgtttgatttgtgaaggtagttcttgagcactagcaacaggttaggtgtggttggggaacttacacttactgtaacaaaacgccttgatcagataaaaaattactgttggaataattttctgaatcactgaccctcatccagtgggagactaaagctcctcccctgattgctttttcccagtaataatttaaatggatgactatttttggtaacctttatttatagtttgtcaaaatgagcagaatattagctaaaggaagtatgttttcctttgtggagcaattaatttttcgtttcaaaaaggctgtcaggagataatttttgtaggttgcttatataacaacatcaataatttaaaaaaattacatacacacgtacacacgcacttacattattctgagttttagatatgaggctcttggaaatggcttataaactttggggattttttaaaaaagataaactgccataaccatactccaatttatatttgcctggatatttgaagtatcttcaataatactgctgttgtttaatgcgcacaaaaaaataattaaaaagaatgaataggatgtagtattagctagtaaaacagaatgactatagtaaaaaataatgtaattgtacatttaaaaataactgaaagagtataattggattgtttgtagcacaaaggataaatgcttgaagtgatagataccctgtttaccctgatgtgattattatgcattgcatgcctgtatcaaaatatcttatgtaacccataaacatatacacttattatgtacccacacaaattaaaaattaaaaaaattttgaaaagcaactaaaaaaaaattgctgttgccatagaaagttttttattatacactgtcttcattctaaaaacctaaggccatgccctgtacagggtttggattcttgtctaaagcagaattattaatttagaagccataaattaaatttccaaacattcaaacaggcttctttctccccagggtagatttttaactctctatgtcaggatctattggcagttttttgttccaactcaggtgtcaagggtcatgtggagaccatcatgatatggcctaatctataatttaagtatcatgtacatttcagtttaatattttaaaatgaaagtaataataatgtgcattttagaatttttactgcttgaattggtgtctcaagtttatttcaaggtgaccaatgaacaatgattttggatctcattaaattcttaaattttctggctgtatagctctttgtatatttctgtatgactacatatcactcttttatagtatattcatataagattttctgcacttttttgtaccatccagaagagccatattgtaggtagaggttattatatactttatgaattgcagaagtaaacagttttgaataattcaatacactaagaatatatggttccacatggacctcctagaacatttttgacaccaataattacatcacaggagtgattaatacttacgcagatatggctggctaggtctttcagtatactgaatgtttactgtatgtgagaatgatcccttgcaccttttcaagcacagctgtctagtaaacatttattgactatttgtccaataggctatgtagctctgatatttgataataggattaatattttgccttttctgtctacattactgtactaatttgattattttccctgggcctatcatgatgacaaggaattatgtctgttgaccttaaaatgaccttgaggaaatgaggtgctaatatcaatttaggtgacagatgataagtgcctgtgttatagctgactgaaaattcatgttccacagcgtaatatctatttggaatctaaaattctaaagttgaatatgacatttagtaaaaagatatccagtagaatatatattcatatctctgtgtgtgtatgagtgtgtgtatttgagccaaatattctctttgggtgttgctaaataatggaaaaagttaccaccaaatttgttatgtgttttaaatgatagcatttggttatcatttattaagggctctcaaatcatacctgcagccaacattgtggataagagaatacttggtaacaatcattattaaaataagaaattcttggaaaggtggatttcagcattgctttctcagaaaacatatggtacttgaatttgccttcttctctgtgtctagtcaaggtttgcatttctttaatgatgtgcatttgcccttttccactataaaaagaattgctttttgccacaatcagaaaacatttagtatattttatgtggacactttctcagttggtagaagacggaagaccaaataagcttataaatagtaatacacatgcatgataatagtaacagattattttagtctgctggcagttataggtaggtatttttatacttaatttgaaaaatacttgagaattaacagcaaatgtaaaattcaaagagctgaattatgaaaaatgatattttatctcatacaaatacatttttaaattctaagataatgaaactgaactcttagtgtgagtttagaagtgaggctgaaaacagatctcaggactatttttagtagactttgtttaaattcttgctaatgtccaactaaatacatttgaagttatttagattgcaataaaaaaaaccaccttcctgcttctttatttcatttgatgtctcaaatcccacattatttatggaaagctgattttaaaataatgttttatttttgagttgacgtaaaacatcaaactgaaatttgatttttccataaacataaaaagacatttttttgttgttgttgtgtttgctttttaacagatatgtataaatgactctcctcccagtggaagtcatttttggaaattttagtgatacagtccagtttaattgctgaattgtttacaggtgttaaagatttctagcattgatagtagagaaatttttcctcattaatttttctttttaggaatttgaagccctttagaatataacataaatacattttgcttcaagtttaatagcagaaaaagatcccttccacctacctcatcatctctgtgtacactaagctctcccaagagcactctgtgtgacttaccgtgatgacaggtttttgtgtctgttttaatcgtatttaccatacgcaggtgccaattgttctgtgagcatacacataacagcaggtggtgccagtcaggattcagccaggattaaggaggaggggctctgcattccacagtgcacatagccaccttttgttttcccatgacagaaatccccttccctccccacctgccagccctgcttatccacctcactctaggagctcaatttgtggtggtgtgctttgtgaaaaagtaccaaccacccttacgtcaagaaagtccaaacgattgtgcaaagtatggcccgtgttgttctttgggaagtcaattttaacttttaagatcgttgtcatgaaatgacagttaattttcttgttagaaagttctgtagaacttctaacaaaaatgttagaaagttctgtagaacttctaacaaaaatgttagaaagttctgtagaacttctaacaaaaatgttagaaagttctgtagaacttctaacaaaaatgttagaaagttctgtagaacttctaacaaaaatgttagaaagttctgtagaacttctaacaaaaatgttagaaagttctgtagaacttctaacaaaaatgttagaaagttctgtagaacttctaacaaaaatgttagaaagttctgtagaacttctaacaaaaatgttagaaagttctgtagaacttctaacaaaaatgttagaaagttctgtagaacttctaacaaaaatgttagaaagttctgtagaacttctaacaaaaatgttagaaagttctgtagaacttctaacaaaaatgttagaaagttctgtagaacttctaacaaaaatgttagaaagttctgtagaacttctaacaaaaatgttagaaagttctgtagaacttctaacaaaaatgttagagttgaaatttaaacaaatacagcacctctcaaattctacaggaacatatagatatcacctatatgtgtataataaatataatatttttgttattgcaaaatcagtatatatgtgagtgctctcttttgtgtgtgtatgcatgcaagtgactttaatgtgtgattcatactaatttcattttttagagcataaacttttagagctgaaagcttgaaatttccagttctaactgtcttattccatataaggaaatggagacccaaagaagtcaagcaccttggccagaatcatgtacgtagttagtggcagacacgggcctagaactcatgttacttgattcctagaaaagtgtttttcctgtttcttacaggtcatctgaaagagcaatcaaaactagcaatgggagagagaatttcagtgttgattttgggagaggtatagctttagcaaagcccctgatctactgcatgaaggagacttgtgattaacttggcagtgagcacaagccatgtttctaacatcaagtggggtactgagcttctatctacaacgttattacacaaaagctaatttcccaatatttactaatcaattgcttcatgagaacttgtcgtaccggtgctcccaaactaggtctgttgttcagctgtgatttgtggatggggcactattttactatagtcactactctggtgtccccaggaaattagatggcttcacctggttcaggtatatattttataatactttaagaccatctttaattagaactaaaacaaaaaaagtagttgaaataaaaatattatgaggaaacaatatttgggtttgttgaaccattaacacatatgtcctctaaaggtgtttggtttaacagtgtgtgtagttttattttttagtctctttctaccttgattcaagtaccctcccctcctccccccagccccacaaaacacacaggcgtgcacgtgagcgtgctcttaggcctcttacagtttttgcaagccgaccacaggggctggactcattctgtaagtgtttgaagttcaattactatggtactcttattacgaagggttactggtggggtgccttttattcatctatgtatttatttattcttcacttagcacatttattgaatgccttttaatgaccagacaccgtgccaaatacaagatacaaaaatgacagagacatattccttggtctcaagaagttcacggttcataaaggcaaacaaatacataaatagatgattactatgtgagatgataactgtgatatggaaacatacatagcctatcacaggagcacagaaaaggctaggcaagagctcctgcaagctatgatgactgagctgagctttaaagaataaataggagtgagccaggcacaggtgtgactgacagtacttctgggagaaagtggagtctgagccatctcatgaggtggtgaaagcagccctgcacatccagtgaagaagggcaaactgagtagagcgtggactctggaacgggaccacctgctctgctgcatgcaaggtgtgtatgcatgtaactttgggcaagtaactgagcttctctgtgtctcagctgcctcatctgtaaacactgagataattacaggaccacctaatagggtttctgtgacaattgtgagctagcatacataaagtgcttagaatagggcttggcgatagtaagcattatgtgagtgttttgttgctagtttgtgaagtgaaaaacaagcaggacaggtgagaaatgaggctggaggcattggcaggtgtaagatgactgtatctcatgtttatgagcttggactttatgctatgtagccagaggggactttgaaaggcttaaaaaagtgggaaaacatggcgagatgtttttttgtcactctggagactgcagcgaatgggaaaatctggagacagattttacccagggagctgtagtgctagggagacatgatatggaaatgaactaagatgtagcagtatgtgtaggaagaatagggaaattagtctgctcaggccactgaggggacatgggagtgaaatggagggggcggaggggaaacaagagtccaagatggccccttggtgtgtagtgctggtgatttggtggctggtggtactagcaactgacctagctaatggtaaaggaggagcaggtacagaggggaagatactgggtccagattttcacatgtaggtcctaaagtttctgatggaaaagtccagcaagcatttgaagtgtaacacttgggaggaaggtcaggacagatagagttttaggaaccatcagcatggtgaggttgaaatcacgagtaataaaatccctcataggtggaggacagagtcttggaatgacatctacagttacagcgaaagctaagaagaggtcttcaggttggaggcaaagaaggtagaagagctcctgggaggactggaaaaagaacatgctcatgtttttgcccccagagatgatttcctcacacatgtgtgccaatattagattttaagaagtattcttcttaggttgcactttacatatgtggccccaagcatgagtctaaagttgctagtgttccaaaacttcaggcaggccacatggccaaggtgaaaataactagtcacatgtttctctctggttaggtggagcaagcttactcttgctaatactgatcacacagtcactatgttcccggagccactcagtaatgctggcatttttcctaaggatgctcttaaaagtctatttatctagttcctgggatcatttggatagccattcccaaagaaagccaaaacatagcatctctctctatggcatttttatttctttctcattagtttccccctgagtgttggaaagatgtaggttgatagccacatctttgcaacaatcactattgccttgatgagcacataagtttttcctgcccttatgagtgaatttcttctacacaatgaaacaattgtggagatacacaaaaatggaaacaattagttttgtctaaacttgctgtgctgcatataagtgatgatataaattatgaagatagtgactttgttaagtttaaatgatttggatactggaagtccttggaggatctttaagcgtatgttacccttgtttgcttgtaccattgaatatgttgtgaatgtcatacaaactcacatcccatacaaactttggaaaatttcaactttaaaacatataatgaaaagcaaataaaaatacctaacaccatttgaatacttgattagaaaattgtacagcgaagcacttaaatgtaatttttagattacagatgtaaagttgatatcacataaggataaagagaatgattagaaatgactcacatgattgtatgtttgcattacagagagaaatgacatggctaagagtcaaaaactgtagacaataaagataataaactgccactttaggtttagggaaacaaaaaaggtatgaagtcaaataagagatgttagacggaacagattaaggaagttagagctgggcatggtggctcatgcctataatctcagcactttgggaggctgaggcaagaggatcgcttgagcccaggagtttgagacaagcctgggcaacatagtgagaccctcatctgtacaaaaagttttcaaaattagctaggcgtggtggtgcatgcctatagtcccagctacttgggaagctgaagtgggaggattgcttgagcctgggaggttgaggctgcagtgagccatgatagggctactgcactgggcaacacagcgagaccctgtctaatgaaaagaaaagaaaagaagagaaaagaaaagaaaagagaggagaggagagaattagaaatgaggatcaaagtcctggaagtaaaaggtgaggtaagcacagaagagattctgtagaacaaggagagagctgctgggcaggtaatcagtgaggagaggagaacgcacaaggtcagagagaaatgaagagaagaacatttatgccctaattagtgagcaatttgttataaaacagctttgccacctggagagtagaatttaaaaatttattggcacgaactaccaaatcagccaaattagagcaggccatcttccaggtctccagcacaggctacagtggacagtgtgcaatagcaacccttgtcatgaaggcggagagaagaggaagtgtacttcaggaaagcacgggctaatccaatcaacgaagatcagcataaggtcataagagttccatgttgcaatcagtcttttaaaagccaaaattaccttttgcctttggcactgctatctgataccttaaatggagtattttgctaccaaatgaaactaaataggacaagaaagagctgctcatctctttattgcaccatcattgatactaaacttttccacaaaagggtaatgtttctctttaacctcaggggcacatgtgagtcattgctctttcagatcctaactatccagtgatatctattaagtcaccacttgtacctttaacacagtttctattcagtcctcctggcctcccgcaaggactgcattagtctagtcaaccagtagtgctgctgccgaagttacctattcttcatgcttgactctaagaacctcttcctttctttcttcttgttttctaggcatagggatttccagctttacaacatgctatgaattatcctcctctgtgttaacacttgtgttaacctcatccgaagtcctgggggatgtcctgttcaacctgccatttcacccatagtagagttggtccacagtgaaaagtggtgaaaagactgaagtctttataccacttgcatatattgttcctgatcctgcgtgtacatttcagagaactggtgaataaactctccgctccatgcctttctgctcagagaggttacatcttatattctccaaatttaaattaaaatgtagcttccttcatttgcttctcttgtttcttggtatattttcccttcttctagacaaagttgatcagctttttatttttttattttttgtactctactgagatctattcctagaatgccagcattgtccacctttatcattaaaaaaaagtctgcatcatgaaactatgagtcctaattagaagggtagtggtgattttctaaccaaaaattacttggcataatttactctgggattaataagtataaatgcattgtcccatctttgaaatttttcttttacttctgactagacatggcaactctgagtttgaatccaaacacaaatgtacttacttgaatttcctggttttggtccatcataaaagcaataagtttgacaggaagacagcctatcagtttgccctacaagtcttatcagtataactttggaaccaaccaatccaacactctttattttgttgggtagcaactactcctgcttgttcacccgacattacattttcttccagcaaagatccatcaaccttattcccttgtgtgacttccctgatttcactcgtggctgccattaaatgcactgtgtcttttgaaaacacttaaacactaattaaattaatttatggtatatgtcattagtatcccattttgccttggtcttttctgcccaaaacaataagcccccgagacattcaaaatgcttgtgtttagttgcttagtaaatccttagtatccatcataacatcaaatcttgatgacagtaatggtgatggataaaggagaaaattacaccccagagaagttatgagtcaagaatgtctagttagatttacttagaacaaagtaacagacaagataaagccctaagaataagtctgggttcattttaaattgagatgacaaccatcccatagtcctaaaataattactgcttctaatatagactgcacatgatttaattacttcacattgattttaaaacaaaacctacatgcaatagttgctgacagaagtttagacccgatgccttttcagccaggataggtacaagcactggcgcgtgtgacagcaggcttcaaacctcattcagcagacgggatagtaggctagataataaacagcaattagaactcactgtgataaaggccatggtaatattgttagagagtgctacagaaatgcacagtagtagttctctactcagaccaagagatcaggcagggcttcataaacatctccatgtaatttgccttacccgggctgttgcctaccctggctgcctagataatgcttgcttctcttccgagactcaactcaaatccaccttctccttaatccagatttattctttccttgatcagctaacatgcgcagtgttctgtcccctgcacactaccctcaaccccaggaggattcattgcttccttttagttgctataagggctttacaatctggccaggcttagtggtacaccctgctcctttcccattttgaataaaatctgcaccatagggccagagaaatcagagagaagagcaattaccttgagtaggtatattagttcattctcatgctgctaataaagacatacccgagactggctaatttataaaagaaagaggtttaattaactcacagttcccagtagctaggaaggcctcaggaaacttataatcatggcgaaaagggaagcaaacacatccttcttcacatggcagcaggagagagaagaatgagtgccctgtgaaagggggatgccccttataaagccatcagatctcatgagaactaactcactatcaggagaacaggatgggggaaactgctcccttgattcaattatctccatctggtccctcccacgacacatggggattatgggaactacaattcaagatgagatttggatggggagacagccaaaccatatcagtaggcatctaaaaactcagccctccactgtctgtgtttctctccccagcacttttgccattaccctatagatataatgatggagctctggcttcatgataacttcagggttacctggtatggaaaagagagacaataaaacttggtttttgtaacaatttttatgtcctcaagccagatcccctttccaggacatctccagcatgtagggatgattcagagacccagacataaggagtcacttaagcaaaccagagaagcatatacagttggaatttggggtggtgggtagagaggggcaatgttttttgaatgctacaaagttcaaatgccaatctgttctcttcctgccggactggtctttgtgatgttcaaataaagtgagcatgagatattctcaaagttagaaggagtctgtaactatttgcttacaggcagaggtttgggtaggggacagggtgtgagagcacctcagttaaattgtgtacggaggttctgaattgtttaggcaatagcaatgcattatgcaatactcagccaaaatgtgagtgtaataaattaatagaacttttggatgactttttcccttaaaatagacacttggcataatttttttttttttttttttttttgctgtcttgtctctccagcaagtgtttaatctttatgtgtttagattgtttattgggtgctataattatagatatttgaatattagagtgtccctactcaaactgttttcatcacaaaatgtatgacaattatattgtgccattagtagacctgcttttcttctcgactctgtcacaaggacagtgtcttttttttttttttttttttttttttgaggggaggtcttgctccatctctcaggctggagtacagtggtgcaatctcagctcactgcaacctccgcctcccacgttcaagtgattctcctgcctcagcttcccaagtagctgggattacaggcgcccaccaccatgcctggctagtttttgtatttttggtagagatggggtttcaccatgttggccaggctggtctcctgacctaaggtgatccacctgtctcggcctcccaaagtgctggaattacagtagtgagccaccgtgtctggctgagggacagtgtcttttgattcttggagttttgcacaacacctggcacataaatattcctcagctaatttatttaaaaaataataactagaggagctctgattcttgactggacacatgcaatttagacttctactaaataaaaaaagaacactagaatagagaatagatgcactgggattgtgcagccaggagaaatcaatctacctagattgcctatgtgattcaggtggaactaggatgccagcctgaagcgtagaaagaattcccaagtattctacagaagactacaggccagaggtagaacaaagcaagaagaatggcattttttctctacagtcagcttttaaaacagcatacggtcttgtttccatggcaagaaaatctcctaggtgcattgccaggagattctcccttagaaattaaaaagaagaaagaaaagaagggaaagaagccacccatagctgtgttttctgaaaacagcttgactctcctgctgatcatcgacggctgccacgccacggaaacacctcatccaatggtgcccaggccgcctctacgcagcatgctggaagcttgtgattaattttgtttgacagcagcaaaaagtatgccctacgttggatgccagctgattatttccagtatgtttgctgctgaaaattccattaatgatttttaatatccattcaacttgaagagaggagaaaagtgcttttctgaaaaaggaaaagtaaattggactcagtcttatggaaaatccaaatctacagagtgaacgtttgatggcagatgagttgaggaaaatgtgagcaatttcaaaatttttttacgtgaaggatttgctctattattggtaatatatctgtagagaatgtgttgtgaataataacatattttgattgatgtgctttcattttcttcccagtgtacaaatatggcaacttttaatgttcaacttgatgtgtatttattaattgcttactgtgttcaagacccttattaaatattgattgaactgaaatgagccctgggggaacctaccatctaagacagcaattctcaactgtggctccacatttgaattcccaggggaacttgaaaaattctgggccctcagaaattctgacttaattgttctggagtaaggtctgtggcctcagtattttttcatatgtctcctcatgtgcataatatgtaattagatttgagaatcaacagctgatataaaaggaagtgaaaaggcagtacatggccaagtccctgtagatatgcaaaggacactgttttaaaatcatttatctatttgaaaagtatgatgatttaaaaggagaggaaattacatttttttgaggctgccagaaaaaaactccatgaaggaagtaatatttaagtagactctcaatgtgtaaaattttgatcggcagagataggtatccaggtagaggatcaaagactaggatgagaaaagaataaggccagttctgtgaatacccagtgactaacacaaggctaggagaaaaggagtattgattgctattataaagcattaccattaatatgtaatttcagctagctatgaactcaaatacgtttatgaagtaatgagatattttagcatttttttctcatgtgctactcctaaaagttactcttaaaacaacagggttgacaaatatgtttaatatatggcaaaatagacatagatttaaaaatgcactttagtatcttgctatttgattgtgtggtcctcagatgagcagcattggcatcacctgtaacttgttagaaatgaagctaatgcaggatgttggcccccaccccaaacctaacaaatcaaagtctgcattttaataagatctttgtgtacacactaaagtctgagaagcactactttagcatctcaattattattacattattagcagtaattaattgagaagagtagagaagtacgtttcaacaaattaaatttctacctatgactgtgaacgatgaatagtgttgatatgcaataatcttttctttcaatcatatctttttatatatgtcaccctatatatccccatatagtaatgtacttatgtgtgattaatacatctaaatatgtttctttgtataggtgttctctccagttccagtctttatgtctaaaaagataacatcttttcattttagaccttggtaatgttttctgtgcttttcaaaaagatgtcctcaacatcacctctgaaaatgcattatgatctcctgtgcctctgccatctcattgcacactggtttcggtggcatgtggcagatggaacagaaagacatgaggctgggaaactcatagattccagaggaaacttgaggcacacaggaagctggttcagcttgggcatgcaagcattatttacctctttaatctgaattaaacaagtaacagtaagtaatgattcagagaagttttgttaagtggcagaatattttatggatgggtattttcttacagtgcttctgacctaagaaacggcagcctatcaacaaataattattaaaacattccttttcccaaatcgtattggatttggttacctgcttaaacacccttaggctgatggttagcaacaagatcttagtatactttagttacaaaatcatctgctgttctcaaactttagtgtgcgatagaatatcagtggatgttgctcaaaatagatactccagatcccactgagaatctgattcagtaatttgggggtaaggtccaggactcttttgaaacaagcattccaggagattttgttgttgttactaagaatactacattttgagaaaacaaaaacaaaaaacacattgctttaagacaggggtatccaatcttttggcttcactgggccgcattagaagaataaatgtcttgggctacacataaaatatagtaacacgaacgatagttgatgagcttaaaagtactgcaaaaaaatctcataatgttttaagacagtttacaaaattgtgttgggctgcattcaaatccatccttggccgcatgtggcctgcgggccaagggttggacaaacttgctaaggcattgtattcttaggaatttactattttctttcggtatcagtattatctaaactaaagctacgcaccaggctaatacctaagcttagtaaaccatagattgatccaccaacctttttgaaggagatgatattagaaaatgattttgtatccattgtaggatttcatattctaagcattgacatatgtaatctattgggccaggcacagtgtaatgccagcactttgtgaggctgaggtgagaggattacttgagcccgggagttcaagaccagcctgggaagcataacgaaaccctgtctctgtaaaaaatacaaaaattagccaagcctggtggtgcatacctgtggtcctagctactcaggcagctgaggcgggaggatcacttgagtctgggaggttgaggctgcagtaaaccgtgatagtaccactgtactccagccagggcaacagagtaagaccctgtctcaaaaaaagaaaaaaaaaaaactgaaaaaataagacagctgtattatacaatgcattagatttgattagtgaccatgttgcattttttgtaagaaaaaattcactaactgtacagtttttacaagaaacctataatagaatctgactttactggttggtgctggatgttttcttagctacttaccattaaagaaaggaaaaagaaggaaggaaggaaagaaggaaggaaggaaggaaggaagggaagaaggaacatgaataacaacttatgtaaatagatgatcattgcaactttatttatcaatagcaaaataaacctaactctcaaaccataggaacatggataaacatattttggcatacccataggagagaaaaatgcagtcatttaaattaatatttttcaaaatattgaatataagaagattctcatcatatcatgttaagagaagaaataagatttaaaaagttaattttaataatgataaaaacatacacatgaaaaattgagtggaaaaacaacacaatgtaaattggtcatatcttgaatattaaattgtaggtggttttaatttttttctttctaactttctgtatagtccaaaatattttcaataagtttatgtgacttttataattaggtaaaaaaaaattttaagaagtataatttttaaaatctgggttgttttaagagtggttcagcttaagaacaggtggatggactaaatgaacctttttaacattgcttcagttctaaagaccatctgcccagtcctattaaccagtaactacagaaagaagttagatccaattagtaaaggcagaaagaaacattgcctttgtgagttctgtttccctgtgcatatctgccaccttaaactaatggagctatttattgagttcaagctgtccccaacgaaagctgctttttactttgcttctgtgcaaatcttgttcactttttacaactggctacagaatcaaagccagcagctggcctccatgctactacacagaacaatagcctgagcccaagcttctgaagagcaggcctgccccagtatcttgaatgtatgcctgcataaaaagcagacaccacccaggatggctgtatctgctgcttctgctcaggcagtaaatatgtaaaataggaagccaaaacacatccagggccacatctcattgagtgcccttggggggaaactcaattggacatcagtttatctttaaaataggaatcataatggcttcctctgattatgtcctgtaaagtatataagtggtttataaactacagttttaacatactggttgttaggtgatcgtgttcccattttttatgtggttgctttctcaagcacatacataatcatgctaaagaacggtaaaatagcagcagtcctcctgccatgcccaggacttatgctactttgtaatgtgatctcaaaatggactgtaaatggatggcccagtggtatttattatcaccacttaaagtgaacccatatgccagtggcatattgagctaacaatctgtgatgtcattggcagaagcagctcttccagaaggcagagttgctgaggattctctatgacattactctatcagcatattggatgttgctcgtcaatagtagccgtggtgtcggggaaataaggtcaagtgaagcagtgagttactggtaacttaggggttaccacctgtcaaaaatcatacagattatgatttttttccaaaattaacctgaaatctcataggattatcaccatttatatgttttgattcttctcatcagtcctgtgaggtactgttattattgccattttaaagatgaggagactgaggttaggaaagattaaggaaggtgctcaagttcactcatttgggtggtgaacccaaatttgaaacctcccaggtaggctgaatgcagagcctctgctgctcaccactttataacgtttacctgtaaatattctgaacaaagtttaaaaaaggagcacttaatcacttaggaaaaccaactgccagagagtattttaggtttagccattcacataaaaataatgcaaactagtagagttactttcttcttaaactcatattttaatatacaaataagatttctaaatcccaaagagagaatcttggaagatagttgcaaatatgaaaagttgaaggctatttcattaaacccatttacgtttttttaaaaaaggaaacttgaaacccagagacgttgacttgctcccaaaattcttagaataaacacgtggaaactgcacaagaccttaagggtcctacctcctacctcatggttcagtgcccttcatgtgaccttgtccatatatttaagtagaattatgagattaaagtttgtaccttttcagtatagttgaccgactcttcttggaatctattgagttagtgttttattatgctctttgttagcctcgattgtttcccggatacaatcatggcttgattttgtcactgctcccttaaacttgagattctaacctacatgaactgggagcaattttcagtgttgttttgtgctttttgcttctggccatgtactgtgaggctgtgtttgaggttgtccccgtaggtactcattcagatagaattgcctgtgaattgttccttaaacttttaatttcagcatctttaaattgcacttacttgttttcatgtttggttttcttttctagattttaagttatctgtggtcagggaacatgacttatgtgctttagttttcttactgctcgtcacactatgtggcacattgcaataaatgttttttaagtaaataaacttggaaataattataattgatttcttcttttttaaacttcttcgttgatacctgcctttcttctcatttatctgaatcaatgtgtcattatggacagtgatcttgttggaggaaattaaacatttcaattgcacgtgggctctcttcttactatactttttcctcagcatgccacaattacccaaattcaataaagcaaaaataatgatacctaattaaagatgaaaacataaagtcgtttatctattaatttaaataaagtgaacctgttatcaccctgagaatttttttttttttttttttgagatggagtcttgctctgttgcccaggctggagtgtggtggtgcgatctcagctcactgcagcctctgcctcccgggtttaagggattcttctgcctcagttacccgaatagttgggactagaggcacctgacaccacacatggctaatttttgtatttttggtagagacggggtttcgccatgttgactgggctagtctcgaattcctgacctaatgtgttccgcctgcctcggcctgtcacagtgctgggattacagacgtcagtcgccatgccctgcccaccctgactttcttaatgccttgattctggaggatgcagttcttagtaaccaggctgtggccctctgatgtaactttagagaatgattaacatgtcacgtggttagctgggctctgagatgatctctgtaacaaagcagtctacattgttctcccaaggaagagatttgtgtgtgacttattgaaggggaattggttttgtttcttagaacggtttatcatttcacaacctgtattttccattgttattctttatcactagaaggttttaaaactcagaaataataaaagagaatataaaaactctggaagcctcttaaattgattgatgggaaaatagtttagtttgttaagtacattgtctggtagaccttctttccatactaggaaatggaatggaatatatacattccattcgagaatatatattaaatataatgtttgaatatatattcaaagaagtttgttgcattcattcctggcatggcctccttactagtttttctaactctgccatgtcacctgttgtttcgtggatgagcaacctattgagtttgttctctatacctttgtccctgtagaactgtgtttggaatcaggcttgttaggacagaaaatcaatcggagttgtgaaagaaagtgaaaccctggatgcattggagaggacatagcagaatggagaggaagaggatgggcataggaaagagacacaggaaagcccattagggacagtatagtaacctccatgttaatctactagtcacaagtgcattgagactacaaacaaaattgtaagaggatattttaatctataaaataaatgaaaaattattttcaagctcttcaaaggcattacttacaaaatatgtattattcttatcagactccagaaatcgatcattttgtatattttaaagaatttggtttcttgaaaaaatgtaatagagagttttcactaactcagtctatcttttcttttaattagttctgttaataagattttactgcataggtagtaccacttaccaccttacatttttaaactcagtattaattgtgcatagggaagcttcttgcacattgatggtctttaattttgaaaggagtacctctaaatcatcattaatttattctaagagcttgacttcattccagtctaactgtctttgatgcccagcaagaatggctgggcattttcttccaattaatacagctggcttctgtttaaatgaattaatcacgaattcaactgtcttgattctcgtagtatgacattaggaaccatttagtaataaagtaagaagcttaatacttaatggaaagaaagatctgtttttttaatgcaaaaattttattatcattccagttcctggggaaaattttgctgccatggcaagtattcttagcagactcttgccttgttctcctactttggaatcagggtgtttagatgatataccatagacagggacttgaaatgtaaagattgaatttacaaagctattttttttagctttacttaaatgcttatatacacagccattagtatggtgaccacatattttaagtactcaataaatatttgctggataaataatacatgaaaacacgtatttttttttttttttgagatggagttttgcgcttgtcaactaagctggagtgcaatggtgcagtcttagctcactgcaacttccgctgcctgggttcaagtgattctcctgcctcagcctccagagtagctgggattacaggtgcgcatcaccacacccagctaattttgtatttttagtagagatggggtttcaccatgtttgacaggctggtctcaaacttctgacctcaggtgatccgcccgtctcggcctcccagagtgctgggattacaggcatgagccactgcaccaggtcatgaaaacatgtattcttttaattagttctattaataagattttactgcatataggtaatactacttaccaaattacatttttagcttggaactgaatttgcatggtctatattttgcatctaaatatccagtaagtgtgtagaataactcaggcttcatttggtataaaaacgccttcctatttcaaacttgttttttttcccctttttgtggagagtggggtctcactatattgcccaggatagtctcaaactcctgggcacaaggtatcttcctgcctcttcttccctaaattttgggatcataggtgtgagccacctggcccagccaagcatgccttcttatttgtatagaatcatattttcaatttttttagtgactatacattttactaatttatttaataattagttttatatggctaatgatgaaatgcataattactaaaacttaatgaaacgtgcatttagttataatgcacaattttaccttccattttgtcaatcgtacttttgcaaaaccaattcagcttcaatatttgaaacatatgtgagagtatccctctattgtggataagagcttcgtactagaatattttaaaagtgaagagagaaaacgtggctcaaatagtctgaccaattacttagcatcttgtgaatattacaaagaaaaatgccttctaaaatgtgtttgtattttcttcttaacgttttatatatttagtgttcatttttatatttcctgaaaggaaatatgtaaattttgctataaaatcgagccatctttgtaaaagtgatcctgcttaaaattacaaaatctatctgagagtcatttataaaggtgtgaatgtatctggcagcctgggcaagcagtctgagttacttcctgatatatacatttggcccttatctggagaggactgtacatgtctgtataatttcttttgttgttttatttttttaaatttttaaattttattttattattattatactttaagttttagggtatatgtgcacaatgtgcaggttagttacatatgtatacatgtgccatgctggtgtgctgcattgttgttttattttgagagacagtgtctcacttcgttgcctatgctggagtgcagtgatgcaatcatagctcactgtcaccttgatcttctgggctcaagtgagtcttctgccttagcctccctgagtagctgggattacaggtgctcgccaccatgcctggctaatttttaaaatatttttgtagagatggagggtcttgctatgttggtctcaaacttttgggctcaaatactcctcccacttcaccctcccaaagcgctaggattacaggcttcagccactgcacctggctctgtaatctcttaattcctcttgagttagatagcagaattggcttgcatctggtctttatcttcctccagatgtaaaatccaggcccatcactgttgggtataaggagtgagagagaggggttactatttattccactcagtgtgtaatctattaagccctctgagccaatcaaaatcatgtgggcattgaagttcaaaaccacaacatagatgcattcatttatagtgacattgttgcttaggcaacaagaaatctgaatctcctattaaactagccaacagcaagaatttaaaatattttattttatatatctggtattttgaatcaattaatagagttttttttctgagaatgactaatagatacttagttttcatacaaagtttaggtgacataagagttacggctgatagctgccataacatagaagcataaaatttcatggtttagcacaaaacatgcttaaattttgttcacataaaatctagtggaatcgttgtggggtgagggggtgaggatcttgtatctctgatttgcgattgttcggggactcaagtttataaagatgtgtttacacggtcatcttgatagagactgcttctaaccattggcttctgaggtctcgttagcagttgacatccagctggtccactgaggaactgagaatgtgcaggatggtgcaggagattgtcacaggccaggcctgaaagtggcgtgcatctcttttgcttacattctgtaacctgttgtatggtcaaagcacatgcagaaggggtaggaaaatgaagtcttccatggagtagtcattttccaaaaacaacgcttctctgtgaaaaagcagcatgaatttttggtggtcagctagcttcctctgctgtgggaagagagtgactatgattgctgtattcaagcaccaactgaaaatcgtcagtgtaatggtattgaaaataaggctatttttaaaaatggaaacgaaacgcgattaaatccataattgaatacatttaggactttgctttagaactagaggagatgttatagcatcaagtagagtcccatttagatgattaaggagatattttggatttctgaaattaaaaatagtttttcctgtttttccctctggaaagtaaaaaatagtttttcccaagggtaaaaggggagaaactattttttactttttaagtaaaggtctaaaattccctctttctgtagttgctcaaataaaactgctaagcaagatgattttctctgaacatacgtgcaacacattaccttgtatttagtgattatgacatatgaacattctatgatgctaaattaaatttctgtaattaagaataacaatatccagatagtattttgcaaagtacttccaagtccttatgccattttagcctctcaatgagcctctgagagagacagaacaagtgttcttagcccctttttggacaaagaatatgagactatcagtgtttaaatgactagtttaaaattctttgggttgttaagggttataatccaaataatccaggattattgttaagattatagttctcattgtaatcctgtaatgttcttttcattatctgcaatgactggatctatctggacactagaaacggccattcgtgtacgtttttcaggttgtacaatttataaaaatgcccacaaatgcagttgatgtgagaatcaccaaggtgactgaagtaacggatcagcattactggtttattcattttgctgatacagacatattttgtgtattgccttttaagtatttatagagtagaattccaagagctgacagatattaagatattaagactttttcttttctttttcttttttttttgagatggagtctcactctgtcgcccaggctggagtgcagtggcccaatcttggctcactgcaacctccacctcccaggttcaagcaattctcctgcctcattctcctgggactacaggcgtgtgccaccatgcccagctagttttttttgtatttttagtagagatggggtttcactgtgttagctaggatggtcttgatctcgtgacctcatgatccacctgcctcggcctcccaaagtgctgggattacagacgtgagccaccgcgcccggccttggaatttgtattttaaaatccatggacaggtcaaaacatgttaagcaagaagaagatatatctaagagataactttgtaaaagtcttcaattatttgaagggcctgttagagagtggctggctgtgaggaacctggctgggaacacatgccagcaaagacctaaggacggcctgagaaatttggaggaagggggaactttccttcagagttattaagcactaaaaccagtcactagtgtttttagagaacctttacataattttcttgtaaaaggaatagattcttctggaacagttcattaaaagctctgcatgtatctaggagggaaaaggaaaagatgaaaaaaatagaggacttagcaagatcattttttaacttcaagtccccataggctgtaagttaatttactgacaaactatagaaactgtaaaagatttttccttttatatgacacaaaagctggtccaatgttatatattaactggtcattgatcagaagagtataacagaaatcatatctttaatataaatattaaaattgcctcagaacacatttaggaaccactgcatcctgttaatatagacactgactacactttgcctgccttttaaatgtaactgtctcagacattgataaaaggcactcacatctgcaagattccccttgttttttgtacaatgaaactctttttatcataaaatcaacacaattaaaaattcgaaaagaggtttgactcccatattactttaacaacatcccatttatgttctagtctttatttatattcatagattttttttatacagttgcaacacaacaaaaacatacatcattcttttattgaccacaggttgacttagtgccaactctctggcaggccctgttctagggctggagacactgctgtgaattaaacaaagtccatgcccttgtggcaactatattctagtggaagtgggtggggctagacaattaacacataagccaacaggtagataatgtcaagtggcaaaaagcaagcaagcaagcaaacaaacaaacaaaaaaaccacgaagaaaactgaagcacagaaagggacagagagtgatggggggctcttcaaacttggggagttagggaaggctcctttgagcagaggatttgactggagtgaacagaggaagttacttctgtgactgtcagggtaagtccattcctgacagaaaaacagcaagtatataatgcctgggaagggaactcgcttggcatgctggaggaggagtaagggacaccagtaagtctggagcgtagggagcaagaaagagtggtcagaaatgagatcagaggtcagcagagaccacctgataagtaccactgtgtatggcaggtattatgttgggtgataggaatacagacctgaccaagacagttcttaacttcaaaaaggttacattcaaataggcacatagatgtataagcaaataaggaacaacaaattgtgttaggtgccattataaagaaaggagtatagtgctgtgagcagtgtaactaactgcatcagtgagatgatgatgccgaaatgggatttgaaggatgagtacaaggtttccaggaaaagaagagaggaaagagtatttcaaacagagagagcagcacatggtaaagtcaaggagttgacagaaacatcctggcatgtttttggtttagcaaaatgtttagtgctgttaaaaaaagatgtatgttggaaagttatgggagatgagggtggaaaataggttagaaccaaattgtaaaggttccaagtttaaaaattttccaaactttacaataaagtattctagactattttctgtttttcatttgtgttatgttattctatagaaatttaaagttcttatccattatactaaactcattgttttcctgtgttattttttgctgctcctttaagcagcaaaaattattaacaagcaattaaaatattaaacaaagatggcttaatcattttttaagcagaggtaaccagaaagaattttcaatgacactttaatttttggtctttgaggaaggaatcaagaccttgaagttatatctatattatttaataattatttactttaaaaaatgataggtttcctagtttccttacagatactgacttaccacaagttctacagttatacatatagtaactttttaagggactatttcttgctcatgtaatattacttttcaggagatgtaatgtattttgaatggctgttattattgtttaaaatttattcacttcattgtcttgcaactaggctgaaaagttttagaaatgaattataaataaattctagattctgagcataagttttcccaatgtattattttaacctctgaacctcaaaagatttcatttcagactgattttattggttctctttttgaaaatggaagtgtttctaaaatttctagaaaagcctggttttttttaataagaaatcataatcaatccataagtgttattcactggatagatttaaggctgataaattgctgtgtcccttgatgctcttcattagcatcagaagtaccatggtgaaataatgttatgggaacctcaggctctggggttttacagaggagcaggcagtgccctgagagacagcactgggtcactgggagttttcacaggtgccttcctggctatgctgaggtccttttgttagtgactggcaatagtcacagttcatttgggaatgggcaaggggacaagctggggaggtttcagcattttagaatatacatgtctatgcaaacaaaacatgagcatcatctttgattttgaaacataactttaaagtggaagcgtttacctatataaagtggacatttccagagcactccattaccaacaattggcctcacatatctaaaaacttgactgtagtcttattttaatggggcttatgtaacaaagcttgaaaacctgagaatattaatttttttgttttttttttcttttacaaaatgttatttagaaaaggacgttttatgtctccaaaagacggtgaaacagaaatcaaatgactggaaaggaactggaaaggaaattaacatttatctgtagatgggcctttatatatgaatccaccgaactgtcacaattgttgcacagacataattagaaccacatttttacagatgagtaaactgaggctcagagaagttgaatgacaggtctgtgaattggatccagatctttctggctccagtgtcccttttcacactgctcctccctatcatgagtcccagctctatttaaacatgtcatttgatatttttgagccgtagttctgctctagttaattatcacaacataacaaaccaccccaacacttagtgatttaaaaccgacaatttaaattctctcatactccagtgggcccaactggctttcttacctggtggtctcagggaagtattccaaaaaagtgaaatggaagctgcgagatctcttaggacttctagcctctagaagtcatagtgccacttcaccacattctattagtctcagaaagtcacaaggccagcccagattaaatggtgggaaatagattctacctcttgatgggaggaactgtaaacatttcatgaccatatgccatcagtcactattcttttctgtctttaatttttaacacattgtgttatgttgtattattaccaaagcactgaagaatgttagcaagtgaaactttagattatttgtctctaaaatgtgcctcctaattttgttctgctttaccattgtgaagaagatatttgaaaggaggtaatgagcatggagatgctttgaaaacctataaatagagccctttataatctaagatgttactatgatttatggaagatgctagtatttattgtagaaatgatatttcatcaattaaaaaagcagatgaaggccaggcatggtggctcatgcctgtaatcccagcatttgggaggctgaggcgggtggatcacctgaagtcagaagttcgagactagcctgaccaacatggagaaacctcgtgtctaagaaaaatacaaaattggctggatgtgttggtgcatgccaccatcccagctactcgggaggctgaggcaggagaatcgcttgaacccgggaggcggaaattgcagtgagccgagatcgcaccactgcactccagcctaggtaacaagagcgaatctctgtctcagaaaaaattaaaataaaaataaaaaagctgataaaaaaatatatgaaacaacctcctgttcatagggcatataattctttcttctagacttacagaagcactaatggttttctgaaacgtaataatatgtggtattttttattaagtgttttgttgttgtttgtgtgtgtaaaatcaaacagtgagtaaaagttgaatggaatcggttttccattctttgggcagttaatagtattacagccagatgtcctcatacaaggaagtctgtgaaatcatatcttgggaatagaatggttttcactaatgcagaaattcctaactcaaaagactttcccaaagagtgagattcctcagttaaatctctttctaagaatctttctaactttgaatatagatttcataaaaatctcaaatcattgataagctatagttttatgaaataaattattactctcaactccttacttttctaaaatctattttttttgcatctcaaaatattattacagtttgctaaaatgagttttaaaatggaaaacctacatagtggtatgaaacagatatcctcttgattacttctttttttaagggatgaataggtgagacgttagaactttacttaggaagaggttcttgaaaattaaccctgaactatctgttcttaaatggcccaaataactgacattataaagattaaaagctttgagtttggtccttttttggagttgcttttatatatacatatctacttaagttgcgttctctaccatgaaatctggggattagaaaatacttagaccaagccacaggcatattcgtttagctcacattatgttttaaaaattgagttagttgccaatgttttaatcagaagattttatgtaaaagtcttaaattctagcttcgtgataaaagtcagaatacctgataatattgggccagcattcccactctaatataatgttttgaagctgaatagaagttaccctcgttagacgaggcacatgcaacctggttaccattattttcactttccatacttttataatctgcctggttgtcctaggcatttgagtttgagacaatgacagagttgtggctgaaggattcaaacatgcctctgacgtttgataaacaaacacaatttgagggctacttctgggcatatcagtggtacatcagtgacaaaggattgagaccctcagatggatgggtgcaaagagaaatgaggaacttaagaattccatatgccacctgatcaagctctgaatagcagtggtacaggttctgcccatctttgaaccatatcataaaacctgattttggcagtaatacttcagcacagattgtacctgctgtttttaaaatactgcttatcagtcatttttagcatcatattgatatcaaggccaacacagcctaaaattttgacttccctcaatgctgctgaaagctacaaagaaaggaggacaataattataatcccaaattacccttaattctgaactcaggaatttaggcaaactaactaaatagtagacctttcttttgatcaaattttggattggcacagtctttaagagatgtgatatttgatctgtatttttgttaaaaatcttgtgaattctgcagtgaattttttccagagtagttatcattgtcctaccaattagaaattttaatgttgattaaaaagcaaaacggtccaaatgtctgcagttttactttctaaaacagagaaatgaaatggatcagcactacagaaaattatcaaaattagcttttaatagcagtagctaacgttatgcagtgcttattatgtgccatccctttgagatagatatccccacttttagatgagaaaattgaggcatggataggggattaaatttgtctaaatttgcagagcatgaggatttgtttctaggaatttgtttaaagattatacaatgctttgcgatggttatagtcttgttttatagattaagtgcttttaatcgcttggctccaccctctttcagtttgcgctctctcagacatacgtgacagccaccactgaatttcacaaaggtctttttttcagacattgtaagaatgtgcaggagtccaatgttttttgggctttggggacattctgtatgaaacttaaggatttatagtcatatgtattgtaataacagacaaaaccaaaattcattaatatgaagattggtagaaactgtggattttccttataaaacaaaatcatatatttccattttaaatgtcatttttttctcttctgagattgtttgaatatagccaatgtgtgttcttaaatttagtttttaaatgtggtaatgtacaaagatgaaaattacggtgagactatttggatttttttaagaatggcatctggccacagaattgcaatccatacactacacaacataaaaaacatacattacagcactaaatatagttcaggcttgcctttgcttctgacttcaaggactgaaccatataaacacaaggcagatgaactagtgagaagtcacttggtgtagaagtccttgttaattaaagtgtccatggaccagcagcatgggcatcacccaggagcttgtaaaaagcagactctcagaccccagctttgacctatggaagcggaatttatatttacatcaacagattattcctatgcacactaatgtctgagaagcattgggttagatagattggattctgccagtctctgggaattagctattcatctttgaataagttactatgttctatgtattttagtttcctccatttcttgctacttactacatgttgatttagagcaacttaattctgtaatcttcatttagttgcctataaaatagggatattaataatacctacctcctattattataaggattaaatgaggtaatgagtgtaaaatatatagaatattgtccacatatagtatgtgattaatatgtgcttgtgatggttcttttagttatttctctggtgcgctatataatcttattgattacatgacaagtggaattagaaatttctttcaaaatctactacacagatatataaatatgcttttaaaaatcaaaaaattagaaggagataaattttccaagggttaaagagtctagtggaaaaaacactggaatgggaattacacagactaaactctagtcccaattcttttgaccttgagcctgacatttaacttttttgatttcatggatattatataagaatataaaatgccttaacatgcttatagtgcagttatatagatttatagaactggcagtaaccaattattatgcatacattgtcttaatctatgagaatttgtgatagggtgttcaggtgactgctgttctgtgacattatattgggtacttgtagaagtttcagtaaatccttcagattattaaattactgtttaagctgcaaacacatgtcctgatttcctatatctaatcccaaatccattatttatataagaagtagttcctttttgtgtatttatatttattttatttatttatttattcgagatggagtcttgctctgtcacccaggctggagtgcagtggtgtaatctcgcctcactgcaacccctgcctcccaggtgatcctcctgcctcagcctccaggcatccaccattacgactggctaatttttggtatttttagtagagacagagtttcaccatgttggccaggctgatctcgaactcctgacctcaagtgatctgcctaccttggccttccaaagtgttgggattacaggtgtgagccaccacgcccagctaatttgctttttgaaactctgtttattacgcaataatgccaacacatttattaaagcttcaaataaaagtcagctttcctctcctctttatgtcatatgttcatctaggtgatatatgcctgaatcattgcaggcacacaacaaaccttcaccaaataagacagtaactttacccttgttttctgctctccattaaataattcactggaatttgttgcttcccttttatgttagtagagtctgtaccaaaatatcaactctatgataaccaagaactttgagttaggagctcattgtaactcttctttgcttgaaaatctgtcccaaattcataattaacttggccagtgtttatattggagtagagtatactgtgaaacttgtataaatgaatagaacttcttggaccttccttaatctgtggcttttgtttctctttttcaattattaatgataaatcttcccagtgaacatgcagccaacacattgaataaatatttcaattaagtcggatgttgatgtgaatgcaaattaaattaggcaatttttctgcttattttaatatatctgcaaatcatatcccattgaagtgctttgtgatgttttttaaaaaagagataaagtgatctcttaaaaactgaggagtgctgttatgcttaagcatcagattcataaataaataaagacatttcttatcaacctatctctgagacaaagacttcagccgttagaaaaaagacgttctcaaaggaaccatgttcttaaatacaaattttgatacttatctgaaggggatatttgattatggattcaaaacaatacatccagcactaagaggaccagaaggaatttatgtgatggaaaagagggtgcagcacgtgtgtgtgtgtgtgtgtgtgcatgcatgtgtgtgcgcgtgtgtgtataaacattgaagctgcagtgtattacagttatcttcttgttagcagcttttaaaagatgtaattgacatagatatttagtgtacatatttagtgtggggtacaatttgataaattctgacttatgtataaaccataaagccatcactgcaatcaagataaaaaacacatttagttactaaacatatttagttattggaatgtcagaaccagatttcatcaccagtaaaaattttactttatgttgcatttcaaaaattaagttagatttgtgtatattcatttgtgtttagtcacaaagcattgtttttgtaactaattaatggtttttgtcttgttttttaaaaaatttagggtgtggctggaatgcatgctgtagcatgactggcctccagtggtgtctttgaagaatagcatcactgggaaagtcaaagcaacaggtgaaatttaaaagataagagcaatttgcacatcagctaagatgctgtggcacagtctaattggcaggggctggtgaaatagaacattagatcttcaaaaatggaaggtgagaactaccctcttccaatgttgggattcctcagtggcaagaagtgctctgatgctgagtgatgcttgactgcagttattactcaggaatttttcacagaggaaacatcaaggtttatattgattttctttttctagaagagacttttttaggctgcatttttttctactgtgttgatgcttcagaatatatctttattatttaccttttttccttttgtgcctttttcttcttacagcttttaatttggttatatactccaagaactctaaaactgtacctatatgagtaaaaattgttacacataaaatgcgtttttgatttggagtcattttaatgatgaatttaggtgcctgagagtgtgcctgtgatttgtatcaggcacgaagacaagaaatgtttagatcttgaactgctatgttctggcatgtcctatctctttattctttctttctattattctattgttatccccagtagaggaaatgtagaatcacaaattagattatgaggattgggggagaatctaggttacaataagtgaaacagatttatacctttctgtttataagtataataataattcttttataaaaatagaattctttatcatatgaaaaggagaactagtttcttgtataaatacatttgtactctacatctcactgtctgtgcatgctcatattatgtcttcctacagtttttgtccatgcatgtttatagtagttaactgcaggctctcatctgtgctaatgagtctggtgagccacttcgttggctgccatgtggaatctgagcacatctttcctttattccatgtccctctggtctatcaccaggctccactgggatacaaaggtgcatattgtctgattagaacccttcttccccatggtgctctgatgaggggctgccaaagtagtgtagctgtgctccagcgtcttacaaagttcatcccgattcttcctatagggttcaaatataaggagcactcagaagctgaccaggagttcagtgcctgtgacagcaaccagcctttcctattttatgaaggacaccttgtcactgcatgggtctccttatgaattgctccatcttccgtttgaatgagctgtttacaaaagtctcccagtctcctcatcaatcaggattaattgatttgttaaataactgattaatcactggaaccaatgaaaccccaaaatcacagtgacttaaataagatagtagttcatttctctcccacataaaataaatccagacgttggtaacctggggctggtaaggcgctccatgggctcaggaatccagggtccttctatcttgcttctctgccatccttaccatgaggcttccacctcacagcctgagctgatggttcaagctgtaaccatcatgtccagcagaatcacaaaaagtggatagcagtatttatgctttatctttaaggccacttccaaagctgcaaataactctttttaaaaaaattctattggtcatcacatagttacatgaccatactttgctttagatgagactaggaaatgtatgctgcaggagcacatatgcagccatgtgcccaactattactattattattattgttgttatcattattattttatcaaagcaagaagggagaccatctattgaagaataagccttcaatgctgtatgtagaaacatagaaaaaaacccagtaagtcgattttgccacaatacttatgcaagtaggtctctggaagactcattctaccagtccacacaatttgtctaagtctgggcttaaattcaagctaagacctactccattatactttgcttcattgtaaagtaccatatgccttgggcaaaagcaatattaattgcttccaaagccatcaagggctattttatttggacctttctgtggcaaatattatcactccttcaattccagatttgggctaggatgtctgtcatttacagagttgtccagtgtcacttttccttttttatatcattagattttcttaaagtgagtcactcatactctctctctctcatatgctggaatagtctatatgatgtgacctttgcaccagttgtgccagatggtgtgctttcatgacaagtattcactcccctaaattattcccacaaaaaggtatagctgatttctttttttctgatagatctctgtgctagagttaagttaatagaactcattcagattggttatggttgtcttcaggtcactcagcaacataattccttttctctgagtgagtcctagcttatactctgtaaggtagatttggctgcgttgagctattgtctaagagtggtagactccagtatgcaaattgcacccaatttatacagcttgggagtgtgttttcttatcaaagattactctatttcctaaaccaaagggaaaataaattaggatggactagtgttagagaaaaagctactgcttttggtacatgttcatttcaggaagcactgtataaatgaaaactttccaatttttgcccaagggctgactctgtttgaaggactattaattttagacataatcaagagaaattataggcccagatgtagggaaatcagaatgctgcaaatatttgagcactattaattattttagcttttacaaagctaactttgaaatttgagttagccattagctcaaagtaaaaacccaaaatagctatagataaattttcctcttgtatatatatgtgtgtgtgtgtgtgtgtgtgtgtgtatatatatgcacacacacacacacgcacacacacatatatatgtatatatacacacacacacaaatcataaatgtgcttgtgtatatataagataaataaaatgataaagtctaaaatatcttagtggtttataaatgctattcatgtaatattggacaagccatgtttcagagtttccactttctttttatatttgcctactgagtgaaatttatagcattgaatgaattgtttggaaaagaaaaaagattaaaatccatcaatctaagcttttatcatagaaaactagagaagataaagaactatataaacctaaagcaaacagaagaaaagaaataagaattacagcagatacaaatgaaatttaaaacaatagagtaaaatcaatgaaaccaaaagctgattatttgaaaagatatataaagttgataaaattttagtcaaactaacaaagaaaagaagaaagaaaacacaaattcctaatatcagaaatcaaagagggatggatcatcaccgttgattccatggatattaaaagagcaataaataaatattatgcacaacaactaagatgaagtggactaattccttgaaaagtacaatctaccaaaacctatacaaaaagaaataggtgatctgtaagtctgtatctatgacagaaatcaaatcaatggttaataaccttctaataaataaagcaccaggctcaaatggtttcactgatgaattctaccaaatatttaaggaagatatgataacaattctctacaatgtcttccaaaaaatggagacagaatacttcctagttaatcctatgaggctggtataaccctaattctaaaacccaataaagacaggacaagaaaggaaaactacagaccaatatctgtcatgaaaataatgtaaaaatattgaacagaaagatttatataccattatcaagtgagatttattctgtgtatacaaggctggttcaccattcaaaagtcaattaaggtaattcatcacatcaacagcctaaagaagaaaaatcgtatgatcatataagtgaaggtagaaaaagcattagacaaaatccaacacccattcctcaaaaaataaaaagaatcacagaaaactaggaactgaggggaacttccttaacctgataaataacatctacaaaaggcctatagcaaatattagacttaatggtgagaaactagctgctttccccctaagactggcaacaagtaaaaatgttttctcttactctcatattctacatcatactggaagcttagctaatacaataacacaagaaaaggaaataacagatatattgggaaaaaagaaataaaactctctttgttcacagatggcataattgtctatgtagaaaatcccaaatggtcaacaacaataacaaagacctcttggaactaatattgatgatagcaggatcacaggatacaaggttaatatacaaaagtcagctgatttcctatataccatcaatgagcaattggaattggaatttttcattagcaccaaaaaatgaaatacttatgtgtaattctaataagacatgtataagatatatatgagaagaaccacaaaactataatgaaagaaaccaaaggagatctaaataaatattccatgttcatagataagaagactcaatattattaagatttcacttcttctcaacttgatctatagactcaatacaatcccaatcaaaatctcagcaagttgtcttgtggatactgacaaactgattctaaagtttatatggaaaggcaaaagactcagaataataaacacaatatggaagaaaaataacagaggactgacactacccaacttaagacaatataaagctatagtaatcaagacagtgtggtactggtgaaagaattaacacatagatcaatggaaaagaatagaaagcccagaatagatacacacaaatacagtgaactgatttttgaccaagataaaaggcaattcaatgcagaaatgagagtgttttcaacaaatggtgctggaataactgcatacccacatgcgacaaaaagtgaatctagtggcagatattatacttttcgcaaaaagtgatgcaaaatggatcaagagttaaatgtaaaatgtaaaacgatgaaacttctagaagataacatagcagaaaatctaggtgaccttgggtttgatgatgagtttttagatacagtaccaaaaggatgattcaggaaaacaaaaattgataagttgggcttctttaaaatttaaaacttctgttttatgaaagacacagttaaaagaatagaaagacaagccacaggctacaagaaaaaaaatctttgcaaaacacatatctgataaattgtagccattatatacaaagaaatcttcaaactcaacaacaagaaaacaagcaatccagtttacacatgtgtaagtgatctgaacagataccttatcaaagaagatatacagatggcaaaagatgcatatgaagagatgctggacattacatctcattaggaaatcacaaattaaaacaagatgttgttttacagtacaaacctattagaattactaaatccaaaacactggcaatactgaatgctggcaaagaggtggaacaacagaaactgtcattcattgatgttaagaatgcaaaatggcacagccacttgggaaatcaacttggtagtgtcttagcaaggctaaacacagtcttactgtacaatctagtgatcatacttctaggtgtttactcaaatgaaatgaaaacttaggtgcacacagaaatctgcgcttgaatgtttacagcagctttattcataattgtgaaaaaccagaggcaaccaagatatccctcaatagatgaatggataaactgtgatattacagtttacaatggaatattattcagtgacaaatgaactatcaagccacaaaaaaatatgcagcagctgtaagggcatatggctaagtgaagaaacaagcccttttgaaaaggctacataccatttgattcaaactatataacattttagaaaaggcaaaactttagagatagtaaaaacatcagtgtttttcagaacttttgtggggagaaggggaagtgatgaatagatgaagcacagggaatttttagggtcgtgaaactattctgtatgatcttgtaatgctgtgtgatcctggaatacatgacacaatgtacttgtccaaactcatagaactgtacaacataaaaagtaaactctgatgcaaattatagaccttaattaattaaaaaatagaataaaatcaacaacaaaaacatttttccgaattatagagattactgttgataacatgttcatgtatctctttccaaatgtatatatgtaaatgtatcataattagttttttacatacatgaatgaatttgatatttctccctacactgccaaaaatcaggctttgactaaatacagagtaactttttgcagagatagtatttcttctagctgtaagaaggaaatatccttaatttctctaggaaattcaatatggatcccaagggatgtgtcaaattctaggcattagtggtgttaactggactctaaagatacataactttagcatttttaattatcaatattccttccaatgttcttaggcaacaacaaatttttcattctttcatacattcatgcattcattcatctatctaagaaaaagttacagagctcatataacacgtcagttaatgttttttggcaccaggaacttgtcttagtggagtctgtatttctatggagagaaaaaaaaattcaacaaataagaacccaattacctatattactagaagttgtggtaggtgctatgaaagaggacacaggtttgtataagagagttttacaaggagacctggtttggcttgagttgggaatgcattaagggaggcttctatgaccaagttatactgaagttgagatttgaaggatgagtcagatgcaagaatgaggacaacattccaggcagagggaagtacacatgcaagccctgaagtgggaaagaccttgatgcacatagggactgaaagaaggccagtgtcaccggtgtatggtgaggatagagaagcaaagagggtccagctcatgaaggctttggagttgttactaagtttaatggaaatttattggaattatttgggcattggctaggtggaaacaattctataatttgacactgttacactgagaggaatggtggagggatggagtagaagtagggtagctgataggatgttatggttatagacctggtgagcagcagcggtggctggtggctgtggggatgaaaaaaaagtgtacatggaagatatattttggtggaaaaatttataagactcagggatagattgaatgtggacaactcccaggtgtttggctgggtactattcacttagatggggaagcctggagaaaaaaacatttcgggggaaaaaatccaaaaatagtatgtgagacatcaaagtggatatgtcagatgggcagctcagaaaagaggctagaaccagagataggaactttggattgagcacatatatgagatttaccaccatgggagcagatgctgctggtggggcgcatgtataggctaagaagagaggaagccccaggacagttctgaatttgagttccgatagaaaaggaggacacctcaaagaaaactgaagcaaagcagaaagaccatgaaaagaacaggagaaagttgagtgccagaactaagaaaagaaaattccaaaagaaggaagaatgtccaactgtgaagtgctgttaaaaaatcagataatctgaggactgtcaaatctctatgagatttggcaacgtggaggtcactagtaatttagtaagatatttcctagtatcttaatcacatacctagacggaactgaatttctagatatcctcctctttattgttctcaccttttgttccaggactaacttcattttcagttcctcttcactttcccaagttattttcctatccatctattctcctcactttgggccaatagaaaagtgtaacacagggaggaggggaggtgaggaaaagaaaacaggacaaaagttaatgcaacatggtatttaattttgtgcattcttcacagaattgcttttcctccttgtatttgcctaagtatttcatttacttagaaaaacaagtatattttaattttaaaatattatctgtttcatcatgctcaacataaatgtaatcctgtgttgtctactcctgaagtgattaaactataaatagagctttctttgcaacttaatttgctataatccttagcataaaatgaagatgtccttaatgtggaatgcaaatactatgatatggctgatgtcatgaggacttgaaacgtttcatcctctttcactaattttttttaaacattcatataagaaaagccttggcattaaatgctaagaaataggtgcttagatggccagaaattgactgggtttgatggccttcatgatacaaaaacatcaactgttttaaaaatagtattatctaagactgaagatttcttttaagtgagaaatgtattttgaaattaaggaaaagaatgtcagtgatgttttaatggcaatttttgaaagtagtcaaaagacactccagtatatatcgtcatgaatttatgactaatgactaaaataatttagaattctgcttagcactaatcaaaatccagttaaaagactgcttttgtacttttgaagcacgtaagatctttggaaatgcattactgaatattatttgtgcttttaatgcttcatcaacatttaggagtacaagcttccattgtcagtgttttaaaagtcagctatgtaaagctgatagagtatacatattaaatatatccattagtcattctcaggaagtggaatatgtacacacatctgaatatttgcttaaatataaaacaagagtaagatgtttaagcttcaatgtagaataaaatactgatatttgggttttaggttaaaaaatattagttgtgatttttgtcccccttttcctccatgcctttgattccttccctctgaagacagacaaaatcctgacttaggcagtattttttaaaataccaagggtctcggaaacctagggtttgataagtaagaggaacagatcaaattctaaatctcctttgtccacattgtcattctccagcttgttgttcttttcagtggtgaggtaagaatataactcctacttaatgttcctgttccttaggtgaaacactaccaccttttgttcaaaagttagatgctggggttgttgctgttgttgttttcttcttttcttcctttactttttagattttgatggagacgtggtaggaagtctgggctgggaaatgaggtgaaaaagaaaagcaattagtttgtctttatacaaaataaaaccttctaaaaaaccttattatcacaaaaaagagctctacaaatctagatagttgttttgaagaagagaagagaattgtgaaaaacatgtataatttgggagggctgggcacagtggcttatgcctgtaatcccagcactttgggatgctgaggcaggcagatcacctgagatcaggagtttgagaccagcctggccaacataatgaaaccctgtctctactaaaaatacaaaacattagctgggtgtggtaacacacgtctgtggtctcagctactttggaggctgaggcacgagaatcgcttgaacccaggaggcagaggttgcagttagctgagattgtgccactgcactccagctttggtgatagaacgagattccatctcaaagctaaacaacaacaacaacaacaataacaacaacaaaaacatgtataactgggaaaaaactgaaagagaatgcaggatcataaaaatatagcaaacaaagtgagtgggatttaaaattagtggaataagaaataatgggtaacaatgaagaacataatttaggtaatagtatagtatcttgggagccctcctggaagtatctagttatggacagtgagcagcagaaacaggatgtaactcaattcagcatacttgatggttgtggtaaccctagaaaatgactccaggaaataggtgagaatccaatcagattgagaggctaatgttcatgacaggggtgccctagcagacaggcaaagctgaatagaaattcaggaggagaggaattttggctatttagtaaaattatgagcagttggtcataggcaaattttatgagtaggtagcccttctgaagtcttaggcatataattaacctaggttggaattataattagacatcaaagtttaaacttttttatctgaaccgagatgcaaaagtaaattggttctgtgttctggagaattgtaaaagaattccttaattccttagcaaaatttggaagtcagtatcaagtggtgaggataggaaagttgaagagactgtggaccaggcaagaccttatcagttgatttaggaagcagcagtgacagaggccagacaggtaacaagagaaaagagaaggtggaaagtaagagacagttttaattgctacgatagaaagatgggattttgaaaagattagctatatggaataaaattaaccaaaaattgatccaagattataagaaactatttcaagactcattaattttactattgctgtcaaacacacattaaatcattttccacttgggtcagctataggcatgaaggttcatttgtgaaacaatttctgtagagtattattccatgatctgacatgcttcacaaactgtgtttgtacatccaacttaaaagctgaatagtctatggtaattctgccatcatgtttgaaattttcttaccttaaacaaaaaacctgatcatattgtattactcaaatgtgtgtaagactagatttaacttaatgtgtactagtgtacagtgtgagactgcataaacaaactttaaagaaattcgttatacatattttgatttaacctacaatgaagttaagagaaatccttaaccccattagagatttgggagagggatgtggcaactgctaacttataaatattttgctaatgcttaaattttactagctttctgtcaattcctatttttactcaaaaaattatatagtatttaaatttataatttgtattcagttattctagcttactattatatggtatggcttgacggaaaggacattgtcttcttctcttctgcaaagcagaaaaatatccactaaacacaaaaatatacacagcaaatgttaaagtagccctctaaaccttatgaagacttttaaatcctcaaatagtacttcagagcaactggatttaatatctttcatccagcagagggctaccaaactccattagtttctgtgaacacacatgacaaaaaaattcagatgggttatttcagtggttttcagattgttttaagcagcagatccttttcttaagatagagttttacagtgtggaagtgagatacactctctgctttaattggagaagggcctccaagctgcctctccagaaggcccagagaggtgtggaggataattgaaaccctccactctgatttatccaaaaatacactcccacatttaaagtcagctctttttgggatcagtcgtaatccttaatgctgacaccgcatggaaaatatataagcagaatgatgcccaagttatagaagttcctcttcctggattttgtcttcaattgtaactgtagttcctaccgtgtggttgtatgtgttgttagtttgtttttgttttgttttgtttgggaaaggtgacatttcatctccaatctaatgagtgagaaagatgcttattctgacaaattttcttcacaatatttcataggtgtgccaagctgacagattggttgactctgtactcttttattttattcctgtaactgggccagtttctgcccttaactaaaactggatcaattataggagtgaaataaaggtccatctcctgcctatttattactttgctttggtaataaatctatttttaaaagaacctattacagagacttccatttggaattatgcatacttggtgtcaaatggtgattgttctttgttgtgtttttccattcgaaacaaagcttttgtgaggcgtccctttattctgattaaggcctggtgtaaatctttgataatgaagcccattaacaaaaatgactataaatagctctacttctatcagggatattaaatactttctcaagcacacatgctcactgattttaagactcattccacagtgttccaagttgcgtgttagattttttttttcttgagacgaagttttgctctgttgcccaggttggagtgcagtagcgtgataacggctcactgcaacctcagtctcccaggtttaaacgattctcctgcctcagcctcccaaatagctgggattacaggcacatgccaccatgcctggctaatttttgtatttttagtagagatggggttttgccatgttggccatgcaggtcttgaactcctgacctcaggtgatctacccactttggcctcccaaagtgctgggattataggcatgagccaccgcgcccagccagtgttggattttatcattaccaaatagtcataaagagtgtgagcttattaatgatgctgaccattcaaagtgatcagcaatctctttgcacacacactatctctggggatgagtctatctatttccagtccatccatcttgttttggtcttgtaaatctactttattatcttatgcttttatattcatgttttgtttcagaacaataatcatagtagtatcatttattgatctgttaccagtgttttacatgtgctatttcacttggttctgttaggtagatattgtcttcattcatgtgaaatgagattgaagcccataaaggtgaagtaatgcacccaacatagaacccaaattaggattcaaaaacccaaatttgatgccctctaccacataaagaagctttatttcatagcagtagcaaaaccattatttgatcagttaataaaaaagatggttaaagtggagaaaaaactgatatatgcgtagtttaaacattttatttcaacttgaaacacgtaagttggacattcgtttaccaatgatctgatgtccagtcaagaccttttatttaagtatattttatttaagaagtttccagaatttggggtttagctttgtgtttttaaaaataaacaatacctatttgtaggcattgtctcactggtttgttatctgttaaaggcagtcagtaattaaagacacttgcaaaacaatctgattgtagaacttctaaatattttcgaagcttcctccccaatctttttgatttgtttcagacatacccataattcaatagcaatattgtagaaattcctttttattaagttcttacaaagcatgcatcgtaattttcataaagcaataatttttggaactcatttttattagataatctaagatttatttaaattatgtaattgcaatagcaactacaataggatcaaaaggtttgggataaacatacttgactcttgctgagcatataactttactagtgggagaagaatgtacacatattatagaatggctagtaagctacaagcttttaatgtatggtgggcatcagtcagcatttatagagaaaatggaaacattttcttaagtaaagtttcgctgagagagcttctactctgtttttcaagaaattaggggagagagagaatttactccttgtctgtgaagacatgggatttaagctatgtgtatcacaggacttgaaacagaaaaaaaaactctacagatgtttttattttacaaagttagttgggttaaatattgcccaaagtttctacctgaaccatcaagtttggttttcataaaaagcttttaatttgtgagaaaaatgttatttgaattctttcaattacatcttatcagattttggtgatgcttttgaattctcaaatgtttcaagttgcaattctctgttaagatttattacatcattatcaaaactttgtattaagaaaagagtatatctttctgaagtcccgtagtacatattgtttctgccattcatttgatgcttatatttctcatttgctaacatttataatcatctgttcttacgcaaagcagtatgtcttggtggagaggtagtggaaaaaaacaaaaaacacccatgaaataaatctgtactcaaagaattcagcttgcttaacttcccaactaagtgatactactttggggaaccataactgctttccttactccatcccttttgtttcacagtgccttgttcacagctcaattatttgaagtctttatagatctgtttctctcttttgttgtttctgctgtacacctggttgtctttgacattacttctgccagtctttgtggtcacaagtgacttgtggagcattttaaaccaagttcgaagcttgagttttgttgtaagtctcggcaataaaacccaggttataaatctgctgaaggtctcgttatttattattctgctcttacccttagagtattgctttttgaggtctcagatgactgtgaagagggctccctattggactgtgcaccttgtgtggacattgaccttcgatatctgccttcttgcctggaacttttcaaaataaaagctcaagtttgcagggaaatgcacttaggaaacaaaagcaatttccctgcttgcttatctttcagtggttccattttccttcagttttgcctagcaattccttattatcattccagctgtttgttgcttttaagaagttatttatattttatccagtatttctagtttgtttcagcagtagtgtttgtctgaatacctggctcctattagctggaaacacatgctgttcatacaggtgcttagtgttttggttgttgatgtgatttagaagtgatataaagaccatgtcacacaaaaaagctcaaacatgctttacctctgaaaatgtggtttctaaagaagattttatttaattttatacttaggtttccatatttatggaatatgagtttgcacgagtgggcataaaatgaaaagtgctggtcatgctgttattagtccgttctcatactgctaataaatatataccagagactgggtaatttataaaggaaagggagatttaatggactcacagttccaaatagctggggaggcctcacaatcatggtggaaggcgaaggaggagcaaaggcacatcttacctggccgcaggcaagagagtgtgtgcaggggaactgccctttataaaatcatgggatcttgtgagtcttactcactatcatgagaacagcatgggagaaacctaccccatgattcaattacttcccactgggtccctcccatgacacgtggggattatgggagctacaattcaagatgagatttgggtggtcaaaccgtatctcatgcctaaagcaagaaacaaggaatccctagcaatagattttatttgcagtttagttaaacaacaggtgcaagcatatcttatgtctgttggtaaagaagtgaaaatggatcacagaagctctttcagagggaaaaaaagagttaaatatgatagcatccagaagcattaataatccagatgtttacaacttcataaaaattgccaagtacgcatggatacaatagtcattttcaccaggtgaaaaatgaccagatggtagcacttcaattctctggtgccaacaatgcagccacagggggattgttttttgagtggctgtgctattgaaacatgttttataagtattctatatttatcgtagtatctgctgcacaggactttactagccatagaattggttgttggaattgctgaaagtgtttatgtttgtgttttaacaataagggctttgggttgggaaactggagacctgacactttatcagtgatttcatgtttgatctatagttgatttggatgtgctctaatattacattttgccatttttctattgttaattttgaaaaataagaaaatatttttgctaattatttactggccaagcatactgaattcatggtctataaaaagtacagaataatagcccagtcatttaaaatcacatttacaggcttttaagcattattaatttatatgtaaatacaaaattattttgtgaaaatttaagatacacatggcttaaatttagagtcacataaagaataacaattaaaaatagttctgtcccaattaggagaaatcaatctttttcttttgcaaatagtctaattaaaatattctatcaaaggtttatccaaatgacacatctagttgacactgtataaatgtaaaacttacaggtattgatcaaacttaccaataaaattgtttcccttgagatgctaaagctgttaacatataatttctgagtaaaaatataattactaaagaaaacaacaaatttcttcatggataaaggcacgacataaatgagcacacaaaagcatcctcagtgaccttgagggttaagaggcttgagattgaattttcacattttaaccacaattcagtgcttttcatttgaccaaagtaaaagggctaagaaatatacccagagcttttataaaaagctgttacaaaccaaaaggggaagttatatgtgttttaaaacacggcaataaatagaggagttagatattaactgtagtgttccaatcctttaatagactatgaggatttcttatccaaaatcagtatattttttggaaaaaaaaccttgtgagcaatagaataaaatatcatttatgagaagaaagcagccctgagaagccatttgaagatattagtttcaaacttgggctaagcatttgaagattttgaagcagctttctatcaagatgtgaatattagtaattgcagtcactgtagattatacaaagtgactgaggtgttccaggaaggctgaaaagaaacacttctatggctggattttcatatccatgaggacaagggttttgtcatttttgttaccagatccccagtgcttcctggctggctcatagtaggcctttagtaactgtgtttgataagaagatacaaccataaaaagaagctgtgtatgctaataagatggggacaataagaaagtttttattttaaataaaggatattttaaaaggataattttaagttcaatccctaggctttcagtttaagatactattatagtaaattaaaagaatgattttaacatcctggggcttttctgattctggaataaatttctttattttctgtcaaagagagcacacaaaatacatttgtttaggaagttctagtgaggggattttttcatcagaagagttttcacaactagcaaatccagcctgtttacacaggcagactccacaagctgggctgttgcacactcatctttgtccatttgggaatgagtgattgaggctggagtggggttgggaggatgcagggggagacagaatgtgtatggaaatgtcttttgcttctgaactgtggctttttcagtgttcccttctctgtacctttcccttccctctgcccactgcagtgtggctgctgcctgtaatccccagacttcctctgtcataataaagggaggtctgtggtgacagaatggtcactatttatgacctacactttctgcagctctatcttctttatgtcaaggggtgtcccgagggtagcttttcattccttgtctgttggccattgttactagctagaaattttctgtgaaacttcagaagtgttatgagcttgagaggcatacacttggggggtcttgagactgcttctacatctccttctcagcctatgaaaaccgcctgttttgatttggagctggagtgtccttgtttcctttcctcaggcaggagtagaaggaagatatcctttgggcattctcattttagccaaatcatctccttgtggaaacattcttatcacaagaaagtaggatctattatattatgagcaagcttttcttggtaattttgcattatcaaattggcttttgggtttggcttcaggtaaaacaaattgagagtgctatgccattggactcacttactcagtttgcttttccttacctcgatcactcattagtcccaaaaaacagaggaagcctcaactatggattaacaccatgaacttgattagaataatgaactcttggcacatagttcaaacatagttcaagtgagcacattcttttttttttttccctgattaggtgatgttttaactgtctttgtagtgcatctgcttctctttccacttagcacccataccacatttgtggtagagtgacgatatatgctgttcaattgcatagctgcttctcctgggcagggctagggaaagtgaagggggagattaagttgcatgtggctagctcagttgttattaaacgctgcctgactgatgcctgatgtctgcagaggattttctttggaatttgatcaatggagtgctggacagtgaggacagcaaatggccattttatctcctgtctttaaaataaaatatgccctctctgaaggacagtctatgctggctctcaagtttaaatgtgaacggacagtgtgctccttacctttgaaggcagacacaagtttatcccattgatggtcatgatgctttgtggaaggaatcagcttttgttacgagctcaaaattcagccagaattatatctctgctggaggtttgatgggaagagccttttaatgtggtgcatgcatcatttcaatggctgtgagctcctggaattggaacctggtgccttgtctgtgcagaggtcagctggtgagtatgagctactctctttcctcagagaactgataccaattattttccattcaaatagaaatcatagttaagtttgagcaacacaagtatacaagaaggaaagattttaaaaacatcaatttctcatcagcttactactgaataagctagttataaagaggcaaagttaccactctgtgtaggaatgtctaatctgcctagctttcttaaaaggattatgtgctactatctcctatgggagcaatctgttccttaattaaggaaaagagaaataaaaatcacacactacgaatggacttgtgatgagtttattttgtttacaaatatttatactaattgtctgggatttcctgttttgtgatttgaatagtaagagccctcaatgagggctttttgagtgggttccttttccgaggtgagttgatttaagagccctgaaccttggccctcctgcccttgagagccatcccaaggaaagatacctggaaaaaattatttggcttctagtgtcctcatctataaaaacatggtgactctgcttctctgtcacacttaaagatattatgagaaaatgtaagcaaagtagtgtaattatgattcttaaagatgtggcaatcacagtgctttgtgcaatgcgtatgtcggtcaatctaacatctaacaaactatcacctggttcattaccttttctttatgagacaaagataaaaagagctgtcatacttgtttatagaaagtaaaagagtcttagagactaagactctgttaaccatccctaaatttttttttacttattaagttgaagtttaaaaaatgtgtaaaaatgtataattttcctggcattagaaaacaacataatgaaattaataactgtttgattttacaagagagtctatattgagctcattaaaagccaatgaaataaaaggttttttttgacaacaggaactcctcactttcttctctatctgtgctgatgatttttcactttcttaatgaggtttctagaagaggagaggatattttgatagtgtatcagcagattctaaaggggcagtggaaaggtcttgtgccagaagaagctggagtcaccctcacaacaggaaaaccattgcaggaggcttagccacatttccttgggactcatgctattaagctaaatggacatccaccaatcaagtaagacttgcttgttgcgaacatttttttaaaagtagaaggaaagaaaatgccagatggcattcagaacaccctgtgctctagtcttgctgctttccctgaaccaccttctttcctaatgactgctttgacaccacaacagctgattctccagagtacttcagaggacaaaatgtttgaggtatgctatgtcaagtggtagacggtgactcccctggccaaggagatagaagaatcctccccacatccacacattatctttgcagaaagcctgaatgactatgtgtatttctctgtaaatatgtaaaaggtttttcagacaagggagtttgaagggcttagatactaatgaagctgatttgtttttatttttgtttttttggaacatgaattttcagctgttcagatcagagaaagctaatgctccccatatatgataaaaactgctcccttctctcccttcctctaccctctgtaagttgactgaccatcatatcaacaatacaacactgatccatgccatggtgattactgttttctttgactttcgaatcagattaagtgctaggttctctgtactactgtggaatgcattttgcttgcttatgggatattttattaatcttagtgctttcaactcagtttaggtaaaaggaaaaatgataaattatgttatataaactataacatgtaccatccacattagtattttccctcctagaagagttgctctcttactatctttatgtagtgcaagaaatgagactttacgttcttcatttatggaagcagatatgtcataagggttaggatacaaaaacatatcattttctaggagagcatttttaatgttattttactcttttcctaacaatagcatatatgtagactcagattatattgttttactatcaatgattataatagtgaaaacccttctcctaaaatgcaacagttgtgtgtattgggaaggaacgtccatagtcctctatatacaatatagtggtatgattctgtctccagctaagaatgaataactaagaagtgagtgccatccttggcatcctattagacctcgataaaactatggcagtataggtaattggaatactatagagaacttcatcttcttgagttaacagcttgtatcctctttcctctttcattgagcctccctattgggtgtatatacagcaacattcagaaatactaatcctgctttacttcatcacattgcttttcaagtaaatttgcatttaacaaaagcctttgataattaataatgagtacctatgtgccctctttgagtgataaagagtggcttgggtggtgcctgctttcctctttcccattctctatccctgccttcctctccctcttttgagctccccgctctttctcccaggaaaacctcgctgagcccagattatattgtttgttcactgacagctcttttctatgcttaatgcagctccctaattcagcctcacgtggatctgtaaatggtacagtgaggacccggctacttctagcccttcccagacctgctcacccctgtattgccacggcagtggcaagtaactccaactgtgctcctcttctcccaaaacagcaacgtcgattctttactttaaatgaaccttggagaaggaaagggctgtgagatgaaaaaggcaggaattcatgtcatgtgctacagcagagcagccgtagcaacggcagtaacagcagtagcacggcagcagcagcagcagcagcagcagagtcctttagcgagactgcaccattttcttctcaccctgcatagaggtgtggttggaagcagcaataaactacccaccccctagcagtttcacagaggtggcctcttcctggctccagtcagaagacacagtctgtctggaggagtccccaaagactgttccaattggtgatgtgtgtctaaggatggctttttcaactagtaggatgcttctctgcacttgcagccacccaactgctgaagagctggaagtctagtgctccgccttcccccgggaccatttctgagtgtgggtgcacacctatgcctgtgtgcgtgcaggtgtgtgctgctggaggtctcggtttgggaccttagttcattgtagtgagttgtgggtgctgcagaggctggagcaagattatgacctagctcgggggcggagtggattatcttgtgagtgttctggctgccagccattgccctggtggggaaaatcacatctccatagagctctgaaatcacctggattgctggggagtggaaactgatcctctgctactgcttctgctgatttcctctgcaaaatggctcacgctgctgcttctattaaaaaagttcgagaggctgatctggatgaaaaggaaaaaaatcttgagagagacagaaaaaaacaacggaaaatccccagagaacgtatggaacgaaaaagaaaggtatgaggagcatccttttaaccctctttctctgcagctctgtgtagcaccatcagcctcagaactggcaacttcatcctcccttccttccatcattcccctgcaccatttctaagctcagtttgcagcctagagctcatgcctacatttgctgcattgggaggagatgcttgagcagggtgaatttcctttgctttgaccaagcaaggcaaaaatgcctccacttcatttttctttttttttgtctcaattatctttatttaatctcaaagctaggtgctttatctcttcaggctactcttagtactgggcacagaagaaggaaggggttgatttacggttggagggttaaagtattttcttcttcttgttcctcatctctattactctatctttagcagtgtgtcttctcactgactgtatatttgatgtagacctctagttaagaataaactaaagattttatgtgctctctttttccctcctggaggtttacacccggttttcacttcttagtgaagctgcactaagaatattggtgcagtgagctgtgtctctgcatttttaaaattttaattaatttttttgttttctatcattaatcctttaattttcttttctgaatatggcaatgaaatcaaaacaaccaaggttaaacaagggatgaaatgttgattccttttacattgaactattgtttctttctcttaaaatattgttttcctttataatagaaataatcttacaacttgatggaactgaaatactcatttagtcagtgatctagatctataaagaaagacctctgtaaatgttttaattaacaaagtaggtcactgaataatttcagaagatgataaatggcttattacattagcagagcattaaaatagtggtttgtacacaagctgttgttaaacatagctctgggattagggatgcaatggggatccatatacttaataatccatatgctcaatggactctttttttcttccataatagatatgtttacctttcaatttgggggatgttgtctttgcctcacttttggaaagacacttgagaaccaacattgagttgagatcttactgcatagggattcattgcatttcagtttactacttatctcaccaccaactagatcaaatgactgttactaggctacagaaataaaattagcagtatataatgatttcccttctggggaaaactttcatactgcttgtctgacctttaaaaggccgtgttgtttcaagattgcattaattcttttttttagtatcaaaagtattattagccattttgtggaggtcgacttccttcttgacagcgactgcagttctgtttctaatgctctaaatggaacattattgtataaagaattttctgtgattatatcttttttatcttttgttctccaaaacacagtatatgatttcttggctagcggcccttgtcagcattcagctgtgacctagcaactttgcttagctagagtaccatgcatacacctggaaaatcacttgttctcactctggtttgtttctgtatctagttgaatgtttttccctttccaaaccttgataaaaacagaaaaactgaaaaactgtactgttaaaataaaaggtgccagttgttgttgagaatctcagttgcttggatgcttcattgctttagcttgaatccagaaccataggcaagattattggttagtaatgtggtcatatgacaggatcatctggtcttcacatgtagatattatatctaagctagaaccagagtaaattaggaaaataaaggcatagctagtatttgtccttgttcctcttttttcatgtgcacctattgctcctcctcccttttctactgcagatatttacacagcacaacaaacttgctaaaagagtgggtgtgctttttagctatattatatttattttctagatagacagtccctcccccaaccccaccacacacacataagcactgaaccagttttcaattttcttttgaaaaaaagaaatttacctcatcatcataccttaaggtgtacatcataccttaaggtgtacataccttcatgatagttcatgaagaaatgaaaaaaaaatggtagcctattagtggcattctggaataccatctgcagaaagtaattttaaaattatcatcgtttatttgctgatgccactttatcatcataagggaaagcatcagttgtagagatgattgagtatatcattttcatatccatttgtagtgcctcttactaatgaaactgtttatttgaaaaattcagatgagatccaccccaatgcagataaaagccaattatggggcttgaaagaaaataaataagctgattttgaaggatttttaccaaggtaaagatattgcacattaaaatcaattaagcagtcacatttaatctttattttaatattcttttgtaaacttactgttaattaaaagaatatttgtattattattttgtactccttaaaacatttaaaattaattttaattatttgtaaacttgaaacatgttgcatacttgactataacccctctaccaagttgccagtggtgttgtattaaaacaatatatactaagagatctactttcaacctcattataagcagaacttatcttactataatatgttcagatttctttgggctatactctggttagctaatatttaaatatggtatagtaccgaatatctattgtatgtgtcatactatgtagagctaaaataaaactaagctttaaacaaataggcaaagattaagatgagttaaactaatttagtatgtttgctgaagagttcattaatctggaattttacaaaaatcagaatatctctattctaattattagcttatattagcaagtaatttctttgtatgtccagattttgccagtttttatgttggaatctgagaattttagaattgaggaggatgccaacaaaaaatggttaagtgatttatcagcgttttcacaaatttgcgagacttagttctaaaaagtgatttgaagttgaatattctttccacaactagatactatttcccaactgtacgttttttaaaatttgaaaaatacataatttttagagaatgagtaaacaaatttattcttgaaagtaaaacatatatttattttatttattttaaaactttattataagttcaggggtacatgttcaggatgtgcaggtttgttacacaggtaaatgtgtatcatgggggtttgctgtgcagattatttcatcacccaggtgttaagcctggtaccaattggtgatttttcctgatcctgtccctcctcccaacctgcatcctccaataagccccagtgtgttgttcccctcaatgtgtccatgtgttctcatcatttagttcacacttataagtaagaacataaagtatatatttaaataatatttatcacttaaattcaggatcaccataaattttcaaataaatcaatatgttcaccatttctcagcacagacaaactattgtccaatcaatcataatgtctacaatactcactggaatcatatgacttaaaaggcaaatgtatgactagttcttaacatcctgatgcttaaaacattctttttattattttaatttatactattaaaatgccagagttcacattttctgaaaaaatatttgtgatcatttattaagtacccatgtggtcatgtatctgacactttacacacatcgtgctgttaaccatgataacaatcctatatattaggtattattctctggatttcacaaacaaggaaattgcttaatcacacacaagtagcatgtggcagagttgggatttgaatccaggtctgtctggctctaaagttcattggagaaaaaaagtaatattatttcttggtcttgtacctacactgggtgtagattataaggaaatcacttattccaccaatgcttcaatttcttcacttctaaattaccttcctacagctgaaagaaatttaaatactgtgatagtaaattaaatgatgaatttgagggggaaattatgtaaattcgtgttgggattctatcaaaattgcaccaaaatatttcatgagatttcttggaaaatcaactattagaagtcaacatttgctcttcaaattgaggtcaattactggcaattatagactatgatatataatcattttttgtcacaattttattaggacttcaagatgtatttgcaaatctacttttattaaactgataggtgattttgcatgggattaagtagaaaattaaaaaaaagcctccttttgagttgttttcatttaatttcacagtaaaaggttctgattagttatttgcttttaaaaatgtacacagttattatcttggtgagaacaagacttatttctaggataggctttggggaaatctccccccccaccacattcttcttgttcatttgcttatttaattgatagcaatgataatacttattgagtatatataataaagttctcatcaagttgtaacgggacatggagcaatgaagatttttagaagttatattagtattttttcttaatttaaagtgttttatttgcaagttgagagtggaatgtattctataactttggaattgtgttataagaatgagttgaaagtgaattgtgttataagaatgagttgaaagtgtgttataagaatgagttgaaagttgtgttataagaatgagttgaaagtgaaacatagtgtaaaactgagcatgctttccctggtggtctgtgggtaaagactgcagtgtaggaggagattggacagcctagtcatccctctcatttttgagccttctgcttgggcactcagcagcctgtttctgaagggaagtccaactacggaagttgcaacacttagtcaagaaccatgtatgcacaaagatgtctggacaccaaaccaaatacactgtgattaaaaatacaagtcacagccagaataacatggcactgtataatgtgttacattctagaactctacaaacatgggaaatctgagtcaacagtttttaaaacctgcatggaattgtctttatgttaacttcccagaaccccttcatcagtatgtcagtatttccagaaaccacattaacataaagttgattggtgctgtcttgagttttatctggacagatgctcttcttatgtcttagtgtctacttatatgtgaaaattcaaaagttttattggtttgctcttcccattttgagtctaaataaaaatgttcagccatatctatttaaatgtggtagtttccatagaatcattattattatttaaaacccattatctttttctttatcactcctctgatttctcttcttagctcagttcacaaatcctttcttggctagaatcattatctttaaataaatgacttgcattattaatgacactcttcaccagcaccataaagctgagtttttattataaataaatttatatatttattaattataaagaacttcttttgaccattgcatgggtgactaatagcttaggtttacagctgtcaaatttgtgcaattgtggcaaaaatagtcccaattgtatggcttgaggtaagttttaagaagacagttgaaagaaaaagaaaattttaattgaaaaaagctactatgagggattgacttatttttggaatctaaaatcttatacacactcaatgtaatttttttcctattttattacattaatctgtgtttatataaatgttttaatctttaaaaaatcagaattaattctttcgttacctttattatcaaacttaattttattagtccccttattcaccaattgattaaaaataatgatatttacactatattttgacatcatcatgaatacagaaaatattttatagaaagatttaagagtcagtgaaagtacaagcaagttaagacttctactcatgccatatttaatgatctacttgtgtttatatttttccattatgccactcttttttatttgtatttctcaaaataatttcttctttacaatagtctcagtcacagagacattatatactaaaataaagtgtaaagaagacttttctcaaattctggatttctgcataaattgctagtgaagtcatcagctatttgagtgtgacccttttgctccaaaggtgagctgtgattttaaatgtttattgtggaaagtctcaacagaatcatctggttctatcccattcataataagtcagaatcctggggtagactggaagggaaaagagaccataatccatatatttttaaagctcccttggtgattccaaccagggttggaaatgactagaataaacatttccattcccccaccaacccctactctactccatcttgaaatttcaagcgatcgtagatttacttctaataatcagtatgactctaattttttcatgtgtagataggagacaccctggcaactttctgaaagtttaataagactaattggtttatgtaataaccaattaattctgagcacagaaaggaggaaacaagtgtttaagagataagttgcaagacttcatgatctgcagtttgactaactttgccctaatggaataatcttcaggaaataaggttgtgtgtaaatgacttttatgtaactaagctcaaacaggtggagaagttatccaagctaagtttttaaaggaagaccactacattgtgaatttaaaattatgtcttaaacacgttatgctgttttgaaagaactcaagttagtgtcctagggatttaattggtagcttagcagccttggaggcctcaaacctttggagaggtcagcacttctaggactcctaacacaagtcaacaactaccttttgtgttttgtacttgactttgatagatcttttcaaaattatgtaatatgacattaatttagtaagaaagaaggaataagtaattcatagatgagttatctcccctaattcttcagatattctctttcaatactcctaactcttcaacttctcacagtgccaggatcttttgtttggttggttggtcagttgttctgtttctgtttttgtttttttcatgaaactgctctctcactgtctttctggttcaccacagtttccagagcagtcagaaagggattccttactcagttgtacaggattctgaaatgtactttttagcatgtacagttggaattccttcttccatgttcctttacttcattagcaactttgccagggaaaactcttttttctctcattagagtttcatttatatccaacttagcctttttctagagaaattatttcattgtatatcattattatgttgcttatcataggggaacacctcaacagaaaacaatgtaagtagtattaaggaagagaatatgtgggctgggtgtggtggctcatgtctgtaatcccagcactttgggaggctgagacgtgaggagagcttgaagccaggagttgaagaccaggccaggcagcatagagagatccccatctcttttaaaaaaaaatcagagatatgacaatcattataaacatgtatcttaatctaatcaatttatttggttaagactaatggtgttatttcacattaacctatatttcttggctttttatatatttttgcatagagacttattaattaccaattttaactcacttgtttatagtttgtctgtaaaaaaagccttcaattaagactgaaaatgacctctctttgtgtatttgaatgtaattaatgatggtttttccaaaagtctattttttagcgaaaaaacttaatctctatgttattttttcataaataaataatgttaacctcacaaacatgaattctaataatctactttacttttattattataaagatcaaatatgatttttgcgtttgaaacaaagtttagccgataaccctttcaagacattcagcaggataagaggtggatgtgaaatctaagattataaaaaacaggcaacataccagaaagctgtttactaagttaataaagtatatttatacaaaattaccagatacttctaaagctccataaaaacaaattcaggagacctctgcttaattctgtctactcactacaaccttgggtaaacaaatgacctcagtttttgcatctataaaatgataaggatctgagatctgttagaattcttcctgtctttatgcttctgtgtcattttaattgtttctttgcttccctttattattataaatgattaagacagttggtagaatttccaggtttttcttcatttaagataaattttttttgagctgacactatgtcgtagacagagtacctttacccaaggagctcatagacctccttgggtgataggaacttttcacagataataagaatgaaatgttagttgtgccactatgttagaattgagattgtctatttttgtttatatgacgcaagttttctttaataggtgttacctgggagatgaaataatggaaggaaatagttcctgttgtggtgcatgaaattttatggaagttattaagactgggtatatacaaaatgaagtaatcatataaagctctatggttgttttgtatttcagatactgatttgagccattttgaaggaagaaatttattgtggttccctgagaaccacagttgatttctcctgaagtttattctcacttttcttttaggtactctgtacactgataataccaggagttagaaattcacagagaaatatcatcattgtttaattaatcattttacaaagatctgatggcagtaatgatagctgcctttaaattgcagggtgctgtaataaacaaaagtccacagtaaacgcttaaacctcagcaattcacaaacctttcaattgtacagcttagtgaaaataaatctcctgagttcttctacaggtagtagtacaaacttccttatttatggctcctgcctcaaactgggccagaatgcttaattaaaccatgtcacatcctaaaatgactgaaaccaataaaatgtaagtggaacaggttacctggaaacagtaacttctttgaggacagaggttacttaggaaatgagctttcgttcagggtggtcacctacaaaacatggggcttcactgtgggctccgagggacaggaatcaaagcctgggtgtgggtgggagagagaaaagccatctgtgaaatcacacgtttccattactggggagaagggagacaacaaaggacccagtagcagatgccaattctctgactacaaacacattatcgaatataagggcccttgtatataacatcaagcactcatactcagtctttcaacacaagggacaatattttagaactttcagctttcatactagaaaagagaaccaaaatataaaataagactttgtaatatgctaatatgacaaatattttgccattgaaggaaacttgatgattaagactaattcccattaatcactgtaattggccttcacatgagggccttctgggttatgtattctttagtaagttgtataagagcatctgaaacaatttagtcactccaatgatctttaaaagtttgtaaaactttatttttgatcaagaaattcagagaatgatgcttcttagttttaatcacattttcacttacaatcaaacagaagctcttttaaattatgcttgttttatttatcttctttcatgtcttagaaaaacatttgccatgcttcacttttccatcaagcatcctccctatttccaaagtcggttcagatgtatataatatatataattcagggtattgcagtcccttggatggaagaattatttgttgaataactgctatgagccaaattttaaattgagagataaagattatttactgagtaaaaaaatattttctctcaagtaacttcccttttagatagatatttaaggtcaatggcaatggaaaaattagagtacagagctagattaggtatcataacttttaaattttctttctttttttgtttttttttttaatacatagtagatgtgtatatttacagggtacatgagatgtttttatacaggcatgtaatatgaaatagctggttgcttttaagagagattgtggacttgaggataggtaggtggtagggttggcttaggtggagagggtacctcagaggttgaacatagaagctggtgaacagcttggcatgatcaaagtggaaggaaggggttggaaataaagttggagcacttacagagcaaagaagtagctgaactcagtgaagcaaaaaataagcaggtatggaaggttcctgtgatgaagaaagactatgagggggaagtgaagtgtcaaggtcacccagaagactgttatggtaatccaagagagatgaacagggcttggattggaatggtcataccagaagagcagcagggaggaaaacaggatggttatcagcactcaactaggaataaagaaaaaagagaagagtgaataaaaataactttaaagttatatatttcaatgatattaaaaaatgcttgtcatcaacagaaatacaaatttcatgtgcaagtcagaaggaaagtaaaaacacattgctttatatgtggtaagtttgaagtggtggcaggatgatgtttattttcattaattgcagagactttatatgtaaaaagccaataaataaaaatgtgatctttctctttgggtatagtaggaagagaatgaagtttagagtttggagtccttaattcaaatcttagctctaccaaattctggatgtctgatccctggcctcagttgtctcatctgtaaactgagttaataatgataattatttttaaatgcacacgtatacgaaacagagtaattctaaggattaaaatgaaatgatgcttttgaaagcacttatgtgcatagtaatattacttattatatcaccatagtccccctttttatgtgagaggacaaaaggaaatatgcttagtaaaatgattaaaaatgtccatgaaaatatcatatgaactcgttgttatttatttattttttttatgagacgaagtctcactctgtcaccagggctggagtgcagtggcgcgatctcggctcactgcaacctctggctcctgggttaaagcgattctcctgccttagcctcccgagtagctgggattacaggcacctgccactacgcccagctaattttttgtatttttagtagagatggggtttcaccgtattggccaggctggtctggaactcctgaccttgtgattcgtccacctcggcttcccaaagtgctgggattacaggcgtgagccaccggaactcgttgtttttaatatatacacagatagatataaaaacaaatacgtagagttgtacgttgtgtgtatacagacatgtatttcctacctcccttcacttagagggcctagaagcaaggatacttcagtagcaatgagcaaacctagcctgcatcttggtttccaaacataattttccaacagaagaaaatataacttcttgggaaaatggctgatttgagtaagaacaggctcggaaaatgatggggcatatcaacctgaagcagctcccaatgactgaatacacagaaatctgagcaacaaaataactaataaaaacaaataataactcatagaataaaagaaatagcccggggtctttactaatagaaataaataattgaataaacaagtaaataagtggaggagaagggacagatttttttatagtagaattccagtgaacaaatctagaagaaatatggaaattataactagtacaaaggcaatcagcaatctagcttgtgtttaactatcaaaaattgtattagcaaattgttttcaactatagaattctgtaaaaattaacccattgtgtttaagtcatcatagagggaaaaagttgagacacaattgctttgtataacttggaatgacttttgctggctattgaactcccagatgtatttagaaaaaaagattatgttatgaaattgccatttttaggtgtttattctaaagataaaatggaattacaagtgcaaaacagaatttttgtttgtttgttttaaacgtatgactgcaagttttacataaattattatttgagtaaatagcacatgcaaggagctgctatatagtacattaaatgatataaccaaaataccagaaaactattttgttcatagtaccatttttcaaatatctgaagttggtctttattaaccatatgtctgcatgatactgaacattgtacttttgagatatatgatattggcattgatgtaatgcatttcttattttactattttattcttgattcctctttgagtaaaataaacttaaaagacccttttttgaggtaatgagtggaagtagatttttaaaaatttgttggtgatattaactacatgatgttgaaaataacaattacaactgacattcattgaccactttctatctcccttctgttttgtgaaattataactttatttagtttgaattacttagataactgtctcttcttccacttctttttgcaactaagacatgccataaatctgtgcaggtatctgtataatatgctgtttctgtttcagtgttaataatttataactgagacctatttccactttgaactagggttcagtaggatgaaaactaactttgtcttttatttatcacacttgattgtctaataatttccataagcagcagttgctctccacatacagatagaaccctacacctaacgaatctctcccttggtccctcctaaaaaggcactccatttctcattttcattaactttgctacagcatggccaaactcagtaaaatttttttttctgttttctttgtctttaatattgtctttaatatttcacctgtctgtttcaatttatcttggtaaaatatttagatatataatatctgttcacttttgaaactaaattttcagttttagtcaaatgtataatgatactgcaagttgagcaaactgtgatcaaagaccatgatagtacctgtattaatgttacatgcgtgttctttacatacctaagcagtatagtgacaactgagtgtgtttacctgggagaactttaggtattttccctaagcccatgtactttgaggttttaatgtgcaggatgagaacagcatccagccaggaacagcgtaatgccccgatgtcatgggatttgacaagcttgctctgcacctaataaccataggtttctatatcacatcatctttgcctaagacataatagatactctactgattctaaatatccaacactatttttgtgtcctaaacttaaacttcaaatttgtcacaagttaatctcctgaatcaaacctaggaagagaagtttccttaggcaacacatagattgtaccaatgcataaacagttatttgagaatgaaacagaaccagagctttgtgctattttcatttttataaattaacaaggaaattaaagatgttatgaaggatgagacaaaaaaatttctggaaaaatatttttgtcttcccttgtaccatttctatttaaatgttaatgcactgtgtttccatcttaaagtcaaacaaatgtttaaaaactgtaacagtttttaatgaatagttttattaactactaatcctcctgttttcaattcaaatttcctagtctttgtagagcttgaaactttcctctgggatgcatgaagtctactacttcaggctggcaatcctctctcataactcctatttgcactgttttcctttccccttcatctcaagccttgttcacactcagtgcctattggtggcatgtttagctgccctgaagcatagcctctgtaactttccttgttctctttcagtttgactttgatgaatgcaatgctcctgcaatgagaaaactgtacacaccagtgacccaggcatctgaattgtctgggaataggctgcattactgaaatttagggtctactccttgttagacatatcagtgttccaatgacttataaaacatttgatccctgatggctgtaggtttctcttgtttgaaagctgctaaaaagcctgcacatcattggaatgcaaaattaaaacaagaagtagaagtgtgaagctcatttagacttttaaaaactggtctaagtgattgtggcatgtcaaagtactttatacactcctaagtggagacaaacctgtgaaacagaacaccaaaggcacaattgtgttgcaacaagcagtatattgtaactgagtttaaagccccctaacattcctgcacactaaagcacagtagatttaaataggatctttgtgattccacatatcctaaagaagcagtttttctctgtgtgaaaccacatgcattttcatagaagattcagggataaaaacacatccgggcaagatataagagtgaaatgtatagacaaaaggattaagggctcaaaggcttttttcttctttttcccctttcctctttgagctgaattatcatttaatgccgtagactggataggtcaagagtttgactgaacagagtcataaagtcaactaggaaaatattttttaccatataaaagaaaaaatagaaaactattcagagatgtcacaagtatcagaccatatggtgtaatgccacttgattagaggtttattttttctaattagctcattttggagtagattatttgagaatactcatccttggaattgttatgatatgatgtatatgcacatatgtatatatgtggacatatttatctgtattctatatagatgtatttatcaaaatgcatttccgtttttatatgttttaataatgtctctcccttcacttttttctcctggagttttcaacatattgaagttacagtattgcagttttactatagtacatacttcaaatgtacttaagggaatgatcatttgaataaaatttgactaagggatagatccttttaataagtatgtgaaattgataggaaattttttagattaaaaagtactgaaatttaaggtatagaatcattccacagaactactttgtaccctggaactggaccccgtggcatgatggtagcttctcagccagacggagcccatgagatagatggctctgacaggaacatttgggatctgacattagatctgtgggtggggtgaagagaactgatctagagtagatcatactgggtcctacagggtatccaggcatgatatcacatagttgcttcatccacaatgtaggaaatagtcaacattggggttctcactccagcagggggatacagcaatggggaattccagcagccatctatacttgggaatcaaggaaaaaggggctgatcatttgttcttggccatcatgatactacctgctgatattgattatgggacaaagcttcagtattgggaaagaaaaatgttgtgatgattctaccttcggagctgtactattattatacttacaaacctcttcatggcagccctccagctggaaggatgcactagagttttggtcatccaggccaaattcagaagtaagagttaattctcttcactgacaccagcaagagaaaaatggagttatattttgagggcaacgtaattattggttgtttctagatatagttgaaagtataaggacttgttcctaaatggtaagataggagagcaggaacacttagttttctgaagatgacttcattatgagtcaacattagatggaagtcgaaaaaagtttgaccttttattctgaaattaaaggtgaatggagacagcaggtgagatgtatcaagggtcccaggcatgagaaactgatccagagaagaatgagagcatgtagactctatactcgactttttacaattgtttattatattatttaattctcacaatggggtagatattctaaatctcattttttaggggaagaaaattatgcttgaatattttgcttgaaaaagattttcccctcaaatttcatggcaaataaataccttaagtgacagaccccagatgccagattccaaatcccatgccttttcgctaaaccatgctatactaccacgtaatgtctgatttgtagtatttttaacttaaattttagggcagataataaacaaaccttagacccatctgattcaaaaagagaaaaaaataatggagttgaggaaaaataatcatagttagcttgctgtgcaatgctatatactggacactgtcctaagtacttaagatgcactgacttatttaatcttttcagcaacaccatgaggtagaaatgattataactcccttttgtccaatggaaaaagtgaggtttaagaaggaaggaagaggtaagaccccagatgacttgaatctgtgcttctccaactgaccttataatgctataaagaagagtagctgggatgaaaaatatatatcaccaagttacacaaaaatatttctaacctttcaaggaacagacaaacaaaatagcagggggagtctctgaagaattatgatgtgatttacactacagcaaggtccctaataataagattacaggaagaaggacagaagagctagagttatcaagtgctgaaaccatctatactactagcacctccaatgatcaaaatagcatcaaggccgatttctaagtcttggatgtcatcaacaggaatctcttgttagagtagaagagaggtgaggtaggttctggcccaaagtatcatatgactggctagtttggagttagtttattaaactgcaatggaagtagctctaaaatttcctgaaagttgtcttttttttttttttttttttttttctcactgcaaccacagagagaacccaaggacaaaattcaaagtaaaatgaaaaaggagggctactgaggtattactcacaacaaatacgaaaagttggggagtgcatagagatctctgaatgcctcttgtgctctgctgaacaatgaggccaaggatctggaagacatctttataccataggaaaattgatccccccttatcttagtatggaataataataaactgaactatgttctccttgttccagagcaaggacaaaaaaactaccttctaccttatcagagatgtttttttaacacttgatctccaggtcagctaaaatcaaatgttattaaaatagaaaaggcatatttcagtaaaattgacattttaaaatgtcagtggttaatgaaagccatagtctcttttattgataattctttttttaggaagaatttaggacaaaattaaactgtcatgacatacttcttggtctactaaatattatatgacctttgtatttagtaaaacttgacaaaatcagattagaactttgccatgtagtttaagttatcaaaatatgaagtcagatcaattttatgaccatagaaacttaaaaattggaaattctaattttagacattagaagtggcatgactaaagttttatggtgtccatttcttcaggatgcacaattactacagttagcatatatctgaattactgatgtttcacagtggcaaagaatggagagctccacctgggtatttgaatgggttgttggtcatgaacacaagtagaaaatgcacatctttctgtgagtatttattgtaggctgataactgtggggtgtttttgcatttacaagatgccatattattggtggctgttgtctctaaaaggttagcatttgctttgaaggtaagacatgttagaagtaaagatacctatgaaaaataaagaaaaactgtggagagaggagcagcaagtgagtgtcatagattaaaggtaattaaagtaaagtgatggccacacagaggtgacagctgtaaggaggattagatatcacggtcaggcagggatctagtgatggatccatcactggaaaaggggaaccaataatgaaagaatgcagagaagctctacaggtggaaagagtggaatgaaaggagcttttcactacatgtaataccgtagaggcaaatgatggccaaaccatagagctgtgtgtgtctctctgtgtgtgtgtgtgtgtgtgtgtgtagacatttatgataagagtaatccttctggacctctagagaacaataattatatttccctgacattagcaatgattactctccatatgtttatagtgacactgatggatatcctgaaatatccatgatgtgatcaacagtcttactcttacctcatgaaccatcttgtggttcatggctactgatgcttttgtggccattggcatttttgttcttttcattcctcctcatgttcagatggccaccaacagatttggtgcctggaccaaaatcaaacatctgaaaatataattatacaagaactgacagaatagtaatgtgaccaaaacaaaatcatttttaatggtaattggataaatgactgcagattgctattctcggagattcattaaagcatttctgtgagtacatcagtaataatatgcatttgtctctttttatttaaatgttgtgtttgggcctgcgtatagtgctgaatgaatatttgtgagaagaatgaaataaatgtttgcataaaccactcatattttaagtatgtgaaggaagttttttttattgctcatttagtcagtaatcaattatgagtgcctgctatataggggcactatcaggagtactagggacaaacagacaaataaaatacagtgtctgttcataaaaagacaattaaaatacagggtaacaatcatcctgatggctctgtgtccacagcaggctcctaatcttgttggccaggcagggcttccaagaggagtcttgcagatgctgagagggagggaggtgatccaggggaatagttattaataaaagtccagaggaaatttcaagggagagaatgcaaagatgagattatgaaaactggaatacgctaggaatggtggttcgcacctgtaatcccagcacttgggaggaatgcttgagtccaggagtttgagaccatcctgggcaacatggcgaaaccctgtctctaccaaaaatacaaaaattagccaggtgtggtggtgcatgcttgtaatcccagctacttgggaggctgaggtggtagaatcgcttgagccgggggaggtggaggttgcaatgagcgccactgcactccagcttgggtggcagagccagaccctgtctcaaaacaaacaaataaacaaaaagcaaaaactggggaaagaaagatcagctcagataggagtccataccacattattaaggattttggctttttttttttttttgagacagtttcattctgtcacccaggctggagtgcagcagtacaatctcggcttactgcaacctccgcctcccgggttcaagtggattctcctgcctcagcctcttgagtagctggaattacaggtgcgtgccaccaggcctagctaatttttgtatttttagtagagacgaggtttcaccatgctggccaagctggtctcaaactcctgacctcaagtgatccacccgccttggcctctcaaagtgctgagattacaggctggccaggctggtctcaaactcctgacctcaggtgatccacccaccttggccccccaaagtgctgggattacatgtgtgagccactgcgcccgacctagattttcgcttttatcttgaagattatagggagttccttgaataggtctgagctttggaaagatctccttggctaaggcgcatgacaaatggattgaaacagagcaaagctagaaccagtaaactctttaggagacagttacagtaattcagtcaagaaataaatcactgacctaaaatagtggcaaagggatggaaaaaagtagactctgcaggactggatgtatgggaaaggtaatgtcaaacacttcaagattgtcagcttgggcagcaaggtgtatagggctgctggtcactgagccagagaagactgggccaggagcaggtttgagtagggcattggcttaggaaagcactgagcatgtttaaatactaaggaactggtagaaaaggaaaacattttttcttaaaaatattacttaataattgctcttaaagaagaaaacccttaatttttagagatatatctgcattttaaatcatatttatattcctttcttcttcctctttccttcttccttcttccttcctttcttatcttctggtagagaagattaattttatgtggacctaagtgtgatttataaacttctgactgtaaagattaaacacatataaacatcagcatgagtgtatttactatagcttatcattatacagatgacagcaccaaagttcaaaatgacagctgatagtgtccatctagaatttatttctagcagcatgtagctaatagcaatggagcttagaggacataagaccacattaacataattttcgaagaatgaaataacagcattgactttctaatatatttatgactgtatttctggagtttttgattgcttataaagtgattttgttttccaaacaaaagtagggcaagattgaaaacttgaaaataattctcccattttccagagagaacaaatgatacatattcagggtatttatttcagtatgaataatatatgaaggatcataaataattctttataccttgaagtgtatagatacatttactctaaagagatcctgaaataaaacccaagtgaatgaagttggacaatgaaattcaagttctttttggagctctaagttttccgtctttgaaataaaatgaatttagtctatgtatcattccataattgtagtgcaactgttcttgactaaatgcacactcatcatgctgtttaaagtaatcataataccatattttacagtaactctctgatgtcggtgcaacacaactggaagagcctagttgattctgtgtttcaacacagtacaagaaaatcagttatcctcataataaatcaggtttaattggtaattctaaaataaatactcatatatgctctagttgaaccagcatcagatatttagtttgaacttaggtttgttattgactgatgaatgcctggctgctgcctggaagtgtattttcaatgtctatgtctcttgcttaatttcaaatgtcatatgtgtgtattttgtagggaaagtaggattttaaaatattttgaaatcaatagattaaaatatttgagtataggattacacagaactgagctctgtgttacagttgaagaaatcttttggtaatgacaaatgtatcaaaacatttaaatccatgtgttgaagcccaaaaaagtttatgaagggttgttatttctctagaacctctagggtgagtatacaaactgaacatataaatatatgtagcttaatgcctgtgaactttcaaaggaaaacactggccaaatgctaatagaaataagtagtaggaaaggataaatgaatatttattttctacccttagtcatgaatagttcactggatctttgtgaactttgaatttgcttaatagtaagacattatttggggaggttgattataaatgatcattagtacaatactcccatttttcttgtctagatgctcaagcagtgtgtctaactaccatggcatgtgagtcctctttgatagatagataggtctggacaaccatggcgtgcaacatatagaacctagccaggcagctttctctccagcctaccatgaacagtcacacctcttctaagattgttgttcctgtgggcaccaaactttgcccattaactgatctattctcatgctatgcatcatttattttaaaatcaccttaactgagtacttttcagattatctcgatcagctggttgccagatggaaacttactacaagtgtttataaattatactctggcttaggcttcaaaaaatagctattacagccagattataatgaagcccccatcttgcttttttattttaatcacttgaccctctcttcaaaaaagctgtggggaagcccctgctttagtagttcatcagtttggggggattctgtacacacatatttgtcttcaaaataagtaggagtgcacagtgactaaattgttttattcacattgcatttcaaaatccagtccgatgtgatagaacatagaattagtcaaatggccctttaggcttgctttggccaccctacacttctgtcctcatagtctctttaatgtcagtcagcgacatttattgagtgcccactttgtgttgggcattgcgtggagtagccttcggaaagctatgcaagctgttagcactgtttattaaagaatgttgtcctttatgtaccagaagtcaagaggcagcagtgtggaatgaaaataatagctggaaggaatgtaaaattaaattggttaattgatgtttgtgggcacatgaatagcttggcaatattcattttgattaatctgtgtaaagcataaacagtaaaagtcatttatattgacctcaattagaaaaattatgccacaagtccatatagggaatttagtgtagatccataagttatgcaacagtttccctgattgatcagttataaacagggccaatttgtaaaaatcatgatgtgtttaacttttagtcaaataaattgtattgaatgtacccaaacacggaagaaaatagcatgctgccttgcttattgcacagaatgttccaattttctttccacaggtcagtaattcccaaagacaggagaacttgtccttggattcatgtgactatgtcggcatcgagaattctgcatgcaatagggataaccaaagattaatttaattagataaacgcatttgagtgaaacaatcggtcttgaattatagctgccatgatcaaaaacaaggagaagggcagacagtaatcgaagcagatttctaaattcagcaaaggtaacatagatcttacatattaatgatgatctgaaaaatataaagtattgactaaatatcacgttaggatagtttttttgcacatgatagtttagtttaagagaaactctacatgacctttttaaatttgtgtgatgttcttgaataatccttggatcttggaggagagaaaaaaatttaattcaatgactctgagtgaaacattctgatttgccactttaaagactcatggcaatttttttttcagtctttttaatatgatagcactagccctttaagaataaattaatcggccgggcccagtggctcacacttgtaaccctagcactttgggaggccgaggcaggtgtatcacttgaggtcaggagttcaagaccagcctaaccaacatggtgaaaccctgtctctactaaaaacacaaaattagccaggcgtggtggtgcacgcctgcagtccttgctacttgggaggctgaggcaggagaatcacttgaacccaggaggcggaggttgcaatgagccaaggttgcgccattgcactccagcctgggcgacaagagtgaaactccgtttaaaaaaaaaaaagcataaattaatcgaaacatttgaaggaaaataaaactagcttacacagttgatttgcaaagacttgtcttacaaagtcctataaagctgtcctgcaaagccagtttgggagagtaagaatgtttccaggcgacagttagtttacaattgtgacatgtaaaagatgtggcagggtgtaagtgaggctaatactcagcaaaggtggaataagagtgaaatggtcctcaccttgaaaaagagctcctggatattaacaaagagtctgtcatatgccacagtggtgttttcatcctccctgtgagtctgtcagggaaacactactgagcaaagccagcccagagagtgagaaaccatgtgattcctatcctttttttccccatgcaaatggactaaataggtgatcaccttcaactatggccttgtgttaggtgtgtgttcaaatgttacatattctgtgtcatagaagtgaaaaacttcagagctggaagggatccaacaaccatcgaatctaattttcttttttaaaaaacaggaaaatagaagctcagatttgataaaggttacaaaagtccacacagagaaattcatagtgggatcaaaacctgggattagtaaatcctaactaagaggtcttctcaaaacttcacttcaggagttgtgatctatccctttaggttaaattatagaactgagacagttatttcttctccaaggtgttagtttcctgatggttctgtaatcatgatttcttatttaaaaggtgaaatttaaaactgcagtgaatgatttttagatttgctgtcatagggacttcagcagcaactttcagaagattaaagctgagaggctagcctttgttctcagtccttaatcgcttttctcttatgatggatttgaaacacagcaatacaaatgaaataataacagtaaaagggcctgggaatttaagaagatattgcaaatatgtcacgtcatggaggctttgaatttcactttctaagtcatgtatcaaattcaagtaccctgctctaagtgtggtcaaacatgcaaatatttgctttctgagtaatttgccctaatgactttgaagcatttttgaaaaacagtggtgacattgttctgccctggcagaaagcatattccttgtcagatgtccacagagatcccgactgtctactggcagattattaaaggatggtgctgcattgtatttgctaagctttccttcagtttgacaaaatgttatgtatataggttgtcacatcacccaagcttctgtgccagacctgtctggcagccacccttggttaaccactggaagatagaactagaaacgttttaacttctgaaataaggtcctcttctacagaccccttacacttttattttttattagaaagtatctgatcgtcggcaaagtttgaagtgatcacacataggcagctgctcataggaaattctgttttcacagctatgatgttttccaggttccaggttggtaatttaaatctgttcagccagaaaataggaaatttcagccatcacagtagcaccaggtgtttgcatttgtctttccttggcctgtccctgtttggacactaagctttagcagtggggttcagggatcactacatggcatatttgggacagtgctaatcataggagtatggatattatattcaccaagcagaaagtttctttattggagaaagcatgagatgatttccccgagatgaagaaaaagaaagaggggggtagaagaaaacaaataactagttatttagggaaagtgtattccaacagttgtcagcatgttacttggttggttcatactctcagtggttttttcgttcttaacaaagcactgtaatttcttttctaggaaaatttaccccaaatggtgttaacctttttttcaaaggccaaaagggaggtttattgaaaatctggaaaagaaattaaatatttgtcacacttaaatatgtttaaaattattaaatctgtttctgttaatctgcaaaaaaaaaagacgtttaggtcagtgtagtccagttaaatattgatattatgaattgcgtccctatctgtggttgtcttttattcatttacctcacaaacatgtaatactagtgtgcatatttaggtatgggaggacattggtcagagaaaacaggtatatcttgtaaagagcgagagctgatagtagtcacaaccttattcaaaaagatattaacacaaaataagggactaatatcacaggtgtaatgaagacttgcaagagaaaggaaagctttaaaattaaaggcatggcggtggaatgggtattgtattaatgagacagaaagatgccaggaaacaattcgagctgttaaagcacagcaaaattattcatctagcacctaggggcatctcctgaatctgctgtggttaaatattccttttccatgtgtaagtacagagtttcagacctcagctccagaatgaagtgaggaggctagagataatttttaaggtttacaaccagtgttttaagtggacataattctattttgaagattctattgaatgtttttaaaatagtacactaattccaaaagtgtgcgtgggggagtgcatctctttcaatagctggaaaaatcttggttggcattctttgttttgggtttatattctgaataaaatagttcatatatgttcaagaagaagcacgtattataagactttgtggaccacagaccttctccaagttctaagaaccttatagaaggagacaaaaaagttaaaaccacatcttagtaaaagaatttataagtacaccattaaacatcatagcctacttaaatactacagaacatggttcaaatatgtggaaaatttgatgagaaactaccatattatgatgaatcgttagtctatataaaattattcaggaaacatgaaaggctttgcttgatgtatcccagccaacagtctaatcttgtcactgattttgaagcatcatctttctgaatgctttcacttaaaactttaacatttaaaaggtttagatttcatgttccttttaacatgaatggagaaatgagcccccttccattgttgtcataatatttttggttcagtcagtaatttgtaaaacatgattttaagagatgccttcacctatagctgggaagttaaagtaatttcactgaatactggcaatgcctctcagaaactggattgtaaggataggaactttataataagcaagatacttgaggctcataaacgctggaatgaagagttattcaaaaccagattgacaaaaaagcagcgtggggccctgtggaaagcaacaatacaaaaatgtccctcttggatttgagtgtttagggatttgtgaactcaaatctgagaaaggtatttcaggaatgttatttttaatttttttaaaaaaaataatggcaaatggtttttagctttaaaaaaaaatgacatattggaaaggaaaattctagtctatcaaatgtaatatggttagtttctaaatatcttccacatcctgttttccccaaataattgcttccaattcaatactttttttagacatttaatatttaatttatagcatgtggatggataatataaaatctaagtctggaccctgcattgagtagtttaaaatgatttgcaaaataagctgtatgtacatgcaaataacaaatgaggaaggataggactaatattcaaataattatatataataatatttatattaatatattttatatggtttttaaactatatactacttaaactatataatatataaaaatttatatataaatatatagttataaatatatatatatatagttttagaggaaaccctaatggaggaataaagcttaatccatattagtccctcacaaagctttgatttgatcataattagcttcatacagcatatctaatgtatatttgctatgctcatctcagtgggaaacaatttctttcaaaaacctgtaatatgatttcaaagattggatggtgttgaaagccatcttgattattgtttgtaaagctggggaaaacattttcaaaatactaaaaattaaaacgaattataaatgaatcaacatgtttgctctcatgtggcacaatcatgaataatgacaaactacacaattataaaaaccaaaacttctataccagtgtcaggtgagccatttgatggatgtgtttccattgaatattacatgttaaaagaacggtaaaaggatggctaattgttttctgtaacaataatgagaaagagtatacataaaccaagtagtttccacttggtggaagcaattacaaaaataatttttatctgttttgctgataaagcagattcattaaaatatttagtattgtgtgaataagagacagagaagagggaaatagaaagattcaaaggcattcattgagtaatgcaaaaattctcatatgtagagacattttacccagcaggaacttaagtccatgtgtgaggcaggctgcttgcatggtgaaaaacaaaacaacaccgccccctcccctgctctctgtctgcctcacccccctcactccattgacatgcatagctggcctggtaggtgtaaaaatagactggcagcgcctgcactggaaatggtcactgaatgcagcctgcagttgccgggggttttgagttctctctgacaccagcaagccagctagcagatggggagaactggtgaggggcgtggaagggaactgagcagaggagccaaggatcatcttgatgaattgcccacattagtgtacccctgggagccctggacagagtgcagagggcaaggacgggcccactgacagcaggaactgtagagctgagatggggaatgcagccctctgctcttcttgccatgcggataagagcataagagcacaaggaaacatgcaggaactggataaaaccccagactactatggctgtaacagtgaggacgtcaaagaacctggagtgtgggtaagttttaggccacaaaggaggaggaagggaggatggtggcataagaatcaacagtagacctcattggtcagacctctaaacttcctggaaggaagctgacagaataaagccaatgtgatcaaaccacctgactacctctgatcaagtggcatgcttttgcttcctcttcatgttatgcaatgccacatgtttgttttttctcggttgtctttaactctgagctgacatttgggaaagagcaatgacactgtctctttaatttggaattttgtccaaaggtggacatacgtattattatagagtgactttcagcaatattgcagagattcacttacgttcagtctgtcaaattctttcgcctatttattcatgtatagttcgtttctcactaagtcacagagcatttttttaagcatatgctcccttagtatcccagctccagcctaaaacagtatttccctctaatatttgactaacttcagtgaagaggtccttaaatgcttttcttgttatgatagtaatagtttgtaaaaaggcttaaacgttaagcaattaaataagatttatttttttaaatctttattaaaattttattttttaaaaacttcagattttaataattcataggcatgatgtgttccttaaaatgggtacaaaggcttattgtgattttttttttttggccaggaatctctgaaatatttggattttcatatttgctggagaataaagtttatcttttatctgtcagatccaggaatttgaccaccttattgcaagttatttatttgcatgaaaataaatagctggttgcatggtttggctgcaactatgaaactaagatatgtaggatttctgagtaagagaggcagaggcgtttgtacttgttatgtacttgcctgatatttccaggagtgagaacagggtctgaagcataggaggtggtgctctgctctctttggcttttactctgacctgaaacaatgtcatcatttcttagcactgaaactctgtcagaccatagtgaaactaaaactaaaactaagaatttatcaacaaaaacaacatgaagggcaaatatttgcagttggcagtgaacagaaagccctgtcgtgaaaaagaggacagtagttccagcatggaggtcaccgtagtcaaaaacgaagaaaaaaaaaggtggggagggaggccgtcccagggaagggagatcacccaccgttaacaaccgcacaggcgaggtttgtaaccaagagcagtaacgtttctcctggattatggtttccactacccacatccacccaggagagccgctctggacttctcagagcagtcacttctaatgcagctttctgaactgaggggacaaaaagtatcattactactagttcaggaccacaaaaatgagtgtatttttaaaaatgtacaatgtcatttctctgaattaattaatatagcctgttagtcatttaataaaatcttctgctaaaggttttatagactggagcatatcatgattggtgtgacattggaaaggtgtggtagaggtggaagtggacctgttttctaccttcagaaatgatattctgcccagaatttttccactttggccatggagaaaaagaaaaagttaatgtttaacttaataccaagcatgacttaagcaaaatatgtggttctaggtagtttaagttggactttatgtcttccaaatgagaatgtaagactcacaaacatatgtcagggttttcctctgaaatgagcttggcttttacgtaaatccttaaaggaccaaagatctgctcttatcacaattggcttggcagctccaaaaaagaggaagcatgcaggacaggacagagtgaagaacaaaactcagctgtttttaaatttttatttagtcctggtaatgcttctaaatttttaatcacagaggggaaaactgcgtcatctcattatttttccatgttcatgtatgcagatgactggtgggtgtattccaagttcacttgtgaaagaagcagctcttggagatgccttacagactttgccctggatcctagggtagctctgacacaagtcagcaaggccttgttagggtccaagtaggctccagagagaaggattcttgaccatgttttgataaagtgctatttagaacagcataaaaaatgtatctttattttatggtcttcttttggcttgtatttttgtgatgatatcatttataaatttgcatattggtctaagtatactctgtatttttcttgcattgagatcatgtatttctattgtggtttccttagcataacaaattaatttgctttgtcccaagagcaaaaccatagatgcgatgctttaatatagacattttttaggttacctaccctagctgattttcaagttatcacatccttcttttttttaccagtttactctcagagatttttattttattgcttcatttatttttaacaatttttcccaattgtagtagagattttcaggtttttcgtatgagctttttcattattctataaatgttcttattactttagaccatgagcatgaattctggtcttattatgaaaacaatacttttctgctagctgactcaaaaggtaataagtcaatcagcaaatgttcactgagctaggtatagttttgaatgctggcgatttaacgatgacaagacagagttcctgtgatagcgggagacagactttcagcatttatatggggggatgaggaagcatggtgcctaactgagagggaaatgtactgggaacgttcaagggacggaaggatggttagcatgactgaaatgtagtgatcaaagaagaggacggatggcaatgaggtatgagaagcaagcatgggcctaccttggcaaaagtttgatttctttctgaacataattgagtcttggaaaaggacttgagatttcattagaagcacagtgggaagcctctggagagctctacaccaggaaatggtagaacttcatttatgctttgagaaaaatctctctccctttctccccatctcttcctccctccatttccccctccctttccttggtgaaggatgagttgtgaatgcagcaagagaaaaagaagggagaccagtttaactggtttcaaggtttgcagccctgaagtgaacaaggatggaggattggattaggatgttaacaatggaggtgagattgtaatcagattgaggatgtatttttgtttttattgaaagatttttgggagattataaaagaaatagaggggtgtgtgtgtgagagaatgagtgagatgattccttatctatgaagcatatcagtatgtcaaaagagttgagttaaactttccttcagttttgaactctaaaagaatataaattagtttaaatggtatagtattgtcttccgtaaaagttttataaaagataaggaaattttgttcatatggttagttttgatattaaccctaacaagagccaaaagtgtaatggaaattactctggtaaagcatttcaaaaaatacaaaatgatttagatatggttatgtaacttttagatgatttatttaaagataaaggcctggcatggtggctcgcatctgtaatcccatcactttgggaggccgaggcaggcagatcactggagcccaggagttcaaaataagtctgggcatcatggcaggaccctgtttctacaaaaaaatacaaaaattagctgggtgtggtggcacacgcccatggtcccagctactcaggaggctgaggtgggaggatcacctgagcctggggaggtggaggctgcagtgaactttgatcgtaccactgcactccagcttgcgtgagagtgagaccctgcctcaaaaaaaaaaaaaaaaaaaaaaaaaagaaagattgaaagaagagaagacatgactttcattctctaggaacttacaatccagttttagaaacagggcttacccacatgtaatcaattaactataaaaggtagtagagaattcactggctgcacgagtgttgaaatgagccattataggatgcccaagaaggaggggatcagtgcaggcctcggtgctctgggaacacctcgtggacagagctaatacttagctgatatggtgcagatcagctgtaccacttgtttacagtttgaattgctttcacacaggctaattaagcagctgttactatgaacctaccaagctgccccttctgaggctagcagaaccccatcctcaggatttcccagcctactcccatcctctaaagaagcaaacaaaagaataatgcttggactctcaaggggcttccaggaccaccctcctctagtgctgtggccagtgtccattgggagtggttggtgcctgagctgaactagttgttaaatatttttaatatccatcctgccagtggagaaggtggagcctgaagcagatcttgggagcaaaatacaatctgggttcctgttgggaagaaagtacacttgtgccttcagtaagcatgtattcagccaggcatgggcctaccaagatgagtaggacatgcaaacttggcttgaaggagtgtaatccagggatggccaaagcaggactttgaatattgtgttcccatgtcctgagaaagcacaggggattatagagtacttcaggatgacaactcagcctcagagggtggcagaaaagttaagtcctgaagcattatgggaagttcacacactcagtattggactcattagaaagactggaaagcaatggctataataccatttctactggacatttgtggaacccccaaaatttagatgaggcacataggctaagattatcaagagattcataagtcaagatttagaatttgaactatatactagtgaaaggccattgaccaaaggctgttttaggagaatcaattaggttgtagtctgcatatcataagctctattttctttgaagttcctaccagctaataggtacttagtaaatatttgtgaaaaaaatgaatgaattaatgactaggaaatcacccaaagtagcaaatctatttatgggaattttcccactacaggtgacatgcccccagatgaaaccagaggccgccaacattgaaaaggtgatggaagcaaaaaaacacttctaaaaacagtaaagacgttggtaactaagaagttttaattataaccttctgctcaaaaaaggaatgtacccttactgcaattgcacacattacttgttgtcgtagttcatttgtgtagctacaaaagaatacccgaagctgggtaatttataaagaaaagaggtttatttggatcacagttctgcaagctgtacaagaagcattgcaccagcatctgcttttggtgagggcttcaggaagcttccactcacggaggaaagggtaggagagctggtgtgtacagaaaccagggggaggtgccaggctcttgttaatgatcagccatcaggggaactctcataggaactaatacagcaaaaactcactccttatcaccagaatggcactaagccattcatgagggtccaccctcatgatctaaacaccttttattaggctctgcctccaatattggggatcacatttcaacttgaggtttgcagagtcaaatatggaaaccacagcattggtataaaatatatgtataaaacatatttactatagaaagtagtagacattttcttgaattgttattctctatatcaagttgtacataaaatgcaatggttacattttaaagaaatttggtgaaggtaggctgggcaccatggctcacacctgtaatctcagcactttgggaggctgaggtgggaggatcacttaagcccaggagttcaagaccccctgggaaacatagtgaaaccccatctctacaaaaaaaaaaaaaaaaattactaggtgtgctggcacacatctgtaattccagctactggggggctgaggtgggaggatcacttgagcctaggaggtggagattgcagtgagccaagattacaccactgcactccagcctgggtgacagagcaagtctctgtctcaaaaaaaaaaaaagaaaaaaaaaaaaaaagaaaaaagaaggaaagaaagattacattgtaatgttaagcattatctatttattttttttataatgaggtatatccaaaccaagtatttgtatttacttgaactatgtaataacttttgaataatatctcttctgctatatttaataagattagttccactgtccctatagtggctttttcaaggtcgcctgtgtgatgatggagctgggaatactctggggagagagtcctcttttcagctgtattttgcttccttcccacacagacatctgctgtgcctcttactcacttttagttgctgttttggattttatgcccctttaatcaaaacttattatgccacaagatagattgacttgtttcctgaattctttatttttatttaagggtttctctgtgaaatcttaggcatattatatcacatttgattgtcaaaattttacgtgtttgatttttcaaagctgaccttcatatcatatttgtgtgggcttatgtgactatagtaaaacttttttgtgcctttctttaatacttccttataagaagtatacgtgtaattccagcaatttgggaggctgaggcaggaggatcacttgtgcccaggagtttgagatcaacctgggcaacacagggagattctgtctctatattaatttttttttaagtttgatggtgtgcacctgtggacccagctatttgggaggctgagctgggaggaactcttcaggccaggaaattgagggtacagtgagccttgattgtaccactgcactccagcctaggtgacagggcaagatgctgtctcaaaaaaaaatagtaaaaatcttacaatgattgacagaagtataataatttcaatggtggctttgagctaatgaattgtttcttaaagctatgtgaaagccagctgtgtaatagtagagattataaattgaaactgtgtttttgatgagtttaagtgttgctgacatacagtttatttaaatttcagtctttttttttttctgtactctttaccttcctcagtcatcaatgagttccaaaagggggctttgaagtaaatcatagattctgtttgatactgtaggaatttccatattctagtacagcaactctattaaataaacacattgtgtacttaaattggatctctcacaagtcacaaataatatattagaactagagctgaagtacctttatatttgctacttttgtgtcatacctttctagattattggctttctgaaggatattagaaagcatcttctaagatacctagtaaaacagaagtacatagaaaaatttgtgaaaatctttcctttttgaaaaccactggttgttacatatgaacttttccccagagttacaaaagaaaaagagtatttttcaggaataaaagacatttaacaattttatattagtaaggtatatatttcacagatttgtctataccatctataatacataatcatttcttttaaaaaatggcttatgatattcagctttttatgcattcttacagcatacattttgacagactagatgattaatgatgacataggataaactgtatttgggattgtgtaataaacacacagtatgaaaagtctagttaatcctttatgtcagcgcctcccaaagtgtactctgtgaactaccacatcagaagaatcgcctggtgtgtttttaaatgatgtagatggctgagctttactccagacctcctgagttaaaatctcagaggtgagagccaagaatatttatttaacaagattaagcatagtctctaagtaacccttaagtgcacttaagtatgataaccactgctttgtgttgcaagaggctgactttactgaagagtcagggctgaatatgtaacatcagcacataagagcataaaagtagaagaaacccttcacattttattaagcttcttcttatccaggttaattcaatgtattgccaaaattctatttagaggcaattaaagtagctgagaccacatgggacatgtgggaatggaggatactctgccagcaaatgggcccttctgcatttcatatgcatcaccttaaaagtaagaaaatatctgtgctgtatcaccataaagttttaaaccataacacttagaataaatttaagtttcacttccaaaaactaataattactgtgtacctatatagagtccttttattcattgtttaaccttgtcaatttccactggaaatccaaggagtaaggtactataagacaatgttatgaaaatgtgtccccaaatttttgaaaagtcaaaatttcattccattgttgagcagtcagcttgaacagcaagattgttctgaatgatctgatccttccttggaattgagggctagtacaatatcttggctgaatcccacactcctgcttaaaatgtcacatagcacatgagagatgattaacaaaattcttctggcctcactaaaagttcttaatatatcgactaatgtgaagtgtatcaaatattagatactctctatattttaaaattatatataaatctgtagaattaattattcagtaagtttctttcaagaaagtaaataatgaattctgtaagtctacatgttctttattcttgttttgtaacatatacatagattgaagaatcagtctttcctttggtattgatttgtcgtacccaccaatcaattctttaaagaattaagcagtgatctagatggacatgccaactgccattcttattttaaatgtaacccaggcagttacagctacatgccaaaacctacccatagacactgtcaactaatggactgggctgcttcctggcccatcttggtcttaaccacttcatctggcattgggaccagatctattctacccaggatcacaagataacttagaggtggaaaacaagaaggaaataaaaagtaaagacagtaaacacataaaagaaatgtatgaatgtgtatagcaaattccatattaattatcatcaataatagctatcatttattgagcccctattatctgctagattctgtaatggcatactgcataccatttcatttactactgacattagctttgtgaaccgagtattaacatatgcctttattggatgcctactattccaatacactgttctcaggggtttatatatatgacataatccaatccacatattctatacattttatatactaggaaattgaggcttttttgagttcaggtatttcctcaaggtcacacagctcatggcaagtgatagaaccaggattagaaaggcagttctaagtccattttataatgctggctctttaaagaaagagatacctaaaaaaggagacattggagaaatttaaagtgggttctaagattttccacaattggaagaaattactgacttggaaaatttcaaataagattgttacttatgacccacactaaaatacgttttaggaaattaaaaaaattaaatggaagaaaaaagaaacaatttttaattaataaatctataagaaaatgagaaatatttcattgacttcagggttggaaagcataaaagcaatggaataagaatctaaaagtggaacttcatactttttgatttctataacaagcttgagaaaattttcaaaaacaatgacaaaatgttatccttctatataatattaaaaaatacttttgaaactctaaaaggacaaaaagtgtgaatagacaaatcaaagaacaaatgtggtagacaataaatatatgactaagttttcaaactcttcaaaaacgaaaaaggcaaatgaaaaccacaatgatctacttatcgactaagcaaagcaatttgagtttatgattgtgttgaggtggtctctttggcaaacatttgtaatgtcttttcagttagcaactttcaatgcctacagtgtgtgccaaaaatctacattctttgacactgttaattcacttttaggaatttaaacaatggacacaatcaagacagggacaaagatgtacatacaagagtttttatggcagtgttgcttaaaataatgaatattaaaggcaccagttctgtacaaatgtttgggaaatgctaaaaacaatgataatctatccatagactattatatgatatataaaatacctttttaaacttttgtgtggtataggctatactaactttgtaatgtttatttttaaaagtaaaacagaatattattatttcaacatcatgaaagcattacctacacaaacgtatagagtatatgtagaaaaattcttttttttttgtttttgagacagagtttcactcccatagcccaggctggagtgcagtgacgtgatcacgactcactgcaacctccgcctcccgggctcaagtgattctcgtgcctcagcctcccaagtagctgggactacaggtgcacgccaccacatctggataattttctgtatatttagtagagatagggtttcaccatgttgccctagaactcctgagctcaaatgatctgtcttccttgacctcccaaagtgctgggattacaggcatgagccacaacacccagccttaatgtagaaaaattcttgaagaaaacacatcaaaatatgcagtgttaagtttgactaatgggattatggttgctaaccgtaattttgttttcttttatagtcattttcaaatgtcctatatatatatatatattatatatataaaatgtatgtgtgtgcgtgcacactttcacagtagaacatgaaatcatcatatataaaaatatatgtgtgtgtgacacacaaacagatttgtctacttccattacataaaggctagggaaggctatattttacatatatatcctttttaagagaagggagattgtaagagcaaaaaaggcatgaaagggcatagacattttgtagttttatacaaatacttttatgaaataagtatttctatgtttcttaaggttttataacctaaaggttttttttttaataatccatgctttaatagctcttcaatcaatttgggagagaaaacttattatgggtttcatttctactacttagtttttactgtgaaaagatttagtgttatagtttcttaaaggtgtaatcaacatttaaacagcaagtatggtgattaattaagaacagctgagagaggtttcatctatcttggaaggggtccaggtttaaatcccactcagggagatatgtcaatatgagctagtaacagtctacgtgctgttatagaaacagagggacaaatgttgtctttgaagcctaccattgctgtgaagcttaaaaaaatttttttctttgcatgttaatcatgataattttgatagagatattgctctggattcacttactgagtataatattgacacactcttgaaataatataaccatacccttaaaagtcacagctcttgggttagcaacattaaagaaaagaaatcttggtattccacaggtggcaatgccacatggttcaaactttgggccctgcccctaaccaaaaaagggaattgagcatcaagggagatcagaacatgagagttgagccaggaatgtgactgcagtagcttcatcccaggcaggaagcagcagccactcctatatgtcggtcaacagtggaaaggtatttagcacctttgggggaacttggggaagtagtaatgaatggtggtctctatggtaggacttaccagttatcaatttcgggtctgccacttcttaccccaaagtatacagatgaatcatttaaccttatgagaccttggttttctcatttgggaagcttaagaagattaaataagattataaatgtgcttggaatatagtaaagttagctattaatattgtggtaaaaggtgtgagaacaaaatatgtaaggtgcaaggtctcattcattccctcaaggagctgacagtctagttgaatagccagagggtatacacaaaagcaaattgtatattgtagagtctcttgagtagacagatgacttaaaagaaaaagcaagtttagatggcatgtagcatcctaatttgatgttatgtcagtccatgttgtgtaggaaaaaattcaaacatttcagtgaggaatcactgaaactgaataaatacatatgaatcatgtaaaaatgaagaattgccttgcttgctcaatgcaccttttagcaagtgtttatcttaagacatagtgaacatcagtataaacccaatcaaaacacatatgagtaattctcttacttgaaaccatgatcagaagagatggcttttggtcagaccaaatctttgtcatgactacattattagtacaaagttaatagttatatctatgaaaaagatgttatcagtggaggaaactcaattactaatatatcctatgattatcatatgtgaaaaaaaaataaaccaaatcaaagtggagcatctccagctgaaggcaactctatcttggtggaatgccacagggttttaaggtagacccaggttctcaccacgctgcacattatatgctgggctcccattttgaaggttgccaatgagaaatggcacaacctaaacaccttttatttgaaattcttaacatctcgtagtttcacagtcttgccctttaattactgagacaagggtagcctgctaccctgttcttagtcagggttagagatgaggtatctatggtgttaatttggcatttcaactaagttaaatttggttaatgaacaagatctttctgggtacagtttactgctttgccaaaaaaagttctgttatcttttcatatatcccacaataatctaactcttctttaagtgatttttgaagtttattttttgagtaattaaagctagcgtaatttgtatttatattaactgttgtcagctttacataaaaaaaggtaaggtaatatcctccccagggttctgttatcatagtaatcatcattattggctgatatattttaggcactgaattaggttttgggtattctaagaattataaggcatggtttccaccttcaagtaaattgaaattttgttctggaagtagcatatatgacttcctctctctctctttctctttccttccacacacacacacacacacacacacacacacacacacactagtttatattatattacaggtagatatttgtgtaaaaatgtatatgtaaaatgaaatatatagactccctatgactgaagagagatacattttatatacatagtaattataaagaaaacaaactttctccttcgtatcttggccagaataattttgacataccaatgatctcttttatttagaaggttaattaatcttactgtaattacaggggatactgaaatatattactgcatgttttacattaaaaaatactgagtagtcagtaattgccctttcatggataatttatacaataattaaagcttatatattgcttcacataaaatctttttcctcacagagaagagtaaaattatagtttcttatttctttattttttttttctttttgttgagatggagtctcgctctgtcacccaggctggagtgcagtggcacgatctcggctcactgtaaactttgcctcccgggttcaagtgatctcttgcttcagcctactgagtagctgggattataggcacccaccaccacgcccggctaatttttatatatatatatgtatttttgtagtagagatggggtttcactatgttggccaggctggtctcaaactcctgacctcaggtgatctgcctgcctcggcctcctaaagtgctggaatttcagacgtgagccactgcacctggcctatagtttatttctaaaaaaagagtactagtgttcctatgtagttaatatcagcaagaatctagtttctttctgtatttaatttatttagtaatgtcataattgtcatttatctgttaacctaattaaagttagagaatgtcgagctgcagagcctgtctagtcaagtgtattactaaattcattagtcatccatgacttcagctgtatgatagtaatgatacagacacactttactcattaacccttagaaagagttcagcattgtttgattttattgtggatatttgatagaattataaaggaaacttaaaaaaattaataaatagagacagggtctcactatgttgtcaaggctggtctcaaactcctggagctcaagtgatcctcttgcttcagcctctcaaagtgctaggattacaggcatgagtcaccacatccagcgggtaaaggaaactttgaaaaacaaatgtaatcttaggcaatgagtttcaggtgaattaataagagcagatataaattttgctaatcaaggtttgaaaccaagtgttaaaatttagtaagtctgcaaaaaatttacttgatcccccaaattttcactagtttaattcatatcgaccaatgctgcttgacattcctattggccaatttcaccctgttgaacatcttcccttatattgtttttcccttatattatatttccagaaatacttctccatctattctgtgtcaggtactgtgctggacagtggaaataaaaatgaataagtcatggactatttctaccttggagggccaggccaactggggatatagacacgtaaacagatgaatttggaccccacttgagccatgcacaacatctagcacagtgctatgcttctgactcattgtcaacacatatttataaacgattgaatgttcagggtgttggggaccccggaataaatggacttggtcaaacttgagggtagatttaaggcagggttctgaagaagctatccttgcctctgggaaatagactcacagggcccacttaatacaaattcctgtagaagtcaaataataaaagacaactagtaaagaattcttcattgttccttaagcctggcttaagtctgacttttcttttaaaagaagatcttgggcatctgggctaaagtttagttccatgagatgaattagctaaccttgcttttgtttttagttgtgtttaaatcaggaatttccttacttttcaaaattcgctctagagttgatgccagtactcttacaccaacaaatcaagaatttgttttgaaagctgcctcagaagacgttcagatattctttgaaatacagtaataactacgtggatttttgttgacagagttccaacagaagaattttgcaatataagctaagttttttttaaaaggcagtgcaagctacaaatacttgatttgctcatcttttttctactccatgtggtatgtactataattaatcaaacacctacattttcagccaatgctatcttttacattttagtgtaaaattatgtaagtgctataccttgcatagaattcaaattgaatagcccaaacattcctgacaattacagttcatagcacaatggtaaatttagaaagttacagcaggtcacatccaatgaggataaagtggcctctcagttgtgccctggtcttatgggaaaaataagaaaatgtcagctgcatgatattagtattctgagctcatgagaaaactcctgtacaaaattttgttttagtctcgtgtgtgtgtgtgtgtgtgtgtgtgtgtgtgtgtgtgtgcatgtgcatgtatgcgctgcaattccttattttattctcactgcctggtatttcattaaatatgttgatgggtcagcattattcccttccaggggcattacaagaggcccttccttattcctaggacattcatgagcagagaaatgggaaggagtgaagcgaaatccagtgtctacagaaaaactgggccatctcccagaggtcactctatggcctctatctttagtccatgcccgtctcttggactttttagccttgcatttttaattccctactctacagtgacagcacttcaagttcaatccggtcaaaaccaaactgtgttcttctctccaattttagggtattctgttcccctaaattattgatctttattgaaagtgtcacttattacacgcaaaagctagaagtctccaacttttccctagtttctccttttccataaactttcagagtcaatttcccccaagttttacagcttttttttttctatatatgactaatactttgttttcacatgtccctgatgacactgcttatcctcatcacatgctagagtggtaattttaaaatggacattctgatcttgccttttcctgtcttttacttatggtgtaacactcaatctccctattaggacatacaaaacattaatggtctgggccctactttacttttagagttttacttctttcctgtttccaatatgatctttataactccttatactgaatttatagttttctctatactgtgttctttcgtgcccctatgacattgcacttgctattccctgggctggctctgttttccacctgacttatcagcaggaacctttatcaaacactatattgcaatctctattctaaatgtaaatagtaaaacaagtttgtaaaacaaacaaacaaacacctattgcttagactactgcctctacatggatctccctgggtctacttttcccacttctgttcctggtctatcttgtagctaaaggttttttttttttttttttttaaacttcaaagattataaaatctttgaggggatgaatcatgtttatttcttctacattcaatccctagcatctaacacagcgcctggtacatagtaggtacttcaaaaatatttctttgattctcatctcagctaaataactcattgttaaggacagattaaattatttcaactatttatcataaaataacctgctgtttgactgatttattttcgcttgagaaattgaaagctataatttttttccagtaggtttacatatttagatagatacagctagatccttccagtaatttaatcaagtcaactcagtgagttaaactgggaagcaattttcttcttatacagtacacatattacatattctttagtctcttaaaaaattttatgttaaaaagatttgttgacactgttgtgcaccagtgggctggcatgatgggagtgagaaaagggatgcaaaatgcctttatatatatctttcagtataatgtcgacttattagaattggaatttttccttctaaagctcaccatttgcactcagtgtccatgtaaattgtcacaaatatgcaaaagatgctgaaagctgtgcatccccatttgcgacccacatactttggagaatggggtgaatgaataagttctcaaaaattatatacacattagaaaaatgggcttttgtcatcttacagatgacaatggactttttttttaaattaaaaaccaagctttggccgggcacggtggctcactcctgtaatcacagcactttgggaggccgaggcgggtggatcatctgaggtcaggagttcgagaccagcctgaccaacatggagaaaccccatctctactaaaaatacaaaattagcctggcatggtggtgcatgcctgtaatcccagctactccacaggctgaggcaggagaatcgcttgaacctgggaggcggaggttgcagggagctgagattgtgctattgcactccagcctgggcaacaagagtgaaacttcgtctcaaaaaaaaaaaaaaaaaaaaaaaaaaaagaaaacccagctttatggagatatattcccatatcatacaattcacccatttatagtatattatccaatggtttttagtatgttcacagagttgtgcgaccaacaccacaataaatttcagaacatctttatcactcaagaaaggaactttgtaaccatcaatagtcattctccatttctctaccccctcccccttgtcctccccatggcatcctttggccccaggcaatcacttaccagtttttcatctctgtatgtttgtctattctggacatttcttttatatcaacaataagcttaaataacagtttaataaaagggactaggctgggtgcggtggctcacacctgtaatcccagcactttgggaggccaaggcgggagatatttaggcaagtagagtcagatggtcacagtgtggttaagctataattaagtgatatctcctaggaaaatcaatcacatatgtatatatattagactgttacaaatgaaaaaccagtgtttccacgtgcatcttcatggggccacactaagatcaacagtgtgagaaaatgtaccatgatagaaaaatatatgcaagttcttttaaaatagtctccgtagtttaagtaattgtgaagttttaagaatctattttttgttcaatcctgaataatttaatactaaacaagcaatctactttttagtgtgtgcagcccttggggtgcggtcagcacctcatctgtgttgtgtcacgaagctgcttctgattgagtgatgtctgcttcagagcagatggtctctgaagctgcagaataaggagaccaatggggataaaaatgtggtgcctacctcaagggggcaagagtaaattaacactataagatgcggatgcgtagcataatgaaaaattgatgaaaggtttttttcacttggttgggtttgtttttcatatcctgacagttctaaaagccttgaaggaggctaagacctaattcaggttcatgtatcctaatccttaagtattgcagtgggatgagctctaatatatctttttctctaaacatcctgtaatattttaacatgctgattagggaatgaaaagagttttgtatagagaatatttcttaaagaaagaattaaataaactactgttaccaaaggatctcaaaagttctctcttttttctctcgacccaaatgttgttataggtggttgtaattcatttataaaagcaactttttttttgatgaccagtgatgatccaaaaggaaattcctttggatatttgtgtacaatatgtaaaaactctgtcagcttttccatgcttgggcctatattcattttggggcatgttgacttttagatgctggcagaacattttttacagagctatctagctagttgaaaattgggaaagagattgggtctgtgatacaaattgttttaaaaataagtttttcattattttatacccaattaataccagttggagatcctaaagcaataattgagaactatttagaattcagtcatatatagatgctgtgggtattattaaatatccaatgtggagctgtaagatttgattatttctattgctggcctgaagaagtacagatttccatgttactttggttattaaaaatattagggcaaattatctggaaaccataatagtcaacataggacttgtataatgttttgatttcctttacattgtcagcattttgaacataaaacagtaagcagaacttttcaaatatatctgttcaaacagtatggttagaggttgtatgtggaattcaactatgatgttttaagatacctccacaccaagaggaaccagtaacaaaaatgagggaatcatattcttctagttcttatgttattctctagaagtatgatagactctttgggaaggaatattaacttttgctacagagtttaatggctaaagaaactaaggtgcttacctgactgaagcagtaatgtcttaaatctgtgtagctgaggcctctcaaagagtatcttatttcttgaaaaaatctgaagccttagataggtgtggtaagttttaacatggacctcaaactgttatttaatctgacatctgacctaaagctgtagcaaaatgtttccctgttactctgattttcttagcagaaatttggaaatgttgtgatacaagtcacaaatattttcatctataaacttaccatgttcctattcaaattcagaaaatactgacgtgttcagtgttggaacttctgagttctgtaggcatttcagagttatcatgcctggagtacaagtaatcaaaacctattgattttgttccttacgagaactttaaattttaaattcaccataaagttcaataggaaactaacagaataataaacacctaagaaagttttcacctatctttgttaaagttcccattttagtgaaagattttgttgcctcattgtcattaacattttagtaactggcatagttatagagacattttatgaagccaaactaatatcaacacaacaaagttatcttttaagtcacacttctattatgtcatgaaataccaaatacagatttcacatttcttcagtttaataattcttcaaaaatgagcgtatatttacactcatataagtgtgtatgtatatatgtatatatatatatgcatacatacataagcactttctaaagttttaaaagcacatagagaatgtgaagtatgaaatagttatcaaatagttatcaaagatatttcatcagaaatatcttttctagtttgtggtttttgttcctactagtttttgtttttttggtttttttctttttggtagtaattctcattcactggaggatagcatcacattattaatattttgattcaattttcagaaaagtaaatgccataaaaaaatgagtattcagaactttttaatgtataaaattgtctctgataacttacttcacttatatttatcccggaaaatttaacaactgagatctctgaaccagatctggtcttcttgaatttgtagtaaacatgttgaagaacaggggagtaatgctatttatacaatatataccaaggataataattcatgtataatcaaagagaattatgcaatttttgtaattacaaagcctcatgaatatcagaacaactaataaaaaattatccagagtttgattcttagtaagcattcttttgagctaaagaacaaaactctatgtatttagtaatctgcattgtctcttagactgtaccataaatatacaatacaaatttcattaaaaatatcacataatatagtctgcatttaaaaattgcctccagtgtgaaaaaaagataatgcttttgaatactaatttttaaacctatttacttctctgtgatttttgtaatcagtttataaattaggaataacttatttttcaggactactcacatttagctaatttttaaattttttataaagatgggttctcactctgttgcctaaactagggtcaccttttttttttttttggaaacagagtttcgctcttgttgcccaggctggagtgcagtggtgatcttggctcactgcaacctctgcctcccggatccgagcgattcccctgcctcagcctcccaagtagttgggattacaggtgtctgccaccgtgactggctaattttgtgtttttagtagaaatggggtttcaccatgttggtcaggctggtctcaaactcctgatctcaagcaatccaccctcctcagcctccccaaagtgcggggattacaggtgtgagccactgcgcccggccaggtcaccatcttttaaagtaaatattttatttaattatagcacacatacagaaaaatgcataaattataaatgctcatcttgatatgtaggaagtgtacatacctgttaaactgcacccagaactagaatgtagaattagaacattatcagcaaccaaaagcccctttctgattgtttccgaaactactactgatttctaacactatggatttgttttgccagtttttgaactttaataaatggaataaaagacatgtccttttttgtgtctgacttgttttgcttagcattatctttgtgagatctattgatggtgcatatagatatggttcattcattcctattcccactgctgtaaaatattccaattttactctcttttaaaatacaagaattttagaaaggaattcatgaatcttgacacaaccttgcaaaataatcttaattaatgctttgaaagagatagaattggtatgctgtaggtggttcttatttttcatggttggtatcttagggaaagcgttgataagtgatataatttagctagtgtgctagcaaaaattagtgttaaaatgtaatactaagttaaaggaaaaattgctgtctttatttaaaaaggaaatttcaaataatctctcacttaaaatatttaggtagaatttatctgtttagttaaacttagatattgttatgattccaattctcaattttgtgtgaatagttatcttaaataacattcaaaagtaaaaatataaacacttaagtttactctttcttcttcccctaactaaagcatttatagagttcacttttatgtctgaaccaattttcttaacacaaaggccattggattaagaacactcttttgagaagttgcatttactctctctgaagattaggggacctgtcagtaattttcatttagtagcaatctaaagagctgttgaaggacaccatatatgtaggttaacctgcatgtttgagccagagtgtacaaatttatggtttataaattggtagcagctgaatagaaattgtcaagtgggattttgcagtgtaaagtgttttatatcacttatgtgttctgactgcaagaaagtaacttctgcaattctttctaaaaaatcctagtatatccagcatgcagttcttggctgaacccaaattgttggtttcgacaagacagcaataataatgtgagctaatgaaagagctgaattaattaaacaatagagcagtccttggacagaagtataaatctgtaggtacaagcattcagatatcacaaagagagttctctgcagcatcttcatcactggtgacagaccacacccagttctggttcattttgtccttttatacctgtacatctcagtgtatttttaagtactctggtgtagcttaggcctgctggcaacacagtaacgccaggaatcttcacatttaaaaaaagtcatgtgtgtgcatcgataatttgatttattattgttattttgcatttatccctcacaagaaaagccactaatataaaacaaactcagtaagtgtcctctgtgcctgtcagtggggtaagcatgctcaaatcatcatattttttccttagcaattctataaagtacatttatttttttgataaggaaattgagacatacaatgacccaagatcggacaagtcacaatttgctagacatggattttaacttatcctacatgcctaggaagagacctaaaaaattgtaaaaatgtcccttattttcctggtattcttattaaagtttttcccttcaagttactttactaggttttatttattttgtattgctataaaaacgcagatctcagagtagccaggtaaatgaccctgtttttacaaaggaatgactgcttcctaagaaaataagcagattcctcaaattccacaaggagcctgtgctttacgtaaggttagccagtcagcaaatatgtgtgtagggcgcaccataagccagagactgtgacgggggaggtgttcagtgtcactcttttaaggctagtagggactgctggttgggtcaccgttttagacaagtggttctcaaacttgaatagtctattgatttcttttaaagtatataaaaaattatgacctccagtgttatttttattatagtgttaagtattaaaaacataaagccacataaaacttcttaaattcttgtgccactataaaaaagaaactttgacaaattaagtaaaacttatgtaagttttataatattattcaaataaagggcataaatttaatacaatgaatggaaatgtctgaaactaaatttaacatattgtgcttagtaataaaaaaagaaataacctcagagttctgtatttagtttctgaatttgactccagtaaaaataatataaagaataccttttttgtaagtatgttgtacaaactattcttaataactttaaggtgttgtttcctacttcaagctaataaaacttatagctatcagagaatagctttaagagaatataatctttgaaagctctctttatttgcttggagaggaaattactattgggatagaattgtgtacgcaaaccaataaaagctaaaattgaaaactgaaaaaatgtttcactgtggattttctattacactcactgctaatggtcagtgcacgttggactatatgaagatagcatctgagcatatgttaatatgctactgactgctgctgctcaggcacttttggctcgtcatgtcctgccatgtatgatgaacagattctctgaccattcttgtctctgtactacagcaaaatgttctgtctattatgcatctgtatatcatttggacttcacttgttatgtactgagttataaacacaaagacatataccgaagttatatgtttatactcacatatagggtagccatgtagaggacctggaatatgctaatattttctttattaggttattattgaaacgtaagcacagaattaaagaattaaaaaacttgtagcaagctcatgggcccctgtggacatgcccctagagcctttgggtcagcactccttggggatataatgtggctctatgaatgcacattcctccctgcctttcatgtccacactgctgggtgctaagaaagttgttctgtgtttctaatattcagatacaagacaacatacagaactgtgtcaagaataatttaatgggaaatttttctttcttggcctgagatgtcactccagggttataaagggggcaagttttaatgacatccatctgttgcagattaaaataggtggggctcagcattggaattccttgtccagagtttgactatgggcatcagcacaatttgttttaggatttgagagtcctagggacataaagcagcaaagcagggagaggatagtcttacatttgtctgagactttcttccaaagaagttgcttttgcctcattttctctttattttgcttttatgtgtgaaatctcctggttgagcaaagaaaacagtctattttaaaagcatgcttttcctcctacttatacttgattttagaactcttgcttttatcataatcagttgggaaacacagcatggtaaaaattgctgtatctctctccctgaatgtttgaatcctctttcatctctgtgttgattgaagataaccaggctaaccactgtttatccaaagcgcttgtgtcaagggccttaatcacagattgacctcattgtagggtacgatgtgcttgtgtctatgtggaagggagagaagaatatgtatttctatgcaggtatataaatttgggcttcaataatgtcaatattcatacataacttttaaaacctcattttatttctgtctttggaatttacattcttggaccattttatgataatatttccatttaatgcattttctcactttgggggaaaccaaatcccttaaaggggttctagaagaattcaacttacccaaaagtctcctatgactcaactgctgaagtggtctttggcagaatggctcagatattacatttccataggacccagacccttcagaacactgggagcattgtttgctaaaattctaaggatttgctataactttgacatgcattcactttttaaaagtttgatgaaaagagaaaaccagttatgaaaactttttgttactctataacggcaaaagcaatcctcaatgtcatgtccaatccccagagaagattcaaagatggtctattatatactcctcagcaatacctgaggccccatcagaccatcattgccactccaggctgctgcattggtgtttctaggtgtctcttcattcctttggtgtcaggctcttcttctggctccacctgttcacagcattcttttttataggaacaatagagcaacctgatcttttgctgagtttaatcatgttaagcatgtagagggagacagacaattggcttcttaatgcaaagcatcctttatcacctgtttcctcattctcacatgaatgtgtttctaagtagttcatctcagattggctcttaattttctaggtgcatatagaggggtgatagttgtgagggtagggatggcagtcaagaattttctctccagctgaggcactttatttagcaagtgccatgatttacagagtaaatatgtagaccaaaggcataactggggttaatgcaggtgaaataaacctagagctcacaggctaggaatctgtagtaatattcactgtgatactttgaaggtgtgggataggatagcagataaaacttacagctctgaactgataaacataaattaaatctcaggtcttccactaaataaatgtgtgtaaatacgtgactctggaaactttctaaatctctttcctcatctattaaatgggcataagaatagtttttttctcatagtattgttgtatttgtgatataatacatgtgactccttgagctctgttcctgacccactaaaccctcagtaaatgttacctataagcatctgctttatgtacaaattggaagtactttctaggaacaacctctaatataatatatagcacacagatttgttttggaaaaactttatatacaggaataatatgttcgtattttatatctgtaacctaatactatttaatttttgttgttttatagtaaaattaatgtttcttgtgagatattaatataacataatacacagtattataactcacttttaagtgctgtgacaacaaacctgaaggtaggaaatcctcttggaatttagcatatgctgcaaacagcaaaataaatttcatagaataggcatttaaaaacgagtcacagttcagtcgctgcagcattgcagatattcttgggggcactctgccattggtacagacttcaggaaggatgaagagtgaagaacagtgtgatattaatcatatgatgatggatttctaaagaatcagggcatgaattctggatgtatagatttcagtcacacctttcaactcttaataaataatctatctcatttataaacatataagccacttggtatttgggttaaaagtgaggtaacttagttctatggttttcagtctttccatgtgtaaatcattttaacagtatgcaagtaattccatatttgaaactcccagagaagatacttccatttctatctctgtacatcaccacagatcataataaatagctctgaccgagtatgccaagaggttcttgccaagtactttgtttgagggagggaggcagtgtagcctagtgaggagaatgtttgattaagagtcatcaaaccttcatctcaattcctaataggtaaattgtgtcccttttcatgcctccattttctctttagtcagatattatatgacaaaaaattataacagttatgcaggtgtcttggaacccaacaaaagtttatcatcgttattatgttaaggtttaaaagtcagactttataaccaagccagggggccgtgtgattgtaactgtgcatctggagcaactctcttcggacttttcacgggcagaattcagctgagtctcccagcatctgattttgagaggagtgtgggaagatgagaaacttaaaaagcagtttccatccagagtgatcatctttaccaaaagattttagtctggtattatgtcaggtggtttaaatttaatcatgtttatccagaatcactgggatcacaaaatttgcatcagcccagtccacacctgcgaagtagtgctatcccctttcctcaaagcaccctcggagctttctgttattcccttctaatgagaccagatgactgccaagtgacccatactcagtgttctctctcagaagcatctgaaaaccaacaggaaagaaagagaaagaaaaaaacccagtagctttaatttctttagctttctgattcttttttgacttgaggttagctcagtataaagtcactagaatcttgaagctaaaatgaatgagtaatagcagtacttgaggctagcatcaacacgtcttcaattgtggctgaagatttagaataaagcagtaacaattatttccattttaatggttcttttatactctaaaatattgacttttaatgtacttagacaactctctagaaatattgtgaagttgctaccttatatagtgaatgattattcaatgttttaaactccgtattattgaaatttttccaactaaagcttttctgacttcagtgtaaacattcttgtctttctgtattggatacatttctatttcatcaatagttcattaaaggtcttttatttttctcgcagtctgacagcaatgcaagcttcctccgtgctgccagagcaggcaacctggacaaagttgtggaatatctgaaggggggcatagacatcaatacctgcaatcaggtaagaacatggcagctagctctgtgttgtgcaacgaaggaacactcattacattctcagagcccaagattatttttgtctttattaaaaatactaaaatatcagtgactcagacttctgaaatcccattttttgcccccttaccaacttttcaagtatcagatgtttgtatctagagctaatgttgctgaaaaagcagatagatcaaaaacaacaactgaatgtcaattttgtttgtgaaatgatttgggccacctttagctggaattttgaccaagaatgatgttttacttctcatttatcatctagtaatccagatcttggcttctttccttcttgactatatgcactttactcatgggaaactgattattacaatttagtatacagaaataagaggataaaatgttctcctaattaattttaaaatatggctcataatgagaataatttgaaattattattgtaaatgatgtatccattcatcatgtccatttcataaggactttagagaatattatacactttggatattatttggtaccaacgttgacatttttgtgctatttttgagtaagatttttacatcatgaattaaagtgtctagtggactgcagtattcacttcaatgctaaatgttgtgttgtgtgttgtgtgtatgtgtttgacagagacctaactaggaagtgaataattctggctaattttaagttaaaaggaggtaaatgtcactactggattctaaattatatataaattcctttttctatatcctggtatatattgaacccagttatgtttactttatagaccactgaaattaataaatctttcaaaaacaacttttcagaaactgagcccggtatcttatcctcaaacttattgtactccctaattcctacctgctgatttcctcaccaatgtgccattccaacccaactgtttcccgttcctcatctttccccctctccagcccagcactcctctctttgttcaccttctgcatccagattacatgagctcggatcaccttgtggtacttaacagagttgtcataacagccttcttactaggttctgtcttcaatcttgtccactttgatcaattctccacataatgccttgagcgataaataaaataaaaataagattacaacacttccttcctccccaaacttctatggctaccctatatggctaccaattcccagatcagtgaggtggttgtttcaaaatcacctgcaggcttttgcaaagggtacaggatttccctccttcttcttcagagtcactggcataaagagcattgtcactgatgtcaatatttctcatattttaggggagtgtgtctcttaccgtgaaaacatgttgagagctacttaatgttgggaaaggcattctgctgtggccctgagcagtcctgcagatacttttgggaataacaagaatgaaagactttgggattgctttttatctgggctatttctcagggtggtgctcgcagtgagcaaccttgagggattaggcgatatctccctctagctacaaagcaggcctgtatgaatcccccaaggtcagtgttcttctttaacacaacccacatgtatgggcatccatcattggtcctttgtgtcaaccctgttagatatgggggaagaaagggatagggaactggtataagcagcaggctgacacttggctactgcttttgctctgaattacaacgtcctttgtttctcacccagaagacttgtgtcttctactagcattatgaaacagtaatggtttagtttttaactctttggtaagataaaatctcaagaactttacatagttcttaacactgacctatggaataaacccaaattactgtattccaatatgtaaaatcttcgtatgttgtgtctacattcctccatcttatttttcattatgaatcattttatctgatttttttttgtgttcttttggacaaataatttgaactttagatacattagttaccttaagaaagaaagaacattcaaactcccatatggatatatggacttattctataaaatacttatgaagttgaatatgaaatatttatttatttatttttattttattttattttattttttattatactttaagttctagggttcatgtgcacaacatgcaggtttgttacatatgcatacatgcgccatgttggtgtgctgcacccattaactcgtcaattacattaggtgtatctcctaacgctatccctcgctcctccccccaccccacaacaggccctgggtgtgtgatattccctttcctgtgtccaagtgttctcattgttcaattcccagttatgagtgagaacatgcggtgtttggttttttgtccttgagatagtttgctgagactgatggtttccagcttcatccgtgtccctacaaaggacatgaactcatccttttttatggctgcatagtattccatggtgtatatgtgccacattttcttaatccagtctatcattgatggacatttgggttggttccaagtctttgctattgtgaatagtgcagaatatggaatatttaatacttttcacgtaaacttaggtttccaggctggagtgcggtggcgtgatctcggctcactgcaggcttcgtcccctggggttcacgccattctcctgcctcagcctcccgagtagctgggactacaggcgcccgccaccacgcccggctaattttttgtatttttagtagagacggggtttcaccatgttagccaggatggtctcgatctcctgacctcgtgatcagcccgcctcggcctcccaaagtgctgggattacaggcgtgagccaccgcgcccggccaaacttaggtttctttaagtagattaaatgcactccctaaatgtcaatttgttaactttctaaatttacaatatgctagagaatagacaatgaaaccgttagttcatttaggtaaacttatcataaataacaccaaaaaagagaacctaaggaaaagaaagttcatttcaaaccaagtctacttcacactgaagtataacaaatacattaattgtatgaaaggtcttagggttattttgagaaagaataatctctcaacagtaaatactcaattcttatcatatttatagaccatcttagcttcttgagttagctttttcttatagtggccagccatccactaacatgtcactataaaaggaaagaacatttatttctgtgagaaggcaacatgatctcatgaagcccacacaaaatttagagcccacaggttcaaattcaagtttcatctctactttgaagaagtcagctcactttagaaagtgatatttttctaacttgtaaaacaggataaaaacaatacattcaatgcttatacccctgggttgcaatttaagttaaattatgaaatgtaaaaggagtttctaaggtacatgtgttctaattacaattactgtatataattcaccaagaattatacaaattaaaattgacttacactcaaaatatgaggttgattctcttcaattccctgactcgccaggtataaagtaaatgcaaggccaggtgtggtggctcacacctgtaatcctagcactttgggattacagtgggaggctgaggcaggaggattgcttgagcccaggagttccaggctgcagttagctatgatcgtgccactgtgcttcagcctgagtgggtgacagagtaagaccctgtctcttaaaaaaataaataaataaaacaggccaggcgcagtggctcacacctgtaatcccagcactttgggaggccaggaggtgggtggattgcctgagatcaggagttcgagaccagtctggtcaacatggtgaaaccccgtctctactaaagatacaaaaaaattagccgggcgtggcagcaggcgcctgtaattccagctacttgggaggctgaggtgggggaattgcttgaactagggaagtggaggttgcagtgagccaagattgcgccactgcactctagcctgcgcgatagagtgagactccatctcaaaaaaaaaaaaaaaaaattccccaaagtaaatgcagtctcatgctggttctgtatttttattaatactattcaagacagtatattaattaaataaagattagggaaatacagtgactaatgttacctgcttagctactgtgtattagactttgtgctggggctttacatgtgatgtcttatcagtcaactgagatgaaatattgtgagacagggattagttcaagtttacaaatgtagaaactgggcccacagtggttaagtgacattcccagggccacatggatctgtctgtgtcccaagtccaagcttttttctgctgcaggatatctttttgagtagctatttggagctgcccttcaaagtaatacagtggtgatgtcctttatcttaaagctcaaaacttatttttaatctactactgctaatataaaaataactttattcataggtggttacaggatcttttaagtcaaagagcaccaccaccaggatttctactaaaactcaaatacaatatagaacaggaaatgatttctaaatacccaggaaagtaaaagagacaactattcagccaaactattgctatttctaagtatacaatattcaaagataatatggcatatgaaagaagaaaagaaaatgtatcctctagtttgctgctaagcctgagtttctagggagcattacaatatgtaatgtagaaaccaggactttctgtactctgttgcatttctcaatgaaaggcaatctgagctgcaccagctttccaaaaatatcacatgtgttggcgtgctaagattccttaaactgaaatttgaatcaatgttttttctttataaaattggtttcacaactaccatgagaagtttaaaatgtaattcccaaatactattttgcttttaattatttaaatgatatggggaaaattcataaatttggcacatgaaaatactctaaaagaatgtcaagttttcatttttcttttttaaatgattactaatatggttaacttttattttctttaaaagattacaccagtcatctttttaccgtattatctcttgtacatttagaagagaaaataaatcttagcgttcaatttatttctgaaactcataaagacttactttcttacctattccctatttagtaattctgcataacttaatactgttacaaacaagattaacattcggacattaaaaataaactgtatagtattttaataaaagtttgtagccagttacaagtcaataaaaaccccagtagtttcagaaagtttcatcatgtatacaatttattagtttcactatagtgacttcaaaatgaaagactatcacttagcatttatttaatacaatcctggatatgataccagtgattaacaggtcttaaaatgccctgaattttggccttggccttttaccattggagtttaaaggtgcaaaattatcagttaaatcctgtgtttccttttttataaacagaaggcaaggtcgaagcaccattttcaaaacaatattaatgttcctcaaatagcagacctttagcaacaagaagatacactcagcaatgactttagcatatgctcacacagtatgactcagaccatgaagcatatttggaagtcacattaacaatgtggatgctggaaaccaaattctagttttccccacttaccagctgagtgaccctcggcagtcagcttctgcaggcctgagttttctcaactggagtgagcataacaacactgaagttttagggttgttttgatgattaagtgaaatgtttgcaaaatgcttggcagagcaagtactcaataaatacttgtgaaaatgatgcttattataataatgtaatttttttatattgattctcaacctaagctttagcaaaagtagcactgattcgcacaagcaggacagaacataaaaggtattgccatagcctgtatcaccaaatagaaaaaaattatgattagtagcaatttggtaaagttactatttatctgggttgcattaaactgaaatatttatctggaactaaaatctttttcacaaatgccatttgggttcatctggtttagacttctctttaaaaatactaaaaacaattctattagcctgggaccttataaaaacaacaaaaatgaataggggagaattaaattcatggaattaatggaacatggaatgagctatatgcagttttctaaccagttaaattaggcacaaatatatatgcaaaaatataactatatagctaaatgcttattattgacccctcatttagaagaagcaaaaggtgatgtttccatctggttctggttatgtggttttggattctgtgccatcctgtaatctctttcgatgcatcagtgctggtccttgctctatactgggtagtgctgattcaggttagaattgagtaacacctgtctaatattttgagtacttagaaattttagtttacttgttgatatttgctcaatgtaaagtaaatccagtagagagttttcatcaactacttgcccccagctctaaaaacttcattctgtttacaattaggcaggtttatgaagatttcgaaatgtgactcttctttcattttaaaaatgctgggagtagcttcatgcaaattatttctatgactgtcttattaagtactctccgcagtggtttagatcggaacagaacactttataatctggaaattctcttgaacactctctttctatggctaagcgacatggattttaatatctgactccaagcagccactccactcttcctagctcatcttagatagtagaatcgcagcatttttttctgccggtctgaactcaggcacgctatttgttcatctacttactcaaacatgtattgtgtgtttactcagtggcaggctctgtcctaggtgctggggatggagcagtgcagagagacaaaaactctgctctcataaagctcacaatctacaacctgagagaagaaaaggcagtaagtgatatggaggaaaatacagcaggggagaaggagagaggggtggaatgggagcggtgtgtcactttagaggggatggacagaagaaaacctaaagaaattgagcaaggaggccgtgcatgctgtggagggagcacactttagaagaaggcttgacaggtgagagaaccgcacagaaggagcatgctggcatgttcaagggccagcaaggaagcaagcctgcctggagtagaatgagggaggggaagcgtaggaggaggttggggagagcagaaagcagcattgggtcatgtaaggccttgtgggctattttaaggactttggctttaattccgaatgagcagagaagtgattagagggtttttagtggaagagtgacatacgctgacgagtcttaatagtaaggctcaggctgaaagggaacaagggcagaagcagggaacacttttgtgatactttaggtgagaagtgaggtgttttacagtagagcaacaggcaggagaattggtgagacgtggctggattctagacacatttcaaaaatacagctgattttgttgatggagttaatgtaggatgaaggcaaaagaggaattaggcatgagggttgaggtcacaatggaaagaatgagagctgaagttttattaactgagatggggaagactgtgtgaggagcaggtttgagggaatactcagcaggtcagttttgaacatgttaagtttgatttgtttgtgtgatatccaagatattcagtaggcagttggatatatgaattttctagggtccagaaaaaagattttggcctgaagtgtacattttggcatacccagtgtatagatagtattcaaaaccgtgttactgcatgaggtcaccaaaagagagagagtttatgaaaaatagaataggttcaggggcttggccctggagtactacaatatttagaggtcaggaagatgagaagccatcaaggagaatgggaaagagtgtccagggatgtaggaggaaaacctgaagttgtgatttcttagaagccaagtgaaaacattattttcagatggatgaaatgataaactctgtaaaatgctgttgatccaataagctgaggaactgaacaacagccttagtaatgtgatggaaactggtgacttgatcatagcaattttggtggagtggaggggtaaaagctggactggagctcattcaatggatgacgggcagaccaaggactgcttcaagggctctttctataaaagaaagaagagaataagaaaagtagctggaagaggaagtggaatcaagaaggctttctttgtaataggaaagaaataatagctttgttttgttgatggaaaaatatcaacagggaaggaaaaataaataatttgagagagagatgggagaattactggatggtgtccttgagttgatgagaagtggggatggagcttggtgcacaagtggagggactggcttttgctagaatcgtggatagttcaggaaaaggaaagatgtatgggcagaggagcaggaagtggtgtgggtgccgtgctgggagctggttgtggggtggaagttctaattgcttctgtttttttcagcgaaatatgattctaggttatcagctgagagtaaagataggagaggaggggatggaggtggaggagggagaaggtgtgaaataataatccaggagagtgggagagatagcagttgagggtaagacagtatgattggcaggcagcatgaagggtctgcttgagcatcatgatcaggaatttaaagtgagtggaggtggcatgtgtgtgtgttcttctgcagctacattcagacatgggatcacatggagagttatatatagccaggaatgtggtttagctaaacacatatggcagaactagagaaacacaagggaactgaggatgcatataaggtaatgaataaaataacgataaagactatgcataggattcatgccaagtgaggagataagtgggcaccgtgaaaagatgaataggctctaactattaaggattgaaggatttctggagttggatgagtagattagcaagagagtaagtgctgttcagagggttggatgcttaaaattgaaatactagaggaagtttataattattggaaaggaaaatgtctagaatgtgaccatggaagtgagcggataaggtagagaaaagaaggaatcattgaggaattcaagaacctgaacacctggagttttggaagagtcacctgtgtatatgtaggagaaagtggcagtgagctagaagctaaaatcttcaagggacaaggaatggcatcaagaggatacaggctgatgacatcaggaggtttaaaaagaggaggaagaaaaatagtttaaaagagtttaaaagagtggtgagaagcaagaagcaaaatagagctcccccaagttcggtgattaataggaatacgagatccaaagacactgcttccctgaagtctactcaagtgaagtatgcatcacttgagtagacttcagggaagcagtgtctttggattctagttagagcaagaagcttaaaagggatatttagagaacagatttagcccagagtatttgctaatgactacacccatgcattctaaaggatcagtgtgggagttttgggaaatgggaagtgataggagacagaatcagaaaaggaggtatacagaagtggagagggataagatttgcagggatgatggtggagttggtgactatcataaacagggatagaggacatgataagtttagcccagacagtcccaagcagatagcaattgtgactttgtggaaactatctggagaaagaagtggagggaatctctccaggagtctgtagagttcaggagtcccatcttgatttttgctgttggagacaaagagaggaaagatcttaatgcaaatatgcactcactgcaattcttccagtatgcactacaaacacaggtggtgtgtgagatgaggtgaagctgccattcctgcctagtcatttttctcctggttattttctttgtgcctttaagaatcttccagcccttttgcagtagctgagattttgccaactgatgttctcatattctgttttatggctgatcattaattcttttattattattattattatactttaagttctgtgatacatgtgcagaacgtgcaggtttgttatataggtatacacttgccatggtggtttgctgcacccatcaacccatcatctacattaggtatttctcctaatgctgtccctcccctagcctcccactccccaacaggccccggtgtgtgatgtttccctccgtgtgcccatgtattctcattgttcagctcccacttatgagtgagatgcagtgtttggttgtctgttcctgtgttaatttgctgggaatgatggtttccagcttcgtccatgtccctgcaaaggacatgaactcatccttttttatggctgcatagtattccatggtgtatatgtgccacattttctttatcccgtctatcattgataggcatttgggttggttccaagtctttgctattgtgaatagtgctgcaatgaacacacatgtgcatgtgtctttatagtagaatgatttataatcctttgggtgtatacccagtaatgggattgctgggtcaaatggtttggttctagatctggttctagatccttgaggaattgccactctgtcttccacaatggttgagctaatttacactcccaccaatactgtaaaagtgctcctatttctccaaatcctctccagcatctgttgtttcctgactttttagtgatagccattctaactggtgtgagatggtatctcattgtggttttgatttgcatttctttaatgaccagtgataataagctttttttcatatgtttgttggccacataaatgtcttcttttgagaagtgtctgttcatatcctttgcccactttttgatggcattgtttttttcttgtaaatttgtttaagtttcttgtagattctggatattatccttttgtcagatgaacagattgcaaattatttccccattctgtaggttgcctatttactctgatgaaagtttctttcactgtgcagaagctctttagtttaattagatcccatttgtcaattttggctgttgttggcattgcttttagtgttttagtcatgaagtctttgtccatgcctatgtcctgaatggtattgcctaggttttcttctagggttcttatggttttaggtcttacatttaaatttttaatccatcttgagttgatttttgataaggtgtaaggaaggggttcagtttcagttttctgcatatggctagccagttttccccacaccatgtattaaatagggaaggcacagcttgagcagacttaaacgttcctgcctgccagctctgaagagagcagtggatctcccagcacagcactcgagctctgctaagggacagactgcctcctcaagtgggtccctgactcccatgcctcttgactgggagacaccttacagcaggagctgacagacacctcatacaggagagctctggctggcatctggcaggtgcccctctgggatgaaacttccagaggaaggaacaggcaggaatctttgctgttctgcagcctctgctggtgatacccaggcaaacgatctggagtagacctccagcaaattccagcagacctgcagcagaggggcctgactgttagaaggaaaactaacaaacagaaaggaatagcatcaacatcaacaaaaaggacgtccacacaaaaaccccatttgaaggtcagcaacatcaaagaccaaaggtaggtaaatacacgaagatgaagaaaaaccagggcaaaaaggctgaaaaaaagattctaaacagttttttcttccctctgtagaagtttcccagtactttcccacccatccctccctcccctcctggatatcttcccgtgtctctctctctctctctctctctctcttctctctctctctctctctccctcactcactctctatctctgtattgatgattgtaaagaagtaaacaaatcctatgatctctagtcttttcaaggcctcttctcttatggaatacatagaagaaaagaaaaaggaaaccttattttaaaatggcaacttcttcaaattgggaattctcttcttagaaaaaaaggaatttgtgtagaagagaattcgtcagaattaagcagtggttgtcagattgatgtgggcatgatcagagcaactgtctgtgaatgaagctgcatatgtgcaagtgtagagcctcatgtggcagttgtttttagtccccatactcagttcattttttacctttttcctcagaaatgaaaggtcttcagggtaggataaaagagaccaagatgcagatgagcaagagcccataaaggcacaccttggggcataaggacacttccccattccacaccccaccccaccccctaaactgtcattacttaaaaaaaaaaaagaaagctctttatgcaggctggagtgggcagaggggacagtttgaaataaatctctgcacctcagtgggtatgcagtcattgctgcagtcagtgaaggctgttactgcccttgggaaaaagagaatttgcaatgtgatatttcctttgaggaataaaggaagacagcaacagtgcctatgggagttagaggagggaagcaggcagagaaaaccatttatcagaaagttgagaatatagtttctcatccaaagtaacctcagaagtttttcaagagatttgttgttcaagttcccttggaattataagtctcgatgccaaactaatggtcactttggccctttttaacaactctacttttagtgaaatttttgcatcttaaaaaagacactagtttcttattaaccaattgtgtccccagctagcagttttgcaatatgcagacaggaaagcaagtcccgcaaactgggaacttggaactttagcaacacaggaaatttgaggggtttacaaagaaaagctcacagagtatacaaatataaacagggttaaaattaaacttaccagggagagacactatcactgacttacatgaacctatttcaaagaatgatttataaactagaatttaagcttcagtgtcatataacgacaggagcacagtgttggaaagaacaagacccaggattgacacataatagatatccaattaatatttgataaatgaatgattgagtggatattgggccagccacttaaatcattctgaatctcaaattatccattcatgaagtgggaaataataatacctgttatatcaaataatagtttattgcatgcctattacatcctcatcactgtgctacagtgtatgtgttacatagtgtgtgtgcgtatatacatatgtacatatgtataatcttcacaacatacttctctactttaaaaggagacgattgggtcctcagatgatacatatgaaaatcaattgtgttgtgcacactcatttaggaaaccaaattatggctctgatggttatatttacatagaatttggttagcaaagttaggctagccacaaatgattatttcacccacatcagagtagatggacggacaaattctggacaagtactaacaagtatattccttttgattttggctatgaagtttctaattaattgttataatttcttttagataatttatagtcctatgggacacaggaaagcttctaatacttaggaaggttctagtcatgcctccttaagcatccactctgctttctagatggaaagatccacatattattaggttctatttacaaaccaactcttaagacaacatttcttctacttatagggggaaacttcttttggtcccctaagaaaatacatctgtgtgcctcagtttgagaaaacctgcatcaaaatttgaatgttccctttaagtgattccttgaaataaacacaatcagaagcatgatcaagaacaaaaaattactaaatgttaattaaatatgattatccagatgacccagaatatgcttctattaatgtgtttcagattggcactaaaataaacatgtaaaatttaaaaattgtcatagaactctgagatccttaataacaaaggctatttaaattaagtccttccttcagaatctagtttccccttgtatgtgttaatggtaaccaatttgggcctcagagagtgaatgtctcctgattttgtttccaaagatggatatatttatacctgacttgttcatgcactgacttgcatttgctgacaaaatgtagagtacctgggtgaattaagcaaactcctatttaccttcatactgtacacattattaattagcccatttattgtacaaacattattgaagtgcaccttttttgtgccaggtactatattaggtgtagaggttaccagtattaataaaatttgaccatttctcatgaaaaagaagccttgttgggaagataaacaggaaacacacaaatacaataaattggttaaaagaaccaaattttatgattgctcagaggagaaagtgactaagccagcttgtgtgtctcagacatacctgaaattgataccaaacaccatttataggaattattttataatgatggaaaacagagtaccagggtgttatttagaagactcttcaaagcttttattgtctaatgctccctcctctctcttcccacagagtccagcatgccaaatttggcttatttttaattaaaattataaaaaatgtggagaagatcggaagtcattgtaatgctctaataatattaccaaacttttatattgataccttgaaatatagacttggtttctagcacaatgtttagcaaacaataaatagtcaacaaatgttttagtatgtgaatacttgaatttagttactatttattgaatttaagctatccctagtctattaatttgaaaactctgtatcatgttttatccgagtttagtattttgttcaaaaatatttctttacttgtgcctcattagaagcaggaggatagggcacacactggaatctgctgtggaatttctttagttctagcctccctttttgcttcctttccttcgaggtcctgccacctctttcttctcaattccgatgtcaccgttggtgcctggaggcatctccacttctggctgtctcactagagaattctcttgtttcatggtacatactccttcccctgcttgccaaccttgataaattctatgtcagtaggagaaagttcaggtttttaatgccctcttttaagatgggttcattgaaatgttaaatgagtcagtgataaacatgcagaactaagacctagtcttttggattgtatctttaaaaacttctagaaattatactcttattacttgtcatctgatcttagaaacacagaattttgttattacttgtcatctgatcttagaaacacagaattttgttactgtaaaaaaaaacttaagggagaaaccattctaaaccctttgctccatttttacttagcatttacttttatttatttatttatctatttatttacttattttgaggcaaggggtttgctctgtcacccaggctggagtgcagcctcagcttcccaagtagctgagattacaggtgcacaccactgagtcaggctaattttttagttttcattttttgtagagacagggctctctatgttgccaaggctggtcttgaactgctgggctcaagcaatcctcccgcctcggcctcccaaagtgctcggattataagcgtgagccactgtgcctgcctagaattcacttttaaatgctgagcttggcatgcatttgacaccataacattctacaattcattttaatgtttttttttttctaattttgatgtatttggacattaaatatctacaaacctaaaagaaataatttttagagactgagatattttctattaaaaaatagagctaatgagaagttgaggtctaaagaaaataaaataggattatgatgcagaggccattggtttttgtgttacggaggccagggaggtgaaaaggggaggaggtttaaaagtgcagtttctgagccagaatcaccaggtagttgataactcagaatgttcagttcaggattatatgaattaatgcaattaagcacttagaacagaacctgacacagaagaataaactctgatacattttagctattatttaaatgatttgccactcacttttaaatttaatttttacattcctttaaaccatgactattataataagtagttcagataatttttcttctttgagccttatagaaatgttttcttcttatacatgttaagccaactactaaagaaataatttacctatgtaatcttataaaaattaatttaaccaaagaaatgagagaccacatgaaaatggcatttacataggagagttgaggctgggtatggtggttcacgcctataatcccagcactttgggaggccgaggtgggaggatcacctgaggtcaggagtttgagaccatcctggccaacagggtgaaaccccgtctctactaaaaataccaaaaaaattagccaggtgtggtggcatgtgcctgtaataccaactactcgggagacggaggcaggagaatcgcttgaacctgggaggcggaggttgcacgatgagttgagattgcaccactgcattccaacctggacaacaagagcaaaattccatctcaaaaaattaaatgaataaataaataaatagagttgaaatgttcagtagtaaaattgcaactctttaaattattgacaagggtgactactaataaaccaagctccttttacccatctacttcctaggttttattgtaattcaaaatacttaaaaaaatacatcacttttgcatacgttaatacttttgctagcctacgtaaacgtatgttgaactcaaaaatgctcaattcatctcatcacatttagccaaatcttagtgatggaacattggcagggctgtggatggggagagcaggaatatatacatgtattactgtttgcatgtaactgggaaataataataccttacatttgttttttacttcacaaattacaaacagaattaacctacattgtttgatactcttaaataactatctgaggtaggcaaagtaggacatttcccttttttactattgaagaaaccttaaatcctattgtttaggactggagagacagcacgggagctcagatttccttttgccctgtgcccgtgttcttcactctgccaccgtccctctcagaaccccaaatgtggacacgatttagccaatattctcaaaatgaagaattctgcttcatcccattgtcagtccttttatttgcatcacaacacccatctaaaatgaaaattaagttcagaaaactcaaataagtctaccaacaaaaccatttcttttcttttttaaaaaattttactttaagttctgggatacatgtgctgaatgtgccggtttgttacgtaggtatacgtgtgctatggtggtttgccgcatctatcaacctgtcatccaggtccaacaaaaccatttctaaatgtccattatcctcccttaaagtgatttttgtgagtgccaatgttttatttatttgatctaaaaggacatctaacttccccaagatgacctcctgtctcaggtcttgactaaacttcttttttgcaatccagagcatgcctgcatgtgcacacacacacagacgtgtgtataaaaagtttcaccaaaacccctcaaaatcaacagagtccacccacagtgcactctgtctttctttatgctacttcatgatttgaaccatgctgattagcagtccattagattgaatttatgacccgtttatgcatcgtgacctacagtctgaaatactggtttagcatttaattattttaaataaaaaagcatgggtctggaaatcagatagatctgagtttggattttttgctcttcctcttataagtggtagtgatctttgaggcaaatcacttgacttctgagaattttagtgtcatcatctgtaaagcataataaaatatgctgtaatataatatatgtaaaatgtaaaatataatagtgattcctatgtcattaacatttcttattctttcattcatcaaatatttatttctcagcactcataacctcttcatttttcttgattttagtaagattccgaagaccaatttttacagttttttcttctcccaggcaaatgcactaccatattcagtgtcattctctatattttagggattgcattatttaaaaaaaaaaaaaaaaacaacccttgatggggctagacagggagaaaagatcagtggccaaaaagggagctaccatccggggcgctagacgggactccgctatggatgaagtggagatcctggtgtggactatatagagtgacatcttcaaagtattcttattctagccctttttcactatgaaataatcgataacctgaacagccaaattccagatctcattgtaaatatttttaagttaatgaaggcttagtaaataccacattaaattatcatttgggaatttaaaagaaacccttgaagatctgagaataactaataaaacagatatactcttggatcacctatagtttgatttactttgttaaatcagaaacctgtggagaccagccaaggacacagtcagttcagttaaatgtgtctgacaaagatggcgcattgtgtgctttgcttttcctgatcttcataaaaaactaaatccttaatcccaccgcagtgaataagtacccttggtttagagaagccgctgtggaagagaagggaaaagtgcagataaaagatatatgggcgtaaggactgagaagggatagagaacatgtaaatgtgtcattttcatttttaattggattttttcttcattgtatagattatttcttttgccaatgtcatttatattaatggcacagtgaaactgcagtaatatttcacatctatttgtatctacatttatggcacgtatttcatcttgagaagagttcttggcttgggggaatcttgacactgaagtccattcagagtggtggtgaggactgagaggacaagttgcactttccttcacaattactgcctttggatgtgcccattttctctctatctctttcttctaacctctttcaaaaactttcaagaactcatatattttaattgccttctccaaaatatttacattttcatacaattaaagatgttatataagttagttgtacttttctgatatgcaaaagacagactgtgaaactcttcattcaacatgtgccgtatgcaaagcagggcagacagagatctgaaaattaaatcattgacaatatatgctactgtgtagttgattttcagttgtttaataataagtatttgggggccaaatatttatcgggacaaaaattacataatgtgtcctttacttctcccttagaacctagcactgagagctgagcacttagtgggtacctagcaaatgcttatggattaacaaataaatttgtattaattatgaatttataataaggtgaaaaacagtttgatggatgatgatgcaaacatttaaccttcatgtaagtttagccatatcttcttgaatctgttcctcaacttttccaaatggactcctctgtggtttttctgtatatgtcagaaacactcaaatggttccatgaaaatttttattggctatctgttctacctggggtcatccactagctttatatgatcacagaaaggcagtcaatggggaaagtatttcataaaatcagcaagagaagtagtgaacagagcttattataaatctgattatgaacaaaatgttaaaatattgctttataaaatttgatagaagtgctgaacaaaaaagataactttgttttttaggattgattaatgtgcacatggttgtttcagtgtagcattaccatctttttttaaaatctacctgatatttttagccattttaatggtattatatagaaatagcattattctgaagttgtggtatcaaagatgatatcatgtctggaactcacagatctgcaaagcccaatatcttgctcacaataagagctcaataaatatttgctgattgtttcaaaaaactaagtacatattattttatcaaaattaacttacataaagtcagtatcaatgacttatcaatagtatcctgctttagttgtttcccatttggtatgcagtatatataaaattgagagatatttaaatcattgctagaaatataacctgacacagtgaaactataacctgacacagtgaaactgatagatatgtagaacattgctggcagtgaatctataccttgatgcagcttccccaaattataatgttaaaattattccctcataaatttacatttcagtagaagactgttagatagcacatctctgaactataaatctgatcatattacatatcattgtcatgtcttttgcctctaaatttggagaccctatcaagaatatcaagattgtctttgttctctgactctagcatcataataagatcattttattgactgatttcaattcggtggtcaggaattaacaatgaaatattattattattactattaaatgtcacagtgtaagaaggacagtttctataaccttcatatttagtacaactttttctttttttacattctgagtatgactcacagtcattcttagataagtactcttctataacaatctacataatgtaaataatttctatattccatttcaaaatccaaaaacatttatgattagcttctgagattatttatgaaataacattttgtagcattacttgggtctatatgatatgtgtaaaacagtgtatttcaatttgcatgtgaaaaatgttaaattattcagtatcaatattagaataccgtctgtataagacaagtgggctatggaagctaataattggcaccatgtaccagctgctaaactgtcactttatttccattgctctgtttaagccttactactgtgtcagttgaagactttaatccttgttttgaagatgaagaaactaatatttattctatttttcaggttgaattaatattttcctcttgaaaatttgttcttgatttttaaaatcatattaattttcttctaagttttttccaaattgttggtcagtattttgagtcactgagtagctagttggagtgagttagttataatattaatcaaggtataactgttgtctgtaaatcccaggaggtggggagtacatcttcgtaagtgtgaaaagcgcttagcagagtgctgctttgagatacaaaaggactgaaaaaatataaagctgtacatgtcccagaaagtgtacagaattttattttgtgccagtacaataaatggtataaaattgttctctttaagtcatttaaaaaatttagagatttcttcgtttaaaaaaactgttgaaatgaagttgccaaaatccatgtttctaatgaatacttaccttattgcctctctgaatcaaaaacactgaaattagtctctcttaaattaatagattcaagattctaatgcaaaaaggaaaaaaaagaagagatcagagtctgtctgttctctgggttatatgcttgagtaggatcagggcactattttcctcattacttcacttcttaaagccttgtttgtttcttctctcagaatggactcaacgctctccatctggctgccaaggaaggccacgtggggctggtgcaggagctgctgggaagagggtcctctgtggattctgccactaaggtaacatttatgttggtagaacatttttttccttagaaaagcgaaaataatttaaagcttttcatttttatttattttttagacaaggtctctttctgttgcccaggaagtagtgcagtggtacaatcacggctcaccgaaacctccacctcctgggctcaagtgaccctcccaactcagctgcctgagtagctgagactacaggcgtgcgccaccatgcccagctaattaaaaaaaatttttttagtataaatgaggtcttgctatgttgccttcctgggctctagcgatcctcctgcctcagcctcccaaagtgctgggattataggcgtgaaccaccacacctcacccacttaaagcttcttttccctctcgtacatttcagaggttggctagaacaccaagattcttaacctgcagaattaaaattaaaaccccctccattaaactctgcagagtgaattgtttcatttaaggacttatgggacatcagtctgaaaaatctgtaaacctagtttataaaattttatctttcccccttcgattcacagaggatgagattaacataatcctttgtagacaatagcacctgttttcctacggttaactcattgtttaaaaataaacccatgtgggaaacttctctatggaaaagaacaagtaattttaaatgtatacattcagtttggtatgagactatgcagaatcgtttatactctaataagaaaagagattttgggtcatggattgaattgttagggcaatattagattttatcatcataatgtgtttggtaaggaaattggactcattttaaaagaaatgcacgggacgcttggcaaaccagaaactgttccttgatgctgcttttgctaaaacatatttgaacttgtcgaggattcatttcataaacaacagacatttaaaaaactattatgaatggcaacaatctttgcctttggaaggtaaaattttatttggaaaaatacagtgctaatcagagccaagtctgctgaccaagccttgaatgtgataatatggctgtggaagatgtagagagagaagtcaggcactctggtctctagatgggacactagtctaatctggagtaaacaaacaaacaaaaaagtacaagaataaattaaaaacatggccagttaacgtggatttccaatgcctcatgcataattgacaaaatgtgcattggttctgcttgtagtatagtaaacagcaattctagcagaaattaaaaaacaaaacaaactaacaactggcaattccacagaagtaaacatgtgaattcactatatgcaataaatttcttacttcgaacataaagagggagtaaacatttttataagcatttctctctggcacatcaaatacattttaaacaaatatttaaagaatatctatttgaagcccagtgtgctggctcacatctgtaatcccagctactttggaggctgtagcaagaggagcactcacaggagcctaggagtttgaggctgccactgtacaaccccaccatctattattttttgtctttttagtaatagccattctgactggtatgagatggtgtatagttgcccatgttaatatagtgtattcattaagccaattatttttgcctgcttaagtgtttattactatttttgtttttcttttcttctaaactctgttgatattttaaaaattaggcttacttttaatcatagaattgtagaatttcctggaaaagaatctcacttaaacagaaaaaaactgaagcccccaaatattaagtgagtggctaatgctcccacagtgagctggagacagaaagagaactagagtccaaactttatggcttggaatctactggtttctggtttttttttctttttgttatttattttaatcacatcataggtatttttaatctcttggcctttattttcacaaaaggtttaaattatttttcattggtgttagtgttgtggctggtaaattttgatgtagcaaatggtagaaaatcattggtactgttatgatttatgtaaaatttatttttcttattcccaacatattctcaagtgccccagtagctgcaaacataactataagcagctcgtttctctaccactaaaaattcctaggtttctttgcaaggtgaaagaaactcaatgtttcagtaaacctttttttagttaatatttctttgcaataggattctttagttgttaattaaattgcatgaatctcatgagatattgacacatacacacaccccccacaaatttttgattcattgaaaatacagtcattccgtgttaacactaaaccaatattgtgaaaatagaaaaggaagacactatatgaggtggccaatttttttttttgatggtaaaaaataatctcttcgtaagtgggctactatcttgataaataacaaattttaatcggttaaagtgattagtgaagttgaaaaatgcctgcacattttgatttctgcaaaattcagaaaccttgaacattttctattttgtttctccaaaacagaagggaaataccgctcttcacattgcatctttggctggacaagcagaagttgtcaaagttcttgttaaggaaggagccaatattaatgcacagtctcaggtattccattcagattttccctgatgtacatacatttaaattagaacagttttgtgaaattgatttaatgtgtttagctagctgttctactgataaatttattataagtgctttgttatttattttagccaaataattttattaacctttatgatgaagcttattttttcaacatataatctcccttttaatgtaacttaacactggaaaaatgtaagtctatcattgtctctaagtatttttcaaaagaatataaagtgatttttttcagaatgacagtgacatctgtgaaatatgaattattcatgcaagtttcgtgttactctataaaagtattctctttccgtaaatttaaaatatacttgaaagatttacattccagtggaaaatctgccataaggtgggaataacactactttggtcagtttacacccctaatgtgagctttactaataataaataggaaatgtatggttttaaaatgaaattaagaaaaaattaaacaataattatttaatcaaaattatactataagcttgatccctttttttttctggtggaaaaggggagaaaatgttgttttgcccaaagctttactcttgatatctattatatcatgtacgcatgtggggattgagaaatatatctttataataaaattcattctctctatttttagggttttctcctttgcctttctgataacacagactatatcatggaggatattagcaaaataagccagctctgttccatctattctttgggataacctcaccaggttgcctttgaaggccattgtgtaggaatatgtattaactgtatagttcattcattaattacctaggcatggctctagttctatagatggcacaagttctggacctagaaaatacaaaaggcaatggttaaatcagccctattttctttgattttaattttgggaaaaatctgttgaaattatgatagataagacattatttttatctttgtaatatcatgctattttaattagtcatgtttttttccttacaactcaaaccttcagttggatgcacatcaatgttttaatatgtattgagaatatgccttagtctaaaacccttattagatgaaatttttataatttggtaccatctgtaaagaacatctgtatattttataaagtataacagcattttaggcttggagagaaaggtccctgcagaagctactgctccacctaagtgattcaaaacttttctttttcaaactttattttacttagattcaaggggtacatgtgcacgtttgttacatgggtatattatgtaatcaaatagtgaacattgtacccaataggtaatttttcaaccttcagtcccttctccccctccccacttttagagtccctagtatctattatttccatctttatgtccatgtgaactcattgtttagctctcacttctaaatgagaacatgctgtatttgactttctgtttctgagttatttcatgtaggataatggcccccagctccatccatgttgctgcaaaggatgtaatttcattctcttttatagctgcctagcattccatggtgtatatgtaccacattttctttatcccgtcaaccattgatgaacacttaggttgattccatgactttgctattgtgaataatgctgcaataaacataagggtgcaggtgtcgcatgttctcactcataggtgggaattgaacaatgagaacacatggacacaaggcggggaacatcacacgccggggcctgtcagggggtggggggctaggggagggatagtattaggggaaatacctaatgtagatgacgggttgatgggtgcagcaaaccaatatggtacatgtacacccatgtaacaaacctgcatgttgtgcacatatatcctagaacttaaagtataataataataaacaaaagagtgaaggtgtcgttttgacgtaacgatttcttttcctttgggtaaatacccaaagtggtattgctttgggtatttacccaaagcagtagggggattgctgggtctaatggtagttacgtttttagttttttgagctatcccaatgctggaaaacctttctttatatcaagagaacatctttttgctttagacagaggttttcaaactttagtctgcatcataaccacctgcacggcttgttgaaacccatgtttctaggctcctccccagggtttctgattcagttctggagtggagctgggcaattttcattttttacaagttctcagatgatgctaatgctactagtccagggaccacatttctgaactatggctttagcaaatgtgaggggaaactgggtgtaagatattgcagtaagattcacaaggtatagattcaactacatgactgaatcaataatgtacttatacatcatgaaaatgaaagcctggttaaattcaattgttcagtggaggttctcctgactttgacaggaaattcacctatacattggtgctgttaaaatctgtgaaaagaccatattttactttcctcaaaatgacaaacatagtgttgttataaaagttgactagtagcaaatgctgcaaggtaaatgcttgttaaagctgtgataccagttattacacagtagttattggaaatgtatatgctttggaggcttctcacggagaacaagctaaaaccatttaatcattaactcgctttcagagtcagaggcttttatttataaggtataatcatgccaaattataacagatcttaaaagaagggttgtatcattattaagacgttaaaataatcctatttgtaatttatactattaggtcaatttaagatttatattgcaggggattctgacaaatagcttcaaactaacattcatattgtgcgaaagttttagaggaagaaaaactagtaatcaaattttagaatcttttctaaatgtttttctaagtcttttgataaggcctatgacattatttcctgtattgaatttatgtacccatcattaatagttgaaaaaaagtattattacttagaatattttataatataatgattaaaattaaaatacatgagggttgattattttaccccctgtgtgtgagccaatcccaaaactgatggtttcagagccactgagggctgatttgagttcctccacagatgttatttccctcagtactgtcttatgtaagatacaggattctttatgtgacaatatggggtgtcaagtggatggatgggagacttgcttatggcagttaaacaatctcttccttttgagaaccagaaaaaggacgtagggaatcctgaatgtacaacaaaatgtctgaattttgtattcaagtgataccttcttccacatctttctaagaacataatttaaaccactgaaatgcagaatagtctgaaattataggaacattggcagctgcctagtactatgcctttggcaaacttccgagttatttgcaaacagactgctaaagttatttttgaattaagaagataacaaattttctgaaaaaaccttcaaggaatatattcagtaaaatttttggaattataggttatggggaaatacacacttacggatttttctgcattttgcatataaagtatgagattcatgtgaggcttaccgccacatgatacagtaccaattttggtagagagtgtccttggttcattaagagttccagaacaccagctggatcaacttcagtactttaaatggtatagtgtaattgatttagtaacaatgaacaaatgtttatttttgtttctttgttcaacagtggtatcagtgtggtctctgctgagccagttcttggtgtgattttaagtattgcccctgaccatgtagctctctggcttggttctttggtatcctagattcagtgacatggaggtctcatccatggtgccggaattatggagttagaagtcaaaatcatagagttgaggaatgttatttgctttgaagatgattttttgctttctgaaaacaaagtcacttgcagaagatctttagtaggcatcttatcctctaaataatcctacatacgtgatgttgggatgatttccatttaagctgtatgggacatttgtttggtcacttttataacctgtaagtctgttagactcagagacattacttttaaaaaaatgttcaaatttcaaattctatattgctatcaaagaaactctacttagaaagtttttaaaaaatattctcaaaatcatgagtttctttaaatacttgtagcactctttgttgacattttgcctattgatatttgcctatctctgattgcaaaaaaaaaaaaatacatctttaatttctccaagatggtaaacttcttgggagcagataattttttctcacacttctttatagtttcaggattatgcataataccttgcacatatatgattggaggatgaatatatgcatgtatactctttatgtataagtcttagctttgttgtgtattccaataactcctaacagtagacattaatattaataataatacaggtaataacattgactgccaggcattgtctctagtgtgttgtgtacattatctcttttgatattcctttactttatcattattgatgacaaattgagactcaggtggctcatttacttgcccataatcttcatccccaggcaatattgcttctcatagttcccgtaacagttctaccttctctacagacctcaaagaataatttttaaaattcctttttcttctagcccaaatcctattcaggtccaaataagctgattttcttaaagtagaatccatgtaaaaggtttaagatggaatttctcacttaatattttttatgaactataaatgtcctgcaaaatgttcaaaaaatgaaggatattctgctgttaccaccaaggaaatctggctttagaatttcccccttattattttctccacaaaaaaaatataatttttagttctcatataagagaattttttctttagatacttattattaatatattctctaattataaaatcattaaaatcggaaggagcactctaaataaagcaaaattgtcttaaaaatgttttttattattacaaagcaaattggtttatataatgtatatttttacatgataaaaaaggtaaactggatcctagactagacaccatcatcaaacatgagaagctaagcaaaattttggagaatgggtatggtaaatttcccttccttttaggaaaatatgacttttttatagaagaagggaagggctagaagttctcatgaggctcctcaagaagtttgtgtctggggcggtcagtctgccttggagcaaattccagtgtcactaaactacagcccagtaataatatcttgcattcagacccttaattttaaattgtatttttatttatttaatctcatttataattatgtgaatcaacaatgaatagtctcattttggacatggaaaaatttgaggcataggtaggaaaaccaaagtctcataacaattagtgatgaagccacaaacctgtggtcattggtacggacaccttccttccaaataatcctaggcatacctcagtctttcccactaaactgttgtacaccttctacttgaattagggaagtccaaaaccctgcttgcctaggcgcttagatgctgctataactaagagccttccgcaaagctaggcaactagtgagtaaagcgattcaggtgtactgggagggcgtatccataatctgggcttcatacaaccatccacctcttagactgttcttcaatcaaacaaaatttttaacatgtgtaagacttggccgggtgcagtggctcacgcctgtaatcccagcactttgggaggccgagacgggcggatcacgaggtcaggagatcgagaccattctggctaacacggtgaaaccccgtctctactaaaaatacaaaaaaattagctgggcgtagtggcgggctcctgtagtcccagctacttgggaggctgaggcaggagaatggcgtgaacccgggaggcggagcttgcagtgagccgacatcacgccactgcactccagtctgggcgacagagcaagactccgtctcaaaaaaaaaaaaaaaaaaaaaagacttaaatataatttctgaaattggtgatgtccttttcaattcatttttcttatctgtctctacattcttctacttgttcttggaatttcttgtttctgtcctctcataaggattctagaaacagatttgttttcttttcatcttattttaatatcaagtgagttcaaataagatgttcttacttggcatttttgatatctcactgaaaatttatttccatttttattggttatttttgcctgttttgtgattaatactcttttctttcaatcctgaaaatattgtttcaaaagaaggctttcctatttataactcaaggatgattaggtgattattttattagcttttggatttctacagaccacgactattaattccagttgtaagattatatcaccattggttacacccccagatttatgggggtgcatgcacccactatatgcaatgataaatgtcttttcagttgtggcttccaatagttttttcttcattggccctaacccattgtcacagacaatggaattgaactgtgaagaggaaggaaacacacacagttggtcagcatgcccattaccttgaattgcttccatatggtcttagagccatccttggctctgaaagcaaaaacttgtaatggaacattctgttctgtgacatatgcacagagacacacacatacatggatgcacacatatgcacacacacacatacacacacagtgtataaagtgggatctatagtcacagatttttttaaacaggttttattttcagggttttcccccaaaatatatgcatatggttcttttttcctcttttttaaaatttaatttaaatttattttaagttccaggatacatgtgcagaacatgcaggtttgttacacaggtaaacatgtgccatggtggtttgctgcacctattaacccatcacctaggtattaagcccaaaatgcattagttagttttcctgatgctctctctccccctgccccctgacaggccccagtgtgtgttgttcccctccctgtgtccatgcattctcattattcagctctcacttataagtgggaacatatgtttagttttctattcatgtgttagtttgctgagaataatagcttccagctccgtccatgttcccgcaaaggacatgatcttattcctttttatggctgcatagtatcccatggtgtatctttcttaataagggtcttgtttttttttccattgggagtattactatctgtaatacaaatcctttgaaattcaaatgaaggcaggtacttgcatttgacaaggaataaaaaagaagtcaggacacttgtgtttttgactctgaaaatcaggccactgggtgattacaaatttgcaggggcatctgtgctcctcagcactccaagttaaagaaaatatgctttttccagttctctatatgcttgggaaaaagatgagaatcgatgtctttaaagttttgcccaggctgggtgcggtgactcatgcctgtaatcccagcactttgggagactgaggtgggtggatcacttaaggtcaggagttcgagaccagcctgaccaacatggtgaaactgcatctgtactaaaaatacaaaaattagctgggcttggtggtgggtgcttgtaaccccagctactcaggaggctgaggcaggggaatcatttgaacctgggaggcagaggttgcagtgagctgagatcgctgcactgcaccccagcctgggcaacagagtgagactccatctcaaaaaaaaattgccaagaaagacattactattctctattccagtaaaaagccaacactaaaattactactctacaaagcgtgcacacgcacacacacacacacactcccacatcctaaaagacaataatattttcatttataataaagtaatttttcaacttttgaaataaaattaatacaattatattttgcctttatgctcatttatctggggacagatggtatggaaaggctgaatcctgcttgtcattttattctgaaatttgaatgaataatcgaagacatcatcacatctaaaatcttcggtagatgtctcatttatttatcactacacaggcctatccaagtccaatgttattgcattttaaaggaactaaatttgtagtcagttaagacttgtagggagaaaagtaaatggtctccaagttctgttaatagaaatagacttcaaattttacataagagttacttctttttctccccttctgagttaaaatgaaagataagctactctggtagtaaatggttaaaatagtactgtagcattctgcttcttacctcaaatctaacagcattaatgtgtatattccacaacaactaagaagctaggtgaaaccatcaagaaccaaaatggtgatcctttgaggcaaggatcacaaagcaaaaaaaaaaaaaaaaaaaagaagaagtaaaaacatgacacgaattaaactttccaatagaaactgattggaagtaataattcacgcactcactcactcagcaggtatttgggcatccagtgtgtgccctcgaacacttgctaagcctacaatgatgaggtgggcagggggcatgcggaagaagacctaggaagtggtaactgaacttcttttataaaagaaagtgttaatgcgcacatcagcggtcaggggatgaagtgtgctatgggcaaatacaatcatacatgcaagaacctaaaagaaatgggctatctggaagctgaaacatccaggggaaatgcagtgtatgaaatgaagcctgaggaagaaagtcagatcctgaaagattttatgagccatattaaggttttcgttctaagacttgtatcctaagcccaatatgaagctggcttgggggtggaacaagctcaggattctgttttggattctgaaaacatgaccctggtgcagcttggagaacaagtcgaagggagtcaggtgcaatgcaaagcaaatcatttggagaccgttgtcatgatctactccatataagaggtgatgttagcttggaatggagtagtagtggtctggatgatggagaaaaggggactgttataagactgattaaggaccagtttcagagcacttgatgatgatggcctatgggaggagaggaagacgatagtgtcaatagatctctcccttgcctaacagtatagatggtaatgcaacactataatataaaacagtgcataaagacaaagatttgtttgtttattttattttattttttttgagatggaatctcactctgtcacccaagctggagtgcagtggcatgatatagctcactgcagtctcaaactcccaggctcaagcaaccctcctacctcagctttctgagtagctaggactacaaacatgcaccaacatgctgaactaattttttaaatgttttgtagagacagggtcttgctatctcgcccagactggccttgaactcctgggttcaagcagtccttccacctccacctcccaaagtgctgggattataggcatgagccactttgtttctggttttgtttttggttttggtgaggagagtaagagatcatgaatagcatttgaactgcttgttatacatccctaaaagaaatataagtggttattacatcatttgatgtaaatggttattaaagcagtggactcgaatgagactgccggagcagtaaagacagtgaagaggcaaagggcatacttccccttcatcctctgaaggctggctaaaaatcaactaacagaaaggcagattaataggagaaaaggaatacaaatggattaacatacatgggagccatacaaaactataacaactcaaataaatggccagatgattgacacttttataccattttgaggatacagaaagaataggggcctggagcatggcaaaacaagttatgggagggggagaaggcgaggtctagctaacaaaggaggtcttgctatatagatgaaacctcaccagtagtagtagcccttggagaaaatagatggtgaatgtttctttcagacctttgaagatgtcagactctcagttcactttttctagatccagacaagggagggcccacagagaaagcctggctgcatcaatgcagattctctacagatgcaaatctcccccacaggacagctttgcagggctacttctttttgtaggccctctgaacggccatctcaaaatatgtcaaagaagaatatttgttatcgaaccaaactggggcccactcgccctgtatagcaataccagatatccacaccaaggttttcagcgggagaaaggaaggtgtttattggcagggtgcctaacaaggaggatcaggcagctcatgcttaaatcctgacctccctgatggcttgcaggtaaagatttttaaaggcgggggtaaatttcagaaagcagaagttacaggcaaaattgtaaatcaaaacatggaggttccacattggttttggcctaaaaggtcagagtatcttgaagcggaggacttacaggtcacagattttctgatttgcagttgggtaaggaagagaagctttgtttaaaaatgtagggtcagcagaaaagaatgttagcctgggttcatgggcatgacttttttcaggcccctcaggaggaagtgtaaaacaaagaatgttggccagagttcagtcctccgttcccccttaccaggggcttctgtgccagcagatctatttggtgggggtctgggtttctgagacagaactcagagacatatgttaagatgttagcttttgtgcctataggggaaccaaacatcttgtgattctagcttccttggctgctattaccttcttgctcatcaagtttcttatttacttctcagggttagctacatgcctggaattccccttgaaggaactcaagattttcctttatttctatgcttggggagcctgcaggtccctaagaggggatccctgctctgtcttctattttggggataaaatattttggtttcctttaccagcaagagatagaagagggtttatgttttagggacaattttcacattgaagaaaataagatgaagaaaatttgaggcatatgtcaaaaaaactgaaaaagttataataattgaccagaggactttgggtccttagtataaaatgagtaaaaagtagcaggcttggaagaattaaaatgagagctaatcaagtccagtgatatcagcatttgatttaaacctggactgtcttcagtttagcactggttagaagcaagaatccagagtcagataaactagatttaagtactgcttccatcactcactagccttgtgaccttggacaagttatctcccatttctgtgcttcaatttgcttatctgtaaaacaggtaaggaataattacagtacataaaattgagtttttgtgagggttgaaagaaataattatgtaaaacgcttaacacaatccttagcatataggggcactctacgttagttgctgttgttatatttattattttcattgttagcttcatgagcatgggaaggctattatactacctttgtgggaagcacgagatcagtttttgttggttctttaggtcctgaattactttccctccctatttattagatttattgattcttaggaataagaggacaaggaaatctaaattcattcaaataattcaaatctaaatttgcattcaaataaagaatattgcactcaaataaagaatatcagaaagaagcagaggagagcagtggaaataagtattgctcaacaaaatctataaggactgttgatagaaacctggtaacttaactgatggagaagagagatgaagaataaaccaaattctatacattcaactgtatcaagatagtcagatcagagatttggaacttctattcacagacaattataatctgccagactaggaaaggattcttgcatcaatgtgagcacaatgtatcgagctaatgataatttgtgcatcattcttgttcataactcactaacatttgacaattggaccaggtgcaaaggcttgagaggtggcagctcttttccttctttcacgtaatgtgccattgattaataatcaaacagcttgcattttggagtaagtctccacagacaacatcatctaagatggatgttttggtgttcttcctatttcttgaagttttttttagaaagatctcaaccttctaggttagcattgtgcattgtgttttgaccaaaaattgtggaagcaataaaatgtagatagtgttttaactattttgaagacaacttttccgtaaacaaatgcaaatattttgctttacttggggggtgtgagagcctcttacattcttcacatattatactcttaactaaatcacttcagtgtataactggaaggggctattagagacattgtgtccataacacttattacaggaatttgaaattcacagggtcaagtgtctcatccaaatttgtgtcttctgatatctggctaaatactccatatgtttgtaacatgaatatattctattttaagcaatcaaaacaatgcaaaagtatatggagaacaaacctaattctccattcccaactttcaagtacaatggcctttctcagaagtattttttttgttcctttctatacagttaaattctctttatgctatattatcttgctttataaacaattacatctttactgctccttaatggagttctccagttatatatgtctaaaatcctgaaaagcgtgacaatatttattgacaatattttattacagcttaatacataatttgcatagatgtcaggcattgctttcttcattttatacagaggaaactgagagtttaggtaactgcctatgtaccaaaagtgatttgatttaaaccccaaactttgattaattacataatcattcttgaaagatgaaaattgtaatctgtattatatcttatttttttcaaagttttcatatttggtgcaattactaataactttttttcagatattattctttagtgtttatttcctttcttaattgggaagatatgcaaagcccagtaattgactaaacatggtaaatataaatttgaatgcatgtacaatacagttagctatagctattaatacctatctatgtgtaataattggaatcctctggttatttctactctttatttctactcttaaagctatgaagaagaagtttttaagactttaaaatggccagcgatctcttttgacattgactgaggtaggcagcatagtgaaatggataagaacgcaaattctgaagctaggtggtcaaatcccagaggtcaaatttcagctcttctgctttctactcatgtaactcatgagctattctgctttctactcatgtaaatgtgtctcagagttctcatctgtgatagggggatcataataacagtaccttcagcaaacagttgttgtgagattaatccatgttcggcatttagaacaatgcctggcaattctaagagctcaatgactgttagctgtcattgttaccaaattcagcactagtgcagccatgcaagaccagccattctgtatgcccactgctgccttttcttggcacaatgaagaacataacaaagtcagtttgtgtgactggcttgtttcacaacctccttagaacactgtcaatttgagtatatgaaattgcattcacctaaacacaatgcctaaagacccttaagtaatttaattgttaaaacacttatagtatagacattgatctcctactgagacttgaagcttcaagctaatgggaaaaagaatgaagattctcatcttagatagtctggatggtgaaaatagaagtccaactaacaaaatgtgttttaaccaaatattatttttgaaaatcactttcagaaggtaattctaagtctggaaaattctaaatggaatatcacaaacctaaaatgtattgtgtttacatttgcttgtgtcataatagtaaaatgatttttgaagtgtctataatataatataccttagaacaaagtatcagtgaagctaaagtcacaagtttaaaaatgtgaagaaccaattttaagctgctatttaaaagatatctaatgttcttgattatatgggctaggtttctataaatgtaaagttccatgcaacacctgctatttgggcaaatactatgtgggcagctgtctcaaatataagtcttgagaagggctaataggtcatacttttatgggtcagtgtagtgttcccctataatataaatctttgattcaatattttaatattcaagtgattcattaatatatgcaaataatttacattgatttaatttaaattttaatctgcaaatatgccctctggaatcagcccgatattcctagttggctagttttaaaattttaaaattaattccagattaaatagatcaatagattaaatgttaataattgttgaaaagcatccaactaggaatatcaggttctttgcagaggaaacgttccaaaaaccactgcaaacatcagtattctcattaaaggcagtaacaagaaaaggattcctgtttgcgatactatttgacattgcaatcaatccctagccagtgcaatgaaaagagaaagagaactatgaatataaatggaaaaagaaacgacaaaatgctgttttatttattttttttttttattttttttttaagtacaatttccattttatttttctccagagaatagcctgtcttcagtctttaagaactcagctccttacatgggctttggtgggggacgtggggcagcacccgcaggtctaaatcggggtgggggtgttcggtccttgcgggcttcacgagatcgattcctgactactttgctgtgaattgcacaactcacacagtaatgtagcttcacatacagcttgggaagcacataggcatcgaagacgctcgcttcagaaatgtccctgactgctgcggcctccactatgtttcgaatgacgaatttcttaatggccttgtccttgggcacgcatcgggcacagttagtgcagcgaataggctgcacgtggccgcggccctttttggcacgaccattgttccttcttttctttgtcatcttggaggcacggaccggagagaggagccaaaatgctgttttatacagaagttatgattatttaaataaacaatctggaaaaatctacaaatcaattaataaaatatttattacattcattaatttattaagagcctgttgcttataatattcaataccatgaatcacagaattgttttgtcatggtatttgactaatattttcttcagcctaaaggttgacatgaatcattctgtaaaaaatttattactaagagtattaagcagcaagtttttatgtatgagcatggtaggttaggactttaaatatcctatctgaaattagactcgtgaggcaaaggtcaaggcatcagagggtgcttgcatgactaacttcaactatattttttattcttttcaaatcactgggaaatttttgtgtaataattttgaaatgccatgaaatcatatcactgtgaaagtacacatcatttcacttacaaaaagtggccctttagaatggtggatttgcaggaatcaaaacacatgtgaaccaacaatgtcatcaaaagacatttattaactattttattgtacaggagactctcctgtatgttgtctgaacataactgggtacaatcttttaaatcataccccttaaaaatgttatgtttaaataacatattaactggaagacatgaatagcaggaaacatacataatataataaaaccttcacattaaaataaaaaacaacatgggagagcaaaataaagacattactaagtgaggtaaatgcaggagcagggcaaatcccactctacttctgaacaggagaggaaaggcaatgaaatatgtttcattaatccactatttgtgtgaccttgggcttattacttaacctcttagcgactccattccccatctgtaaagaagggataatagtatttactacagagggttgatatagagattaaatgggttagtacacttataatgcatgtaataagtgcaatataaatgttagccacttttctaatcattagatatatttgtattatctacttaagttattgaagaaataaattgactggagttgagaacaatattgcccaaaatggctaattctccattgagactgagagattactattttctggagtggggagtggagaaaagattgtacagaagtttcatcttttgtgattagcagcatattaactttaccttggtataacatagttttggaacacagggcctgaatgtgaataattagaaaaagcatttgctacaaacagccagaaaaaaatgaatatattcattaactatataccatatgccaagcactgttctagctctgagaatgcaacaatacagtctttgctttgctttcttaacttttggtagttaaacagttaaactaaaaacacaaaaacaaaaacaaaaaaacccactttttttcttgtgttatcttcatctacaatttttctatcttctattattttatcataactaatatttttaattccagtatttacttaacaaatttatttatacacaacttaataaggaaaggtattatttgtctcttcttatacatgaaaagcacattttgaaggctgaaaataaaggattatctgcttagaaagagccttttttcccaactgttaaatcgggctactctgtcatcattttcttgtggtatttcaagtttcagattctaaatcttccaccttacactaggagcaagcatttctggcataactatttcatcactaatatttatcatcatctttcaattgactgagaaaatgactaaaacagtataaatcttcataaattatttggcagtttattgttacctcctgattttatagtcaagaactgtttgaggccaagctacagaatactctcagcaacctcagacaataaacactttctcgaagcctatgcgtagcacagtttataatgccaggaaggggaagcactatatattgacatatctcattctaattttagacttttaaaggtgcttacatctaaacaccctgattctttacttagaagaattggtgaatactcacttgccatagctaaaagaaagataaggaggtaagaatcctgttgattgccaatgaaatgccttatgaaggcaattaggcctgttagggcatcatcttttgaaagcacaataataaatatcatttcagaggccaaaataattattgttttgtgcagtcttgctccagtaaacacatctaacagatcatccttatcagtttttgggggtacattttgaagccaatatacccaggaagaacaacactcagaacatatttttgtttaaaatctggctctgaacacaagtataacgagtgggcagagcatacttaggtccttttaagtaagagctttgaggagcaacaccttcccttaaagttattggggcccaatttgtagcttttgtactttgggatcaagaattttatccatccagatttttaaggcagttcaaacactatttttttttttaaaggaaaggcttgctatagaacgtctttgttggaatgaggcagcttctgtgtcagtaagggtacatcacactctacaattttcacgatttgcatgaatcaaccttgccacatcatatgctaatcagagcttattcctctgatgaaaacttaccttcatttaatagtgattcttccctcgacacatatgagaattcttccaaagaacagccaccggtacactagacagccaactgtgtgttctctgtcctttgtatgaaatcatcattctagatggccaaaaacaaaaagcaagttctcctttatcaaaatatgagaactcccatctctatcacatttcccttttttctgtggctgccaaaagcccaagtgttcaattattgtacctcgttcattctgagttctggttaccaccactagaggactacaactaaagtttgttcggggttgcacttatagccctatcttgactgtagatatatattttaaccatatatatataaagtgtttcaagtagccttaaatttttgaatgtgaatgtatttcaaggtataaattataactaaatactccaaagcagcggttgccaaggaccgattttgttgaagacattttatccatgagcagcggatggtttcaggatgaagccgttctgcctcaaatcatcaggcataagattctcataaggggtgcgcaacctagatccctttcacaggcagttcatgagagggttcgtgcacctgtgagaatctaatgccatctctgatctgacaggaggtggagctcaggcggtaatgctcactcgccgcctctcccccgccccgactcaccttctgctgtgcggcccagtttcagtaccggttcatggcctgggggatggggacactaagtctcggtaccgaactgaatggttccatgtgttgtctacgtgaggttttgagtcaatgcgttgaagatgtttattctttgaggttttatctttggcaagttgtgaattagaatttgttaagcagctgctaaatattgagtatatcactttttgtgtagtgtaattgtcttctccatctcagcactgtctgggcacactgcctgctctaactgcctagcagcttttaaagaccttggataagggtaagtcagcacagataaaaacccacacttagtaatggacaagatctatagtaagactttcattgtgcttaaattgctctgttgttcaaacattataaaacctatttataaccccttgttctaatgctctaacctttactggtaaaatacatgtaatatgatatgaaacaagactttgattattttcaaaactgttaataccagacatggagtgagaatagcattataattctgacgactgttgagaaaacacagcaactattttagaatcaaaaaaatgaacctttttctttggaaaattttttaaaatttggaatccccttggaatgtgtcagtatatttgtgtcagaatgcatgttttaatttttgaattgccctgcaaagttaattgtcagtttaacagtaatcattaaatgaccaaaaaaaaaaaaaaatgactgacattgatgaagaaagcaataacttcatttgattggagatttagatttcctgggtgtatatctcaggcgataaaaagtgctatactgctaccatctatatttattaacaaagccaagtctactagctgcagttgacaggagtataggaaatgtgactttagatgagttggtctaaccatatcatatagtgttttgatgttaggtgtgtttttaaaaacttggagcagcattttattttctcaaagacagttaagtagaaataagaaaactatttggtagtcattcatttaaataattttggggggtgtaatgcatgagagaagtaaaagagttatggcttattctaagtggtttaatctagaaagtcattttttatttttattatattgaatcaaccttaaaatggtagaacaataaccagttaagttaatactgtagcttaatgcaaaataattacttcaggttaatggattttgctctgttgggggaaaataaaagcaccctatagcgattgttattgacttaattttctcaatgccataggcctatacaaagtagtcagcatttttgcttttggaggtaacacattttctcttgcttctaagttactaggtcatgtattaaattgctcaatatacctattttaatgcactggctacatgctgagcaaattatactacatactgaagatctgaatctagtaatctatgttgttagacaatttgaaagtctagaaaagtttctttaaggaaatctaccagggaattaatttctacccaatttcaatattcaaatatttattaactttacactaaaatttcttctctgacatttagacattttcattacttttataacaaattgggtacaacaactgtaaaatttaatttttattatttaaattaattatgcatataaaaataaaggcatttatatattattataaaattttatgtgatatggtgagcagcacttaatctaaaataaacttaatatttctattgacaacttaaataaaagcattatacattacaaaaaacaatgaagaaaagcctactgctgtgtatcttattttgtgttttcccctcacacagaaaaagtatttttaaaatctcatcacttgcaagagcagatttactttcttactgaaaatgatccacctgcttttttgtagtttaacctcatacttgaaaatctattttagattttctctgcagatgatgtgtctcagggtcactaaataatatattttaaccataataatgttaaattatgtttttcttactattatttctgtgacgtgttttatgatactcttcagatttcctggaaaatgctcccttataaactaatggcagtggtacaaactatattttggtatataccagactaggatataccaactaggataccttcaatcacaaataagaaaaacagctcctcattagataaacaacaaaaagggggttttcttggctttcataaataaaaaatgtaaatgggtataatgagctctaagattgcctcctgcccatctggtggctcattcataaccaaggactcagaattgtttttttcctctttgctataatttctacagtgccagtttatcctcacctggctttccttgtggtcctaggatcggaaccacacattttcttgttcagactcaaaagaagggaacatgtctgtcctagctttccaaaagagaattcgagtttggtggattgaaccagcttaattctcttgctcaaacttaaaccagcattaccaagagaatgtaatctgctgattggcttaagtcatttgataacctgtctgggcctaggagataaggagagaagttcagctttattgtaattatgtgaatcttactggaattatatggggaaacataggtactctaatgaaaaaccaggatacttccaagaaagaaggaggatcctgggtaggcacctacaaatacccacttctatagcttggatattccatttttaaaaagttgtatgttttgtttttttaaaaaatttatttgttttctttttaaatttgtttactttctctatgatttttaaaatattcatttgctttcttattttttgtttggaaatccaaagacataaaaaacagaattattccatcatagcttaacagtttagcaaggtctttgttcatttttgcaaagtgaaacagagagagaaaaatgttttggagttatgtgagagtaaataaagcattactagccatctcaacttttctgtagaatggggtgatggtaattcagctattaaattcaaatgttgaataaaggagaaaaacacaaatctaagtcatctataattgtcaggaactaaggaaaataaggctaaaagtaaacttttagtcaatcaacagctatttattggacacttactatgttctcagcacaatgctgatttctatggaggattccaatcaagtgtaagagaagaagctgctttcacgaagtgtataggctacacacaaagtcaaggtgaacacacaagaaacaaaggcaagcaacagaagacactcttggtactaaattatatggaatagactgtgtactagagaggaagatttggaatagcctagattttgttaacgaaaaactcacagaggactggagccaggcattgactcgtagataaggtctgcagacaggaaaatgcaaaggaagactttgcagatgggaagattagtaacaacaacgtgaggaggtagaattgagcatgtgagtgtagaaatagtggtgagacaagttggtctggagcaacatcacaatatgtattaaaggtttgttttcattataacttactgagtaaaatggggcaaggatataaaaggtcttgatgttcagttattgtctatgaaaactgatctccagggctgggcgcggtggctcacatctgcaataccagcactttgggaggctgaggtgggcaggtcacttgaggtcaggagtttgagaccatcctggccaacatggtgaaaccctgtctctactgaaaatacaaaaattagcaggcatggtggcacaggcctgtaatcccagctactcaagaggctgaggcaggagaatcgcttgaacccgggaggcggaggttccagtgagccgagatcgtgccactgcactccagcctgggggacagagtgagactccacttcaaaaaaaaaaaaagagaaaactgatctccagtcacagtcagtaaaatgacaatgtagataagtagtttgttgaaaatagattttaagaagattaattcaggttgctgtataggatgcactggaatgagtaactggaaacatgcaaaatagttcaaatgctttcttggtaatttatccatgagaagctgaaagcagggatcatggtagacccagagagaatacagtattttctttctgtttgctggcaataaccagacatggtataatatcatctgtggaatttgctgttaaaacacatggcagaatagtgtagttgaaagaacatgaattttggaattagttaaacatgggttcgaatcccagctccatgttttaagtaatgtgaaacttcaggcatgcttcttaatccctgtgaatgctaatttccttgagtcatataaagatacagtatttgtttcaatggactgctggcattaaataacgaatgtaaagtgcttagacttctctcttcttactaacaccacccaaatttcttacccactggaaataaaaactggaagaattcctatgtctaagaaaacatttgaacattcttcatcaagcaggtcatagaaattccataatgtcacaaggcagagctttccagctcatccctagtaaatggcttaggtgaaagtaaaaggaagttaattgtccaattgctagataaaagtacaggtgttctctgaaacaattttttttttttttttttttttggcaacagggtcttgctttctcattcaggctggagtgcagtggtgcaacctcggctcaccgcaacctctgcttccttggtttcagcaattatcctgcctcagcctttttgagtctgaggcagtttgatccttattgaaaagggcagctgagggagtaaaaagagtactgagtttggatccctttagggttcagatcttggtctcaccacttggtgtctccttgggtggataactgtgagccacagtctcattcgtaaaaggagcctaatagcatagttgtggatataaaacaggatgacacagtaaacacttgataaaacttaacctccccagaaagatttaggacattagtcattttaatgtcattggatagtttaactatgaactaatcttttaatcatctttggagagaggaaagtagttaaaataatttataatatcctaaccctggctaagaattgtcaacttcagattatctgagaaaatgtatatgatactttaattaataggatgccttcttaactattaatactaaacaagtatataatcatatattttgtccttttcccttaaatgctcccccagagtacacaaagtagtctttatttttgtgactacaattagtacccattggttttttacatcctttgcagctgtgccttcacaatatatttagggaaataatttgaatcatcctgaccttaaagcttggtgacaatttggggatgttttccaacttatctttcataatgctaattccaaggaagaagaagatgcatagtttctgggatgggaattagagtagtatttcccaaccagtgctaactggagtctgtgaacatcctcctagcatgtcgtggttaaggctgctgaagagttctgctctgtgaagaaacttaaatcttgacgttgacctgcctgcaaaagatggggtgcttcttcaaaagaggaagtctacttacaaaatttgaacccagatctttctgtaacgattcttatttcctactgttggacttggttatgtaacttattgagtgtgttttccagtaaatatagagtatataatactctcagaaaactggaaatagcacatggaattaagggtattgtaaagatttagagctgtagattttagaggttccaggtaagatagcatttgaagagctaaatgactacaaaatctgaaaataaatgtctaagatatgagtttcttttccaaacagaaaggaagcatacaagttgtaagagatgtggttggcagggtaggtgagggccagattatgtaagactgtattagactttatgtcagttggctattgctgcataacaaattatccccaaacttagtggggatattattagcttaaaacagcaataaatattatcatcacagtcactgtggagtggtggcttagttgtgcagagtttctcataaggttgtagtgaagatgttaaccagagctgaattcacctgaaggcctttctagggctagaggattccgtccaaagctgattctttcacatgtttggcatgttggtgctaattgttggtagaggggtcagtttcttccccctgtgagtccttccataggctgcctcagtgtcagcataacacagcaactcatttccttcagagaagatgatccaaaagagacaagaaggcagaagggcagtgacttttaaaccttagcctcagaaatcacgcaccatcaattctgccatcatcagtgctttagaagcaaactactcagatgtcctccattcaagaggagggaaatttggctccactttttgaagtgaggagtgtcaaagaatttgcaggtgtatgttaaaaccaccacaggtataaaaaggaatttgaattctgttttactttattcctttatgtaacaaatatttactgaacacctactaagtgctaagcatttttatgggcactaaataaagcctctcagagagagtaacacttatgtcgaggcctgaaagattaagaagatatggtaagagtttccaacatctctgcacttgctgtatctgttcacctcctattctctcctgaacctctgtaactggccagtctccttggtggttactcaatctctgggttaaaaattcctcaactgtaaaatggtgacatctgtttcagctgcaacattttcatctaggaaaatacggcagtttcttttaatcactgaaatatatttaataagcttagcaatgtaacattgaaagtaaaaacaaataaaatgagtagtttacacagatattttatgtaatcatttgaaatttccataatcattttctactcttgtgatatattttagagaatgtgaattagcttatgcatcatctatgaaattacctaaggcctatctttagctgagtggtaatattgtagttttctatattaagtggtaaaattgtagttttctatattaagttctggctaagagatctttgaagttttttttttttttttttttaattttaagacctgtaagaattccttttgagatgcattcttgcactggcttttacccatgctagtaatttctcttactgttctttcactattcattagactcaggtttagaggacaaaattccccaagtgaaatatgtgtctgcagcaaagacactcatacttcccctacaaacaccacatcttttgagagacaatggagcaagaagagaaaagaacaataaagaacattccactttctctgtatctgccatcctgatttcatttagacctcctaatgttctctctgatctgtgtgcatgggccataatataccttcttcacggagttaattgctcagtctttagtattccagcagcattttattcatgtttctcttttggaaattatagtatgtctggagccttaaatgattctatatagatgtattctgtgaattgtcattttttttactcttgagagcaggaccccccagtgcctaggaataatttttagaacaaatctggtgctataaagactgttgaaaatgaatagtcacatttactcttatattaagataaaagtaattttatatgatcactctttttaagccaaccaaatgatgaatcttcacttgtgtaagggaagaataaagttatgcatgccaggaaaataaaggctgaaaagttaagattctttaaaattgataataatgacaatgcttagagttgaagttcttatccaaaacattggtgttaaaccattcattaccttgtatattaacagtatttttctctgtataatttctttgaaatgacttataaatatcaataaatttacttgctttaaagattttccaaaagcttcattaaatctacatctgatatgtaaaaatataaatattagctcttgcacattcaatttgtcaagataatccaattaccaaaaggaattttcaccattggctaaaacctgattactggtttatagtcatattactaatgtaaataggaagatatttttgtaataagtgtttgaattccctaaaatacagcatgatttctatatttgaagaaaagcattatagctgtttaataaacctgagaactattatcaatgactgataaataatacagactgaatgcaatgcttatcttcctaatcgtgaaacagagtataaataaatgaagagtaaattacattttaaaatactaagatcatattaatacttgtaattctcacttcttgggatttaacaaaaacctgctttccactcttctggactatagtctggcctctgttttccaatgtatcctccccattcctcgccaagtaatatctttaaaaatcaaatgtgtctgtgtcaaacccccgtacaaaaaccaattcctcgcaaggctttcagaataaaattcagactcctcagcacggcagacagggactgatccctgcctatctaagctgcttctccccagtaacaatgcattaattgtaagtttccgtatgtcctgtgttgtctcattgcacggtgttccttctctttcaaataccttgcctgcttctgtgtcttcagtgtcttccagctgttactcccagtaacttcgttcagatatcatttccttatctagttgaattatgggtctttcatctgtgttctctttatatccaacacataatttaaaaaaactaattatataggtgttcactaaagtgtaatacagaattttgctaacttgtccatctcagtctctgggctgtgaattctcaaaacaggaaccttgaattttgtctctgaatcattagagctgaacacaatgcctagcagtgaaaagtcaccaaacatatttttgttgagtaaatataatgaataacaaataattcatagttttctatggacaggagtaatgttcaaaatatttaataaccagatgctaggagcacctgttggtcacaccagaactactgtaacaactggtaatgctgtacttatttcacccacccagtatcagcctgggctgtggatatctttgacttttttataccaaaaaggagaaaatgcatctattttcatacctacatgcaactagagcctttttagaaacacacagagacataaggtgttggaaagcacctggatgcatatacacagaagccaatacagttgtgttcttaagctattaatatgtgatgataaatgctttcctataaagtttacagtggtgttaaagtgctgccatgccttgtcctaattacccagaggcatgtttcacattctccagtgggctattttttgttgttaaataccagtaagttaagagagaataatttccacattttaaggacctgtagtaaatctttattgccttacttcacatgttttgtaacaataaacaatgctccgatctcccaaccaaagcttccttcatcttttatgtacactattgcaaagggtactgcaggagctgattgacaacctacttccattcttgtctcctagcaccccaagccaaggcatctgttttcaccagaatgaactttctaaaatgcaaatgtgattatggtacttcctaccaaaatacattcaacttttctgcatcacctataacaaacttttcaaggcaatttaaaaaaatgtgctcttaaaaaaatgctcatttttgggctttacacatggagactccaattcagtagggatgaggtggtagagtggtacctaggcactcttaaaagctattacaggagattctatcacacagccaggctgaggaaaattcatccacaggatggagtcctaataccattacagggaagagactattcagtaactgccacctgcctgtcactcccagatcacttattagctcaagactttggcttaattacgtaggtatttgagcctcagctgcctcagtttgaatgaggataatagtacaaatgttgcagcaccattctaagtattagatatagtattaggtcatttatcatccaaactgaggcactattaataattacttcaggatactatgataaacttgagctgtcccagacaaactagagcactataatttgaggagatacattcaaagcattttttacagtggatataacagaagctcaataagtcacattcatttttatcattcttcgcatttgctcccctattctgctggaagttgtagcacaccagggtcatggtgcaaggcacacatgtgatgtttgtgaaatgctctaaccaagatcttgaatgtttgtctatcattactcttctccccatattcttgatactttcttccttgattttttttgttttgttttaactttttatttccataggttttaagggaacaggtggtgtttagttacatgaataagttctttggtggtgatttctaagattctggtgcacccatcacccgggcagtatacactgtgcccaatttgtagtctttatcactcagctccctcccacccttttcccccaagtccccaaagtccattgtatcattcttatggctttgtatcctcatagcttagctccccctaagagtgagaacatacgatgtttagttttccattcctgagtttcttcacttataataatggtctccaattccatctaggttgctgcaaatgccattattttgttcctttttatggctgggtattagtacatggtatatatacgtaccacaatttctttaaccactcattgattgatgggcatttggggtggttccatatttttgcaactgtgaattgtgctgctataaacacgtgtgtgcaagtatcttttttgtataatgacttcttttcctctgggtagatacccagtagtctcccttgatattttttataaaccttgatattcccctcttttctcctactttagctcatctctttgtaagtcccaggacaaggaatgcaaaagaggcccgcttgcaatatatttttttttaaattaaaaactacatatcaagctaaaaaacggttaagtatctcctactttgatgggtaaatcatgacaggtccaaaattagacatcctggaatgcttggagttgcacacaggactgtgatgagggcaatgccactcctgggggcctaccacccagtcccctttctactcctatccctgactccatctgcctgacaggagcatcacatggaagggtgtggacacaccaacctgcacatattcaagctttgttcatctcccatttttaccttccctagcaaacaacttgaaaggtgtgtattacatacctgttgctactgtaacaaattactacaccaccagtggcttgaaacaacacagatttattcttttttagtattggaaattagtcttacagaactaaaaccaagatgttggcattgctgtttccttccggaggctctaggtgagaatcccttttcttgcctttctcagcttctaacgctgcattcttggatcacggccccgttctccatctccaaagccagcagtgtagcatcttctctcctctttgccttctgtcttgctcttgtaaagaccccagtgattacatagagcctgtttggataatccaggataacctcctcatctcaaaatttttaacttcacatctacagagttccttttgccaaattaggtagcatttacaggttccagagattaggatgtggacatatgtgggggccatcattctgcctcccaaagggtgtgcctaccaatggacacttgagaggatgaacccaaggaagaagtgtgagtgagcactggagccacacttgggaacacgtaggcagggattctggtaatggaggagctgtgggatcatggtgagcctgtcctcttggctctcagaattctttgccctgcccagccagaggaagtccctctaaagctcaggacccagggcagggtcctttctcaggcagggacctcagcatggtacatctcctttctcctgctgatctggcgacctctgcctgattccctttctcttgatctatctacaagactgtcagaggaaagcatgttagcaaattgttttactctattaaaagttctttttctcttattttcatccctgccttttgcttgtcatgaaagagccccattccacacccactcattgtttttaaccatcctcactggctttcccttcctttgaatctctaattctagccttccgccacctcttcagtgttcttaaaatacacaagatttcgcctgcttgctgtgtttttttaaaaaatatgctatccagctagcaagttattcctgaatcctacaacgttgttaattcattcctcttatatttcttttttagttgtaaattttcctccaacatttgaagccagaagattttcttctataatcttaatttaaaatcactctacttggtctacttgtatactctgtctttatattttgctggatgttggccattttaaataatgtttccacacttatacaatgtatacagaagaatttttatttccaaaaaggtatctttaaaaaatgttttctccctgtagtcccagctactcgggaggctgaggcaggaggatcgcttgaacctgggaggcagaggttgcagtgagccaagattgcaccactgcactccagcctgggtgacagagcgagactccatctcaaaaaaaaaaaaatgttttctcctcttttaagtttttaaaaatctctgaacgctgatctgtgtttttacttattctcgttaatgcatggaaagcttaaggaatcatctatgtttaaggtctgacatggttttgagaccttatgaattatttcacaagaaggttttgtaggttttttccttaatgagacattacatattcctaaggctctgatgaaaagaaaatttgcccattcaaatttaattttaaactcatgttatacaatttcagtgattttaaaaatctatgcctataataatgttataatattaccatagtgtgtgctccattagggcgcatgtgtctgtcttgtttatcactgtagctccgtgatagcctagccaccagtggctgtattttagtaaataactgtgtaagtgaatgtgagaatgaatgatagaatttcaaaatggctttaaaaaacaatataaagatgttccatataaaccatgctgcctcagtcacaacactgaaatatagacttttacattttcttttttttttttttctttttttttgagatggagtctcactctgtcacccaggctggagtgcagtggcgcgatcttggctcactgtaatctccgcctcccggattcaagcaattctcctgcctcagcctcccgagtagctgggattacaggcatgtgccaccacgcctggttaatttttttgtatttttagtagagacagggtttcaccatattggccaggctggtctcgaactcctgaccttgtgatccacccacctcgacctcccaaagtgctgggattacaggcgtgagccaccacacccagccaagacttttacattttcaatcaaatttgtagtctctcctagcctattctgctatgagtagtaaattacttcactaagggtgctaactaaactctgtatattcaagataaccatggtctgtttaaatagtttatgaatgataaatgcagaagatattatatagatgttattttataaagatgctatatatagtgataattccatatgttatgaacttatacagatactgagataccaaatatgctaaagacactaagatttttttttttttttgagacagtctcactctgtcacccaggctggagtgcaatgacctgatctcagctcactgcaacctccgcttcccaagttcaagtgattttcctgcctcagcctcccgagtagctgggattacaggcatgcgccaccacgcccggctaatttttgtatttttagtagagatgcggtttcaccattgtccaggcaggtctcgaactcctgacctcatgatccacccgcctcagactcccaaagttctgggattacaggcatgagccactgagcctggccactaagatatcttttacgcagtgttagctgacgagaaatgtgactctctggtactgaaatgaagactttcctcattgctttaggaattgtgtatggggcttgattcactgcgattttgtctagctttataatgataaatatgtgtataatttattcagtatgaaagtattttacctatcttccctatgtcgaaggtttacttcctagtgttctctcttatacaaatgattgaaggtgtctttttttattgcttgtcctcagaatggctttactcctttatacatggctgcccaagagaatcacattgatgttgtaaaatatttgctggaaaatggagctaatcagagcactgctacagaggtaagactgtcagccctaaagccttgaattctttgatcttaatgtccatattctttatatcaggctgcaaatagtctccattactttgtctaaaatatgctaggaatgttcatgttactattataatcgcaacagtggctgtgaacaaatgactcaggcttgtgcacagagttccatcagtttatgccttcattttggattcgtgtctatttattcttacataaaatcatgcttccattaattttccatcctctgaccttttaggaggtttgtaccattctaaaattcaattacagtaaattctactcatctcttttcaccaatactttatctttgttaggatccaatataattccttaaaggaacaattttttttaccatcagaaataattcataagtatctgtgttagcacagtttcatgaggaatgtcattaaaaaaaaaccctgtaccttattgaagcacaaattatgacacatggttgtgtgactgattatggcaacaactgaatagaatgttcaaaatcagtctagttttaaagagttccaggacatctagacataagaagtgggagtgggcagggaccctgagaacatcagttttctttcctaagcatttcttattccattttctttgtattttccctctcatttttgcttaggcagattaaggagcaagttcaatgactgtctggggcagtgatttcaagtgatgctccagaagcccttgtgcttggggccactggaaggttgggagtgggcgacatggaagaggagaggaagagagctcccctgagacatgcctcttctcacctgtttcaaccagagtatatgggcttggcttttctgttttttttttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcttgacctcgtgatccgcccgcctcggcctcccaaagtgctgggattacaggcgtgagccaccgcgcccggccttttcttatttcatattttgtggccccactgataaaatttcaaaactcctggcctgaagtgaaagatgactggtggattcttgttacccagaaactatcttaagataatttttaatgtctaatatggcttcctttctggacaattaagtcttgaggacatgaactcccttctatgctgcattagaaggagaggttattaaaatgtaataaatcattttccagtccctttgggagaaaactttttatggagccaattgcaacaagtttctgacagcttattctcgttagttaaaaaaaaaaatccaagaaatcactattaatgagaccatgtttcctacctatgactggaaaacacaactacccagtatgaaatgtttttgagttctctattcaatacacacagattttatactcttgtcacttggatatagtgtgatttttatgatttgggacctttttttccctcagacactagttctgtccatgattaccatgggaatatcttcaggcagagctcaggtaacaatatgagactgcatctttgcatcagggcctctgagaaatatatcaaaataaggacatctatatttgttttatttgattttgatttccttgaaagcagaatcatttaccagatgaaacctttatgctagagtgcttctatttaccaaatagacttaaggtttctagtgtaggatttaggagaactcagctcgctggcattcccagctgtctcatggctcctggctcttttggtcaaggccactgtagcatttcccatttggttccaaaaatacccttttatgtacattgcagcagtagaggccatgttacactctgatccccagaaagttaaaatcctctctgatttcacaaggaaatgtgtcttttgcaaataaatcatgtgaggttttaaattctagcttagacacattatatacctattatttgtttcattttagacaatcatttaaataattaaaattacttttttccgattgaatatataagcttaattgattaaactctcaatgcctgcactaatggttatcaaaaaacacacatggacaaatctttacatattcctttttcgtgcatcattctgtaaaaaaaaaataatgtttttacagggctgtgtggttgattgccatttgatatcctgtgttatactgctaaataccttctacagtcttatgtgcccatgtgtcaatatgcctaaagaagggacttgccctgagctgtttggtagctaatttgcaaaaattaatgactaatcaagacattatgatcactttaaagttcaataattgtgagattattcaatgtggcaatgaaattcatgattgagaagaaatatttgaagtttttaaatttcccataattatggcacttagcattggtaaataaatgatgaaaaatgaagctaccaaactttaatatggatttccttttaattgaggcacttgaacaaatcattccaaatgtttagccttgtcccatgcagtacagattagaatgaaatctacgtggtgaagatccgaggttaaatactaagaagggagttctcagtctctccagtaccatttttatacagtatttctctactctcttccttcttcctaaatattaccaaaattaaaggccaaaaactttttaatgacattctgttctgtgagcaaatgcctcatctctaagaaaaagattaatttcacactcttttaatataaactatcacagtgctgcaggaggtaatacatttaaatatgtatgtgctaatgagtctgtgcttttctcattcacagagcatttaatttgtgccaaacaaagttctaaattcaggctactatttttcatcttaagatactacatgctttactcttccattctgttaagtaatgtgttgtgtttaaaattcagttattattaaaaaaacgattattattgctggtactgcacattgatacaatacacttgaggaaaattattttttcctcagaagtctgcagtgactttaaaaaaattattttcggaaaaaaatggagtagttaaattgtggtaaattaccatcgtctctagaatgcagtcctgggttcaagcaattctcctgcctcagcctcccaagtagctgggattacaggtgcacgccaccacattcatctaattttttctttgttatttttagaggagatgggttttcaccatgttggccaggctcatgtcgaactcctgaacctcaggtgatctacctgcctcagcctcccaaagtgctgggattacagatgtgagccaccgtgcctggcctagaatgcagtctttcttttttttgagatggagtcttgtgctgtcacccaggctggagtgcagtggcacgatcttggctcactgcaagctctgcctcccgggttcacgccattctcctgcctcagcctcccgagtagctgggactacaggcgcctgccaccacgcccggctaatttttgtgtttttagtagagactgggtttcactgttagccaggatggtcttgatctcctgacctcatgatctgcccgcctcggcctcccaaagtgctgggattacaggtgtgagccaccgtgcctggccccagtctttcaatttaccattctattgcccatatttttttctctatggaaatggaaacttctaactttgagacttgttttccaacttttgtggattaaggatgttttttttttctttcacgtaagtagagcctaaaatatattattttttaatgtacttgtcacctttccaggaactgaattcttgtttctagaaagaaaaagatagctttccaagttttctagcatgattatctaagttttctctaccttttcacttcccatgctgttttttaagctgtctttttaagtttagaattgaaaaacaggtttttctacattacctagcacatgtaattttatatctcaatggtcaaaataatataaaattcaactattaagagcataattaataagttatcctaatttgccagagttttagatcatattgttccctaaacttccaaaattgaactggtaatagacaactccatccccaggggctgttttccctaaccattcagatatatttaataacctgcatagtcaatcatatattttatttccctgtctcagtcaccatatctttgattcccagtcagacttggtctccattctttctacccttcccacttttctgctttacctacagaggcattatttaggattggttctcacttttatttttcgattgcaaccatacatttgagcacatcctgtatgtaatatgtttgttaaggaatgcggatgtttttcaaaatgtatagaatagaaattaggaaagccgtctgattaaactattccataatatgatggataactggttataatctgcttctaatcttcccagtaatattttattcttttggttgtcaatcttgatcattaaagattagaggcatcattgcttagaactaaatctctagcatctgaagatgttaacagacaatttttaccttccattttaccaggatggctttactcctctagctgtggcactccagcaaggacacaaccaggcggtggccatcctcttggagaatgacaccaaagggaaagtgaggctgccagctctgcatattgccgctaggaaagacgacaccaaatctgccgcacttctgcttcagaatgaccacaatgctgacgtacaatccaaggtacttaaagctgaacacatttgtggaaaggaactctttggctgccagactcctcctgggggatgataaagaagtaggccatggtgataatgcaaaattatttctggtcataaaaagagataaatgactttcagaggtatttcagaaagaaggggaccatctaaaaaaattaaatgcaagataattttctttaaaagatgaggttgagctttttagaaatctgctttcttattctgtttatagtcacaaataatagaatttaaaagataaaattgtattgtgtggtgcttggggatgtcttcttccagtagaatgcattttgccatgttggaacagtatacccaattgcagcgagcagattgactgtttccataattttgcattgtgtaatatcttccctctttcttccaaacaacactgcttcagatgatggtgaataggacaactgaggtacagtattgtggttataccaaaatttaccttgtctttatttttagtttttgcccaattggaataaatgctcactaattcatactaatgattagaagtttgattaatgggaaattaatttgaaaaccttccccataatgaaggcaaactgataattcaaagatatttagtgtaacatatatttgaagcattatttttatcagtaaaactatttaaataagttattagagaatgaaatgaaactctttcttaacatatattttaatgagtgagatttactattaacttattgtcaagaagagatatgattttatttccttaatgagaattcttaggttagagttttaaggaagtgaaaatttgggaggtttctctgccactgagttttgtctttttatctaattgctgttgccctttttttttctgtatgctctttttctttaccacatttatataataaatgatgttattgagcatatcaagagcagaccaattgctttttcttgtaagtcttaaaatacttgtcatggaattgtatattttccacattccaaagtaagtcacatcaatcaataagaacattaagttcagaagcctctcagtatggtgtgtttgtatatgtatgtatttagtagtctctccttggccattgctacagagagagacactaacacgaacattgttgatgtatattatacaaactaacctatactcaaaaacaagtgactttttatgtaggtccattattgttttgctgaggggattctttagactatcatctcgcttgatgactaggttgtggacttttgagcattctcacagggtatacttgaattatttgtgttatttcttttgttccctatcgttgcatggaacctaggtcagagacaacggaaagcccaactgcttggtgaacttgttcacaactggaaccgtacaaattgatatcttaataactaatttcaatacctttaatttcttagatgctttttggtgattatttaagatacatttttgaaagcagtattggctctaaacattgtgaaagcagaagtttgggtggatttttactgagttataaatatttgcttgaagacaatagagtaaaaagaagagaaaccccttcgtctaatcctgtagaaatgtgaactctgcctcctacttccatgttaatcagggaagcgttcctctgaagggctgataccagttttgtgctgatccaagattgacagcttggttatcattatgaatgatcagtgaggctgtatcagacaataagtttatttttgcaaatgatattactatatttaaatactttgaaaatgatccacccaccctcaatatgtttttctgaaactaaattgtaacatcagtaatagacacacactcagggtatgtctgtgtgacaggaaatatcaagataaacatgaaataaatttagtcaattatttcctaaaatatgaaaatttgacattttataaaataacagccaggttgagggctgattttcccctccattttgacatgaatattggcattatgtaaatgcaaaataaaaatatcttgatcatagataggggatttggattaatagtaactgttcttattttgtgtcttgcttctctctaagtaagaaattatttgtatctaatgttgctacagtaagagcacaaattttcattacctaaggtatctgagtgcttatttagggtgtttttaaaacaaagccaccaaagcctatagatcaactcaatagaaaaaaagttgtaattttgaaaatatttcttaaaaacaatacagtaaacatcgtagttcatttcaagtaaaagagagcaataccaagtaacccaaaaactgcaggatgtgatagccaaataacagtttctatttttcccataatcttttgttaagtagtgaaaattctggagagtaagaaaaattattagatctttgtgtactttaataagaaaagagttaacatgcttctattgcaaagatggcaacaattttcaactagattttcatcagaaaaagaaagaaaaggaaatatatttttttcatttgataatttcagacttattttttaaacattttgagagtaaacagttctgtaatgcccatatagttgatttaacctggttggttaaattacactttattgtattgataaaatttgtttaacattcaaaattggagtgagctgaacttttttcttccttttatattcctattgatgccacgtatattgtttaatttttgttttttaattatttcatcatgacaacaacataatcgtgctacacagttgtaaaagggtataggaatatcatgacagtgtaaatgatgtggaacaaattctatatctttgtaagaatttttcaacatattttcatgcttccaaaagtataatgtcaacaaatactgcttttttaaaacaaaaataaaacaaaaacactggtttctttgaatcttctctgaaaagacattaaaaaattcattgatatgttaatcctatggctgaaacctgatgttgtttaaacatattctggttttcttcaatatgcaaaaccaacttaagaaacattgttttgtataaacaacaaatctcataaatagataaatatttaagataattaaaaatatgccatgaatattatgccaataaatgtagaatatttatttactttttatatgtttagttatgtaccaccttataacattaagatttaagatcttactaaagcatttattattgcttatatattaggtagacttttaccatgtgaccttcttcactaatacaatggctgcaacatagaaaagtgaagcgctatactgactgtcatatctttgctttcatagagtggttttacccctttgcacatagctgcacattacggaaatgtcaacgtggcaactcttcttctaaaccggggagctgctgtggacttcacagccagggtatggattgaaatagtttctcattctagatagcagtaaatgaatattttaataaagtaaaaaggaacaccaatggctttcttaaagattttacttctttttccttacctgggtctgtgctggagatactagatttttcatttcctttctttaaatcacaagaagtcatcttggcttaagcagaaaataagaatgttgtaaactcatgcaaaaattatttccaatagttaaggatgacattcattctgaccagtatgaacagttatatttaacgatcatgccatgaatcctgataagtcacgtcaaaaaattattaaactgttaaaatgttaactataaaatatataagtagcatgtcttatgatgactgtagggcacacaatttgatagggaattgtttttaatgaattgagaatttgttcacatgaagtcttactaaaatacataaaaggtgtcacattgttacatgtttcatggtatgctgttattagaaagaattcacttacatgataatggtatatatcagtatacttaatatacagttaatgcagaatatgaatatacaaaaattacaacagacaaaaaatcaggtacatatccttgccataatgatgatatgtgatagccaataaaataaataaatataatttgtatgtataatgtttttgtactaagaagtcatctgcactgaaactatgttgtgttattttcaagctgtttttcttactgaattattctgaaggagacgtttgtttgttgttgttgctgtttagagacagggtctggctctgttgcccagggtggagtgcaggggcatgatcatggctcaccgaagccctgaactcatgggctcaagcaatcctcctggctcagcctcctgagtagctaggactacaggaacacactaccatgcctggctaattttttaaaattttttgtagcgatgaggtcttactatattgcccaggctggtcttgaattcctggcttcaagcaatcctcccacctcaacttcccaaagtgctggaattacagacatgagccaccatgcccaacttgaaggagatgtttttaagaatcatttttatattggatattaatacccaaatatttgtattctgtttttaagaatcataaaacttaagatgccagactctttaagtgcatggatgttatagaaagaaagactttacactagggccctatcttaggtagatttaaaatttttgtttctattacagtaaagtggtccctttgtctcttgactataacttgtacattcaatacatattttgtagttattgactaacttagttatgcagtttcattccatttttcattctctaactatattgttttgtggtttgtgtgatttttgttccttaaaaatcaaagacatagaaagagtagaaactgtggatcaaattaccacgtaggtcacaacttcctttgtggcctttaacacaaaggcatcgccatcatgccctgtcatacccaacagctcttgtttggtctttctgtggtgtagaatggaatcactcctctgcatgtggcttccaaaagaggaaatacaaacatggtgaagctcttactggatcgaggcggtcagatcgatgccaaaactagggtgagtgtctctgttctttcaattttctaccattattatttctttcaagcctcatagaaggcacctcaagacaccaggtcattaacataagcaatgtgttttcaaggaaattgctttattggaattgatttaaatctcatacaacatttaaagggttcataccgtacagtgaaattaatatttgctcataagtgcccagagaagcaaaatgttggtccctcaatgagatagtttttcaagttttggcttagtgattttctgggaccaaagatcaaagattaggcttacacaactctcttttgggtagttataagtatcaagaacccaaactaattaccatacattaagattgagaatgtggcttttacacaaaatattttagtacatgtttacaatcttttgcttctaagtattcaattcctaattcatttttcttaagcagctatgctatactgacctgagcaggggatttgctattatggagaaaagcatacagttagtatactatacctttatgtcattttggtagaagtgatagctttcatttgtttcaaacttaagtaaaatgtcatttcaagtttgcagtacaccccaaatagataacacaatagacagtagagttcagttgttaaaagtgcagaataaaggcaaactgcctgatttcaaatcctatttttactattaataagttgtattatattggcagtttacttaccttctctgaacttaggctaataataacacacctacttcataaagttgtgtgagaattaactcttaggtatattatttaccatttttgaaaaagcagagtaaattacctagctcttcataatatttgataatattactgacgttatataatatgtagttatttgctgaaacatgtaaggattatttcagtattaattatctggagtagatttggttaatcatagacttcagcaaaacttcaaatgtgcctataatacaaaaatgttaatatgtggtataaaagtctatgttaatatgtggtgtaaaaagcctatgaaagatgataaatagaatatgtctcttatggtattttacttcactttgtttaattctgagacttcatgttttcatagtcccagcagtaaagatcaaatctagtttccttgcaaatctgggggctagcaaacacttttgtttaataaactttatcatctgtaagcttccagaatctataccagtcccagactataaattatggtttttaatgacctcaggaaaccttgctttcttaatctcacttctctaaaacttttggtccagagtggctacatcacaacacgtgggagttctggagaggtttgcgttctgtcaaatctttgctgtggtgtccagtgtctttgcatcagagttttatatggtttctactttttgcttagtaggcatgcctttttccttaccatactgtgagtatacagaatttggaacagtatgcgttatgttgcatggtttgcttacttattctttctatttaaaggaatgagttttgcacattactacattactaacatcattactaacattaccaatgtattacattacaaacatactttactaacataatttcttcctatatactgcctttatgagattaccactggaaagaaagcattttggaaatgcaaaaaaatttttatcttggccaatgtcttaaggatgcacattgcttttattaatgctttttggagtattaactcattattaagatagttgactttgttcttattaatcaacagtatttacttaataaaagtactctaatttgtgtggcttacatatatttgggtatacaattaaaaagtctaactccaaatagacagtgtatcttcataaaaagagtactaagaaatgaagagaaatggattcttatactagttctgtcatagtgcagcctttagatacagcaaataaattaaatttcattcaaggatttaaaaagaataaaataggttttctaactgtatacattgtataaacattccattcatttattccttaaacaaataactattgagttcctacttggtgctgtgaaccctgaagatacgacagttaacaagacagagtaggtttctagactcatagagatgcaagtcagtagttcaaggaattaagttaacagtcttcttgtaaaagtttaataataggttcttaaaaaacaaaaaaacaaaaaacaaacaaaacccttgatttgtagcattacctttgctggtttccatggtgtaaatacttctacagtggtcagtttagagctagcaacttggtatcactaaatgtagaattgggaagaggtgtgcaaaaagtggctctccttatttcatatgagctggttccagcacaccccaggattagctacaatattgaatggttgcactgaacatttttatttttattatactttaagttctggggtgcatatgcagaacatacaggtttgttacacaggtattcacgtgccatggtggtttgctgcacccatcaacctgtcatctacaataggtatttctcctaatgctatccctctcctacacccgtcccccaacaggccccagtgtgcgatgttcccctccctgtgtccatgtgttctcattgttcaactcccacctatgatcgagaccatgtggggtttgattttctgttcttgtgttagtttgctgagaatgatggtttccagcttcatccatgtccctgcaaaggacatgaactcatccttttttatggctgcatagtattccatggtgtatacgtgccacattttctttatccagtctatcattgatgggcatttggcttggttctaagtttttgctatgtgaatagggttgcattgatcttttttagcactaaactttccccccataagttgaaatacttcttcatctgtaagtagaaggattttaaaagcattgttgggttcttttcattctggctacagctaacagacctatatccctcttactaaagacaaaatcaagtaggaggtaaatactgaaatcaaggactgtgggctggaattgggaggccaattctggaactataatatttgattactaaaataaatgaatatgttttgctttttcttttgcttttgaaatgtattcaaaaatagaaaaatgtttatattaattagttctcatgctgctatgaagaactgcccgagattgggtaatttataaaggaaagaagtttaattgactcacagttctgcagggctggggaggcatcaggaaacttacaatcatggcagaagcagaaacaaacacatccttcttcaaatggtggcaggagagagaaataagtgcccagtgaagggggcagccccttataaaaccatcagatctcatgagaactaactcactgtcacaaaaatagcatgagggtaaccaccccgttattcaattacctcccactgggtccctcccatgacacatagggattacgggaaatagaattcaagatgagatttaggtggtgacgcctaaatcaaaacattgataaactatatcaatgtttaatttggttttgactatatttttagagaatataataaagcttctacatatgaaaatttttttttttttgagacggagttttcactcttgtcacccaggctggagtacaatagtgcgatctcggctcaccgcaacccccacctcactggttcaagcaattctcctacctcagcctcccaagtagctggaattacaggcatgtgcctggttaattttgtatttttaatagagacagggtttctccatgttggtcaggctggtctcaaactcctgacctcaggtgatctgcccgccttggcctcccaaagtgctgggattacaggcgtgagccaccacacccggccggaatgtttttaaagtattatgttttcattttgttgttgttgttgttgttgacatctcaatttcccccagcatttaaattaaccacaaatattctgaatttagtatattctgtcaaggatcttgccttgatcttctcattattttttctcattcataaggtttttattatctagagaatagcaagatctagagaggctttcagataattaagaaacaaatattacccacagttatttcttggctctcatcaccattttggcaatcattgaggcattttccatcttgttggcattctcatcattgactactatctaatgtgaaactctaagacatttgcaccagagccttttactggtatctgaaagacctcatttcaatgtgaaaacgtaaattttatagctagtgaaaatgaaattataaatttaggctttattaagggcattattctttttttgtttttaagcttatttattatttaaatgtggtgataccgcatattaggattatgtttaaaatattaaaaaacatatttcaaagcaaacaataaaaagtgtacaaaaacattaaaggatgatgaacaaaaaacacacagggaaaaggaatcacccttcttacttgttattaggtataataattaaagcagtaacaataatggttttcaattgtcatatgcatatgttgttctaggcaccctgctaagtactctacaaatatcatcttattttatcttcctaacaacttatgaagtgtgtattattttcttgttgagaatatatggaggtcttcatttgagaaatgagactaccaaagggagaaattagtttcagcagaattatgtaacttgacctaggacacagaactttgtaatcagcagagcctacccatgtattcacacaaacttcagaatacattgttgaaagaatgacctaagcagagaggggggaagatatgaaaagataaagaaactacataagtggcatccctccaatgttgattgatctacctttatgaaaattatccacatcatggtgtatagtacatccgtgtgatgaactgattctagagaaaaaaaaaaaaacaacaacagagaaaacacaaggggtctctggaagggggaaaaacccataacctgcaactacaaacttaagaatttaagtaaaaagattttagaatacaaaagcttgaaaagaatttttttggggcattaactttataatgtgctttgcagaaaatattcaaaatctaatcaaattgagcctgttgggtaacttgaatttgatgtcatcattcacacatcttataagcacagacaccttgcatcattaaatgtaggatttagaactaatttaatccttattgttccttgatgttcttgtgggtatattaaatgttctccataaagctcctgttgttactctgagagtattttggatgtttcaacatgattacacaaagactatttcatgcaatttgcagaaagcaatactctgccttttctaaaaaacatgtaaggtgccattccctccttcatctttcaaacaaggcttgcaagttaaatagggtgagaaacatcatctccactctatgtatcacgaagctcagccttagagagattcatccatggtgaccgatttgagattcactgcagggttccatggttccgaagtccacacactgaactgttacatatgatgtctctgttcaccatgtgggatttctcaaaccctaggtctccacaaagccctcaccaagaatacgtttgagaaaccatgctatatctaattgttaggtaagttatgtagcaactaatgctctgtagttccaccacagggtgcttttatcaggatacaaaagtgtaatcattgtcatcactttgctggaacaactctttaaggctcctatctggcaaattttaaaataatgtagcatttcaactacactagctaaatactttttttctgagaaggcaatcttttcatgctaattcttaggtacccaaaactgcaaaatctgttttggttattcaatatcttcgtactagctaaatggatttcacaaagcaaagaatcattatcagtcaaggtcctagccaaaaacagaggcccaaatttgatcatttgattagagattattgaagggtctatttataatattgtgtagtctgtaggaaagagacaagggacaagggacagtgtagaatcccaggggctagtaacagcgggactcaataccagtgctcaacctaaaaagtgagaagtacaggagacccccagaacttcaaaggagagaattgtgtggaaaggctgctttggcaggaaggtaaactttcgtaaagacacacagccggatttgggaggtctctcgaagtccttttcatgtcttgctgcattggccaaacccagctggaagccagaggacaaggcagctcactgatgccccctacagtggccagtctgttgggacacagagcagggaggagaagggtagagcatgggtctggaggggcaaacagaagacatctagcatagaaatctccgtgttgagtcagagtgttgcgattcagaggaattatttttatttggagtaaagcataacctggagagatggtcctggaagtagagacacaaacgagaggccatttgagttctggataaatcagaaactgctgaaatcttcttaattgctcaccatccattctctgtgatttatccaccttctccacctctgtccttgggacaatctttttttctttttccttccacctcaaatcaccagtaaatttaagcactcagtatttcattttctctctcacttcttgctcactgttaattacatttcgcctcacatttcccacccactctgctttttgcccatgccaccctaaagagaaataaaatataaaagacagagggcacttggggattgctctggaatcagaggctatcccagaagtgtaaagatcagaaagttttataagtaatatagcatacagttctgccatattttatttgatggagttagggttctatttattaataataaagttcatctttgggaagcaattatgtgatttctaaaatgttgaaatatatgtgtgaaaatctttaaaatagtctaaaaaatgatgcttcacttttgcaagcattaggaagcattttagaatttatgaaagtgatgacaattcaaaagagaacatatgtgaaaaaattacgctaagaaaaatttttaggtaaaagtatattagaacaaacaatatgaagacagtataacctaatataatccctgttttcggttccagggagtagagctttaaatttcaacaaatgccacatactgtgctttcccatcttcttgaatacgcagacacatgaccagaagccaatttcattccattgaccctctgtccacacaggggatctctcttgctttctccctgtctctgttttgtttgtctttccctttctctttcttgttctctgtgaagatgtacttctgacttgttttctctttcactcatctttctggttatttaacaaattgcagttctattacttatttattgagtaatcaggattgagtttaggaactccctctttatggttgcaatagatgaaatatagatttttttgaagtgaacttgggcctaattctttaattcttttggcaggatgggttgacaccacttcactgtgctgcacgaagtgggcatgaccaagtggtggaacttctgttggaacggggtgcccccttgctggcaaggactaaggtgagtcattatgagtaagatggggtcctaagaaatctttaagttacttgatgtattatctctattcttttttaaattgaaacatcaggcaagcattttctagttctttaataattgtgtgctaggaataggaatatgtatcaaaccacttaaaattattaaaataaacagatatatgaattaagatgtattaaatgtgtgccttcaagtttttgtctatatttttacctgttattcttactgcagatggaaatctgaatacatctgtattttaaatataaatgagaatatctcttagatgctgagtctagatttttatgattctctcagatgactatgaaacatatataaaattatcttttaaagcagaacaattagcaacacaaaatgaatctttttgctcatccaatctttatctcttaggcaatactaataaaaagtaattactcaacagtggcattggttgattatgttgaagattagtagaggtgatttggaaagtacaagttgcaataggccacctacaaagaactattaagcaagcatattttctttatgacatactacatctagccctttttcctcccgttttatcaatatgctcaaatatgggagaagcacttttccatatacatgagcaccacactgtgagttggtttgctgaagatttttcattatcaaatgtattttaaatgcttttattattgtatagttctctattatccaaccctacattgggttatcagaaaatattttgagacacgaattggagatactcatacagagctgattaatgtgatatgcagcaaccttggatccttaaatacaacacaaagttagacaaagggcagttgttgtattttctccctattccattccacctcataccaccgcccccccccccgacagagttggtatcaactaatgctattactagggtaagctgaagaaactaaggcaattgacacaaacaaatatttttcaatttatatataattgaaatcatttgaaacaaaactagcccatatgtttaagatatgtgtagaatgaactcaatttgtaaaggtgtgcccacatgccataaaagagtggcttcaaatcagtaatatatgaagaagagaaataattatccgcgttacttttattctcatacctatactgtgaatgttgtatagatctgtctttaaaatgcaacaatttgggctgggtaatgcagagataattatgtaaagttttgataaagaaacgttgaaatttaaatggaaataacaaaatttcagaccaatcatgttacagccaatacaaaaaccaatatgaagttgaaaataggcagatatgctttacaaaccgtaaaataatcttatctgcagagtttgcttgtaattgtcatgtcactaatgaagatggcaggttacctggatggaatttttttaatgtccttcctgtaaaatcaagtatcattcaaatgtaaggatcctgcataaagtgtctctgagtgtacaattatgttcatgtattcatgcatccaactattatataatattgagtagatacaatttgccaggcaagtgttctagtcactaaggcaccatcaagatgaataatacaaaatctttttttttttttttttttttttttgagatgcagtctcgctctgtcgcccaggctggagtgcagtggcacgatctcggctcactgcaagctctgcctcctgggttcacaccattctcttgcctcagcctcccgagtagctggaactacaggcgcccaccaccacgcccagctaattttttgtatttttaggagagacggggtttcaccgtgttagccaggatggtcttgatctcctgaccttgtgatctgcccatctcggcctcccaaagtgctgggattacaagcatgagccaccacgcctggccataatacacaatctatagctgcaagaagctcagaaattagtgggcatgatagaaaaaaaaagataattataaaaaatagagatatgtatagggtaataaacacagagaagatgaattaatcaggttagagtgaggggataccgctctcctgggagtggaataggtacctaatgctagactattctccctccccttctgtattagtccgtttcacgctactgataaagacatacttgagatgagactgggcaatttacaaagaagtttaatggattcacagttccacctgaggaggaactcacagtcacgaggctgaggaggcttcacaatcatggcagaaggtgaaaggcacgtctcacatggtggcagacaagagaagaaaatgaaaacccagtgaaagggctttccccttataaaaccatcagatcttgtgagacttattcactaccacgagaatagtttgggggaatccgccctcctgattcagttatctcccactgggtccctctcgcaacacaagggaattatgggagctgcaattcaagatgagatttgggtggggacacagccaaaccatattaccttccataaaaactcctaggtttaaatcacccattctttcttctgaagcaactatctaagtgtcaccccctcattctttgtcaattctagctctcagcaaactgtgactcctcaccacaaccccttcttattcttgctgactttaatgatcttgattagagcagtagataattcttctagttggcctctcagttaggtaactctaaaccctctatctatttctgtgtctaacttcacacttgccagcccctcctatgtttcagctcactctcttcagaaccccaattccgaaattcttttattctgctgggtccttcagtcatagtttcactcttcctcattcacatcatgcccttacctctgcccagcacaaatttcatagtcatttatgctactcccttacgtattcatactacctgcatttcactcaattaaattcaactcacattcatgcaatcaaatgtggctacaggaaacacccagccacactaactgtgctcattttagattcatgatcactaacctcaagtcagctggtaatgctgcctgacaatctcgctctatcttctaagtctattcactctcgatccctgctatctgaccattctatattttcttcaaacttatgtagacttctttccttgtcttcatttcccataacactgagagaattcaagcaattggaagataatttccagagactcccacctccatatctatccatatctatccagtgacatgacttggagcccatgtagtctacattctctcccgttactatcatctggtgtgattgcttggtcctgtcttctcaaaacactttctttatttactttctgggacattacattcttctgactttccttctgttttcctagctgccacttctcagtctcctttactagttcctcctcatctctcaggtctctgaatgttagaacctccagagctcagtctttgtatcttttctctatcggcactcacttactatgaaatctcatgcagttctatctttaagtagtacctgtatgctggtgccacgagtgtacatctccagaattccgtatgtagatgtcagctccccattgccacttggatgtctcctgggcatctcaaatttagtaagctcaaaattaagcactggatataacacccacccctcaacctaatcttcctgttatccttcttatctcaacaaatggccatctaattttttttagtttctcaggccaaatacccatgtcatgttggactcttctttttctcactttccacattctgtcaccaaacactgtcacctcttccttcaaaatgtgtcactaattcagcagcttgccaacaatctcattactaccactctggtccagatcaccatcaaccctacctggaggactgcaagaggcccctaattgacttcccttcttttgcattctgtccatatggtctattctcagcacagcagcaagagtaatcctgttgccctaaaccttccaacagcaccccatgtctctctgagtaaaagtcaaacctgcaaggtctctcacctctttgaattcctccccttatccatcctcctcaatcacttgccttaaaccacattcttctccttacgattattgatatcgatcatgcccgttataatcccaacacaatatatttgcacttgccttttctaagcctcaggtgtttttcccccaagtcaacaagactagctctcttacttccttcacgtcaaaactcatcttctcagtgaggccatttctggacatcctatcaaaattgcactcacgtacacaaactccctaggccattcggtgtttttgttttctcctttccattgatggccatccaatatactatatactttaattcttattgtttttaaattgtatgtctgtcttccacactagaatgtaacctcgatagagacgggggtttcctgtctgttgtgttccctgctgtatccacagtacttgaacagggcttgagtaggtgctaagtaaatatgcgtaaaatcaacaaaagattagatgatgaatattttattttccacgtaaataaccttcaaataggtaaaacagcatcaatgaatgttaatttttcaaagaaacatgcaacactccagtccaaacgtcatcaagccttgaatttcttctacactttgcaattatcttcccctcaatgcataaatacttctcatcagcctgttgctgttttctaaacttatttaatgaacttctaaacatgaaagtaataattatgaatgaagattatttcaaaatatatgaataatttataagtcacatatactctaccacaattaagaattaatgtatttgtttttgttgtccctcactgttgaaatcaccttccttgttgagaatattgggcggggggccttttctggtaaaatatccagatacaatttctgctttgttgaatgtaatgactgtcaaactggatacttggcgaacaatcctttttctagtggccatatttgcattggtattaataaaagacaatagtcccatctctttaataggcaaattgttttttaaaatttagttttttcctaagtttacatattgtttcctgaaagtttatttatttagctttaaaaaaaatgagagtcttaccgagtctgatgaacagtgcattaccctgctttcttgtgttcctgctgttgaccttactctagaattaaggctaaagctgttttggtccatattaatgaagacaaatttagattatcctcaactgtaaaagttgtgaggtcattggcacatggcctacatttgcctcacactcttctagcccttacctacctgttttctccaagtccaattcaagtagtctcctaatactataggtaaaaggaattgtaaaatttcagaggaacatggatctaaaagatggtcaaagtttccatacctccctgacctgcccacttgcttctcattcacccacttccctctgtatttataagaaatgcaggcagagagattaagtgaatgcagactgctatgcatggagttggatacaaataactgaagcattaggtattatttatttttctgtatttaatattgccctaataactgtaaaatcaggctaaattgccacacataccatgcatgacagacatactaatttgcatttttgtctatggtagcataattatgaaattaaattatctcttagtgttcatctctgcgaaatatagtctgctgtatattctgatgtcaaatggaaattattttttcccctgccactaactgtgttagagatcaagaatcaactttgctgtactttggaacctgaaaataatgaaaaaaaaaaaggacattattttgttttcttttaatgtgcagaatgggctgtctccactacacatggctgcccagggagaccacgtggaatgtgtgaagcacctgttacagcacaaggcacctgttgatgatgtcaccctagactacctgacagccctccacgttgctgcgcactgtggccactaccgtgtaaccaaactccttttagacaagagagccaatccgaacgccagagccctggtaaacttggcccagtccacattaactgaatacagattgagacaaacaaacccacattcattgaccaacatgcatacaccagcaatgcaaggttacagatatgtagttaatcctgctaaatttgtcatccttcacaatcagcctgtgtacttcatacattcatagtttgttagcaaatgctggtgagcaaagatgtatttaagagaacaccaatgtaacatttctgaaactagtgagttgcaaacagatagatatgaaacctttggagtgataagcagttttaaatggaaaatagaagttgaaaaataggaaattacaaaataaattctagatacctctagataaagttagaacacgagtatgaaaagttgaatttattaatctctttttggaaaaaaaattaatggtgaatatatttgactatgtaagggggtataaaatgtaagtctatgcagagttcaattgaaaattttcattgttgacttgattactcaaccataggctaatagaaaagttatgcctagtgtgttacggcttcagggagcattttatatacaccatttcaggaactgctcaagagaaaactgcaagaggctgtccctagagcagctttatgtctccccagttctgatattgaataagtcttccttgcttcacttattttctaacaataatcattggaagtattagacatgtactaatttatgcctcttgtgtcctaattcccaaactaaaagtaaatcctttttttctatgtgtttacatggtttgtgtctgttaaaattggtcttcaaacaatcagtatttaagctgagagaccatcattagaatcatcaaatattaaatatgatttttacaagaatttttccattggaatcaatttattgataattacgtgggaagtgaatatattttccagattatatgtaattatgtgaaaacattcattttgtctagggagtcaaaaacattaatttttaattggatagtggtcaataagcttataaaatatcacagcctgttaattgcaaatattttaagtgctgcatgtgcatgtggctatttatatctggcatgttgtatagctcataaacaggggaaatgacctaaccaattaattatgtttatcactctattgtgaaaaataagaagtcatcagcttaagtaagaccatatgctttcctgagaactgctagtgtgtaaaaacgttgactgatgattggtccatgttgggacatgcgaaattgttagctggcagaatagacataacaaaggaacattgttgaaataaaaaaaatatataatacacgatgagtaagcaccgggccatttaacatattttacttaatttgccccaattcctgggcattagcctagttcgccaagttagaaagtacctgacagacttcttctccacatttctttaccccagagctacctccttgcatttatcccagaaattctccatacatttcttgaaaatattcgagaacttaacagtcatttctttatacaataaaatttatctcattggcatatatgttataaaaatgatataaaaatatagcttctgtatgtaaaaatgatcaacataatgatttctgctgactagaaatatgccctttataaagaaagtcgtagcaaagttgaaatatttcttacaaaggcagtatattcttagattttttaagtagatgaataattcttatgctctgagaaatggcccttcagaagaatatatgcttatcttcagttcatcttcaagtaatttaataaccaggacaatcaatataccttaaaacatcttagaacttctaaaatgtaattgcttctctgtttttctttctttaaagagaaggaccatgtatttttcttcacttttgttttccctgtaaccacacaaacagaattacgtacaggcccaccacacataagtgaagttcagtgcctacaggaacacatcaccatttttctttccaaattccaacacctgcagggattgaagaaatggtaacattatgtgacgatgtaacattattgcctgcaatgtgccagcatggagttgtgtgagaattgtttctgcatgttttcaactaacttgattgtcttttgcacagaatggttttactccactgcacattgcctgcaagaaaaaccgcatcaaagtcatggaactgctggtgaaatatggggcttcaatccaagctataacagaggtagaaaaatgttttagctagtcacaaagcattccttctcttactccttcctccctttcctttttctcatcttctgtcctcttcactcaagttttatttatctgaagaagccccaaagccccaccggtgcagaggagtaaaactgctgttgctttgtttcgcagtctggcctcacaccaatacatgtggctgccttcatgggccacttgaacattgtcctccttctgctgcagaacggagcctctccagatgtcactaacattgtgagtatggcttgggtcagaataaccccagggaggaagagcgagaggaacagagattgtgggtgtgtgtatgtgtgtttgcgtgtatgtcatcgaagtaagcaaccaagctttgagaagggcccttgtaataacacattattgaaataatcaccagaacttcactgaaaagaacctggatagggtaagaggtgttataaagtaaaatggaagctatgaagtgagacagcttaagactctgggtgtaggtggattgaacatgcatcttaaatgcatttattaaaacaaaatacattttaaaagctcctctgcaagtgaatggataattggttcgaatagaatctttagggctcaacctagttgcttgagggaattgtattccaggcaattttcacaaaaacatcaaatcattaccataattaaccttaacaaaagattaaccagagatagatcaatatcagagacttttacttcgtgtcaaactcttccttcttcaattacatggatttcccattttgtaacattacgttgatttttacttttgatttgatctgatttgctagagtggaggcttctcttagctgaaagttataccacatatcctggaatgaatgttggtctccagaccactttcattcaatcaacaagtactggatgtctcagaatttttctatgtaatctaaattaggattttcacttctaatttctttgtatatctctcattttcttggattttccccctttaaactttggtcattgtatcaggataaatcattgaatgcaaatgttctcctgagcaagagaacttctttgcacaaggtgcaggcatgtatttgaagttcaagaaggtctagtagagtattgagattcacatgtgcaccagaaataactctctcaaaataaataagcttattattaaaatgagctatgttgtcaaaagcaattgattggcacttgttgctaatttttggcatctcattccatttaagctgtgaaagagaatgtccagtttcactttttatttgtattctctctcatatttctttttttctgtatttcacacaccatttccacagtgaagtttctgatggctaggaaaatccattgtgagaattaattcaattgagtttaaaaattatttaatactctctcttcatgttattcagtaattggagcataaaatcattgaagaatttaaagtctatatttataagttttcttaattatagcttattggtcctaaggtcataatattatatgctaatctttatttactccattagacatgagagtaatttcacaatgtgccaacataagtttaatttctagtcacttcttagaactttaaaagtaatcatcatccccccccttttttttttgagatgactacctttttttttcttttttttttttttaattgagacctgaacagatttacgtacaggccagtaacattaaaacaaaaaacaaacaacaacaacagcaaccaacaaaagaaacaagcaaacaaacaaaaaaccgctgtgttcttgcccgccttttccttttttatctccacctattcttatttgcattccaatgcttataggatcagaggagcaatagtgacactgttacaatatgttatcacattataatgataacatgtacaagaatattctgtgggttgcttgattgcaatcccctgaattaatctcttttagtggagacttttacaaactcttcaaagaataatccatataaaatggttgtggaatttgtggccactcttactttgcttcttcactgaccaattccaaatcttcaggtggttatggagttataatatactcccttctattaaaaaagttatatggggtacatgtatattttcaaataaaaataaaatattaattgaaacaaacaattttgacatatttttcaggttgttgaagactttcaaatttgacaatcattatattaaacttcagcttccaactgttggtcatttaaagttcttcattttatctgttcatttgtccattatattatctttccatccagctccctcaaaacaaattcttgaggggcacatgccaatataatttccgtgttttctagttatgttttgtaaggtaggtccttcaggaagcagatacctattgatagggttgccaggtaaaatataggactctcagttaaatttaaatttcagatgaaaaataaatttttatatatgacccatgcaatagttaagacatagtaaaataattatttgttgtttgtctggaattaaaatttaactggctgtcctgtacttttaattgctaaatctggcaatcctacatttagaggaatttaactttctctagcagtgggatgcctgtgaagttgtgttttctcagaacatgaggatatagctactggatccaaaattctttgcaagttgatgaagaaaccgtgtgaacgctgactgcctgcttgctgtgtcagagttggtcacttcctgaccctaaaacaccccacccttggagcctttgtgtgttgcctgaaatcatgttgcatttttgaatgcaatgctgtttgttgtgcttcgatgcttttcaacttgatgcgcccaaagtggaagtcaatgtagccctgtcagcagagtcagttttaacaactgagaagagtggcatgaaatttagtacctgctttggacatgagcatacccattctcttgctagttttgtttttgcctgaaaattcactccaagtgtgaggtgtaccagtaactcaatcacgtatagacattttttttttaactgaaaatctccttttccagaaggtttattaatacgctttgaaacttagaatgccgaactgccaattacaacacatccataatccaaagtattcatcaataaccataggaatagaaaactaagcattttaacaactatcaagaaagaatgcaaggtcttacaaagttttatcttccttcccataagaaatcagtggactaatggtaaagttcacacattatattatgcttaaaaatttccccgaatccttaaatttcattagcttgagataagaaagacaaggctattaaataaaatagggtgcctgacaatcaagacatggaaattatttattacaacaatatatcctgattttcattttcttatttattcttatatataaacaatggtaatattaacataaaagactaataagggcaacttacagtagaagtccattatgccagaggtgttagataataattaaacaagaccattattataaagtggagagaccatgtgtgtgtttatacataacctttgtttgaatttaagccttagtgctttaaattagattctatatctaactcatcaatttcaagtgtgtaaaacccataaaaaaaacttaagtataaaataaaggttttagaaatattggccagtattggaaacatttcagattttgaaagccccttattgataaagcttggcttaaaaaataaacatgaaggccaagcgtggtggtggatgcctgtaatcccagctacttgggaggctgaggcaggagaatcacttgaaccaaagaggtggaggttgcaatgagcctagattgcaccactgcactccagcctggggtacagagtgaaactttgtctctacataaataaataaataataaacatgaaaatttgtcattacataggaattcctgggacctctttgacttttaacttcttatacagaaatttattcttatcatcatttctaccaaaattagtaaaattgctagccttttatcagacctagaaataacgtaaagatttgaggagtattgtttttgtttttctgagacacgaccttgccctgtcacctaagctggaatacagtgggcaagattatggctcactgcagcctcaacctcctaggcacaggctatcctcctgcctcagcctcccaagtagctggaactacaggcatgcaccactatgcctggctaatttatttatttatttatttagagaagagatcttgctatgtctcccaccctggtcttgaatgcttgacttcaagcaatactcctgccttggcctcccaaagtgctgggattacaggcttgagccactgcaactggtcttgttttgttttgtttgaataccatcggccctctgtatcagtagcttctgtatcagtgggttctaaatccatggatttaatcaatcttggattgaaaatatttgaaaaaataaaaataaaaaactacaataaaaataacaaaaaattttaaaaagtacagtataacaactatatagcatttacattgtgttaggtattataagtaatatagagctgaattatacaggattatgtgcataggttacttgcaaatactacaccattttatataaaggacttgagcatccatgtattttggtattggtgggggaaacaggaggcctgggaccaatccctcaccaatacagagggacaactgtagttagaagattttagccttgccgggcacggtggctcacacctgtaatcccagcactttgggaggccgaggcgggtggatcactaggtcaggagttcaagaccagcttgaccaacatgatgaaaccccatctctactaaaattacaaaaattagctgggcatggtggcgggcacctataatcccagctacttgggaggctgaggcaggagaatctattgaacccgggaggctgaggctgcagtgagccgagatcatgccactgcactccagcctgggaaacagagcaagactctgtctgaaaaaaaaaaaaaaaaaaaaagaagatcttagcctcatctatttagagacaggttttaaatgatatggaaaacaagttagaaatcatgattgtctgtccagggaggaaaaatcttgtgatacatctaaagtctgaagataaatattagcattccaatgatacatcgttttataaaacaacatactccagatacatttactttacaaaagtctaaatctgttatcagaaaataagcccattagaggataaatgagtcatcaacaaagaagagaaaattagagtagatatccaatttagtgctttcacaatcaaatcatttgacatgaatttctcataacttcaaaagaaatgggtctccaaaatactgagaaaaaattaactgtgaactatgtgccaaattaaagttcaccttaaagtttctagatttaagggtttgttgtacaaggaatcagaagaaattattctctgcagtttgtcaattaccacaaccaaatttaaaatcaaatttagtttatttggaatggtttactttacttggttgaaatcatccttatcttctagaacagttgtggtaaatcaatctgtaataatttttattccaatatcttattctaactgtaaaattacttgagtgaatgaaaccctgccttctttagaactatatatggttttaaaatatgctgatttttaaaaacctctctcttagagacagtagagtaataaccggctacttgatgagaaaattctcttaatcaaacccttgttcttcatgctacacctaaagccaccctttcctgacaaatgtgtcatattttggggtagaacaaagatacctgaggcatgatgcatggcctacctcaacagatgacactgctgacagtcactttattcatctttcagtggctctctcaaataactgtctataattaaatatgctcattaatcttaaatagaggacctcctgggcaaatcaaatttcttgtctgatccatttttgtctagtctcataacacaaaaaaatcagatacaaaataatattttatttcagaaggaaattttgaatcttgaaatgatttatttatggtataagtggtattaattttttgcaacgtgttgatcttcagcatctagtttctcactgaaatagattcaagttgtgatcacatagttaagtgagacaatgacagatttttaggtttttagggtaaaagaaaacttcatcaccaaaatcaatttaaagggatgcttaagctgctgattgtgaagtgaaacaactcaagagtatcctggatgttcggataaatttactagtttttcatggacttgaaaaaataaaataaacattcgttttatccttataaagatggagaagaaaaatacaaaaatcagctgggtgtggtggcaggcacctgtagtcccagctactggggaggctgaggcaagagaatcgcttgaaccctggaggtggaggttgtggtgagccgagatgttgccattgcactccagcctgagcaacaagagtgaaactttgtctcaaaaaaaaaaaaaagatacaaatctatattttccagactaaataattatgccttttcataggtttcttaaatccttggatatattgctgaatttcacaaaaagggacaactttattctttaccatccagagcggtgggttaatttatgatttgacgatctttgttccctggcagcgtggtgagacggcactacacatggcagcccgagccgggcaggtggaagtggtccgatgcctcctgagaaatggtgcccttgttgatgccagagccagggtaggtactggtgccctgaggttctcttctatcgcagcgcatgagtttcatccttaagagagggtgttgcccttcagttccttgatttggaaataccagggactgtaagtgaaaggatcaattcaatagcagttttccagaaaaaaaaaagaaacattatttaagcaattacacacgacgaaaaatgcacccaaatttcagaaacattaacatttgaaaaaatgtaaaacttatcatctaagaaatacatcgactgatattttaatactgttttaacctcggaaagcactttctcatatctctttattttcatgaattttaaaatttaacctaaagtatttagatgctatacatattaaaatttatttcttaccacttaaaccaatcacatttccacagtcatccctcactagttacataaaatcaagttattctccaagttttagtgtttttccttcatctgtttgccttccctcctttttatgatatttacttttcttcttactctgattttacaaatttagacattctgtatttccacagttccaaaatagaatttgggcactgaagattgcttgatcagacttgtcctgtttctaatagcttgtaattccttcacaagtttctttttccttctttttctgtttttaaatcttactttccaatttattttctcaccttcctttacattgaatacaccagaatgcactgaatacactatcaatatactgtaccttctatttccttttccatgtggtttggttaacttttgcactgacatcattgagattctcatgttaaataatttccctccttcttcaatatttgatatacctaagttagagctcatttcagtttgagttgtaccattataatacagtgttatcttggaatgaaagcatctggctatggtcatataaattgtaagtgatttcaggcaggtcacttcactttcaagtctttctttaaattattattatactttaagttctgggatatatgtgcagaatgtgcaggtttgttacataggtatatatgtgccatggtggtttgctgtacccatcaacccgtcatctacattatgtatttctcctaatgctatttctcccctagccccctacccccgacagtctccagtgtgtgatgttcccctccctgtgtccatgtgttctcattgttcaactcccacttatgagtgagaacatgcagtgtttggttttctgtttctgtgttagtttgctgagaatgatggcttccagcttcatccatgtcctgcaaaggacatgaactcattcttttttaaggctgcatagtattccatggtgtatatgtgccacattttctttatccattctatcattggtgggcatttgggttgcttccaagtctttgctattgtgaatagtgctgcaataaacatatgtgtgcatgtgtctttatagtagaatggcttataatcctttgggtatatacccagtaatgggattgctgggtcaaatggtatttctggttctagatccatgagtaattgacacattgtcttccacaatggttgaactaatttacactcccactaacagtgtaaaagtgttcctatctctgccaggcatggtggctcacctctgtaatcccagcactttggaaggctgaggtgagcagatcacctgaggttgggagtttgagaccagcctgaccaacatggagaaaccctgtctctactgaaaatacaaaattagactgctatggtggcacatgcctataatcccagctgctcaggtggctgaggcaggagaatctcttgaacccgggaggcggaggttgcggtgagctgagatcgtgccattgcactccagcctgggcaacaagagtgaaactctgtctcaaaaaaaaaaagcattcatatcctctccagcatctgttgtttcatgacttttaaatgatcaccattctaactggcatgagatcatatctcattgtggttttgatttgcatttctctagtgaccagtgatgatgagctttttctcatattttgttagccacataaatatcttcttttgaaaagtgtctgttcatatccttcgccgacttttcaatggggttgtatgttttttctcgtaaatttgtttaagttccttgtcgattctggatattagccctttgtcagatggatagattgtaaaatttttctcccattctttgggttgcttgttcactctgatgatagtttcttttgctgtacagaagctctttagtttaattagatcccatttgtcaattttggtttttgttgccatggcttttggtgttttagtcatgaagtctttgcccatgcctatgtcctgaatggtattgcctagttttcttctaggatttttatggctttaggtcttacatttaagtctttaatccatcttgagttaatttttgtataagacgtaagagaggggtccagttttagttttctgcatatggctagccagttttcccaacaccatttattaaatagggaatccttttcccattgcttgtttctgtcagatttgtcaaagatcagatggttgtagatgtgtggcattttttctgaggcctctgttctgttccattggtctatatatctgttttggtaccagtaccatgctgttttggttactgtagacttgtagtatagttcgaagtcaggtagtgtgatgcctccagctttattctttttgcttaggattgtcttggccatatgggctcttttttggttccatatgaagtttaaagtagttttttctaattctgtgaagaaaatcaacggtagcttgatggggatagcattgaatctataaatttctttgggcagtatggctattttcacaatattaattcttcttatccatgagcatggaatgtttttctatttatttgtttcttctcttatttccttgagcagtggtctgtagttatccttgaagaggtccttcacatcccttgtaagttgtattcctaggtattttattctctttgtagcaattgtgaatgggaatttactcataatttgcctctctgtttgtctattattggtgtacaggaatgcttgtaatttttgcacctggatgttgtatcctgagactttgctgaagttgcttatcagctttaggagattttgggctgagatgatggggttttcaaaatatacaatcaagtcatttgcaaacagagacaatttgacttcctctcttcctatttgaataccctttatttcctccccttgcctgattgccctggctagaacttccaatactatgttgaataggagtggtgagagagggcattcttgtcttgtgcagcttttcaaagggaatactttcagcttttgcccattcagtatgatattggctgtgggtttgtcataaatggctcttactattttgagatatgttccatcaatacctagtttattgagagtttttagcatgaaggggtgttgaattttatcagttttttctacatctattgagattatcgtgtagtttttgtcattggttctgtttatgtgatgggttacatttattgatttgcatatgttgaaccagtcctgcatcccagggatgaagctgacttgatcgtggtggataagctttttgatgtgctgctggattcagtttgccagtattttactgaggattttcgcattgatgttcatcagggatattgtcctgaaattttctttttttgttgtgtctctgccaggttttggtatcaggatgattctggcctcataaaatgagttatggaggagtctctctttttctgttgtttggaacagtttcagaaggaatggtaccagctcctctttgtacctttggtagaattcagctgtgaatccgtctggtcctgggctttttttggttggtaggctaattactgcctcaattttagaacttgttattggtctattcagggattcgacttctgcctggtttagtcttgggagggtgtatgtgtccaggaatttatccatttcttctagattttctagtttattggtgtagaggcatttatcgtattctctgatggtagtttgaatttctgtggggtcagtggtgatactcaagcctctgtaatggcggacgcccctccccctaccacgctggagcctcccagattaacttcagactgctgtgctggcagcgagaatttcaagccagtggatcttagcttgcttggctcccctggggtgggatccactgagctagaccacttggcttcctggcttcagccccctttccaggggagtgaaccgttctgtctcactggcgttccaggcgccacggtggtatgaaaaaaaactcctgtagctagctcaatgtctgcccaaatggcatcccagttttgtgcttgaaacccagggccctggtgatgtaggcacccgagggaacctcctggtctgcaggttgcaaagaccatgggaaatgcgtagtatctgggccagagtgcaccattcctcatggcacggtccctcacggcttcccttgcctaggggagggagttccctgaccccttgtgctttccaggtgaagtgaagccccaccctgctttggcttgccctccatgggctgcacccactgtctaaccaatcccagtgagatgagccagatacctcagttggaaatgcataaatcacctgccatctgtgttgatctcgctgggatctgcagatgggagctgttcctattcagccatcttgccagcctccggccacttccaagtctttatcagtaaaatatgagggttggactcagaaactcaaaactcctttctagactttcttaacattctttgattcaatgaatttaatagacattttcttgtaacaggttccacagatcttcatgcagaatccagtgatacacgggtagccttaacattactcttgttgtcttggttttcatctgcctttctgtgcattgtccacatagtgtaatttatgttctttggtaatcatcattgatctattatattcttatctatttaaagctttattcaaccatgagcttcccctgccataacatttttctggtttccttttaaggttacctggcattcagctatttgaaaaatattttctatggtcaaccagtgcactctgactatcgtatactttactggaaattgtgttgatgttcctgtaaattttttgtaattcgtatttaataatgaaagagtttcccatttctgtcttaaagtaaaaccccttaatgtttattattcaaattaaaatttctacttttaatggaaatttattcattttcatgtgtctctgccaaatttttctgtattgatataacccattattacaaccttttatctttttggataccctctgaagcctcttccttaaaagcaccactggcaacagagtctttcctttaaaatattaattaattagttaattttacacaaagatttcatcaattctacttttttacttctcttttgcaactacatttagtatcattaatacatatatagctacctcttaattccttattccttctaatttaaatatcaaatttcagatgttatcttttgtttattttttttcttttcagctctacctcccattctaagctacaactgaaatcccttccctatagcattttctattgtgaacaaacaaaaatactgtagccttgtgaagcagtgctccctaaaggtcaatatgcatacaaattacctgggcaccctgctagaatgcatattgtaagtcagttctgcatatttaacaaactctcaggtgatgtcagggctgctgattttgggattatgtttcaagcagcaagaagttagggttttcctattcataagtcctattttaaagcgtactttcaccatgtgtgttttattgtcatttaatccttttaatgtgttcctgggcctctgatttagttaacatttgaacagtgctttagaattcatcaagcatttaaacacaaagtgtcttatttgatacccagaggattcctgtgttgtagggtggcttagcgtcctgaaattcaagattgtgctgattaacctgtggtgacagagttaagataagaaaaagatttctcctctgattccgcatctttctcctaactctttctgctaacgtcattatctcccacttcaaatgtaaagagagcccctcttcctcccatccgaacaaaccactggtttctaattagtcacattctttccctgagcttatgactatgatcaggataaaagatcaagcttgggctcatgcgcattcatgcggcccatttatgaggtgggataagaagaccagcagcccttctagaaccacatggaatatgggatgtccgtttcccccaaatgagggatggctgtcccagaagaagggtgcagggggtattgggcagaaaaatgagcacatatctgctattttacctcttgatttctcaccgcacgcatgcgtgcacatgcacgcacagacacacacacacacacacacacacttttggaaacttcctctctaaacctaataacattgctcgagaattcaccctctcccgaagaagagatagtaaaaaattgtgccaagctactacattgagctccaaggttgagattgctgcgtagttcacaatcttctcaatcaggtttagaaataatatctcatgggtctaagtcatatgttttgcctattcacaatatataacaaaagaaaaaccatatactcataataacatctgtaatttttaaagttcacgcagaacactctattcaccagtccagagcataagacacattttgctggacagactggagagcaggggaccacagtggcctcagttcctctgtcagccaatgtgtttgcacccaggtcctgctcgcaggaaggtccttccttgtccagtgtcctcagtggacattactgagaaggccaccagagcctgaccatctgggagctctcttgctttaggagctggttctgttggcacaattacagggcttggcatttgctttagggatcgagcaatcccaggggtcctaggcttaaactcacttgaaacttagctcatttagaactttagttagatactaggagatgtggctcctgggaaccctgttagctagtaactagtaatagaaattttatcaaatctttgaactttatcccagccagtgttatttttctctttgtaaaaggagctggggctcagcaagtctccagagtaaaatggtagactgcagtggcaaagcagagctcacctacttccggtccaggctgtgtcagccagtgatgctttatgatgagggaattgttgcctctcatttttggaagaggtctatgtgatcaggcttccctcgtttctttaccttttcccatgaatcttttcttctgcacttccccaattcttttccctggtttaaattaacattacccttaagcagtaaattcaacttttgcaattcagcagggaaataattggccaaacctcaaaaagtcttatatccctggttacaggttgaaagattttctttgcaaaatttgcatgttatttccttttccactttcaggtaaagctttagcaaaaatggaaaaaagtaggcaagacatcctattttttaacttttttttttaaagaagaacattaatgctatacagtctaagaaccaaggatcaatagttaataactaaccaattatgtagctacctctagtcaatgattgccacttctcagctatggattaaagagtcatcattgctccaactatccctcttactcatggaaaatctattttagagtgtgtcacttgcaatacccacccacctttatcaaattttgcaggacagagatctgagaagggaaccccagaaacaacaaatgttcatcatagctattctcaagttccttggtttttaaattgttgtttgttttgctaaccatttatttttataaataaaaatatgttcattttatttataaataaaaaatgtttattctcccaattcctctatttttttcctctgtatttcagagaaattttatcttctaatgtgttgtcagtctcctttcctactgagagtcactttgttccgacaggtctgttagtggccatcttattgtagtatctgtttccaaagaatgtataggcagagaaatgtctttagaatccaatgccctgaattcaagttctgttttaatagctgagtaaccttggacaatctttgagaacttgtttaatttttcttaatattgacctggaaaatggtctaataatacattttatgctttccttttaactctgttagaaagatgggtcacatatgcattgtacatgaagaaaggttttcaattgcaaatgttcacaaaatttcaattctagtctaaaataatcatattactgttatttatttacttcttactaccttggaattcatgcagtgctattttatctcttcctatagctcctcttcttttttcttataactttaagatactgcatgtttttggatagatctttcttcctctatatacttttctccattcattcttagccctgaaagtcagcccagttttcccttcctcacttttattatgacatgcccttgggcagatagtaaagatatacctctttttatcactaaagttacactcaattttctttttacaagagaatggtttggcctggttctctaaacactgaaaacattatttccaactacacttcagagtcaggtgattttcctgagcctcctggaacatgtccttcctgtcccttagacccagctatatcctctgtttttaatggaaagtacttggcaaatagttcaccctatttgctttttgccagagccccatttcattttttaagttctggatgcaagttccagaactatctacagcattttctgaaacatcttttaaaaccagattacaatatcttctttgtgcactgtttctccttgaagaaaatgaccagcatttgtatccttggcttgctgaatggagtaaaatcaaagattttccagcatccctggttctttttctttgaaagagttcccagaataaatcctgtttctaagtgaaaactcttggatgagaatataggtcctaggacttttggactagattttattcttattccaaaccatcagttagtttatatttaaacataagtgaggcctaaagccttaatgagttgagaaatatttcagaaagcagtgatcaagttcatggaagtatatgctttttaaaaatcaaagggagactttgtgaccaacagggtcactgctgtagcaaaatataaaatatgccatggttaaagcagtaatgattttcttttgggtggggttcctagagattccaagaagacatcatgaaatatgtgagtgaaacatatcaccagtgaagttctgtctgcccggcactaactttttacttggcttgagttgtaggaggaacagacacctttacatattgcctcccgcctgggtaagacagaaattgtccagctgcttctacaacatatggctcatccagatgcggccactacaaatgggtacacaccactgcacatctctgcccgggagggccaggtggatgtggcatcagtcctattggaagcaggagcagcccactccttagctaccaaggtaaggagaatgacatcatgagaacatggaccaagaggattcctaagtcatggcctttctgctctaccacatacagaatcaagagggtagatctcctcaggccttgacttacttccttctctacatatttaagactcattgtctaaatgatttaatagaattgtgagattccgtatatcttcaataaagagtgctgaatttcattctaattaatgccaatgtttctaggacaggtatctagtactctaagatgattttcactttttcttctcttttattataaaatccataatatattcttaagaaaaagataaatgaaatccctaaatatattgaactggtaatactaatgaggaagagggtactgcattagattggcagtactatatttgctgtgagttatagtaccagatcgaagctcaatttacttgtacattttcgcaaccctactattagccaccacttatttgacattctcattcccatattagtttccaactttaccaactacacttttgcctgggtatttacagtgtttaaagagagctgaagctggaaaatcacacttctttagttgttattgacatcgagcaaagaattttacttatgttccaagtttcatgacagggcagagtaatttttcccatgctttatacatgctgtttgacattcataatttggagatgacttagaataaaacatgaatatactcagctaattagagcaaaattaattgagccagtgcaagtgaatttgtcatggggcaaaataattcccacaaatgtaacagtgattcagattaatgaaaggacaatttcaattctctcataatcagtaggtataagtacttcatccagggagagggaaagttgcaaatttaaactgagatagtgatgtggcatctgtcctcttgtaagtaggagcagcccactagctgttatggcttatctggttgcctgttatgacttacctggttgcctatggctgtaaaaggtattttgatataagaaattgacaattattgaagttctgaactctgaaaagttggaaggattttaaaagttcttaaaaaaaaaaaaaactaagcaacaaatgtagtaataacctgagagatttggtgattgtcttatcagaggagggtgtaaatcatcaaaattaagatacataaaatacagaaatagataataaaacgtagtcttttgtctgtcaaagatatttaggatttaaaaaatataactatatccatggtaaattagggcgataaaatagaataaaatgttaaacagtgttttttttttttttttttttttgagacggagtctcgctctgtcgcccaggctggagtacagtggtgcgatcttggctcactgcaacctctgcctcccgggttcaagcgattcttctgcctcagcctcccgagtagctgggactacaggtgccctccaccacacccagctaaatttttgtatttttagtagagacggggtttcactgtgttagccaggatggactcgatctcctgacctcgtgacccacccacctcggcctcctaaagtgctgggattacaggagtgagccactgcacccggccaaacagcattttaagagttcagctgactagggctgaacagtggttgattcatcattattaaagacatttaagagggtaaatgaaatcttggtgagattaacataaaggaagaaggcagatgtgtgactcaagagatgccttctaactttggttttgttattctacagtagattttatgtatttttgtctaataatcatttccaaacttataagagttggatcactattctagcaagactttaaagataaggagtttatgttttcttcctcatgatgcagttagcctcaaagaactctgtttcatcctgagtatcaccctaatcattgtgtgcattgagtggagggaggagagctctaaccacaaatgctggtttatatggacaatgcaagaaggaataaatacttcctacgtttgtcccacacttggaaaaaaccagaagattcgctctcttccaaggatttattaataccaaatgttcaaaaaagaagcaaaaagaaaaacgtcatctcatttaaaaataatttgtctggagacaccgaaagggcaatattgcttcttgggggatattctgtgtttatgatgggggcttaaatggttccaggataagccatggcttagagcacctaacccaggcatatttgctatgtgttttacaggccctgatcggtgttagaattcccccactcccactgtagtgccagaagagcatgtggttaaactgtctggccaagaggatggatttgacatcatggtgtaggaactgtgccatcctcgagatcttagtccagagacttatctgtatttataacacactgctaattacagagtaaggccattggttaggcacggaagacactgaatgtacacatatcaacatgtgtaggagagcagccctctaaaaaaagctctaaagcttcagtgtgtttaaaagtctggtgttaatcagcccaacatcatgccagaagtagaacgtattttacaaaagcaattggtcttttagacagtgtgagtcttttgggaaaggggacaagtcaggatgggagttgctttttaatagtacatgttttttgttctatagaccatttatcttgccatttctgcagaaaatatgtcaactaattcacgaatacttgtttttactatggctgccaaaatatcctaaaatttaaatgaatttggaattcaggtgttataaaaaggattgaaagaaagagaaggagggttggagagaaggcagctgttgtttcaattctattaattttagaggcaagaaaaggctttttttccccattcacaaattggagccagtttactgacactagtggcttttaaaaatcccaaacctataaagtcagatttcagtctccaagcccttaaaataaaatttcttttattcagtctatcaagccaaacttttgtatgttaaattgtattctttttctttgtccttgttcatggctaacagatttaatgctaccagtattttttccaaatgaagaatcagtatactttgctcaatatgttaacaaataaaaagattttttgaggagttacaacaataaatacgattttacttttgtttctcacattttcagaagggttttactcccctgcatgtagcagccaagtatggaagcctggatgtggcaaaacttctcttgcaacgccgtgctgccgcagattctgcagggaaggtaaagattttctatacgttataattatgtaacagtgaaggtgatagattaggagatctgtaaagacatttttctcacttctctgaaaggaatgtgagagcaactgatgaaactatcccaaatagacatggtggcgatgtcttccatgaccgtccaggtacatacacactgattcagaaagcattttgagctgtgcctcaaagtcttgtcacaacagccccagaaagtctctatattaagaagaatccctgcaatgttaatgtagtatttcttacatagcagtttagacctttttacattgtgaccctcaagatcccctttgctggtggtatgctcattttcaattttagttatgtttttaatatgaaaattattagggatttgtttattttcgttcttttttctattgactatattaattcattaacatgaatttaatcaatatcagtttccaggcatcctggtagcttcagggcagctaaccctaatttattaatgctgaaacttaaacacaccctttacagaacggccttaccccgctccatgttgctgctcattatgacaaccagaaggtggcgctgctgttactggagaagggtgcttcccctcatgccactgccaaggtgaggaccacagaaaaggatttacaggcatagggtgtaactatcgcctgaaaacacatgagaattgtcttttaaacacatggtatagtataactgcgactagtcctagcgatagtagcttttggtattgacacccttttttttcccttgtatttctgccagttgcgtcttgaaaatcttttttaagattttttaagagtcagcaaatattaaggggatgtgcctataaaccagtagagatgaatcttattgctaacattctgtgtgttagagaatgaagtctgaattttgagaactgagaaataaagtcattaacatattttctcttctctcctataaaccaaatgctatgatgaaaatgtccttttatactctcattctttccgacttcaaacttctatttgtttctttgtctttttttttaatgttttacctgtgttaactgtagcatggatccctctaagtccctagattcagaggtggtgggaggatgcctttttggtgtatatctagcaccaaattccgaaacagctccaactaagacttgtacttacggacagggcatttcccaccattctagttggccccttattacactgaaaatatatatgaatgtcgtataatgcataaagtcctcattgcgtctttcgttcattaattaagcacagctattttgagaacacatcagggtttatttaaaaaatattgattgtaatgggaaaatatttatgctatattagacaatataataaaaaaactgccaccatttatttgccaaacactatgccgagcactttacaggcaatatctcataataaccccatgagactggtattctaatgatctccgttttgcagatgagaaggtgagatttaagtaggttaattttccaaagtcatatgaataataagtgttagagcttgtacctgtgtttgacctcaggcagactgactttagagccggtgctcttaaccactaggtcctttgtgccccaaagcaatagagggagatttattccacttctgttatacaaatatatacatatatactcatatgcctatttaaattttatacatattataaataaaaaataggatatatacataaaatatgttctgtataatatatattttatatataaatatattatatatatcataaatatataactttgtacacatacatacatatacatctacatatatttatatctttttgatgccaataaacagtttataataaagtacttgaactgtcaaaagagggtgccaaatgttcataattatccacactgttcttactcctcttttttctacaacctcatcaattcagcacatattttatgtctttctttacactagattataagctactagaggagtgttcatatcatattcatttgcatatctatgaggtgtttaataacatatgtgagttcccaataaatttggatgaaagaatgaagattgagcaactatggaataaaaatatacctgctcacttaacataccagcattttttttttcattagctttccaggctgaccattctcaacatagatacaaaagacttcattagtactcatgagtactttcgttgaactcttacaatgtgcaaagaaaggattataggtactcaatgggaggtaaaattgtaaaacgtgtgttctctttccacaagggactctcaatctacttgtaagagaagacctagattataaaataatgtgtatagttttcctaaggagataaacatagccttgatttctagcctctaccttgtatggtccttaatcttaggcatgcacgtaccgagttcagaagatgacataaagcatttgtctactccagagtccacagtaggatgggtattctgggaatgcctctctagtgtctttcacttatctgccccagcctgtcaatgaacatgagcccttcatctttggggccactcctagagggctccagatggtaagatccccactgtagtctccactttagactctctttctgctcattataatgtctcctctccttaatacacacggtcctttggccacgagaactttgcttctttccaccagagtccagaaccttctcttagtctttattgggagtgctgcaattatttgagtccaaaaatgtttcctctttgtggagtaagagggcttttcagatcttgtaggttgagtatctaccaggcaaacctcctccattgccagaattgacaccttctttgatgatcgcttatgttgttttgctaaaatatccctgtacctaaccttagtagagcccatgctgtaggcagtggggtaactaagactaaagaaacacattgtagcaaaaagaagttgactaaacttatttggtccacaaaaatctgtgtgtcctttttttcaatagagtctatggacacaaatacagtattttgaagcatctgggacctctgatcagaccctgaaaaggcttccaagctgaatttccttcagttgcttcaggagaaacattgtttgtcaaaaatgaaagatacttattcttgcttggagaaatggggacagagtagataatgtagggttgtgtgaggatcaagatttgatgatagctcataaagacatttaaattctcaaaacacttttttattttttggtacactttgcagttagctttaaggaaatagcatgacctaaaaatacctctcaagtttgattacaggctcaaacctgtaatcccagcactttagggggccaaggtgggcagatcgcttgagctcatgagtttgagaccagcctgggcaacatggtgaaaccccatctctaccaaaaatacaaaaaaattagccagtcatggtggtgtgtgcctggagtcctcggtacttaggatgctgaggtgggaggatcacttgagcccaggaggtggaggttgcagtgactgagatggcaccactgcgctccagtcttggtgatggagccataccttgtctcaacaaataaataaataaaacatctcatggtaatctcacaagaagcacttggtcattatgctctctttcccttcagcatgtcactgaagggaaaagccactgtttttaatttctatcacacattttgaatggaaaattctaccggatttgataaagaaaaggaaataaaacaatatatgttgcagacttacagttgttccacatttttttcttttaactaaacatggggtatagagttttgttcttgtaagcagagtatgagttttcctgtccctctccacaaactcccgcccgaaataagtagcctcatatttgtactttcaaagcagcaggttataaagaaggggagatctaggatttgaatggaccacaagattcatataagctaattttgttgttgaatatattttaaattagaatgcaacccattaaagacagggatcatgtcatgttcaccattgtattcccacacctagcacactgctcggcatattctaggcactcagtaatatttgttgaaccagtttaaagtacaatccaaacagaagcatattagttggagtattatagtaagataatagaaataattccatttgattctttatgttataaccatatgtgaagtgtagccttggttccagatagcacacacaattcaagagcaatattgacaaactagaatcagctcagaacaggtcatccttatagggagagatctagaaatggcacttccatcaggaatggttgaaggaatggagaaaattaacctggaaaacagaaaactaaaggtggatatgaaaatcatccccagtatttaaaggatggtcatgtagaagaggaacctggcttatcctatgttgcttttcaggagagaagcaatattataaggagagaatttttagttctggagctttgatgtctatatctgtcttacagtagaatggggtgccttgtgacttttattgtagagattcggttattgttgaatggaaacgtgatgagtaagagtttggattaactgtaaactcacttttaactcttctattgattagagatttttatttcctttagagatacgtattagagcaattgttaatcttactctatatgcatgtgttttatttttgttctttttagaatggctatactccgttacatattgctgccaagaagaatcaaatgcagatagcttccacactcctgaactatggagcagagacaaacattgtgacaaagcaaggagtaactccactccatctggcctcgcaggaggggcacacagatatggttaccttgcttctggataagggagccaatatccacatgtcaactaaggtattctgtcctttcttgcatcaatcaagagtgttttggatgcatgtaaacaggaaccaatcgcagacagtttggaacaaaaaggagcaatgtattaaaaagaaacagggatatcttacagaccccaaggacaggaagggagtcaagccttatgagagattagaaaaccataaggaagcaagggagagagactctctgtatggcaacactttggcttcttgacttttctatgcaagtcagtttcattcatctctacatccccgctttccttgcttttctctgtgtgtctaaagaggctaccctgtagctcccaatgttaacatcactataattgctccagtgtctgctgctcctcattctaaatttcatatgtatagagagagaaagaatgcttccatctggggtttagcttaaacaactgcctctaaactggcaggccgatgttcaccacccaaggcattctttagtcctgctgggcatctgaggcacctatggataggagagaggaaactcaataaaatacagatttttttccatcaacgtaggcctagcttgagaggtttggtggtggtggtgagaaaatcatttttttttaataaagcacatcagtcattttagcctttctccagggactggcctctatagacctccgcattaattataatacaatggcagtcaaagatataatggaaaaatattcaaatataaaaatatatatttttacaagtatatgtcttttgatacatctatccatccatctacataaagacctatagatccatctatctaactttctatcttacacttatatatatgctgctatagccagctgctgagaaacacagaattggaaactgtatttattaagttggtctgtcatttgatgtcttgatgctttttgtaatacattatatgagcttagtgaaaattacgtttcttagctccttccataaatatacaaatactctatgttttctacatttcattgttagttggtacttttaaagtatcagtgataagttggtcttaatgacatttgtaaataggttatgtagcatgcatccttcaggaagagctatgaaacaggcagattgccttgaatacttctgcagtcctagtctattttcttgtcactcagaagtgttcctgtacatcccctgcccttacgtacttctctggcctttataaaaagtccccacaaatccttttttaaagcacgatgagagcaaattatagggttagtcttccaaaggatagttgcatttttataagaacgaacacgataaagccttatagtgaaattccgtgtatcagatggacaatcattacagtctagggcatgggcgtccttgtgactgttgacgtcatgtcattcaggtggtcatttaccctgttggagaaaatgtgatcatgaagcatagaatattttatttagtattagtgtatgaagggggcatgtgtttactctattaataacaaataaatcttcatttgaaaatcagccaaagaaatccataaacaattcagcagtattttgagtaggattaaaattccagatagttcatgaaactgatcttacagtgcttctgatggtgttatttttaatttataaaaatgacaagtacatatctgaaatcagttcactatgtcctcctttacggtattcttctaaatacattactttctttgacagcgttttatcagttagcaaacatttaaggagtattttttagttgcacactcagcaatgaagaaaaacattcaattttgaatcacaaagtaattttgttatctttataacaatgatttcagtattacatgtgagtggtgtcctaaacacatagtatgtttatcactagagtaaaactttagtaagtttacacagatatatctgaataataatacaatatacaaaatttacataaaacatataaccttgccttttggttagaattataagataatgcaactataaaaatatctcagataagcagcaaaactgataaaataatttcccattgcttttgaagaaaacatatattcttttctttttaaggccaactcaataatttcatagtctccaaatgattatttcacattaggaactataatatagaagtgatattataatcattgtccaaacaccatctatcataaaataaaaccaaaaaagatccgtcgttgggtccaccagtgtgtcttaggaaataaattactttttttgaaaagaacttcaacactttctattttcttgatttattagaaaagttttttttttttttccagaaacctttcaaacagtgtttttcctctattctcacacctaccacacaacaatcatcaacacagaagacttctgtgaccaaatgcggagaggttttccccacataccaagcagcacacaccagctggtgtcctccaattcagttctaacactgtctatctggagagagtgttagatcccttcagttgagggctcagtccccaagactgccctctgcacagacaccaatcacaagtctgggcctctgaacttctgacctactggcttcaagttggggttcccaggacactccctttgagttccattaattcactggagtggctcacagagctcacagaaacacttacattcacagtgcttacagtttcttataaaggctattacaaaggatgaagatgaggagacacatagggcaaggtatgagggaaggcacacagcttccatgcccttcctgggtgcaccaccctccacaaggaagctccaagtgttcagctatccagaagctccccgagccctgtcctctggaatttatggaagcttcatgatgtcagcattcattcccccaggatataggatgggactgtctctctcaggagggtcttatgatccacaaatgctgggagggaagattagagcctagccttagggaaagtgaaaggaggccgggggaaggtgggagatattttgtttcctgaggcctggccctgaggcctaaaacgcacaacgttataacaaaagactgtaataacggctatgggagttatgagacagcaactgtggacaaaaacctatattcactgcagtttacatcctttgatttggatatgcaagtttaccacaataaactgcagagattttcatactggttgttagtttgtaatcttgcattgcagaaaatccattctgcaaatagagcagaaaaaagcacacatatttaaaagtcatcaaaaatgtctttgagatttgatgatcacttcatgtgatgatcacttcaataacatttttaaacagactatctctgtaaagagaaatattctgtttgttattttagtaaggagaaaattaagaaagaatcttgttttatcctaatattcacattttttatacattaggattaaataatatttgtttagaagtgaagaaaattttaatagaaaaggatacaccttctatctcaccctgtgttttacgaaactcaaagttgagctcacccagagctctcaggattaaaaagctccaggcccacaaggaaaaagcctcctctcacgttgtagaatggttttctctctctaggtttcacttacatttttgaaataaggtcagtgtcctttttgatttccagaagtagcaccatggctggagatcatgaattttgaagaacatggcttagctttctcagcctaagtgctaatgcaggagagtgggcctgaaaagttgtggtcaacagggctggtcaattttaatcagatgtgaactggggaagaggtgctgactcagagcccaggtagccacctcagtctatagctgcaggatgtccaggaagagcataaatatactaggcatttgaacaatagtgaggggagagaaatatacagtataaatatactgtaggctagaatgtaagctccataaagacagaaacttttgttcactgctgtattcaagtgcctagaatatgaacacttcatgacatatgaaacatactcaagaaaacacccgtaaacatgtaaggctaccagagtgtgacattggctgaataagccactttcccccatcttttctccatgcctttctttttttattattaattcataactgtaccttaattggatattcaaataattacttgatgtatatataccaaacatgttgcataaagctgagcagttgatggtgctgtataaataatgaggttactttaaggtaatgtttagaggaacctcctgaaaagtataccctctttgggtgctggagaaagtttttctgaactcatttcctgtaactgtccattttttacactgatgtgatattttgttgataaaatatagatgattattatgcttataaaataggtgtaatagttggttgatcagctatttaaataaataagttgatacagcgggacatccagatggatttgaaatacatgccatttgaaagcttattggctgtgctattttaaagtctcacatcataatataagaacccattatagaaaatagaaaatgtaatttgcctgatgtgttgattgacttagaggacatgtcttagaggaaacaccattaatttagagagtttgccttgaatatcagaagatatagtttctgggaagaggctatgagttttccaggatattttcaatattttcaatattttttcataatattatagatgatgcaatgtattttcttcttcaactgtatccctttggttccattctttctgtagagtggactcacatccttacaccttgcagcccaggaagataaagtgaatgttgctgatattctcaccaagcatggagctgatcaggatgctcatacaaaggtaaagcaaatcactctcagtattgtgacaggttctggctgggatgattcccagtagcccccattcgggtcaccccatgtccagggtcttccctcctcaagagtccattctgaaatataaactaatcataaccctctcctatgcacaaatctatggtggctccccattttttgctagaatcaagtccagtggatagcatgaggtcaggaccctttgcaggaagactccaattttgcagccttaagtctatcctctctcttactgctttagctagttcacatgacttgctgcgttcctcttctatttgctcatctccatgcccttggtctggaaatggattttccctctctatgccataaaattcttacccattctttaagcctgctgtagctacatgtttcctgcatctcctatcagagtcattctgtctttgctgttttcagatattatttatgcctctctcttagttctttgcagattttgtcacccacatctgatctctcttgctgatatgaagttccctgtggtcaggggcacatatataatctgctaaataatatctttagtcaaatggaatcctataataactgatactctacccagtccttctcctctggggtattaaccactagagtagtaaagtttctactttatctatttttaactttttattattatttacagcttggttacacacctttaattgtggcctgtcactatggaaatgtgaaaatggtcaactttcttctgaagcagggagcaaatgttaacgcaaaaaccaaggtaaagtacttgtggtcattttcaattcctataagcaaaaaggttcagccatctggatgcttcactagtttaccaaagctacaagtgtatttttttcttcctttttagttctaaagtgattttgacgaggtgatgtagttttgtaattatttgagaattttcattctaataactttgacatccatgaaggttagcttcgaactacttctattataaagttaaagtagctgacatcgatttaacaacttactgcaggatacaatagatgccggctagaacatcttgatgttctggcagatttcctttacattgtttcagtggcttggcccccctcccctgaccccttctcctctcatgaagaaatacagacagtcagcctagactgcgtgcctttcatttttaatgaactctgtcacattcagaacatcacatggacatgctcagtgaggcaataatgtataaggcctgggctggaagttctcaaggataatgcagagctgacttgatcccagcagtttccccagtggcatttgaaaggtcctattcagcaaagcaaggttggaacataacactttacttcgtgcactcaatgtggttcaaggtgaatagaagttcatattgtaactgtggctattatgcatactataacttgcagctccaagttctttgatccaaagaaatatttgtttgcacatttatttaagttcatatatcagaaatttctttttcttttttttttttttttttaagacagggtcttactctgttgcccaggctggaaagcaatggcacgatcagagctcactgcagtctagaacctgggctcaagtcattctcttgcctcaggactggctaggactataggtgcatgacaccatgcccggctaatttttaaaagtttttgtagagatgaggtttcactgtgttgcctaggctggtctcgaactcctgggctcaagcgaaattctcccaccttggccaaccaaagtgctgggattacaagtgtgagccaccaagcctggcccagaaatttctgactgcagctatttgaatgggctcaagtaaattagtgtgagcacattcaggacttttcaaagccatcattcaagattctataaattaaaaatatacagaagttttataagtcagtctttatattctcttagaagcagaaacaaaatcatttctatacataagcatgtttatagctaatttaaaataaacttatttttaaactataaataatactattaacatttaagatttaaacttataatcttactctagcaagaatagcttgctgcctagtttctgaccagttcttaagttctcatgaaattgaactttgagacttatttaaagcctctaatatgaattctcaggcattagctcctaaagccttttctgatgagccagctcccatataagcactccaggaaagacattttggttggaatccaagtattctcttgaaatgaacaaatgcaacagtacagtgagatgttggcagggcttgaaaatgcttatcatatttttaaatgtttcattgttgaaatggttataatatttagtaggcaaacactatattgtctagagaatatcaatggtctccctggagtttgacctgcactgaatgaagatttgattgaaagaaaaatctcattttatcatttcagttttttttgtttttttttttttaagtgaactaagttgcttgcagtgttacatttggaaccatatatctttagggaaatagatacaaacctcaaaggacagtcttttaataaactcttcagattttttttcacatgaaaatgacatctttgggaaaggaattaggttttcttcctcatatcttatgtgtagctgtagttactaaaaatggattcattgctttaaaaatgtaaacatatacattaactttactctgtaaactctcatgatgtggtataaaagatttggcaaaattaacttgttttataagactatttgttgcttaaaattagaatgaaaccctgttatagcaacttgggacgaaccagacctggttaatcatatatttaatttgtgaagagggtttagaacagcacatgaaaaaaattgtatttattaaagacactgtgaagattatagagctcttcaattagaaaaacaaacaaacaaacaaacagaatgaaaacaacaccaccaaagtgattgctaaaattttgaaagctagaaaataaaacatattcatgaacaacttatcttatccttcatcaaacttgaaatcttggccatttccatttttcaaatgaggaaactggggcttagagaggattaagggtttgcaaatgattggtagcactgggtctagagctcctagccagatgggcctatgacagtggattaagaatcaaccaaatgtttacgtaaacacttctgaattgctccagacttccctggcaaatatcctcactggggatttcaggtaaaggttagattaaatcagggctggggaacatttttgtggccacaatgtccactgatctattgagggcaagaacgttgctttggcattattaatttacatatatttatagataatttaggtttgtttatatattatagtgatatattattttattaatttacatgctaagttatttagcacatagtgtgtgattagtaaatgcttgttgaatgaattaacttggctgatactgaaaagatgaactaaattcaatggatttaatggatgtaaacacaacaaaaaggaagaatttttacaaaaagaagtatcgcttagtgtattctcctcaaatgtccatggattatctgatttgaccgcagagtccctgtaatagccaaaggcttcttggagtccctgtaattgatttatattttcaggtttcctggggtcatcccattgtagggatttataaggagatgtaagacttccaacatgacagagttgaggatgtgccacacttagagacacttaggtaaccctgatacatgtgggcatgttcctatgggcagacagagtgcagtgaatttataaagaaatcatgtagcacccacatctatagtagacagaacaagcaaatatgtatgttgctcacagggcagcagtgacattggatgaaaggggtatgtacacttaaaagcttagagtatgaaagggccactcagaacttagagcccaggacaactgggtctgaaacatatagataaaattttatgagaagtgaagcaggtggattttaataaataatagccattgtctggtagccattggctgtcatagtcttctgcacaggatctgaacctcgcccgattgtggagaaattacttaactttcttattttcagtttcatcacgtctgaaatggggagaaaagctgttcttggaaaggaatataagatttagatttactttcaatgatttagaatccctaaagctaagccaaaggttaattattaggagagtcatgatgaacaagcagtggtttatatgaccctctgcaaccttcagttaaaaacaattttaactcttgtttcccagggaagaaatcacagataatgctgttttcttattttaaatctctcttctcagctcagatgtgagcagaagtcgactgcacccacccccttcaccttcttaagggagccctcctttttaatgctaactggttaaaatgtaataatagttatcatttggagtctgttaatcttgtttcatcagctggtctcttctctttgcttagcagaccataaggtgtgagggagtgtttgctgctgagaaatgggttgctgatcatcttgggctccaaataaagcatctgtgatggttttgttgtaaataagactattcaaaatgaaggctaacctaattttcctctccctctgccaatcgggtgctgggcccgccaccactgtcctccacagaacggctacacgcctttgcaccaggccgctcagcagggtcacacgcacatcatcaacgtcctgctccagcatggggccaagcccaacgccaccactgcggtaaggcagacgccactgcccctcaccacgctttcttctttttcctctcttgccctggtggcttcttgtctgagctgagtgaggtcagattcctcctctttaaataagccccctggactctggaaagccccagatttttgggcaggctttccagaagtcagtgtgacttccccagaagtgcttgccctgggagggaaagcagtcagcctgactctttggctctctctggagacgggggccctccgcttgggctgctggaacgtgctctgcttacagctggctctcagatgtgagcacaaattgaccccccctcgccttcttaagggagcacagtaagggagctgctagcttaaacaaagctcattgagttgtggagccattgaaatgtaaactaagcggtgcaattaaacgaactgggatcccgagtggcctgggttggatgcagcccgaattgcttgcctgtgttattttgctgcacagtgagcttctgcacagctgtagctaaatatgttaccgtgttcccgatggtaacatcttacctgcagcagatggcctgacttctgatgagggataagtgtacctggtacttgctaacaggttttggagacgtcatgaggcactttcttaagtgcaatacagtatttgtagaagatatttgacaaccttagggttaaagcgtcaagtgcttcttattaaaaagagcaagcagatgcaagcttgttgtgttaccatggtgacctggcctatagtctgaagaagttacaaagacagatttagacgtaatggtaaaaactagtgattttcctaagctgtgccttgttttggaaggaaatgctggctgatgcagagcagcgggtgagctcattggctcacatcgcagtcctctctcttatttctcactctctctctttcactctctcttcagaatggcaacactgccttggcgattgctaagcgtctgggctacatctccgtggtcgacaccctgaaggttgtgactgaggaggtcaccaccaccaccacagtgagtatgagtgactgactagcttcagccctgttattcttcgttttcaaactaaatacatgtacagtactttttcactcacaagatgtttggagcttttagttttgaacttctttttgttgaaagtattgtagcacatacataggcgtatgcagaagtaaatggattcacacaaggaatacagggcttcggcttcctttactcagcatctatccctataaaaatgtgtgaatatagttttataatatttaattcctttttctgtgactggcttcttattttctggcttctgtgccctttcctttagttgtgtgtgacacctaccgctggcaaagcggtaacacactccactgcaaacttaccttagccaggaggtcaggccagcctctggaaagaccctgctcctcccaacactgtgctcatgactggatcaaatggactcccagtgagagcaattcatccttactttgcatcttatttctgattattattttttaattcaaaaagagaattccttgtgctttctaggtaaattgtttctgtgttgtgaaaaagtatattttaaaatttcttattttctctgttttgaatacaactgctgactcttcatgacaaatcagtgattatcactggcctttgctagagaaactctagaagagtaaagaccatgacaatattgagtcctaatgctcctgtaccattcagtgggagcaaagtttaaaggagcctcctgagagggggctcctacctgaaagtggaagtgctattatatttgcatttattcactcactaactttctactttaagcatggattaaagaatggctctttaatttagcttcgtaaagtagaaaagtagaacagtacgacatgagaagctcttcaaagacaataaaaccacaaatgaacaaataaagaattctgaaggaggttctagtaaatgctccaaactaaaaatgcatatagagtttgaaatgcttggtgtttttgacagatgtgaggaaaaagaaaggaattttgttcttcaggctgacagtaagttcctgttgacatatattgaagtgatggaatacagttggtttaacgtgcagttttaagcagagtggcctatgatttattaatgagctgcaagacacaaactgaatttagatgggaaagaatagcactgcttgttttctgaagcagaatcttaaaaccttcagccagttcaccacaatatttttaaagatttaaggtatagctttgataaattatataggagaaaaacaggtcttgtcactgcctagcaccatacttgtaggtcactatatttaatggctttttcttattttatgatttcttataccaggaaaatcttcatattaagggcctacacatatatgccacttcatttgatatctttaaaacaaggtgtacatcacaatacgtgaagcctttagtggcaagattggccaagcacacctgttctgccattagaagtcatgttttctctcaactttttaccttttccctgctctgggaataatgtatgtttattttaccaagttatcactagatggcaagcttgtatctcttgctatcttgtacctactttgcttccattcatttcattaactgatttattccttcattatttattggatataaaatatgtgctaagttctgtgctaagtgctgaagaattatcagtggtgaaaacattactcctccccaccagcaacttcagtgtcatgagagtagagaatgagactcaggcttggtaagaaaatacattcatattttactcaacaaaactatggaacttatatgtctggtttcaaagagatctcaggtttgtagatattactcaggtgaatgacttcaaacaaagatctatatttaaaaagaagagcaaataagcattctctggtttgtctctaaatactgtaattgctgtctcagtgtccttgtcagaaatcagatacaagatcatctctctaccacatctatctctggaaaagatgggatgaaaattccttttagaaccccctctgtgagctttttttcttttctggtaactattattctctacattctgtagctgagcattgctccatcaaaagtcgctatacttagaattcaagtttctaggtgaaaagccaataaaaatagaaaacataacagcatttctcctttcagttaggacactaagaaatcattgtccacatgagctaaacaagtatctctgttacctaaatggatagttttaatggttacatgtttcgatgctggtctctcttcactgtctgctgctctttgaactggtttctcttataattgtgagcttaattgttttgtgaaatggaattttggggtaaggattggaagaatagacttattctcatctattctgggagtcttcttacaataaacttcctctctttggaaagagattttcaatcattcttttcccacataatattttttccacataatgtattgttaatgatattaaaaacagtaatatttaagtttaaaaatatgtaaggcattgagggaagatctaagcttcagatttaggttgtcgggttttaaagcccatgttcttaacctttctgatataactgactttggttttgctgaaaatagcttaataggaattttgtgaagaaactgttttcacctaattttcaacaaaaagaaaaaccacttaaatagtgctctttattgatttttgtgggagagtgatattcaatatcattttctaaaatctacagtcacaaaaataatttgaaactactgatgatagcacaatagacaacttaatagttaagtaaaattaataaaagttaatgttattaccgctcaaatgcaacagttgcattacacctgcacaactgacatactaatttaacatgaattggatttgtatgatgtgccatatgagcaaccatgtagtccttttgatcaaagaaagtttcctttcctattctttcttttgagttctttaccccaaagtatgaataaagtcgttgtgtagagaccagaataaggcagtagtttgtaaaggaaaaaccacttctgtagaaacttctgagacattttggaatcgtagtttgtttccttaacctttgcttttctaactttactttgtgagatacagcagggaatatgagacattttagcattctcctgggattacaatcactacatgtttgccagaatggatatcagaatggtagagacacatttctggtgacagaagccaacaagcccaatccactaatgcagcttggaagaactgtgacatatgactcatccttccgctaattgatcaaccatcatcaattatttctattatttgtataatcttaaagtgattgtgttttatgttgcatataattggtatgcagaccataaattactgaataaattagtaaaataaaaatattatcttatattattacttgaacattagggaatagttcagtaaactcagaaaatgtgaatattctaagtcctaaatcttacctgatgccataagtcagttaacatgaaaatcaggggaggaggggatagaggagttgtctaatgggtacaaaaatacagtcagatagaaggagtaagatctagtgttaggcagcacagcaggctaactatagttaactaaaatgtatatttcaacataactagagaagtggatttggaatgtccccaaatccactggggaggcattttggcctcccaaaatgataggattacaggcctgagcccccgctgtgtattttcttaaaaagacatacttagtgcagaatctttttaaacttttgacatgttttttcaacctgttataattgtctcaattacatctaattgggtattactttcagtgactcacctttgttaggactttaaaaagaaatgataaatgtttgaggtgatggatatcccaattaccctgatttgatcattatacttatgtttatatcaaaatatcacttgtaccccgtaagtatgtacaactgtgtatccacaacaatttaaaaattttaaaaataggagccataaaaatggcaatacaataaatacttgtaaagtcatttgacaccttttgaggtagagccaagatcttttctttaaatataggtccatcgattagaaattaaattgccattcttgcacaaacaatatcaatacctattatattatgtatatatatgctataatatgtatatttatatgatatttgtatgttctgtgtactttccttttctttctttttttttgagacaggatctcacgctgttgcccaggctgaagtgtagtggtactatcacggttcactgcagctcaggtgatcctcccatcttagcttccagagtaacagggactactcgggagtagtaggtgggcaggtgccaccactcctggctaatttttgtattgttttgtagagacggggttttgccacgttgtccaggctcgtctcaaacgatccacctgccttggcctcccaaaatgctaggattacagtcctgagcccctgctgtgtattttcttaaaaagacatacttagtgcagaatctttttagacttttgacatgttttttcaacctgttataattgtctcaattacatctaattgggtattactttcagtgactcacctttgttaggacttcaaaaaacatctaccctagtttttctagaaaaaaaacagtatttacataatatttaatttagttattaaagttatattaatatgtatgattggtataagtatgtttagaaacaaaaacaagtttagcttgaactccactgatggaagctatggatgagggccttaaaaggtggcatcataaccaagatcactaagtatgctgtggtggcttagggattatgtgatataaatgcaattggtgaccaggaggattggctgagtgagggttggctaagtgaagatcagttaaacacacagtttcttttgcatagaacaaatcagatattgactactatttgtaaagcagaatgttaagaactcctactttattttctacatttttcatatcgtgattaacaatataaattcattattaaatctctcttccatctattatataccatttcttttgccatattatccgatttaattatatcccattaaacttgtacttagtgtcctactcattttaacttttaaagtagtttctaatcttgaccatagtatcttggattctgtagcagaaagagatgtccatgatcatttcactatagccttgttctctatgtacgattcagaggtagttgcataaaaccatgtttatgtttaaataatcaagttttcaaaggacattttgtttaaaaggaaaatatgtattcatttcttgttacattatacatatgtaggactacttattttccatccattcaacaaatatttaatgatggccttctaaaggtcaaataccttctcatgtataaatgatattatatttaccacattgcatatagaggccatttttaatatctatacagaaaaatatccatgaccaatatgatcacagtgtattactttttctgttgccacatatatttgctgataattctgatagcattcagtgaccaaactgaagtaaattattgtttccactcttacaagtacaaagaaaatatagtcccattatcagcacctgaaaatagaaactgagactatcaggcaatgaaacttaatcatttaaaaagtatctccagtaattattttcaaacagagaatcatctccttattgaaatgtttactacgaaggacaaatactctaaaacatttctgcaaaaattaactttctaatacagtctaatatagtagacatcctttcacatttttaaatattcccaaaaagttgaataaaggtcagccgcggtagctcacatctgtaataccagcactttgggaggccgaggtaggtggatcacctgacgtcaagtgttcgagaccagccaggccaacatggtgaagccccatctctactacaaatacacaaatgagccaggcgtgctggtgcacacctgtaatcccagctatttgggaggctgaggcaggagaatggcttgaacctggaaggcggaggttgcagtgagctgagatcgtgccattgcactccagcctgggcaacaagagtgaaacgacatctcaaaaaaaaaaaaaaaaaagttgaataagatttcatagtagggtagtctctatgttatattttaaatgcaaatcattttcctgcaatttatatactttccctaatacaggaaaatgaatctcaaattgagctgtgcaataaacccacctaaggaacctttaaaaaataccctggtccccattatagctgggcccgatccctatggattttgatttaattggtctatgatgggacccaagcaacaatattttttaaatgtttctaataattgtaatatgtagctatagttgaataccactaatacagaatatgggctataatttattggtgttaaatttctaaattaaaatttataatattaaaataataatcaaattgtatattataatagtctttttgagtttgttcattcaacaaatatttatcaaccactactattctccagatttttggatggatacttttgtttttcctgcagcatttagtttgctttcagtgaataagactctgaataaaactatttaaatatcactagaaatatgcaggcaagctgaatttacaacccttgcctccaactgtgccttcatgtgagtagcaggagactttctttactttctctgtttcttcctgtcttttaactaaaattccacccaaagacaatccatttcatcatgatatggattttaaatttattttttgcataatttagtattaacaagtttttgatatatatttgaaaagctcctgctatgtttcaggtgctgtggaaacaatcttcctcttaaatgactcacactctcatgtgggcagataagcagagagggcacacacagtgcgtagtgtatgacacagcacacacgatgctctaggagtacatagcagcagataaacacagttaaacaaagacattcactggggaggatcagggaatgtttctccaagaaagtcacatctaacctgagccaagagaagaggggaaagaagatttctggtaaatgagagaatatgtggaaaaactcagaggcatgagagaacatgacctgtcaaaataaaggcagctcaacacgatcgtagcatggaatgagagatgaggccttgctacctctcgctctttactgaatcacagggctcttctgagccagtttaatcagttttctgaagaaaacaaagagccaccaaaaagctcatgcagtatcacattatgatcacacagatcttatatatgtatatagtcagagttgctcagtggaatttgattaaccagttgaatttctttgtaaatatatttgaagttatctactgcttttggaaagaaaataattgatgataggttcattatagcctttcaaacaattatctaacatctaggtcaaagcctaaaaaactagacaacctattttttgtactttggtggttttagttgaagatgttactcttatgtcaagggattcatttttttttaaagtttccatgacagtgtcaattgatgcccttaatgtattttcactacagaaactgaaggtttgaatttgacactcaatagtctttaggtgatgttcaaaataatgagatttgaatttttatgtttttggggtacacatatcttttatttatttattttagttggcaaataaaaattgtacatatttatggtatacaacatgatgttttgatacacacacacacacacacacacacacacacacacattgtgaaatggctaaatcaagcttattaacatatctattacctccacatacatatccttttttttgtgatgagcgcacttaaaatctactctcagcaattttcaagtatatactacattgttattaactgtagtctccatgttttacaataaatctcttgaatttatttctcctgtccaactaaaattttgtatcttttaaccaacatctcccaaatgctcctcccccttccttctccaacacctggtcaccaccaggtgtctattctgtgcttctgtgagttttttagattccacatataagtgagattatgcagtatttgtctctatgtctggcttatttctattattctgaaaaatcactggtatgtcttgtgtctaaaatagtgccaagcatgcagtagacattcagaattttccttgagtgcaagaatgattataaaaagtccagaggctcttcacttttaagatgcatttaatactgagttacaataatcataataaattatggtagctaatatttatggagtgccaacatatgccaagcactatttttagagctcttgcatatattacatcatttaatcttcctaaccattttatgaagtacttttctatcctttacttatggttgaggaaattgaggcacatgtaggttaggggacttgctagggccttataggtaataagtgatgaaattagaattttaacccaggcagctagactcagatccttgtctcttaaccttacactgtacatgaggaatgaaaggcagtggattgacaaccttggagagctattgcataaggcaaataagcaacaaaccagaactgtagcccagtgaaatattaaagagatgatttgatcctctgatcccaaaagagatgtgtcatattttctgcccaaatagtttatatctttcacattatttacagcttcttttctaatggctttgcttttaatacattgcatatgttcattgtttctttttaaagcttttctggaaacgtcacttagttcattttagggaagctttgaaaacatcaatctgctttctcaatacaactaattattattaataataccattgctaaagaatttatttttcaaatgagaactcaaaataatgaactgtctcttgtacaacttctctggcataaatgatcatttatcttcaaaaagaacaaatgagttttcatgaaagcaaatttccaaaatatacacgcgggaaagatcccgtagtcatggctcgatggcttgctgctgctgttgagtgtggcctcctatgtgatgcttttcatcttttgtttacttttggtttcaacttgaacattaatgatttttgtttttccagactattacagaaaaacacaaactaaatgtacctgagacgatgactgaggttcttgatgtttctgatgaagagggtaagacttctattcaatcttctatgacacctgtcatgttcttacacaagggcaaattaccctttttttcagagaccaagctggttatgtggatgacagaatcttaacatttaaagtcactttttcacctttgtttcaatacatttacttttgccatggcagcgggggccgggggcagttctgattagtatatttgtttctggtattatttctttttcctagcattaaaattaatggctattaaataatatgactggaaaaggggaaaaactggaaactggccatgtgttaaaatagctatatgataacacaattgttattaaaatatgtttgaattatgttaaaaaatctttttttattcaaatgactttaagtaaagactttaaagtatactccatcaatgagtgttcttcaattgagaaatctctgtattctggttggttcatatgtacagaatatattttaagcccagaggagaagagccttatagaaggtttaaaaatagtacagcaggaagtagtataaattccacagaagaatgtattatttaagtcagaaaatatcccccctataattttagagttgatgaaaaatgatctcaggcaatggcttcctaagtcctgggaagcctgctttccaaaaaggagcagtggggactgcctggagtgggtgtgtgacattgggctagagctggagatgggccagctggagggtgtccggctccctatctctacttcaactagagtagctgacttttcttcattttgtattttgaacttccatgtaataatccacttggataaaaaaatgtgctactaaaaaatcatgaaagcagcatataaaatttgcaagcatttctttatgagaagatagaaaaaagaaagaaaaaaaatcacgcaaccaagtttcaatagttcagctattggtccaatgaacatgattgaaaaattaccaccatatatgtacatgaaaatgtatgtttgaaaaattattgctattaagaatggcactaggtttaatactcattgcttttatacagagaaatattaaagatgtttctttaggttctttaagataaaatcataagataaaactttacattgagatgtccttatttagaaccaacttgttgaatcacctattggtagtatgtattgagttttctcagcttttataaaaatttatgacaagaatgaacaaatgttggatcaatgtagtattttgagtaaattcaaaggtattcccaaggccagcagttccaaatatttagtataattttgtgttctatcttaatacttgccaactagttctcagcattcctatatgcatatcatattttgttttgtgggatcatctttattatctttacttgtatgttgaacagctcttaaacagtttggtgaccactttattgatggggaggcacttagtgattcaggtacccttagaggatatttttggagtgaaagcttttctttgcttttgatttttcttaactggatagaacaacttgtttaaatctgtgtgcctaatactaatctgtttcttttgaaatagcatgtgtaatatgagtggaattgtatatgtgtgcatttgagtgtgtggattttattaacttagaagcctaaagtcatgaattgtttgtactgttaatgattttgcaactattattgagaactgctaacataattatataatctaatgaacattatataaatatttttccacaactattatcttttcttagaatataaatttagagaaaagtaattcttttgttagttgacattgagctagtgtgaacatgacaataactaagttagaccacttgaaattaatgcagtttatatcactcccttggttgatgatatattttaggtgtgattaaaaatatattaatagttatgtgatttttaatatagctaagaatagaaataaagtaacatttaaaaattatttagggtgaattttgcatataaggaaaaatgagtaatgtaagatattttatctagtaagaggtttccaaagtacacgtggtaccactttaagcaactctattacatgaaaatttaaatttataaatcagataaattgaatagtgattatttaatttaaaaatagccctttatttacaaaataattgctggagaattccattagttaatacatttaaagtatttaatattgagttataaacgaaatttataaaaaatagcctcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaatagcctctcagatctgcctattgcattaaatgagataagttataacattctgtactttcattattaaaaatgttatatattaaatattactggtgataagaactcttggtttgtgaagaatattggtgaatgaccaagattatcttttgtggcaagagaagtctatttttagaaatagccaaaacttaatgatatttctttccccgaggaaaattcaagttgaataattttcatgtaaaggatctatttgagtattgataagtaactttttcatggaaaaaattagtgtgaaggaaattagctggttgacattgccaatgccaacactttaatgttttgtgaggttaatatgtttttatgaaacctgctatcatccacgtggacacaatgcagccacatgtatttgaaaattattagctaatccctgttttctctacagtctattgttttattagtagtaatagtgtattgacacccaaaaagagtattcaaactcttgtcattaagaatggcactatgtttaatactaatagcttttaaggagaaatattaaggatgtttctttaggttcttcaagataaaatcataaggtaagactttacattgagatgtccttacattgagatatcctatcaggctaatttgctgtatacacattaaagtaatccataatatccactcatgaatccaattaacaaataatgaatatgatgttattgtgtttcggaaagctctataactgatgccacagtggtcaaaggtgagcatgaggcacacctttaggaagcctatatggagaaataatgtatatattaaaagaagtataatgtaaggcactatgttgtcagtttttcatatccacttggggagatcaggagctagatatacctaacacagtctcatgaacgtgctaagagatgagagattaataacagggcacatagattttagggattagataaggaacagtatgggaaagtcttgagataggaaagtacaagagagagacacagagtggcagaatcctccagtcatttggtctgctgatgcataaaaacataccaggctcagttgtggactgtttgaattcttaactgaaagggaaacacgataccttaaagatttcaattaatgatgaaaacatttaaaactgtttttacaaagatttaaccagcagtggtacatagaaaaagtttattgagaagaacctggaaggaagcagaaatctaagaaaagagaaagcatttactaaatctctataatgctaggtacatgtctcatttaatccttataccatccctgtgacacaggctgtggatatcattccacatatatatatatattttcagttaaggaaaggcttatttttggagaatgaggcctagagacattaagtagtttgttcaatagcacgcagctagtaagtggtgggtgtggaatcaaaacctagtatgaaaactattgtaatagcacagccatgatataaataacatccttatggaggaatatggcagcgaaatgcaaggaaaagacagaaatgggaattcagtctaacagaattatagcatccagatttaaccaaagatgtgaaggtaatcgtctaagtctttgtaggatcgtgagttgatccctgtcttcgctgacttggcttcccagccataaatgatgaggtggggctcagagattttggcatctgtataaccaaaatgcccataggaatgtgactcatgtatgccttattctcatggattcttgagtgggtggcttgtccatatatctctgctagtactctggaatgatgtatactagtaatcaagagaactccagactggctgaatgttgggatgaaatatagaggcgcctcctcctttgaaacactcacttctgttgtgaacacttaacacttagtggggctcttcatctcaggttttagccctttttccatgtctcagcaggaataatgcttgcttgagagggagtgggttccgtaacgtttcagagaatctccttgtcagcatcatgaggggttgtcaggaaggggagccattccacctttttttttttttttttttttgtgatggagtctcactctgtcgcccaggctggagtgcagtggtgtgatcttagctcactgcaacctccatctcccgggttctcctgcctttagctcccagagtagctgtgactacaggtgtatgccaccatgctaatttttgtatttttagtagagactggttttcaccattttggccaggctgctctcgaactcctgacctcagggaattcaccttacttggcctgccaaagtgctgggattacaggcgtgagtcaccacgcccggccgccgttccactttaagttattcccatgctattgtcacccgtgtcctacaggggttaaatataccactcactatcactgaggaatcttgtgttttccgggtatcaaaacatcaattgtacataaaaagcctgcagtacactgatgctttccagttagtagaaaacagttttcacgaaattgcttggaaacattggacaataaaacaacaagaaaaagccaagtcataaacctgggaatcatcattctattaagtgagtaaataggtaacaatcggaaggaagttattccaagtataggaaataataaagaaattcattttaggtttgttctataatgtaaaaactaaaggttgcttttagtttggttttgttttcacattgaataagtaagttgaaaaaaagaaagtgtataatgattctcttaaagctgtctgagttgtacaaaattctttccaagtctaatggcactctattcaaacaaataagagctaaagcttttaatctgaatattattttaaatcatcttttctccccccttggcttgggcaaggaagtagtcgtgctatttgctcatgtagggaattttcaaagagaagcacattgacaaggggagaggtaaagaagatgagttctgctgtggacatgctaaatctgagatgcttatagaaaatttaggtggagaagtccagaaggcaattggaatatagatgcaaaattcatgagagaggtctgggaccaatacagatctgtgtattgttagtggacctctaagtccatgtgataatatgtgaaataagaagaaaaggcagatggaaaatatcaacatttaagagaagtagagacagggaagaaagactcaaaaatatagggggaagaccaggagagatttgtgtcagagaaattaaggagaatagttttacaaagaagaaatcacttctcagccactgattaattgctgaaattagcaagcatctgcttgataagtttgattgttaacaaacaggagtcagagtgtgaaataaagaaggtctaagagtttgggaaagaagctaccatatttcagagatggcagaaatatggatgttttatccatggaaggggaaagacctccatagaatctgtaacagaggagagaaggttgaagatgaagggcctagcagacaatgtatctaggaagttgggaggggatgaggctttggaggcagggatgggccagctttacactagcagaaatcttctcacccaccaagggaagcaagaatatgagtgttatttcaggggctcattaaatacatttaaagctttgatttgtatgcagaattttccagttatagaccaacctgggtaatttttttcaaagtgatttttcacattctgttaatttctacttgctttcactttccatctttcactgctggtatgtattactgaatagcatgatttatatacatctaactgtcttcgagagaaattttatatagcactgacaagattagtccccagagaggtggctttccagctaatgccaacactgggataggatttagacactgctttcagcatttagggactttgcttctttgggtcatttctctctgagacataatcaagacattgactatatacctagggccaccccaggtgtatatgaaaatgctaaaaattcactttaagtagcactgaacctagcagcagccttaggcagatagcatcataacaaaaccatcaaaatgcacaaaataagggagaatgtaaaggacattcacttaggaactcagcgtaatcagaggtggtttttttgtttgtttgtttgcttgtttgttttttgtttttttgagacagggtcttactctgttgcccaggctgtagtgcagtggtgcgatcatggctcactgtagcctcgacttcctgggctcaagcgattctcccacttcagcctcccaagtagctgggaatacaggtgcatgacaccatgacctgctaatttgaaaaaaatttttagtagagatgaggtctaggtgttactcaggctggtttcaaacttctgagctcaagcaatcctcctgcctcggcctcccaaagtgctgggattacaggtgtgaaccactgtacctggccaatcagaagttttaaatttttgtcttgtcaccagagtcataaaattttgatatatttgattaaaaatatattcttcaaatgtctttctattttctaataagattctattcacacgagagaggaaggctgggttcctgtggttgatttgcatgttctacctgatcaaatgctgtgtcttgctccttcagatgtagagtcattccagccagactcttcttttatctttacctttctcaccttttctttcttcacccttataaaccttcctcaccctaccaaggtgtaacaagagggaaagataaatgggagaaataagaaaatttgaaatgtaggacccattttattaaggagttttgtggatttttaaggaccaagaagttaaagcttattttgagttgtatttattccctgtgaccatcttggctgctgagagacagcggtgagaactggcaaattaggagaagcaagatgaaatgcaaaagcaaacagactctgaggagggacaggatgctcgaacctaagtagtattcagaatttggtgctagaattttggggagtaggggtggggtagaagactgggggaaagaaagagtatataagcagacttttttttttttagatgagtctcactctgtcacccaggctggagtgcagtggtgcaatctcggctcactgcaaccttcatctcctgggttcaagcaattctcctgcctcagcctcccaagtagctgggactacaggcatgtgccaccacgcccagctaatttttgtatttttagtagagacagggtttcactatattggtcaggctggtcttgaactcctgacctcaggtgatccacctgcctcagcctcccaaagggttgggattacaggcatgagccactgcagccagccaacttttagtttttaaataatctttttggctttttgcaagggatccataatatgcagcttgcactgtgcttgtattatgtgacagattctgtattaaaccatccccttcaccttttcatgaataagaatagatgtagtctcctgaaatgttaataaaactcatatttttttctgaaagtaatgtaggcttaatcctaaagcagactatgcctgtgttttgataaatctataattagaattcatcttagaagttttttctcctagaagtaaacaacaagggatatccaaacttaatattaaaagaattaaaattcaagtgattacttcttcttggtaagtactaagaaaatgaatcaaatgttgtttctctaagttttagcactgtatagttgtttgctggtgttctgtgttctagtgtgcagtgcagtttcatcaaggtcaaggtaatgatgttgatgcatttcacaatcatgaccatatgttgtagttgatattacattcaagaaataatcctgcttcttcctctgattgtttcaaggtgatgacacaatgactggtgatgggggagaataccttaggcctgaggacctaaaagaactgggtgatgactcactacccagcagtcagttcctggatggtatgaattacctgcgatacagcttggagggaggacgatctgacaggtatctcataaaacttataattgatgtcagccagaagtatgtgcaacatattttttatgatgatgataaaaatgtagatgcaattattgagcatttaataggtaccttattaatctcagcagttagcatgttatgtttttccattgtctaacaactttaagatatgcccattttaaagaacagaaaactgaggcctagaaagatcaaataacttggtaaaatcaaacaactagtaagaagcaaaaccatcataaataagagttctcatcatttaaatgtggcgtttttcatcactggccactttttcctcaaattaaaaggacaattttgccttatagacattcttactgagcggcatcacagacactttggatactcttctgcccccacttttttgttagtaacataatttctgtgaataaagtatgttgtgaggctgaattaaaaagaaatacattcagaacaaaactgcctggaactgactttttcatgaaaaagaatccgaacagaatcccacgagagcctggatacaagaaacaatcggagcaaaatctgagggagcccagtgttaataggcaaatctgggaggtttatataatattctgagatatatgatcagtgctactttttgttattattaactagtacaactggcacttgttatttttttatgcaagttaggtaatgacattctgtggttcctcattgaaattatgactgataagttgggccatgaatatggatgtcatagctgggtgcagtggctgggtgctgagacctgtagtctcagctacttgggaggctgagttggaggatcccttgagccccagaattcaagtccaggctgggcaacatagcaagacactgtctcttgagacagaaaaaaaaaaaaagaaaagaaaagaaagtttgtccacgtagtgtaatgtgttctgctaatcaataatctcaggtttatagttttaaagttggcactattgtaagctattttatgaatatccagcatagagtctaagaaataaataccttaaagtctaagtgaataattagcaaaaacaaacttttcttgggctttttccttgagcaccaatgcccccttccactatctttttttttttctttagcaagataggcttgttaacttcatagtctaatgggatgggagagggcataagctagtggtacacatagagtgccactgaagccctgaggctctagcttcctggagcagatgaaaccaaactgagaccaaataatgagtaacaatggtgaggaaaagtggggagggcatttgaagccttaacaaggtcttgagcaaaggctcgcagggtgtatgagaaaaaagggaatgcagtgttgctggagtgtaagtgtggaggacgggaattatatttgcatagcagggggatccttctgccagtgagaaagaggatgaattttaaaggagagtttcaaagggctaaacctggagattgcagccactctgagaagcaattgttcgtgtattaactgcaggtgtcatgagaggactagcactctaaccttggtgatagtcatggagagaatttcagaaataaaaaatttgagagttttttgagacatgtgtaggaggcaaaactagtcagatttcatgatgaatttcatgatttaggtgaggaaggggaaggagattaaattgagtccttggcttcaataacttagataaagggtgctcccagaaggaggagcccctctggagttccataagctgtcttgatacattggtagatttggaccttatactctgagattcttaaaagatttcaaatttgaataaagtgtaatgttcatggcattgcacaaattgatgataatctatgaacagtcttattactgtcaaccataaagcttctattttttgcatggtctcccttattaagaataagtacttgatttgatctgtttttcttctttcaaagtacttaggttgaggaagaatttagaataatactttctataaaacaggatggatggcttgaatgctcctgcttaaatccaatacttttcagcacataaggtcaggggacatgaaacaaacaagacatactgtgttctccaggtctccacttgcatttctagatcactagatgtattcaccatttccaaaatagagtgacagacagcatctcattttcatggtcttcttttatttttaattttgcttaggcaattcaatataagttaccttttctcagtgaccattttttcctttgcattatttctttatctgaattgctttcactagcaccatgcccaggtaggtattaacagagcatggaaacaagcccttcctagatttatccacatttccctgctcactgctaaacctgcgtgtgtgtgttgccggggcggggggtgagggggagcggtgggggagtgggagggggtgcttatattctagaattatggatttattctaaaataaatatttttatgtattgaactgaataactagctgagctagaagaggtgaatatattattaaaatgtaaatctgtgacatgacccaggtattgctttgtttcaacaatcactgctgcacctgtggttgataacacattagcatggctttccccaaacaaccccaattagcctatgtgtagttggagaagatagaaaaaatattctgatgcctaaaatatgcatagatatggaagaatacaaatacatacaatttaatgtacattaaatacaaatacaaccaagttatgattagttggattttgcatctgttttattttattgtagcttacaaattaaaaatgctttccaaattcaatgtaaaatactaaataataatgaaccacagaagcttcttcatatcttaaagcaaatttattgaaaattgtggatttctactcgttaagtttgccactccattaattgaatgtttaataaatattacagtttaccaagatagtaattattatacttttcaataaaattacactttcataccacctattatgtgtccataaagcagttgtaccgtagtaaaataaaaaatataaactaagaccataacaaaacccctagtacatcccctagatgaacagcaagtaaaactttacacttctatggctatgttattatacatttattaactgaatagcagaaccattgacttcatgaaaaattggcaactgtattggaaaatatttaaacttgtttttaatgtcttaaatcagagtgaacaatttctgatccaagggcttaaattattccagacctttgtcatgctggttatattattttagtgagaataattctttagttattattattttagagggaatattcttttagagcgaataacttctctggtgttggaatagtccatctttatttcatttaagtagattatacgacatcatttttaaaaaagcagttagaaatgatacacattgattaaacaaccaattagtatttcagaaggcagtaagtaagtagaggaggctagaatacaacccatagaaaggtagagacactcctatatatggttttgacttattcattgttgctccctctctctgtccaacttttctcactctctgtgtacatatcctaatatctttctctctctactctaatcaattttttgtgattatatatcactttgtctccttctttcttttcttatccctctgtatttctttcctgttggggttttaggaaagacaaaaaacaccaacacctctctattcctctcagtacaaaaccaattgagagatagactcaggtatcaactaaatggatatcaaaatttcacttgtatgactgatataccgattgcaaagtgcgactttactttcatagcccaatgggctctttaataccacattcctgaaatagacagacttgtctacttagccatagtcactccttgagagtggcaattgagacctgattgattctttcaaagtttagacctttgcaatctggcagccacgtcacaaggttttatttgaggtaccattatttaccattcagtttgttctcattcaagctaaattttcattttccctttgagaccggtgtttctgctattccagaagacggttgagcccatagaacagctgtattagaaacagaagaggttggctcctctactattttcccttccttagccaaattcaaaacaaaataaaggtgaatagaatttaagagttgctgatctagcccgggcatagtggctcacgcctgtaatcccagcactttgggaggccaaggtgggcggatcacgaggtcaggagatcgagaccatcctggctaacacggtgaaaccctgtctctactaaaaatacaaaaaaattagccaggcgtggtggcaggcgcctgtagtcccagctactcgggaggctgaggcaggagaatggtgaacctgggaggcggagcttgcactgagccacgatcgcgccactgcactccagcctgggtgacagagcgagactccgtctcaaaaaaaaaaaaaaaaaaaaaaaaagaattgctgatctcgtgccacctggtacaaaacacatccaagtggatcttagctatctttgtgatttacagcaggaaaacaaattatccattccaccagctgagacaagcttttgctgagattaacccttttcccaataatctaatcccctatcaaaagctaaatgtaaaaccatctgtaatataagtagcctccaattgctggagctaaaactcttgttgatgaaattactaaggctctgtcaagagcctcaatcttctccaagagcctacataacataaaatagttaattctcaggttatatttagattttgttttattgtaaacacagatttatgtatgtgttaacgcaaggatcagacaatcaactctttttattcatgtcatttaccctttaagactttttttggaatatacctacatgtaaaataagaaggagaaggtcctggattactatgaattacctacaaagtgatgatttcctcaaagacaattgatgcgggctatgttgacacctcatagatatgatagtacatggcttacaaaattaaatatacttgcaaaatgaagatagtttctactaataaatatgctaatttaacatttagtccataattctacagtgcttcactggccaaacacctactagctaaaagtaaatgaaagtttgcttctataaatattgtgaaagcttgcgtatctcctttttttcccttatgggctttgggctaatattttgaacacagatctttaatacttgagctacagtgtataaaatatagcttatttaagataccaatctgtcatttgattttacaaattgatttaaaaggaatgagattgcatctatgcaaatgtcaagttttacctattacatatgagtgtgtaatttagaactttgaagttcagatttttcaaaaatgtaatgcatggtttatcaaggcctaaatcccattttgaagccaaacctcatttttggtcagtggccattggcaatttgtctttgtgctggcaggtgtgtctgtgttctgggctggagcttagatacagtttcttgtgctcatgcatctcatcaccacggcaaccaacactctggtgcttcagtcaccacacacaggacatgcaaaggggacagtgctctcgtttgaaataatagcattgttggagtcactagagacaaacaagaggaactccacttccgcaggaagcatgcatctggccacagttcatttcactctgtaccttccaggggaatgcaccaacattcagtcattcacagtttagagaggaggagaaagaggcatagagagagaatggaaaataataagcgaaaatgaaactgggctttcattttgttcttctctctgagggccatctactttcctccttatatttttcttagttgcagagagattaacatttaacacagatttaagcaatctatcctggaattatttcctgagtgaatttctggtactggcagtaataaactacagttgctggtttcaaacatttctgggaagaaaatgaatcagattaggagtatcaaattttaacttctggattcccttgtgctcttgccattgagcggtaggaacctgtcaaaggatgtgttagttcagctgttggacaaaaaggtaggacaacagagacttgtgtccccctggaagttgtgctgttagctaatagcacgcttttttcactctcctgctcggctcatcattttgtcatcccaaccctgctactgctgttggtatatgccatggcctcctgccaacctaccagccttcgatccttcagttccgacaggtctcacactctgagccatgcctcctacctgagggacagtgccgtgatggatgactcagttgtgattcccagtcaccaggtatgtgacattttgccttcatgtctttgctttctggagagctttgtaacattattggatgctagaaatgtcctgagaaagtttttaatccccccaaaatcattcccaattcagttgagaagctaggataagagatttgagggttttcctaaaacatgaaaaatgttcactagattttttcaatgagcagtgtttttctgaaaaagcatactgcttatttcttcagctatactgaattcttctgtggagattatatatgaacattatatttttaaaataaaatctccattaaaggaaaaagtgaagtaggatgcatttaaggtataagatgaatggtacaggttaagttatatctttcaatatttaaaattgttagctatgagaaaggcttaaaatttattctggaatattttaattttagttatgattttatcacttttggtggattgggtatagggaaatagatggatacctactgtcttcaaagacaattacacgaatgtaatcttatataatctatttaaataatgcagtttaaaagagaatgcattttaaaagattcattgtaaatacattggttttatattttaagtgtaagtttttctaggttataccactttccagtgatgacactttttatattttgttatattttactttaattgaagcaaagtgtgtttattcaatccagtgttctttgtgtttaggtgtcaactctagccaaggaggcagaaaggaattcttatcgcctaagctggggcactgagaacttagacaacgtggctctttcttctagtcctattcattcagggtgagtaaatcaatattatgtatcctgatcaagaggtaaaaagagatgggagtgaaaacaacagctttgtccagtagctttagctggtggctagctttacagtggaggtgccctttgtttaaacttgtaaataacattgctttatccaacatggactctatatctacaacaacaaaccagcaaaaaagattgaattcagcattaaaaaaactgactattgttttaaaacaactagtagaattgcgtcaaacagcttgctacctaactggaatatactagtggccttcctactattcacgtactgtctttaagacatcctaaaaagaggggctgaatcatgtgatttctagaaagtttctatttattaggattagctgattggttcaatgaaataaatgcctttctcagatgctaatgcatttcaaataatgttacagaagcttgaatcacacaaatatatagaggagtttatatattgtttgaagtagggatataaacaaaaagggaatttgaacgcaatcagtcaggttctcagttatctttttaaagtcattcagagagtatacacaccactgttgaagcaatgctgcctgtttttattaactcattaaaaaataggagtttgagtcatactttcaaacatacttaaagttgttcttaaggtgttcagttatgtggaatataaattctttaaggagttttaaattgtaacactcttccaatttcttccttacatattagtagtttgcaataatatagtaatatcataattatatataaaatttctattttttatttaattatttttaaagccctatttatatgctatatatcaaaatgcaatattttgattttaattattatccccaaatccttatccataaatcccagaactatttggaaaagtagatcctttcttatttttattattctaaaatattctttattcaggaaagagttccaacatattttagttaaaaattttagacttcttcaactaatcttatactaagtaaaggttcatacaataacataagttatatagttattgaaaacaatcctaatacttttttccttgttaaataagtagaggctagttcctaatgcgacagttattcatgagaataaaaaacaaattacacttcattcaaatttacttgcttttttaaaaaaagaaagctatagattactaaaaagatacaacattgcattctgctaatgaacttcttcacagtggtaagaaggaaaaagacctggatgtagagtattgtaggatcatagataagaatctagaaatcataatgaggtgtttaaagttcatatgcagcctacaaagtgatgagatggttttaggtaaaatgtaattgactaataataactgaatttacacaagaatctgtgcatgccaatacttcagtttgcaaaataaatcatttatattttgaaaaaggaacttttaaaagaagttctttcattactgaagggcagtaaagtagtctaagtacctcaattacaccccaattatgtacaactagatacacctataagtaattatggtgcactacttatgatgaaccaacagcatccagtagttaaagatgaattatgtgttaagataaagatctttaaattcatagtctttaataaaacagttttcctatgaatctcaagcatttaatactgactctggataattctcaacttttgctgtgcattagaatcacctaggagctttaaaaaatactagtgctggccaggcgcagtggctcacgcctataatcccagcactctgggaggacgaggtggacggatcatgaggtcaggggtttgagacaagcctgaacaacatggtgaaacctcatctctactaaaaatacaaaaattagccgggcgtggtggtggtgcacacctgtaatcccagctactcaggagggtgaggcagaagaatcatttgaacccgggaggtggtggttacagcgagcctagactgcaccactgctctccagcctgggtgacagagtgagactccatctccaaaaaaaacaaaaacaaaaacaaaaaaaactagtgcccaggcctcaacccagaccaattatttggaggcctggcattgatactgtctacaagcgccaatagtacagttgttttatatataaactgttaggaaaaactttgcttaataaggctttggttattagagagacctggttaattaaggtatacctagttctctcaaatgttctttatttcttccattcacttatgtattcattcttcacacatttgtgtaattctataaagtacctgacattgtgccaggtactaagaaaaaagctaagtaacatctagcctctgcctttagaaacacactctatgttgttatttaaagttagaagacacttaatctgtaaagagagagaaacatcgtggttaatagtgtgcttgggagtcagacctgtcagaattaaatcctgacactgacactcgtatgtgacatcaggcacagttatataaaaatctctgagtttcagtttccatatctataagatgagtgttatattattgatcccataggggagctttaatagctaattactttttaaataattagcactttgcctggaaataataagtgctcaatagattatagctattagtatttgtacaatccccatatacacatgttctagatctttcacaaattgcaaatccattaaggaaaatgtattatgactcctctaaatggcagcgtcaatgtggttcaattcacaatagtaacgtttgacttactgttatttttattcaggcaaattattctctattagcgtctccagtgtttcaacaaacacaatgcatttgatgactctaacagaatgagttattactattgaaaactcaatgattctcagtttcctggtatttgaaagctaccatgatattaatgtatatgagtaacactcatcataccatgtcatgtagcaagagttttttgtaattttattcattatacaccaggttcctaaatagtagcttttatttattttttttgaagaacttagtttttctttaattaattgggtggattcttaagccacttcaagttctacccaaaatgtaaggaaaaaaaaaggagacgaagtcttactctgtcacccaggctggagtgtggtggcacaatctcagctcactgcaacctccacctcccgggttcaagtgattctcctgcctcagcctcctgagtagctggtactacaggtgtgcaccaccatgcccagctaattttttgtatttttggtagagacagggttcgccagttagccaggctggtctggaatacctgacctcaggtgattcacctgccttggcctcccaaagtgttgggtttataggcgtgaaccaccgtgcccagccaaaaaacagatattttgatagaggtgataataaagttagttttttatgcacatgccactgatttgtacatataatgttctcttaaatttaataaagggattttacattaatagaagacaccgtttctaccaataagcagtattggtgattttattttacctctattttatgtttccagtgactaatgttcataactagagaacaataggtatcagtgattaaaaaatcagtatcagtgattaaaaaatcagtatcagtattaaaaaatctgttctgctcaatacacacagcaaatacctggcaaaagaaagactaacatttgctgtttattttaaagtgttgtcttcagattcacaatgactctaatcaacagttatttctagcatcctagtcatgatcataacaacataatcttgggcaagaattttaattttacaattcttcttcatttcataagtgcataaggaattagaagatgtaagacacaactcttagcagtagctagctttgtaagtcttcttaaatattgttattaaaggtctttagtttttgtagtgttttaattacagtcaaatgccaacaattaaatgtcaattcattaaaatgtcctacacagtcatacattaactggaggtctgtaaggttgtcttttaaagaacttcttttcataaaaacatgttgaaggcaattttgttgtttacctaaaatttctccaaaaataaagtctattttaaaaatcatcttgaaggtattctctcaaataacgggatatttgaaatgcaaggaagtcaaggctctcacttgacaatattaatgtttatctaatatgtacggcagttaagttagttattcatgtatttcacaacagcctagggttttttttagatacgtgaaggtaaattcttttagatgaggaaagttttttcataataagtagcaaaacaagtgtttagtaaggttggatttccggtccattaagcatgtatacttttgtatgtcattagggttgaaaacacaagagaatcttgtgaaagcttatggagggttttacggaagagcagactcataggtagaagaagagtgaaaggtagaactataatgtgggattagacattatgaccactgaggaagacagcaatctccaaagcaggaaatgaagtattgacaaaagcaccaagactttgtttgcatagcttttttttgcgatactctagtaggtaattgatattacctaccccgctttatagtttatgctactgtttgttgttgatctatactttaaattgtgccttttctttttgcatttcttctgtgatagcccaaaaagttattatcattatttttaaagtattaaatgtataaaacaaaaacctttgcgtcaaaactgtgtccatcaaatcaaagactttatgtttttcatcataatgacccttgatgtttctgtagcttcttggacactcagactttgttaaacgccctcataagccaatgttgaccaaggttaaaaacccatatccagtgattttataatatccccagttctctaaactgggagttgccacaaagcccccataacttgctcttctcgacctatatctcatttggatttccatttgttttcaatgaataaggtattggtgtataaataataagtcacttctgagttccttccttatatttcactttatccgttccttctctgtgctaaagtatctattctgttgcagccgcgcctctccatgtcttgaacgtgacaacagcaggtgaactactgcataattctttctctgaacatgttgcctattcctctccccctttcgccatctccttctgcatattccttgcctcaggatgctttagtgtgaagatacctagccaaagagatagaaagattgatgttctccaaattgtggctattgctgaattcccctttctctgtgatgaagagaaagtggtatttttaatttcagtggaaataaagtggggctgttccagacttactgtggactgcctgtcttggtcatgggtctccacatctccagcttcttttgtgagaaaaagtgctacatagagatgaaaaatgttgttccctacaattatgcaaattggtcaagctattttagggttttattaaaggttatgattttaagtggcacttagcagagagttttttgttgttctgggttttattttaaataccatattctaggtgaggcaaaggctgaaagtgtattagtagtgcatttccttgctagtactgctataaatgcaaccttttgatattttagaaattgtactgtagcatgactagtcagtgttctaaaaatacctgttattctgttatttatttaaagttatttttaaaggttcctattagactgctaattatagtatttttattatacagccatccattatggtactacaaattatcagtctacaaaaaagacagttttgtgtttttatttttgaaaacttttatatacatccttatactttttctcaaatgcacgctattgtctttccatacgtgaacacagtggttgataaataattgtttggtgattttaaaaaatttgaaccacttttttcaaagccatatccaagcaatttttaagtttatagaatttggagaattaggaaggaattaagggaattacagaggagaaagagctcatgcaatggtttgtctcacagtacctcagaaatcggatttaatctgaggccctcttgctatgtatatgaggatcactgaagcactctgatgattttttttcctgttctttcaactaactctgaatgctgcaatttcctccccattcccatcccatggtcctcaaagaattaaaaataaaactaaaggaatagtaactttgggggtggaggatgtagtcctcaaatgactggatcatggttttctcctgcctcctctgaagcatgtactgtttagctaatcaaattgtgtatttgtaggcaagtcatctgcataataatggttgcttttgcttttattctttttaaattgtgataacattgtatctcacaatttagaaaacttcaacaagagtttctactttgcatgattgctgaatttcatttggagagtaagagatgcaattaaagctgagtgttaacatgatattttttgtatgtacagtcttaagtcaatgtttagtgcagtgtgtgtacacattttctgcaaaacagctgttttaaccataaagcaaaaatgatatatatttcctgaagtaatagcagtttattttccaattaagaattctttcagagcatctgaaatgaaaggtttaagtaggtttcctaacctagttaacagtaaactgtgcatataattttaatactggaaggcaacttagagtctatttagtataagtctcccattttatggataagaaaactgaaatctaaagatgttaagtgacttacctgaggttacaacattaattcaagatagagatataactagacccagggaagagcatggtacttgctgcattctcctgtgctgtgtgataatagtatttttatatcttatttaagtaaacttcataaactaataaaaacttcatcatcattttaaactacttagcatagttccaggttcattgtaggtactcaataaaggttagtttctccatttatttttcaagtggtatattgtattgtgtttaagatatttaaaatatgtaaaatcccgtaagtgtagagaaaggaagatgatgggaacaagcatttattgaattccgtatgctttacccacacaagatttctcactgtaaccttaagtggtaacaggattatttttcattgccaggtgaggcttcaatcttaaagatcatagatgacaggcagagccatcaatccatattactgcctcctctaaacatatttaattatatgtttttacttaagttattttcatctccaaatgtttatggggattatcttgtcccatttttaatctcctgcaaacatgagaaaaatcacattgattcagtcaactccagtatgtgaacgactcatctcgcgactcacaccttctaacctttctcatttccctgtggtacataaaagtacgtttgcttacaattttttttatgcttatttgcagttgttttttacgtggtagaatacctgtctcctaactctactacctgtccaaatagtggcacttttgggtattctaatatttttaatgaaaatgctcagatgcttacccaattttatattatcaactgttgggattcactgataagcatacctattgtcaatagacttttcatcagcacctagctataaacttgagttatttttcctgttccttcttatttaaagaaaagacttcttttattatgcaattctgtaaattcagcatttttatcagttgtttggcaattccattatttgagtctaatttgtttagagtattttcttgctagattttataaacagttttactcattttgactattaatatttagcttttttatatcttccaatatttttatttctttcttgacatctttctgttttactttcttctctctcttctctttctcttctaaagaaaatttcctcactacaacttggtgggtttttttggtttgtgtttcttcctttagttacttgataaaaacacgaaggcttgttttctttaaaaatttaatttaggccaggcacagtagctcatacctgtaatcccagcactttggaactccaaggcaggaggattgcttgagcctaggagttcaaaaccagcctgagcaacatagggagaccccatctctgaaaacaaacaaacaaacattagccaggtgcaatgatgctgcctgtattcccagctacttgggaggctaacatgggaggatcacttgagccccgaaggtcaaggttacggtgtgctatgatagcaccactacactccagcctgggtaatagagtaagaccctctctcaaggaaaaaaaaattgttttttctctgaattatgcatactggcacctgaatttttccaatttgctttggatttttgtgcaatacttaaatattactttccaggtttacaatgacacagagatacttataggtaaatttatctgcttgcagcttcaggctttaaagtgctattattttgattttcccatctttggtctttcttcatataattttaacttctattaaaatggtttattttgttaaattcaaacttctggtttttgcttactctcattttctactagtcctctatcaaaggaaatcaatgtattaggtctctctatatacattagagcaggaataagcctgtaggagaatatttaacattcaggagagtcgttcccaactgctttcctacatctgaatatagtgattcgaatgaattctgactgctctgattgtccagagactaaagaattaaatttcctcctatgttagccttagacataaatatatacagctcctcacgtcttgcccttttcactaggttgtacattcgcttattcaacagttatttattgactgcctgctaagtgctccatccacactgtgccaggctctagaggacacaggaagaaatatggagaacatgttcactgttattatggcacttttatggctcctatgtgtggacttagtcatttctcagtgaccaggaaagtaagcagttccaagtaatgacgaaaccatcatgtgacatctggggcttacaccatgtactttgtggcagcagctgctatgtctttactttctgtatcctcagttcttagcagggcacttgacacttaataggagggtaacaaatgttgcattgaaaggagcatagaaacggaactatagagcaagtgagaacaaaaagagagtttcaagagacacagtcaatgacacaatcagggcaagtaatctaacctgtagttacttaaacattgttacagtcaggaacttagctacttcaattcactctttagagaatgggccaccagaagatactctacatgttcttccatcgaggctccatgttatataggccataagccatcactggaataaatgtagtggagaggttatagcacacaacatgagcgtggaaacttactaaatgccttcaaaggtataaatagtactgaggattgataacattaagcaggtgtattataataattccttactagtttgagttcctgtctgtgcaccaatggaggcagcaaccaaaagatgaaaaaaaaaacaaaggaaatattaatcttaattatcagtgagtcaaaaatattgcaatgaatttggaagtagcactagttgaaacttgtcactttttgctactttttcacaaaaaccaacctaagtatcctactcaaataagaacaataaaatggaaaggaaaactttacatctgtctagaagtgttaccagtattttcattcttttgagcaacaaatagttcatttaaaagtcaaataaaaaaaattttaaagaattcatactggaagactagtaataagaaaagtggcaaatattttctcattatgttttggtaaagaccagaaacatcaacacttcagtactgaactgttgattgtacttcccagtttttactccttcctgaaaactttaagcgggctaggtatgaatggaaggtctagcctggcccctgcatgtgggaaggcctgtgctgcctcttgtggtctcatcctgcatgacatgcttcagacaggcactctgggctccttcgcacccatttttattactagcaacaggatttctgtttaatagcatgtttaatgagttctgtgttccgctttgaagaagatgctaagatatttttcttcatttatctaaaaataacataaatgttttgtgtttatatcccataacttactttgataaaatacctttcaaatgttttaaatgtcgtggaggcaatatctaggtgggacaaatccagttggttctgtgctgagcagattataagcagagacatgatacacctgtatgttgctttcctcttcccattttggtgtaaagatcttgcaaatgcaatgaaaatttgaaaagacactaatgtaatttgtgaaagagagtacacacagtttgtatgtctttgtatacgtatacacaacacttagattgctgtgttgtttaatttttgctcctcgacacagtaagtgcctgggagactttaatgagtgttaataccaaccaaatgacaagcattcaaattaacctggatcaggatctgctaagaccatcccaaaggaaacaacttcaaagttaagacaaacccgttctcttggtacacttaaagaaaccaagtcatcttggattatagttctcctttttcatgaacaattaacctagaagaaaaggagaaaaattaatagggatgctgttaacatttctaaattattagctataattttttacattcaatttattacaatttgagaaaaatcatgatacagatgatacagatatcttccagcagcatgagcccagggtttcccactcctgaaatttcacttcaaaaatggtgtatgggcgggcctacttgttccctatccacctgctgttcatttcaattagaatggtatggcagagagattcctactcaataagttaaaaagtacattttaaccagcaaattaaattagttcaattcaaaagatttaattattttgcatttctcctcctttagaatataatcagttaaaaatctacatcctgggtaagatgatgttggaacaggatgcagaaaaactgcaatttggtctttcctctctgctttgtccttgtattatttcaacatgtagattttttaggatgtacacataaggaagcagaagtctttccatttataacaaaaggaaacttgtcaattgttctttatgtaatttcattccattttccttcaaaatcaattaggcttatttttaatttacagtttatattgaacatcaccattgtcagcaaaaattagaattattctttacagattaaaataatataaaaattagaacaacaacaaaacagaattaaaggcattggtataaagtaaaataacttttaaaaacaagcattttaccaccatgcatttaaataaaaaagagagattttgagacaaagcattacgaaaaacaacttgacaaagcttgttcatctgcccccaatatttcaaaacatatctaatcttctattttaatttttagtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttgggtaagggtttctgataaacctcccacttagtcatcgatgagcttgtgtcctctacatgaaatcactaggatggaatggaaaaaggtacgtcaaaccattttgaaagaggatcagcaccaatgacatttttaaaattggaagtagcacctcaatgcttgactccacttacacgcctcttattttaaggcattaatgagttaaacattcaggttgaataccacttcttctttttggatgttaataatagctgccagacccccaatgtgaataaccagtattttagccgatggtaggtattattttctcatctgagaattaagtggtaaagtcacaaagaaaaaattctgctctgttccaagcataaatgtaaattctcatacagttatgaaacagaatcattatctttactttggaaagcaatgttgcctttacagaatacctacaaatttaatcaatgtgatttttttttcagctatcaaaattgctaccttgagccttatcattacattggctatttagtcacagtttatattaagacaaatacatcaagactagcttccaccgtgctcgttttggcaattttgagcagaatttagcatttcttctttcttctgtttgtttgtacggctgctgttatattaagtggcatttcattgtgccaagaaatgaatagctacagctgaaattaacaaaaggatgaagttttggagggggacaagtttcaaaatattttgaaacaaatcaattgtatttaagtcttggtgcttgaaatactgggagaaaatcctaataatcgtgaactcttttactttgccgatgtcatattgggaagaggatttcttgctttagaactcaggaaatgttctaaagctttgtaatttggaccaaactattagcagattgctccaaattatgttcacacctgaaaaggggtgtgtttatatttcccaattatagcaaccacttctcatgtcctccagtcagacagaccagagctttacaaggagcctgtgaagttctgggttgcatcagaaaatgccattatgtttggagtaattccccaatgattcttttcatattctgtgtcagaccctgttcccctcgtgctcagatagtttaggctttttaataatcttcagatctgttggggaatatgcatgaaaacatctggcctctgtacagggcagagttttcattatattcccaacagcttgtctttcttgtggagcattttttccccctttttggctagtgccctggcggtgaacctaattagggacagaccggacagctaagtgctctccttgcacagacgcgcctccattgtacactctgggtctcggttccttgctctttgtgaccaatggagggggcagaaccaaacgcagtgtgaaaccaaagttcaccctgtggatcagctggcgacgctggggttctgtggaagacaatacctgaagcttacctatgttctttctttcactgctgctttggatgtactcagtaaacttcacctgccaacggctcctcccccacttaatgagggagaaagtttggtcagccgcattcttcagctggggcctcctggaaccaaattccttgggtaggagtgacttaaaacaaattgatggctgctggccccccattcttctccttcttctgcaatatgatttctcttttttgtcattgtgcccatgacatgtccctttctatgatttaaattctgtataacctatctttagtggaccatttctgacccttgtggtatgtgacttttatttttgagtgatgtttttatatctttccccttaaagtgctgtgaccttcattttcgtttaagcatgagatctgcctagttgtactatgtgctagttatgatgttgttatgatgaatttggagtctgtatcaaagcaacctggacccaaaaatcaaaaccctctacatattttgagaacgaatgtgacctaaaaataatagggcagtgcatgttccggatcctgaatataataggcattggacacaattgggctgtctgctgaggggctcaattagggccacactgtgtacacatgcctattgtttccttgaatgaagaaaatataagcaaaaaccacgagtgcatggctctttagttcacaagtagtcaactttctgacatctcctcatttacgacacatcaaattatgcaatgtgtgagccattttcctcttaaaccatttcgtcattttgcaccttgtcgaaaatgttttaggagattggcagacatcatagatatgcatgtacatttcttttggttaaatgtgttctacttacatttatcaaaggagaagttccagaatgtcacatgcactcacagggaaacattatttggcttaaggtagcagcatgtacctgaggattggtgcccctgaggtggagtgctactgtgtgaccatctgctagccagtgggctccaggggatggcccactatgtccctgtccccagcaaaagaagaattccaggtcactttgcaacagagtcgaggtgcttgtcttgctgttagttagctcctgtccacactgaatgttctgcattgctatgtcaggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaaggtactttcagatgaagcgttttaaaagaaatctaaactggaagcatgaaaatgattcatttctttcttatgacctaggggtgtgtgtatatgtgtgtgtgtgtgtgtgtgtgtgtgtgtgtgtcccttgtggtattttactacagcaggtaatctgctttgctcctgtagtgatgagttggaatgcacaatacttttgcttaattttactcctgttacattcaggaaaataaaagccttgaagatatcaaacatctcattaaagagatgcagcatgcttccatttttagtgtaaacttttttgagccgaaaatgagatagaatagatattgttgcttcataacgaaatgaactgatactggataataaatccatgatttaaaacaatgcctaacttgaaacattagatatttaagatactgataaaaagtgttaagctactgtgttggaaaacttacatctacccataattagtaagttatagaatactataatttttaaactattattaagggggtaggaaaattaagttcattcaatttcctacctataattcaaacagggagttagccagggttgaattgcatacacatacatacacatctagtttaggaacttagttttccattagaacttcaattgctgtaaatctcaactctgtcttggactgcacaaggttgtaatatctcagtatgaaaagaggaaagcggctcttcctcaggtctccatagtttgcacagagaaaaggtcctagacctaatagtagaattcacattcaactttaagtaactacacaaatagggcaagttctttgcctgcatgccaggaacataccaagttttgtatacagctagacactcaagagcaagtatagctgtttatcaagttcttgagtcttctggcactagtttcagatatggcttatggataggaaagagtagcctgaccatcgcttctttaccatttctttctacatcctaccacggtttgaataagaatagaggccaggcttatcttatccaaggggtggatggaggaagaaattatgccctctagatatgttaagtcaatatcttctaagcaaagaaaaaaatcagggtttttattaataaaaattgttccctacaatatttagctgcttctacttcttggaaccattccttttgctgacatttaggtttaggatattttcctctgagatatttacctatcaatgacactgccagtgagcattggtatcttgcccttggatggggacccactctttaactttatttatttaaaaatgagctttttacatgggtattaatagaaagttaatagattaattaatctattactagaaagttaatagattaattaatctattactagaaagttaatagattaattaatctattactagaaagttaatagattaattaatctattactagaaggttaatagattaattaatctattactagaaagttaatagattaattaatctattactagaaagttaatagattaattaatctattactagaaagttaatagattaattaatctattactagaaagttaatagattaattaatctattactagaaagttaatagattaattaatctattactagaaagttaatagattaattaatctattactagaaagttaaagatttgtgtatgtctggaaattttaaaaataaatataggctagtatttgccagtgcatcagtcttcaatcatgtggaatcagatcctgggactttttacttttactatctagctatgcccaataatcaagaaaaacgtagttgctgttcctgcctctataatgaattgtaaatgatttctaaaaatgaacaactttccatcacctcttaaaattcagtgatctatatagtgcacattttctaaatttaaactagtttgattttttttgtattgccctgaatatctacactaatgcaatttataaagaacccatgatcccatcctcttgatgttaaatgttatttttggaaatttaatggcatcaggggaatattgaaaccctgaattcctaatcactgattttttaatatccacagtgagtacctcagacacaacccttccactggagtaaactcataaacatgactcttactcttccaagatagattttattcctgcattattcccctgaaaacccaaagggctatgttacttcttaaaaccacaataacttggatttgagctaactttgaaatttgcaaagaaaaggagcccagaaacaacttcctttccatcacatgaaccaggaatagaacacgttcatttcattccatatttgccctcatgcctctcatttcaaaggtggccctgcaatgctgcacctagaactaaatgtttatctttctcagtgacctggaaagtcactgagaagaaaggaaacatgcaagctaaatgctgacagatcttgaaatattgcaattttttgttttctggtgttgttaggatagccttgctttttaaaattgtcctgttgtttcaaaaaaatgtgttttgctggcacttctgttcattattaaccgagcgaatgagttggctagaatgctgttagaaggaaatctttgctatgtgaatgaaggtgggtcatttcttgtcttagtactggatagcccagaagacctagaaaagaaacgaatctgccgcatcatcacccgagacttcccacagtactttgcagtggtgtctcgtatcaaacaggacagcaatctgattggcccagaaggaggtgtactgagcagcacagtggtgccccaggtgcaggccgtcttcccagagggggcactcaccaagcggatccgcgtaggcctgcaggtatgcccatgttagatgcaaatgatcctaacaggattgtattctaatgattaaaaattagctttgtcaaggactgttacctttgttttataatcacaccaaaaaggaaggtagcattaatggtaaagctaaagtcaaaatccatatttattggttactaatctatttaaaaattcaacttatatttggacaattaaccaaaattaatctccagctacaaatgttttcttcttgtaaaaaaaaaaaaaagaaattagcttttaaatgagaaataaattgttaaagaatcagattattcctagtaagcaagagctgccatcagagatcgtggatcttacaaaattttatgagtgcttagtaataatactgaacttatgattgccatatttgaagcccaccaaacttatttgtaagataaaaaatactttggggaagaaatttgaaattaagtataatgattcattctttattttaaaatatatacacaaatatatatgtgtgtgtttttactttgaaaaggctcaacctatgcacagtgagctggttaagaagatcctaggcaacaaagctaccttcagccctatagtcactttggaacctagaagaagaaaattccacaaaccaattaccatgaccattcctgtccccaaagcttcaagtgatgtcatgttgaatggttttgggggagatgcaccaaccttaagattactatgcagcataacaggtgagtcacatatgactgtgttcgtagagagttctgaaaaaagaaacttagatcgttgtaaatattaaattacctttgtcataagatgtctgcagggtcatatgcattaattcagggaatacattttaattaactagggaaatgaaaggtgaaaggaaacaactattatttactaaatgaagtctgtatgccaaactgttagatagtttatatgcgttgtcattctaatctccacagtaaccctgtgaggaaactttaaccccgtgttgctgagaaggaaaccatggttgaaagaagttctataacttgcactataaatatttggtggtgttgggattcaaaaccacacccatatgtctccaaagttcaggcttcaagccttcattgaagagatcactaaatctgctgggaaaaaaaatactgtcttgagtaattatacccaatagttcaaaccaaactgttatgttatggaattggttatgtctttatcattgatctattgaactaactttagaaaaacaacttaaaggttttcagtgattaactgatttttggtcttttcaattgtggttgtgtagtcgctttcagacagctaccaaactctccaaagacactcccagaacgttggtagtctcttcataacaatgccatcacaaatagtgagaggcaaaaaaattcacatgaataatctgttctagggctaaataatttaactgataatttctctatcaataattacatggtgttggtattcagtaaatattagtactattattagtaggaacagtaatcatccctggatgtttttgtattgttagaattattattttcatttctctttcatattggcagaatgttcacctttattttgttttctttaattcacccttcttactcgtatgtttcttgtagttatgatagagaaccacgagattattccataagtttaataataatgagtggggggaaatcatatgcttcacttatgatctctttcccagttgctcatttttggttattgctatcatttctgggtatctttcccataattccagccccgtagatatatgattaaccttctataatgtgcaatataatgtcatggatgtgaaataggtgaggcagaagaatatctgtgatacgctctgcccttatagtgattaaataaacactctaggggcctaaacaccatctactctatttattccagcacaatgtctttagacaggtttctcataaacatttctgaaatttaattaaaattattttaaaaattaacaaataatttaatgtattaattgtttaaatacctagatatttgagtctttgtatttttctgtgtcatgtagttatgctgagtatgtattttaaaggcctactagaataaacttccataaactttctttgataacttgttctcttctttaagaaactttagagtcaagacttttcttcatttcaaacatatattcctcctacagccctttgaactaaaattttgtccttatctatgtgatcttaatttctcagtagacatgaaagacaggtagtcaccattagccttcatggtagtttttcaatgtacaggggccatcctttgatattcatttattttttcatttaccttgcaatatttattgagctcttactatttcacaaacattttttggctaaacttttattgcacatcgagaggaacttttttgaaaacaatttcataaaatatgaagtttaagaacaaaagaatatttagattgttcacttttttttttttttttttttttttgagacggagtcttgctctgtcgcccaggctggagtgcagtggcacaatctcggctcactgcaagctccacctcctgggttcacgccattctcctgcctcagcctccctagtagctgggactacaggtgcccaccactatgcccggctaattttttgtatttttagtagagatggggtttcaccgtgttagccaggatggtcttgatctcctgaccttgtgacccgcccacctcagcctcccaaagtgctgggattacaggcatgagtcaccgcgcccggccgattgttcactgttttaacaaactgttcagctccttaggtggtcaaaggatatttaaaaataatcagctgtatacaattcaaaattatcttcagagccttgcaattataataaaagcttcagaatgtcaggaagagaacagaaggcttaataaacacttattcaaataactaccctaaaacttagtttcttgagtggtagtctgctgtttgttttcagtgtgtcattttttagcatgtagattttagtcattttgttttcaatgtgccattttgaggggtgggatttggcttgtgaacacagaaccacaaagactttattttagaatctagagtctggagttttgcctgatttttttcaacaatcatattatttcaggtggaaccacccctgcccagtgggaagatattacaggaactacgccattaacatttgtcaatgaatgtgtttcctttacaacaaacgtgtctgccaggtatcgttatatagcacagaaaagcccactatgatatgttaccctccaaaaaaactgccctttgttttattttgtttctttattgtttaaaagttattttttcattggattttaaatatggtctgcctttgcttttatattttaaactagatctgtcagcaagtggaatagtgataatacagtaacaaagtattaccaatccgattaaaatctaaggaaaaggagcgattgtctgctttgcctgtatgattctgacttagtcagtagcagctgctgctttttccacttccaaagtccttaggaatgataatttcctgttgtcagcaaaatagcctgaactacttttccaacagaatgataacagcacaaatctcaccgtggtttgtctaaaaggcttagaggcttcagtggctcttatatacatttcttatttatgtattacatatctttaaaacgatgaagctatctagttttattgcttatgcacacaataactcaattgattaaagttagctcccattcctttgatctttaattgattgctaagcattgttacctctctttaacttgacattacaactttgtgacttaagtagggcaagagacattatgtccattttacagatgagaaaactgaagttgagagtaattaaaacgtacatttctatttggggtggaggagaaaacataaaagtgcatgaatagttaagtaatggcatagcaatagttgggtgtggtggcacatgtttatagttccagccacccagaggctcaactattgagtccgcagttctgtgtttcaatgtgttttgccaatttagcatctatactgtaatccagaagatgacatgttctgaataagagatatagaccagagggactaaaagaatgagagaagggtgttcgaattgggatagctagagagggtatctgagaagaggtgactcgagacatgtgttggaacctaataggcagataaaagtgaaaaagagaataacatgagcaaagatgcaaagatagaatgagaaggtgtagtgggggatagcaacaattatccatgtagtctataattcaaaaataatacttgaggctgggcctggtggctcatgcctgtaatcccagcactttgggaggccaagacaggtggattgcttgagcccaggagttcaagactagcttgggcaacatggtgaaaccctgtctctcacaaaaaagatacaaaaattagctggacatggtggcacacacctgtagtcctaggaaccagggaggttgaggcgggaggatctcttgagcccagagaggtcgaggctgcagtgagccgtgattgcgtcactgcactccagcctgggcgacagagacgttgtctcaaaaacaaaacaaagcaaaaaacaaacaaacaaaaaacaaacaaacaaaatctaggactgttggttgccaacactttataaaaggtcttacagggtagattaagaagtgataaatcactgcactccagcctgggcgacagagcgagacaacgtctcaaaaaaaaaaaaaagaaaaacaaacaaaaaaaacaaaccctttggaagtataaaataacaaaatgaaaatatttccatctaatgacctcgactttctttgtgaagttagctctcttagggcctgtggtgagggatgaagcttaaagagtgtcataagatttagtaacgttaccatagtgaacaaaaaattgccagtcaatgtcacagacttagttgaggctggaaatcataaagtcattatagccaataatttcttctatgaattatattcagcaatacttaggagttctggagcaggttttttaaaatggttgggttgattccactttggtgattagagttccatggaaaagaataacgaggggaggaaaagctgggtagattttgttgaaaagagtttcaggaaatgaaatgacagctagggaggggggatcaaggaaaatagaaaactatgcagtgagatccttgtcttatgtctgctattgagttcactccactaaaggattccaaaacactaaatatatagttcagaaaactgaatattcagaagagtttccaaaaaagaaaattagaaatacagtatttaatagttgatcttaaacctgatatctttctctcttctcttcactcccttctgctttcccttctttcctcctacctttccttttgttcctgtcttgctatttctttcctttggccttctctcattatctccctctctcacttccttttttccaagaagcatttgttgactactttgatcatattgaaggaactgattttatttttcacatggtatactttgaactttagataactgactttatttattttaataggttctggctgatagattgtcgacagatccaggaatccgttacttttgcatcacaagtatacagagaaattatctgcgtaccttatatggccaaatttgtagtgtttgccaaatcacatgaccccattgaagccaggttgaggtgtttctgcatgactgatgataaagtggataagacccttgaacaacaagaaaattttgctgaggtggccagaagcagggatgtggaggtactgtaccaaaaataataataataatttatgccatgttgttatacctgcattaatagattacatttcaaatatcatttaataaatagaataattaaaaagtgaaagacaagttcgcattttggtcagttagaaggtcaacatccaaaatctgccatttttagccattttggacctattcaataggaatgatctgtgcatgtgagaaggtaagatgattcctttaaagattatttgaggaaaaattatgagttattgataaactcaaagtatgtaagtgactgtagtactttagatgtttttagctttccttgttgtccttattttttaatagtaactaaaacagtctgggaagtatatctttttgcataaatgttgaagcagggtgtctagtgcttttctacattactttttcttatttcagaattttccatcagtgtaggtctttgggtgttgaagtccagtaacctgactcattgtgatgtcaaaagttacccaagcaggccaggtgtggtggttcacgcctgtattcccagcactttgggaggccgaggtgggtggatcatctgaggtcaccagttcgagaccaacctggccaacatggcaaaaccctatctctactaaaaatacaaaattagctgggcgtggtggcagatgcctgtaatcccagctactcaggaggcagaggcaggagaattgcttgaacccgggaggcggaggttgcagtgagccaagatcgcaccactgcactccagcctgggcaacagagtgagactccgtctcaaaaaaaaaaaaaaattacccaagcataagtttaaatttaggatttaaatgtattttggggttgtggaataatgggatacactttttggaatgagaacattaaatgtcaccatgcattaaagattcccattactagtaagaagaaagagtgctggacatgctgtgtcacagatagacagaatgtcagttgtcaatttaaagatggttgtatgtgtattataagaatttgaagttccaagtagtactaccacttctttgtgtaaacaacaagtataattgcagctactttattgttatttctctctgttttcactcaggtgttagaaggaaaacccatctacgttgattgtttcggcaacttggtaccattaactaaaagtggccagcatcatatattcagtttttttgccttcaaagaaaatagacttcctctatttgtcaaggtaatatatacatggaattttgtgatgcatttttttcaagatcaaggcagaatttgacttcctttagtaatagaaaattttcgcttttcagtcatcttcagagttttctttttaaccatatttgtaacgttttacagccctgggaaacaaatcatttttatttttgaggttcaaagtcaacctgaatttttatagactatatttaaggatgagaacaggacaaataatagccaactcattaattaggcacagtgaccggtattttccaaatttgaaggaaagcttatttatctattataacttttaaatatttatgcttagatttaaaaatacacgtgaacttcacaagtgtggagatcaaaagagttctaagtggcaactttttgtaataaaatctctcaaaagacccagcatctcacttaagctagtaaattatctgcaatagagctatagacttgatatattttcataaattcattcaataaacagcatggagacatttgtgtgcaccaggtgtttgttgtctctaaacagagaccaagttagggatttgaggtgatatatgcaagtttcattttagattccaatctaaaagggaccacatatgaaggaataagagattcaggaaataaaaaggaggtaataattctactctgcattattttccaagctcatttttcttcttgtttctcacaatttatttcactaatccagaggtcctaacgctcaatcctcttaggtataggctggcttctgtcgttttttttccaatcctacttcacctactcatttccaactgttcatcagcaatgactctttttattttaaccacttattatttttccaaacatgtgtctgcaaacctcttattaagtttttccaagatctctgctgagtctctttcattgtgccatttctggttcaattgttttgcctgactgatgatagattcttacagatcaccacattaagcagtaactgctcagaggtaatggatccatttaacatagacagctatataattaagctaatgtttgacatcattggtgtgcagaatcattctacaaacaacccaatacaaaatgagggaagtgcttcagtagacatttctccaaagaagatacacagatggtcaataagcatatgaagagatgttcaacagcgtagggaaatgcaaatcaaaactgtgaagagataccactccatacccattaggatggctattattacaacaaacaaacagaaaataaacaaatgttgggaaggatgtggacgaattggggccctaatgcattgctggtggaaatgcaaaatagtgcagcgactttggaaaacactatggtttttcctcaaaaagttaaacataaaattagtatatgattcagcaatttacttctcgatgtacacccacaagaatttaaagtagagactcaattacttgcacaccaatgttcttagcagcattagccatggtagccaaaatggaaacaacccaaaagtccaaaggtccacaaacaaaatgcggtatacacatgcaatggaatactattcagcctttaaaaggaaggaaattctagtttatgctgcaatatggtaaatgaaataagctagacacaaaaggacaaatattgtatggtttcacttatatgaggtacctagggtagtcaaattcataaagagagaaagcatttgtttttatttatttttttgacctctcctcgaagtgaaataaagatagaaagtagaagagtggttgctagggacaggagaagtgaagaatggggaattattgtttaatagatacagaatttcagttaggaagattaacaagttctaaagatggaaggtagtgatgattatacaacaatgtgaatgtacttaatgccaccaaactagacacctttttaggtttaatcatttttatgattaaaatgatacgttttatgttacatatatttatcacaattttttaaaaaaggaatgaaattctgacacatgatgcaatatgaatgaacttggaaaacattacgctgagtaaaataagccagacacaaatactatatggttcctccatttctacatgttcctagaataggcaaacgtatagagacagaaagtagaatagaggttattaggggctgggcaagagggcaatggggagctattgttcaatggggacagtttcggcataggatgaaaaacattctggatagaagtaatgattatacaactttgtgaatgtgcttaatgccactgaattttctacctcaaaatagtaaaaatggtaaactgtatgttatgtatattttaccataattattttaaaagctgagtaagttctgaagatctaatatacagcattaaactatagttaattgtatgtaatgtattatatacttgaaatttgctaagagatctcaagtgttctcaccacaaaaaagggggatgaggtgattgatatgttaattaatttgatacgctaatcatttcacaatgtatacatatatcaaatcatcacattgtacaccttaaatatatgcaatttttgtctaccatacttaaataagactaaaaaagaaagctgaatgatttttaaaaaggctttccaaatggtaataggaaaagagaaaggaaatcctttgagttcttacctagcagtaacaaatgaattttacttttccctttcaagcatcatctagttaaagtaaatactgcaaatcaaatgtgggtgaagcatgtatgtctttcttgttcaaggtacgcgatacgactcaggaaccttgcggacgactatcatttatgaaggagccaaaatccacgagaggcctggtgcatcaagctatttgcaacttaaacatcactttgccgatttatacaaaggtatcgtaaaatctgctatagtgcaattcaggtagagtaggaattgatttttaaatcttgttttaggtcagtgcaaaagtaatggcaaaaacagcaattgcttttgcactgacctaataaaatgaataccaacaaagactgattgaaagcatgtgtaataatcacgtttgattctctgtcagatttacgatttccacttaagaaaaaacgtagtgccacctgatttcatgttaaatgcactttgatgcaaaaattctattaatacacattgggcatggaagtaagaaaatttggcttcagatttaactttttgaagaaatttttaaaactaattggcttttcttcattattgttttcatgtgctttcctgcgaccatactcgtgcatttggccctatgaaaatattagagttcatcaccttctgtttactaccaattcacaggtggcttacatattattaaattcagaactgccccgtgatattttattttttctaagtaattaactattaatcttcgaacttatcatattttaggagcatataaactggtgtgatggtgcacacctgtagtcccagctactctggaggctggggtgagaggatcacttgagcccaggacttcaagggcagcttaggcaacataacttgtgtaaattgttggttaaaataaaaaatagttgaaatagttgattagtaaaaaacatatcgccatgttttgagtagatttaaaacattgttgaaaaggagaaatacattaatttctgaccccaagtctacctacaggaattactttcttttgaaatctctccccctcacgtaattcctcgaatactctgatgaaatcaaagaagacaactaaatcaattaaatgttgtggataatttatgtttcattcttttaaatttttttaaccaatatttcttttgaataggaagctctcacatggcaatctataggtggatgcagaagttgtcagtgtctatataacaggttgggaagggtgatgagtggtgactgctgagacctggaggggaagtaggaatatatttaaaatcctaaatcttgacatcacaaaacaaaaaagtcctatacttctttttccccaccacagttgttaaattttatatttgcttaatgaattattcttgtaaatagagatcagccatctagagaaaagctcatagcattaggtttgacattgtaaatttttattaaatgaataaaataaaatattatttgtatatttaaatatacatgttattccaagaattaaaatatagaaatgggtatatcaacccaaatgagcataatttcattgtattttgatggtgcagaatgtattttggggtttgtattgctgattagtagtgagtcagtggaggcagtatgccaataagaacgacaaagaaatatgtactgctgcgggcaagccacctgagtgttaaagaaagatgactgagctttggctgatttcagtgagctttcagtgtgctctaagagaaagcattaacttcattattacattttatttctaagtcaagacatatcagacacagctattaatgctgtgatagtccagtacaattttctaatttgtaactcaaaaagaaaaaaatcccagacattgtacattgaaaatataccttagtatttagtagctcttggctgggcaccatggcccacacctgtaatcccagcactttgggagaccaaggcaggaggattgcttgagtctagtagttcaagaccagcctgagcaacatagcaagaccttgtctctattaaaaaaaaaaaaaaagaaagaatttagtagctctttgttagaataatgcttctaaatattgcctgtgtattgaaaattttccaccatatgcttatttgtagcttttagtattttcaaccaatatctgtaatgattgggatattatcatcactatttctaaagacaaatgccatccagttcatttaaggtcaaactttgagactgccgtggtgacctagtatctggaattagtatatttataatgttggttcttttgtctcttgaatctataaactttgtacttaagccaatcttcttttctgcctgtcttctataaactgttagtaataaaaaaagagtatgttgactgtatgcttgcctgttgatgcttgttgaaagggtatttatttactctttccttttcttctaaatactctctactcttccttctctcttttttccatcttgcatggcatcttggggcggaaaggaatcagagtcagatcaagaacaggaggaagaggtaattttatgacagtgtcacttgttatcggctgtgtcattgctgtaaccactaataagagcacatagttaacctgtgttcttagacggggtaggcggttcttcttagtaattaaaggggcacaattttacttaacctctctaagcctctgttttctcatcttgtggagcaacttaagggaatagtaaagtttccctgtaaattgttgccatgtcgctatgcaatactatatttttccaccaactgctaagagctaaaccattatctcaggggttcttagtcagaagacatctagtggttgaaactctttttgtactaagacattattaatgtcttaatttttaattaaatgtcttagtacattaaaaatgtactaagacattatttgccttttaaacttctatatcctcacaaactataaaggagtctcccagaggctatactacatgtgatgatattgccactctggcaattaatggaatgtatgcttgcatactcttaggttctagcattttctcagccttcatttgtaatatggatatctatttatacatatcacacaccatcggaagtttttcaggctcctcagtaatttttgggagtgtaaaggggccctaagaccaaagagtttgataaacactgagaccaaaaaactttaagaagcatatagctgattccttagactatatcataatgcagaactatgctaataataataatttcttataaagtgggatctttactaagtgttgcacacgcctcatcaatgtcgatctctcacaaacacctatgaggtgtttgttattaaatactacattattgatgaagaaagcaagtcttagagaggttaccttgaataaatagctgtatgaattaaacctgcttcaatatttaaagcaaatgtgtgtttgtctccgttataaagatctgaaaatgcccaaatattataatagaaatgaaaaacataattggaaaacttaaaataatatgtttctaagatagacagatgcatatgttattagttatatgtaaatgttttcaaatatactagttttctttttttaaatgttattccaatgcattcaaaataaaaaatataataaatacccttatacccaccagcttaaaatgtaagcccttatcagttcagaagatgccccggattcgttttttttctgataccttgcaatggagcagggtgagagaggtgactatagaagcactgtcctgccgcacatagccatatacacaatcaacttaagactgaagtcattctttccctcaactgcacagtcactctttgcttcacatactccatttccttcctgtactcagtgaccctaccactacagctgttaaaaatgatagggaagccaattttgccatgttcacaaatcacttttttctcttagataattttcctactgaatactttctggaactatttagggcaatagatccagttcatattcttttcaggatctggaatgctggcttattattaacgataatgaaactacttctgtagaacacatcaccctagtgttgctgtttgtcatcctttcctttttctccactaaatggatacttattattcaatactgacttcaccctttttctgatgtattccctaaatatgtattccaacatcaaaaccagcctgggtcatatcttcccaggattaacatgctagaaaggactttctacctgtagtgtctagaaaacagaaggtttttttcaaagtcaggataagaatcatggagactctcaggaaaaaatgtagcaaattactctgaccttcctatagctatggtgtcacccaacatgtataattatgaataggagctttttgtgcacaccaggggctatgagccaaggcagtatttgtaaccattcaatttatgtatgttttctttcagatcgatatgacatcagaaaaaagtaagaatttaaagaaaattgagtttgtttgaaagctggctaccataaaaagaagcatgaattaaaatgcaagctagttgctattactaaccactatagtaattacatttttatattatccttattaatcattaatatatttataaaagcagcttggccagttaaattacaaatatacctaatttgcgagctaattagcagtaaaatgcaatgattattcatctaagcattcactttcttttgacattcttgttaaccctggtattgctgttatgcttgtttagaaacccaccctaccgttttgtccatttgttagcaaaacactgtcatctcatcattttttaagcactgacatgacagtatcactttttatgtaatgcaatagtgacttctgtagagagctcattatttttgtaggatacacctgcaaaagtgatactgtctaatagttcttagctgaagctaaccccatccaatgcctgccccctcccccatcactcttttgcactttttactgtggtgaagtgtaaccaatgtctttagagctgaggtctaacagacttctgtgaaaactttctgaaaaaaaaccacaaaacaaaaataaacaaaagtgaagagccaagaatgcaaaattaaaaccccctggataaaattactaatcacaacagcatgttattatagggttaattttaaataatgatgcaaatcccaaacctgatctagtagagagagaactggttttgacagaccttaaaagagctatcttagaactcatttcaggtttgtaatatccaattaagattttagtttgttggactatttctagtgactctctggcttcttgtgtggaaactccagttgaattttacagatttctgcttttgtgccccaaatgctttttaaaaatctgatttttaaagtttattgaatatcaataaactttatttcagagtttattttgatttgctgtatttcacagtatattcccaaaatgagaaaacttagaaccatgtttaatatgctcatgtggccctacacaatgatctgagggcttttttaaagtcctaggacaatgtaatttactactaagttatggaagttgctttgaatgaggcttaccctcatgttaaagcattattcagatctagaatgtttgagattctggatgttttcattggtttatataattgaacaaatttgtattggtataaattattttaataaatttatatgtgtaaattcacatactgtatcttctcaacaaatacagattctcccaagagaaggcacttttgtttatatgacatatcacattgccctcactgattcctttttttaagtgattttactttattctcccactttcttcttcagaactactccatttatttaaatggcctcttactttgctctcctgatacaaactagtaagaattaaaaattaattcatccatatggctcagttgttaaaaaaaaaagaaaaaaaaatgttaccatgttgctatgatgccatggattttcctgaaggatttctaggtgttttgagtgtttcagaagttttaaatacagactcaagtttgcttttgatttaaagataatcattaaataatcttcatctaggtataaactaatctctaaagaagtgctctgtggaagggactcttacctgaagtctttttatcagtacattttagaagagtttactgagttttcttccttaaccttaatgggtgtaagcccccacaacctaagcctcaatataccaccttcagcagcttatgcatggactcatagggaaataagtacacttcgccacagtaatgttttacatatctgttctaaattcccgccatcctcctgcccatacgtttcagcaaggccgcctctcccagccgttttactccacctttgctttgcatggaaataacttggcttacataaactgtgtgtgtgtcccgtgtgactgtctctgacttgggttgccatgcatcacattttaactttggactcacttataagtttaatcacaattgttgtttctgttgtttttctttcctttcctttatttccctccttggtctgtccattctgtgtctaaacaaggaggttgctccaaggaaaggaccatgcctcgtagcaccagactgtttgtttcattgttaggtgtgaatttcccttagatgaaatgccggtttgcagctgattcagatgtattttatatagtctttgtatattggtagaactaaacatactgaatttcagacttttatatgattaaaaatgtatatacatcattagatgttattctgagcttgctactactggctttctcctagaggaaatcaactttctgcaatttctaatgctttttttcttattttttcctcatggttggttttcttttttttttcaacattgatctgtaacatctgaacaatcttgagatacctctgtgtaatttcactgcgttctttgttttgatatgtagtgtttttttgtgtgtgtatgtgcgtcttgttttagctttgttgtatgtgtggatgtgctacaagtgagaaaaattaagcaagttatttcctgctcatttttccttttcagttgttttttttttcgttagccttgctttgctcttgtaccctgaggccttgtggatctaccattcccagcccattttgttgcccctcccaccaccaccaccacaggaaaagacgctgtgtcgtttcagtcctgattacatttgccaatatcttttttgatttccattttactttcaatgtttttcattcacatcaaagatgatgagacagaatctacagaaacatctgtcctgaaaagtcacctggttaatgaagttcctgtcctagcaagtccggacttgctctctgaagtttctgagatgaaacaagatttgatcaaaatgaccgccatcttgaccacagatgtgtctgataaggcaggttctattaaagtgaaggagctggtgaaggctgctgaggaagagccaggagagccttttgaaatcgttgaaagagttaaagaggacttagagaaagtgaatgaaatcctgagaagtggaacctgcacaagagatgaaagcagtgtgcagagctctcggtctgagagaggattagttgaagaggaatgggttattgtcagtgatgaggaaatagaagaggctaggcaaaaagcacctttagaaatcactgaatatccatgtgtagaagttagaatagataaagagatcaaaggaaaagtagagaaagactcaactgggctagtgaactaccttactgatgatctgaatacctgtgtgcctcttcccaaagagcagctgcagacagttcaagataaggcagggaagaaatgtgaggctctggctgttggcaggagctctgaaaaggaagggaaagacatacccccagatgagacacagagtacacagaaacagcacaaaccaagcttgggaataaagaagccagtaagaaggaaattaaaagaaaagcagaaacaaaaagaggaaggtttacaagctagtgcagagaaagctgaacttaaaaaaggtagttcagaagagtcattaggtgaagacccaggtttagcccctgaaccccttcccactgtcaaggccacatctcctttgatagaagaaactcccattggttccataaaggacaaagtaaaggcccttcagaagcgagtggaagatgaacagaaaggtcgaagcaagttgcccatcagagtcaaaggcaaggaggacgtgccaaaaaagaccacccacaggccacatccagctgcgtcaccctctctgaagtcagagagacatgcgccagggtctccctcccctaaaacagaaagacactctactctttcctcttccgcaaaaactgaaaggcaccctccagtatcaccatcaagtaaaactgagaaacactcacctgtgtcaccctctgcaaaaacggaaagacattcacctgcgtcatcatcgagtaaaactgagaaacactcacctgtatcaccctcgacaaaaactgaaaggcactctcctgtgtcatctacaaaaacagaaagacacccacctgtttcgccttcaggcaaaacagacaaacgtccacctgtatcgccctccgggaggacagaaaaacacccgccagtatcgcctgggagaacagaaaaacgcttgcctgtttcaccctccggaagaacggacaagcaccaacctgtatcaacagctgggaaaactgagaagcacctgcctgtgtcaccttctggcaaaacagaaaagcaaccacctgtatcccccacttcaaaaacagagaggattgaggaaaccatgtctgttcgggagctgatgaaggctttccagtcaggtcaggacccttctaaacataaaactggactctttgagcacaaatcagcaaaacaaaagcagccacaagagaaaggtaaagttcgggtagaaaaagaaaaggggccgatactaacccagagagaagctcagaaaacagagaatcagacaatcaaacgaggccagagactcccggtaacgggcacagcagaatccaaaagaggagttcgtgtttcctccataggagttaagaaagaagatgcagctggaggaaaggagaaagttctcagccacaaaatacctgaacctgttcagtcagtgcctgaagaagaaagccacagagagagcgaagtgcccaaagaaaagatggctgatgagcagggagacatggatctacagatcagcccagataggaaaacctccactgacttctctgaggtcattaagcaagagttggaagacaatgacaaataccaacaattccgcctgagtgaggagacagaaaaggcacagcttcacttagaccaagtactcactagtcctttcaacacaacatttccactcgactacatgaaagatgagttccttccagctctgtctttacaaagcggtgctttagatggcagttctgaaagcctaaagaatgagggggtagccggctctccgtgtggcagcctgatggaggggacccctcagattagttcagaagaaagctataagcatgaaggcctagcagagacccctgagacgagcccagaaagcctttctttctcaccaaagaaaagtgaggagcaaactggggaaacaaaggaaagcaccaagacagaaaccaccacagaaattcgttcagaaaaagagcatcccacgaccaaagacattactggtggctctgaagagcgaggtgccacagtcactgaggactcagagacctctactgagagttttcagaaagaggccactctaggctctcccaaagacacaagccctaaaagacaagatgattgcacaggcagctgtagtgtagcattagctaaagagacacctacaggactgactgaggaggcagcctgtgatgaaggtcaacgtacctttggtagttcagcccacaagacacaaactgatagtgaggttcaagaatccacagccacctcagacgagacaaaggccttgccgctgcctgaggcttctgtaaagacagatacaggaactgaatcaaaacctcagggagtcattagaagtccccaagggttagaacttgcactccctagccgagatagcgaagtcctcagcgctgtggctgatgactcattagcagtgagccacaaagactctctggaagccagccctgtgctagaagataactcttcacacaaaacccctgattctctggagccaagtcctctgaaagaatccccttgccgtgactctctggaaagcagccctgttgaaccaaagatgaaggctggaatttttccaagtcactttcctcttcctgcagctgttgccaaaacagaactcttgacggaagtggcctctgtgcggtcccggctactccgagaccctgatggcagtgctgaggatgacagtcttgagcagacatcgctcatggagagctcagggaagagccccctttctcctgacacccccagctctgaagaagtcagctatgaggttacacccaaaaccacagatgtaagtacaccaaaaccagctgtgattcatgaatgtgcagaggaggatgattcagaaaacggggagaaaaagaggttcacacctgaagaggagatgtttaaaatggtaaccaaaatcaaaatgtttgatgaacttgaacaagaagcaaagcagaaaagggactacaaaaaagaacccaaacaagaagaatcttcttcatcttctgacccagatgctgactgttcagtagatgtggatgaaccaaaacatacaggcagtggggaggatgaaagtggtgtccctgtgttagtaacttcggagagcaggaaggtgtcttcctcctcagaaagtgaacctgagttggcacagcttaaaaaaggtgctgactcaggccttttaccagaaccagtgattcgagtacaacctccttctccacttccatcaagcatggactccaattccagtccagaagaagtacaattccagcctgtcgtttccaaacaatatactttcaagatgaatgaagatactcaggaagagccaggcaaatcagaagaagaaaaagattctgaatcccatttagctgaagaccgtcatgctgtttccactgaggctgaagacaggtcttatgataagctaaacagagacactgatcagccaaaaatctgtgatggccatggatgtgaggccatgagtcctagcagctcagctgctcctgtctcttcaggtctacagagtccgactggtgatgatgttgatgaacagccagtcatctataaagaatcattagctctccaaggcactcatgaaaaagacacagagggagaagagcttgatgtttctagagcagaatctccacaagcagattgccccagtgaaagcttttcatcttcatcctctttgcctcattgtttggtatctgaaggaaaagaattagatgaagacatatctgccacatcttctattcaaaaaacagaggtcacaaaaactgatgaaacatttgagaacttaccaaaggactgcccctctcaagactcatccattactactcaaacagatagattttccatggatgttcccgtgtctgacctagctgagaatgatgaaatctatgatccacaaatcactagcccttatgaaaatgtcccttcccaatcttttttctctagtgaagaaagcaaaacccaaacagatgcaaatcacaccacaagttttcactcttctgaagtgtattctgttaccatcacatcccctgttgaagacgttgtagtggcaagctcctctagtggaactgttttaagcaaagaatctaattttgagggccaggacataaaaatggaatcccaacaggaaagtaccttgtgggaaatgcaatcagacagtgtctcttcatctttcgagcctactatgtccgctacaacaacagttgttggtgaacaaataagcaaagtcatcatcacaaaaactgatgtggattctgattcttggagtgaaattcgggaagacgatgaagcctttgaggctcgtgtgaaagaggaagaacaaaagatatttggtttgatggtagacagacaatcacagggtaccacccctgacaccactcctgctaggaccccaactgaagaggggaccccaacaagtgagcaaaacccatttctgtttcaggaaggaaaattgtttgaaatgacccgaagtggtgccattgatatgaccaaaaggtcctatgcagatgaaagttttcactttttccaaattggtcaagaatccagggaagagactctctctgaagatgtgaaagaaggggctactggggctgatcccctaccgctggagacatcagctgaatcactagcactttcagaatcaaaagaaacagtggatgatgaggcagacttacttccagatgacgtgagtgaggaagtagaggaaatacctgcttcggatgctcaacttaactcccaaatggggatttcagcctccactgaaacacctacaaaagaagctgttagtgtagggaccaaggacctccccaccgtgcaaacgggtgatatacctcctctctctggtgtaaagcagatatcctgccccgactcttctgaaccagctgtacaagtccagttagatttttccacactcaccaggtctgtttattcagataggggtgatgattctcccgattcttccccagaagaacagaaatcagtaatcgagattcctactgcacccatggagaatgtgccttttactgaaagcaaatccaaaattcctgtaaggactatgcccacttccaccccagcacctccatctgcagagtatgagagttcagtttctgaagattttctatccagtgtagatgaggaaaataaggcggatgaagcaaaaccaaagtccaaactccctgtcaaagtacccctccaaagagttgaacagcagctctcagatctagacacctctgtccagaagacagtggctcctcagggacaggacatggcaagcatcgcaccagataatagaagcaaatctgaatctgatgctagttctttggattcaaagaccaaatgcccagtaaaaacccgaagttacactgagacagaaacagagagcagagagagggccgaggaacttgagttagaatcagaagaaggggccacaagaccaaagatacttacatcccgattgccagttaagagcagaagcactacatcttcctgcagggggggcacgagccccacaaaagaaagtaaggagcatttctttgacctttacagaaattccatagaattctttgaggagattagtgatgaggcttccaaattagtggataggctgacacagtcagagagggagcaggaaatagtttcagacgatgaaagtagtagtgccctggaagtatcagtaattgaaaatctgccacctgttgagaccgagcactcagttcctgaggacatctttgacacaaggcccatttgggatgagtctattgagactctgattgaacgcatccctgatgaaaatggccatgaccatgctgaaggtatttgccagccaccgggattccctgtgctacgcatgtcataaaattgatatagtttttttgtatgtttgttttatttgatgatttgtgtctcattttctttaagctttctgtagtggctaatgtgtttgtgtaagccctttgtgttttgtgctttctctgtatactcttgtctaagaaaacaatctcaagattgagtaatgagaatgcttatggaaaacataaacataataaccgggcaacagtgatcttgccttttttagcctctgcacgtaataaggccatgcgagctttgagttttgttgttctgaagtcccaagcttagactcaaattaagcacttttgcacataaatatattgtattttgtttcatagtatgaagacattgcttttcttcttatcttcgcatactttaaaataatttgtacttacaattttgtaatcattaggaagccatttgcttgagaagatttcacataacatgaaattctaattgttgtggatctgtttttgattcagaaaggttggatttcagataccattggtaaatactttaagcaaacaaacctaaggtaaaaatatgcttttcatttatgtggtagatgaatggagaatgtactctcattagatgcagcagacaacaaaaactcaaactttgcacagtttaagttgactgtgaggggatgatggctctttgacttataaaaaaggaaaccatagatggctttgaaaagtagcctgtgttcttccaatatctctacaatgaagactgtcattcttaaattgaggttatacaaactttcctataccatggtctaaaatgctgcctatcaatcagtgggagttaaacatgaatgggaaaattatagtttataggagtgagtagtatataagcttaatagcaagaaggcagaaactttgcccaaaagacatatatgcatacagatacaatatacacataaaaatgcatatgcttttatcctcgtttctccaaggtcaccaggaccaaatgttgtttctggccacactaatcaggatggcctgatcagctcatgatcaacatctcttgtgaatctctgatgtgattcctttcagacatgacctggaaatgatctatccctccacaagcaataataggaggtcctagccaattgctctacttctgcatcccatttatgatttctctggtgtttcatgaacaagatggtggtcttcttggtgggcagtattctctccaataatttaaaagtcataagattactagaaatcagcaacttatataattatgtctagaactagtcttgattaaagagatatggaagcagatggttttcatgattcatattagatctattccccattccaccccagaaatcagacacacaatatgatctgaaatgtagtatctagtttgtgctttcaaatatttggagaagtgacttcctttctttgaatgaatcagtactgtggttcctctcctgtcatagacaacctttggccattctgtttttgaccttctccagatccacaggatgagcaggaacggatcgaggaaaggctggcttatattgctgatcaccttggcttcagctggacaggtaaaaagaatgtgacccaggttttcaacaaaacctgacatagatgcatcagtcaggtgtcattcacagcataaaaggtaccccccactttcttgagaaagaatacatgaaaagaagaataaactaagaactagaaaacctgggctctgcatcagctaatggtatagcccagggcaggccttttatcatctctgaaatttagaataatagaactttctatttgaagatttagagaatataccaacattcaggaacctctgttggcagttgtggatatctaaatttgggggagattattatgtttcaaaatcatttttagatgtaatttttatcaaatttaatgtgagatttaaccagggctccttcttttagataccttatgtcaaaaatcttcatagtaaacaacactaaaaattgctttgggtaagtgttaaaacacacatgaatgagatatttcactaatatttttgagaaatgagagtgtttaagtatagaaattttatgttaataatttattaaggaaaagtgaattctaaaatcaatatactttatttacacattatgaattgtatgttttaaaaactatacattttcatctacttgtgacttaacctattaaagcaagattctcagtctggctttttttttttttttaatatcacttgtgactacttcaaagagacaaacattgtaaaataatattcttttcctttccatttcttagatttggtgatgaataggagcccataatactcataaagataactactaatttagagtacatgactggagaagtggccactttctcacttgtaataattttaaagtaattcttacatactgatcagacttaactaattcggggttttaggggagagaatgataccaaactatccgtgattgacttactagataacattcagaattatttattttggtttttaaatatgtttgtatccatacctacatagtaaatgcaatatgtatatatttggtaaaaattcaaatcctaccaccatatagaatgacatagaatgaaaagtaaatatgactctcacacctacttctatcttctagccgtgtgcctcagaagtaactgctaatactttctcatgcttttagaaaaaatatacagtgcctatatttatgcctgttatttaaaagtaagaaaagttttactgaataatattcctcataagtagtctgttaacatatacacatgtatttcattcttttaagtgggtatttaattccactatatggaggttccataattttattaatggcttttgttgatgggctttaggtggtttcccagtaacggcagtaaatattcttgtgcattggtatatttttgtgagtatatctatagggcatattcttagaagtagaattgctgcggaaaagatacgtatatttttaattttgaaagatattgtcaaattgccttcaaaagaggtcaccctatttacccacacacgcatacacacaccccataatgtataagcatccatatgtaatggttttttgtttgttattttgtttttgttttgttttgttttacagagacaggatcatgctctgctgcctaggccagagtgtagtggcacaatcatagctcactgtaacctcaaactcccaggctcaagtgatcctcctgccccagcctcctgagtagctaggacctcaggcaaacactaccatgcccagctaattttttaaaattattttttgtagaaatgaggtttttctatgttgctcaggctagtcttgagcttctggcctcaagcaatccctaccacctcagcctcctaaagttctaggattacaggcatgagctactgggcccacccaatccatatggaaggttaatagtagaattcaaaggaaaattttgtgtcttcttccctggatcaattaatgcttcctcgacctcttattcagttgacatcaaatcaaagaaaggcatttatccaaccaccataatatagctacaactagtatttatcaaagtatccagaaacaggatttataatactcaaaacatcacctatgttaattaaagggagaaactttttttcttttgttatcagtcatttattttccattatcttgcttaaaagtataagcaagtattaatgatctcatttgcattttggaatcaaatgggcctgaattatacatatcttatcattgctgcctcacacttactattttcactatgcagtgataaattctatacccagttttaggggaaaaaatccataattagtactagaagaacaaaggcatataagagtcacttctaatatgtagaaattaaggaactcaaatactcaccacaatataaagaacacatcatttacaaaatcacaaagcaaaatgtagagactgaaaccttgaagttaatgtgtttacaaagtagtattttatcttctagaattagcaagagaactggatttcactgaggagcaaattcatcaaattcgaattgaaaatcccaactctcttcaagaccagagtcatgcactgttgaagtactggctagagagggatgggaaacatgctacaggtaagtggggaactatatgcatattgggctaaagttggacatgtcttgctcaacaaccgcatcttgcaaattcagtagaatagtaaagaagcaaatgccattaatctgcagtacagtgggtccttgagtaatatcattttgttcagtgtcatttccttataacattgatgagaaaaaagaatcaattcccagcaaggccactgtctgtgtatagtttgtgtatcctccccatgtctgtgtagctttttccccagtattccagtttcctcccacatcccaaagatgtgcacatcagtttcactggtgtttctacattatcccattctgagtgagtgtgggtgtgtgtgagtgccccctgcaatgggatggcatcatctcccagcttggttcccatgcaaagtgctctgagctgctgggttaagttccagccacttgagaccctgaactgaataaggggattgggaaaagaatgaatgaattgatacaaattgttgtcaaatgaaaatgtatagagtccatggtaattacacaaatgcatgaaataaatgatgccttaggaaagtactcagcgagcccaccatatttgttattgtttgtttatgaatggcatggtgggaggaggtgctccttacaattttcactttgcaaagatttattccttgattgaaccccaccaccactatgaccgccatcacgcattggttcctcaaaaattgaataattatcttacttatgtttattagtctttcttaaatgtatgtgtaactcactttcacttcagtgtttaatattaaaagtgtttggggttttatttagaagtttggcagtgtttttgtgaccagaacattgttttctaagaatctatcaatgatgttgagtgagaacttagtgaactactgtaagcaaatgagaacaagctactgtcacttctgaagtatgcatgttgcttaaaaactcttgcacgatatgcgtatgaaccgcattaaataacagccctcacttctaacagtaatgttactcaaaccctaatatttttaaaatattgataagtggacacaattgctttacttagcattgtttcactggtagtgcattaccttctgtttctgcttcctttactcataaataacatccagtctacatttatcattccttgtctttacattcttctaagtagaattgtcagatttagcaaataaaaacagaagggtgcccagttaaatttaagtttcaggtggtcagcaaatacatttttagcataagcatatcccttgtaatatttggggcatatttatactaaagaagtatttgctttttatctgaaattcaggtatggtgggtgtcctgtatgttatctgacaattctacttttagggcttttgcccatgctgtaccactttttttatgcatatctcttttgtctgttggcttatttttacaaagacttttaattaggctttgattgtttttttctgtacagatatcaaaaatttagtaaggcagttgagtgaaagagatttttaagagtacctctcagacataataaatgctgtttctctaatgtgtcagataccaacctcgttgaatgtctcaccaagatcaaccgaatggatattgttcatctcatggagaccaacacagaacctctccaggagcgcatcagtcatagttatgcagaaattgaacagaccattacactggatcatagtgaaggtcaaactgtgtgtgtgtatgtgtgtgtgtgtgtgtgtgtgtgtgtgtgttgtgtctgtgtgtggttaattgaggcactggacctactgtcttttttttttttcagaaggtagaccatggcctatggtgatcatatgttcttttccttgctaccctgaggctttcctccctgttttacacaccctcccacctccgcttcatgctcattctttgttatttcacagataacaaaatgatccattgaattccttttcctcagttccatggtggcacttcttacacttgtatttttttatgctaccttagccacgtatttctaggctcacaactaggactatatcactaccagtgactgtacatttcctcttttacttctgcaccaacagtgcttcataccctcggggacctccagccattggccttaccaccttttcagtgttaaagttcccctaacctattctcattcatttgtggtctctaacactgtttttttttttctctctctctcttatctctattttacatgttgtcttcttccttcaaacctccaacactgtctcttttctttatttatacccagctgatgaccaaacttcctatttcttagaaaataataagaataatcagaagcaaatgtctatatttttccaccacgaatctaccaacatgagtgcatctcaatgcatatacttaactctaccttccatcctattaaaatggataaaatttcttcacttttctaaagccatcatctcttgttttgtactagatttcatctccttttactcaatcagggactccattcctgcaagtatcccttttggcttcctaccactagaccatacccaacagcattaaaccatgctttaatagatcccatctttaaaaacaaaacaaagcaaataactccttttaccctatatgtcccccctgtattattgctgttactccatccatttcacaggaaacctcttaaaagaacagtctgaatttcctgtctctacttcctctcttcccattccctctagagctctataattcactctagtcaatcttataaaattcacctattgtttcctctttttcaaatctagcaggcagttctcattcttcaacttactttgcctctgggtaacatttggcatgaatagtgaagcctgccttcttaaaacattttctttacttaaatttcatgacattcttgcttcctttttttttttttttttttttttaactttactggctgtttctccttcctgtggcaggttacttctcatggatgtgaatgatgatgtatcttaactgttgagcaagagcctcatagcttgtcctcatctcccacctctgtctctatcgcactggtcctgcacgcctggcctccttgccatttctggagcaccctctgcattctcctgtttcagggccctggtattttctgctccctccaccctagcatgttctttcctcagatcaacatatacctttttctctcactttatttaggtcactgctcaaatatcgcctcctaagcagagcctttcctgacaagtctatttaaaatactagccccatttatcctctacctttatcctggtttacttttctcccaatatttatcataaatatatatctgcagaaatgcaagttcagtggggacggaagctttttatatcttatatcttgttcactgctatatatccagcatctaagcagcacttattacatagttggtgctcaatatatatctgttgaataaatgagtcaatagatgaatgccagtcactcctctgctaaacatctttcaatgactcctcatttccctggatataatgaaattccttagcctgtcataaaagactctacataaaaagagtactatccttatagtgttagagtgagtattaatcaagttaatacttgcagtgcacttgaaacggtgcctaacatggaataaattttcagtatgtattagctattgtttgttatgatgattattaactgtactcatcttactcttcagattctgtgctttgactgtctcagtcaattcccacttgccattaggtctccttggcatgtaacacactctgcattttctttccaaattctaaccccatgttaggtgctcccacactcattgactggcacctatgacccagttgctctgcactggaattgaccgttacttgcgtggactcttctacatgatccgtatcttgaaggtggacacagtgtcttcttcatctttgtaatccatgggcccatctcaggatgtagcacatttatcttcttattttttttatcctcttatatttattacttaataaatatccattcaatataggtaagcttcaactaaatacttaaatcattctgcctttagggttctcggtacttcaagaggagttatgcactgcacagcacaagcagaaagaggagcaagctgtttctaaagaaagtgagacctgcgatcaccctcctatcgtctcagaggaagacatttctgttggttattccacttttcaggatggcgtccccaaaactgagggggacagctcagcaacagcactctttccccaaactcacaaggagcaagttcaacaggatttctcagggaaaatgcaagacctgcctgaagagtcatctctggaatatcagcaggaatatttgtgagtttccaaagaaagcctgtcaaatgtaataccaaagaaacaggctattgtggatgccaggcatatataagcataactagtttttaaatactttttaaaatgaccctaccaaacacaagtgccagagctaaaggggaaaaaaaaagcgttaacatgtaagagacataattgtgacagtgtttggggcacagacctacaagaaccaacttccagagctgtgactttgaacaagtccttatgtgctttgaatctccatttccacatctgtaaattatagtaataatacacacttgactcatctcacagggtcaaaagtgtgtttatgaaagcttcatctaaactgtaaaattccctgtagatgacacggccatgacttataatattgctgcacctcatttgctctgtagcacttcaaatatgctctgtagcacttcatcgtgccattgctggttaggagtatggtcagtgatgatgtagataccacagccaatggtgcatttcaaccaagctatgaggggactaatcataaaaatataaatgcaatgcaaactaaccacatagaataaaagactattaaaatgagttggaatagagttggggtgggagtaaagagaagccttccgaagagcttctggctgaaggaagctgcaggcctaatttggctcagaatttaagttccggcctttatggaagccaaggagaaagagttgtttaattgacactgattgtccagaaaagaaaacaaattgtgagaaaggccaacatatccctaaacctgaagtctgagaatagggtgtcatgagattgtatcaaaacatttcgcttgtcatttggtgagttttgtggtcattgacatgagaagaggatgaaatgagtaatgaaattatctcttcttccactgagccacccttgccccatcaacctgtaggttttaaagaaaatataaggaagaaggagaaggaccaaggaaaagatgggaagaagaggagaggataacagagagacattttaggcatttaatatctatggagtgatagattgcactgaataccaaaagaaggcacagaaaaggccaataatcttatttagcagttgaggttatcaaagttacattggagtaactccagactatatcaatgaaaaaagtttccatgtcaacagatgcctctattattaaataaaacagtttttcagaggtacaataagaatttccttgtatttatacttatgataactatattaacatggggatttatgtaattctgccaaatttttattcttgcttcaaaagccttattatctacaaatacttatgtaaaattcctcgcatcctcaatatcaccttgagttataaaagaaaagatgaaactataacttatatacattgtagaggttgggtaactgtaatacattttaggataatttttgtctttagaataataacatcactctctgccagtgctagatcaatgagctacaactctatatcttgtcatattatttttcttcaaatgtcctttcttggccaaatgtacaaaaactattttgactgtcatagactatggaaaaaccagctccatcttgcctttcgatttccttgcttgagcaggaggtgaaatgcaaatgtccctgaagtctcatttggctttttgattccagtgtgacaactccaggaacagaaacatcagagactcagaaggctatgatagtacccagctctcccagcaagacacctgaggaagttagcacccctgcagaggaggagaagctgtacctccagaccccaacatccagcgagcggggaggctctcccatcatacaagaacccgaagagccctcagagcacagagaggagagctctccgcggaaaaccagcctcgtaatagtggagtctgccgataaccagcctgagacctgtgaaagactcgatgaagatgcagcttttgaaaaggtaagacattcctctccactttctcgcccacctgtaacaaagctacaaatcttccagtttccatttctatgatggtttattttttgcacttcaaaacaaaaaagttaaccaaattaattaacctggcacatggaaaccctcaatcccttttaaaatctgagagccgatgaatcttgaagaaatggcgcacagttccagtgctgttgatttgaccatgagccctgatcttatcattggaaagtcttttgctaagaaaaatgaatacggtggtgaaacaatatatctggaggagcttttcaaaattagtaaacttgggcatgaaacctggtggcagagattagcagcaccaggtaagtcagccatgggatgtgctgggaccagcaggcttgttagatctctggcctgccaggtgatgagcacacagactgtggatattgggtggggtttagctgccaaaataaatttttctcattagaggcaagatgatttccaagttagatttttttttttaagatttattttaggaatgactgagaaaaagaacattgtacctaaattaaatgtccaaatgcctgacggtggcataagattgcatcatagcgcttcctttgtcattaagtgagttttaaaattgtgaaaaggggtggggaccatgttaagaaattaaccattggccaggcgcggtggctcacacctgtaatcccagcactttgggaggctgaggcgggtggatcatgaggtcaggagatcgagaccatcctggctaacatggtgaaacctcgtctctactacaaatacaaaaaaattagccaggtatggtggcgagtgcctgtagtcccagctactccggaggctgaggcaggagaatggcatgaacccgggaagcggagcttgcagtgagccaagatcataccactgcactccagcctgggcgacagagcaagactgtctcaaaaaaagaaaaaaagaaattgatcaacaatttattctcaaaatgtggtctatatagttcacatacgtcagaattgattggagagcttgatccctcctcagaaatcctgaattagaatgaatcccagggtggggagggaaagcaagaatttgccttttaaataactccccagaggattctcagccacaaaaaaagtatgagaatctgtttgaattaaacttaatttaatatgaattaaacttaatttaatataaattaaattagatattgttttttcttttaaaaagtaatagaattcaaaaacactttatatttcaaagtgtttttagagcattaatataaagcttagtagtaaaagaagagttaaacaaaataattgaaattttggggggcaaataaagtgaaacagcatgtgtttgggcttaagacacacatttgtttttgttcactgtaagaatgagatctgctgctaggaattatctgaaatcacaactaaaattaggaaagatccaggcagatgagaactgtgtcctgattttggcagttttcttaaataataaattcatgccatgaatgaatttttattccaagtttgcttttgcatagaattattcatctctcaaattcttggcttgaatgagtactactaaaaatgtttcttacatgttatctaggctaaaagttaccaaatttaacctaagaatccataggcttagtgaagttagacttgaaacaattatctggataatacatatgtttaatctatactaaaggaatatgtttgtataagtcactctgaatttcacataatttatacaggcctgttcgacttattcttgatgagtatcaggcatttctcttaagcttcccatgtggacccttatttctcataaccctaacttgggcatccaattttaatcacttttcttgccaaccatatttctaggcagtagattcctgattatatttaaaatataatttggtttagaatttacaggtcttcctttagcagagacaaatgtaaacatataacttgagttttacagtgtgttaagtaaatctacttgagctttctcttttttaaaaacaaaatttcattagggaagagtaattcaatatatgactcctaaggtaatgtgtgctaagctaaaattatgttttttgctttatctctggcttttggccagagccctaaaatactattgaccactttatctcaacttctccatagaattattctaatattattcatagtctacctttttttgatgccagggagatgcactattggttagataatagctacaggaaactttgacttcctgcaaaaagttctgctagaaacaggggatattcctatacctttgggtgaataattccaagcctaagcaccagtgtcagtggctcataagtgtttactgaactgcttagggtctatgtttacagtcaggctttttttttaggagtttaagtaaaagaagtcacatgagcaagctgctttttattttggagagattttgacagatgggttctccaacagctctcagaattccagaattttttttcattcattgaacaacaacaacaaaaaaccaaaacactctatttttgttgatgtctgagaccagcacgtatttgttttcacctctaccaacttgtccatcaaagcctccatgaataaaagtttcacaatacaatgtaagctaaagaagaaaccagtagtgaagtcattccttagcatgttaaacaaagcaatgcttccatgcttccaccaggagctaacagaggaattaggggagctggaggccagctcagatgaggaggcgatggtaactaccagggttgtccgccggcgagtgattattcaggtacccactgttaaattactgcacgtcagggacagtcctgtccccatattctaagagtgatcaacctggatcaatgaaggcttggcatgttccttaggtagtgcatggccattcaaaagcagatcccttaactctcataagttctgtttgcaaacaaatgcagtggttccagctttcctccaggagagccaccaagcaagagcaagacttggcttcttcacttccacccacctcacctctcgcttttctatttttgttgaagttttatctaactttggtcagattctcctaagcatgttattacccacttgagtttttcactagttgacaggattttgtatctcagcaatgcttctcaacatcgcctttgattttctaacattcctcacattataagcacttgggagtagttcctcagaattggtgccaaacaccacagtgacccttttctctcaactgtttagggagacgatatgcctgaaatacccccagaaacagtcacagaagaagaatacattgatgagcatggacacaccgtggtaaagaaggtattgtctagtatatcctaacagggttgattacaaacttcctgtttaaaatttatcaattccatggtactgtcacacaaaaataagatacacaaatgaaatacatttcaggttactaggaaaatcattaggcggtatgtatcctctgaaggcacagagaaagaagagattatggtgcagggaatgccacaggaacctgtcaacatcgaggaaggggatggctattccaaagttataaagcgtgttgtattgaagagtgacaccgagcagtcagaggtgagacaacctgattctctaaaacccatttgatggagaggaacaaaatagagctcaagaaagatgagtgagattgtttattcatattttcctcacttctccctttcatgtggcagtttgctcttagttgcacattcacctttttgttttcatgattctatgtgattttaagacagccatcagggagacttgtaggcattatactcattgtttttgtttggtctttttaaaaatatctattctttatttaattcatggttgaccactgcagaaatccaaaagtcaaattttgaaagaatacaattctatttgctgggcaagcagtatgctgtggagacaccgtgtagaaacgcactgtggtgcttgtgcctggttggcacaccagccttcagaaagtcactctagataaatatttgatattcagatttctgcattgcagagttactaaaatcaggatcgagaaactctttgatttatccttgttttttgttttaagacagagtctcactctgtcacccaggctggagagcagtggcgtgatctgagctcactgcaacctccacctccgggttcaagcaattctcctgcttcagcctcccgagtagctgggattacaggcacccaccaccacacctggctaatttttgtatttttagtagaaacagcatttcaccatgttgggcaggctggtctcgaactcctgacctcaaatgatccacccgcctcagcctcccaaagtactaggattacaggcatgagccactgcacctggcaatctatactttaatttatttctgttttacttccctttttcagggacatatttacttgttttgacaaatagtttgtgaaattctattttccattcattcacatcctcaaaattttatattatacacatgagattctctagaaatctacttttcagtttctcatagcttttagagctcctcctttgagggctaatttcatctttgtaataccaaaagaaattatttaaacatgagaaaagagagtttcttcacatattattatgtctgtattacactgagcagtttcttattcacaaaactgataactttttgttcaaatgactaattaagattgctttggtgttgtggagatacagtcatgatgtagatattaccaataggttatagttcgtttttttctaactctgcttcccattgctgttttctggaaagccagtatgtaactttatagttttgtcctttgttttttaacatagaaaaaattcatcatagttacatttggcaatcagacattgtctattgtgtgtccttcgatcattaggtcactttgtgtgagcccagcattttgtccagtacctcacaatttcaggctgagccagtggaaggccgtagagtcagcaaagttgttaaaacaactgtggtacttggagagaggatggagaaacatctgggggattctagtttagccactgatcttccttcagccaaagatgactttgaagaggtatagaagcatcatcatttgtctttttatgtgtgtgttttatgttgctttgcatttgaaaagaaaatcgtttgtcattgtatcattctatacatgaattcatggaaaggtgcagaataattcaagagggtagaactcctgtttgaataacttgcagagtaacgtttccttaaactgtggtgttcattggtgtcaccttaacagcttttaaaaatccaggtaactaggatttgcttctgctgaatcagactcagaatctctggagctggtatatgattatacatcttgtttaaaagtcacagaagtgtcttgctttgtcaattaataagggaaagaaataaagacattgcaaattatatttgctagccagtcttttcaaatataatctgtgatagacattaaagaaaattcagatatattccatgtccataaattttaaaagcatttacaattacttaagttctggtttccaacaattagaaaatgggtccacggttggccaggcacagtggctcacacctgtaatcccagcactttgggaggccgaggcaggcggatcacaaggtcaggagatcgagaccatcctggctaacacggtgaaaccctgtctctactaaaaatacaaaaaattagccaggcgtggtggcgggtgcctgtagtcccagctactcgggaggctgaggcaggagaatggtgtgaacctgggaggcggagcttgcagtgagccgagattgcaccactgccctccagcctgggcaacagagcgagaattcgtctcaaaaaaaaaaaagaaaaaaaagaaaaagaaaatgggtccacagtaacagatccacaaactcttactaaaatccccaaatgctgaaaaccaaaacaaattttgtaagttaatttggaagtgaaacttgaaataaattggcatggagctattatgacatgaagcttttttattctacctagagtgaatgttttagtgacataaaaatgggtttgattacaggatgccatcttcgctctggagtattagtattatatagtacagtcatgcattgcttaacccacttatgccagaggttgccatttttaaaatttttgcatgagtgaaaaatcagaccttggtgatgaccttgagcagtaggatataaataacttccacatgcctagtgttcactaggcataagtgggttttaatgacagggatatgtgctgggaaatgcatcattagacaactttgtcattgtgtgaacattgtagaatgtccttacacaaacctaggtggtatagcctactatacttctaggttatatggtataacctattgctcctggctacaaacctgcacagcatgttactgtgctgaatactgtaggcaattataacacaatggtaagtatttccctatctaaaaatagaaaaggtacagtagataaacaaaataaaagattaaaaatgttctacctgtatagcatacttaccatgtagcttgcaggactggaggttgctctgggagagtcagtgagtgagtggtgagagaatgtgaaagcctaggacgttattatacactacagtagactttataaacactgtacacttaggctatgttacatttgtttaaattttcctttaatttttttaaatcttccttctgcaataataaattaactttagcttactgtaactctttgactttataagcttttacatttattttaacttttgactcttttgtaataacacaagttaagatgcaaacacattgcacaggtgcattaaaaattgtttttcttcatatccttgttctataaacttttttctgcttttaattttttaaatttattatttgtttttactttttaaggtttttttttttttttttttggctaaaaacaaaggcctaagcatgtacattagcctaggcctacacaaggtcagaataatcaatatcactgtcttcctcctccacatattgtcccactggaaggtattcaggagcaataacatatggagttgtcatatcctaagaaaacaatgccttattctgcaatacctcctgaaggacctgcctgaggctccttgataattaactgttttttaataagtaaaagagtacactctaaaatagtgataaaaagtatcacttttataatacttgataatgataataagtgactgttactgatttatgtatttactatacatagtaaatgtatttaccgtacataaaccagtaacatagtcatttattatcattatcaagtattatgtaccctacataattgtatgtgctgtgcttttatatgattggcaccttagtaggtttatttacaccagcatcgccacaaacatctgagtaatacattgcaccatgaagttagaacagctatagcatcactaggtgacaggaattttttagctccattataatcttatgggaccatgtcatatatgcagtccatttttaaccaaaatgtcattatgtagcatgtgactgtatatgcattatattaccttgctaaaatccaaaagggacaaaaaaatctaaattttgaaacacatctggtcccaaagttttgactaagggatcctgggcatgtgcaaacatctacaaagtacttttgctattggaacattttgacactaaatgctgtatgtgtgtcctctactatacccataatatatattgaaattatatatgaattcattggaatattaaaagcaaacctcttaaaatactttcagttttcacattttgacaactggcaatcttgaatggtcaaaaatgaattatctgtgttataccatttgggccttgtttgcttgtttttgcctctggttcttacatttatcattaaaatctccactgtagaaagcagttgggtgaagcaaggaggaaattgaaagtcaatccatatggatgttgcttagcagcttttgtaaagtacaataacaaatctccctcacaaatgagagaaactaaaaggacttgttaaataaaactccaaacttaagtctgcttctaggaattgtatttatttatcgtttcaagtatatcttttcatactgactatgagtaaagcaaagcaatagattgtttgaaagtctatagtttatgatgagctttgtcttttcttttcttcttacttcaggctttgagttacacaggtagccacatgaaagtccacttacccagtttagtagagaatgaaatcctgaaagaggatggatcaataattaaaaggtttgggttagcatggggtgatgctttgccaactaacaccataaaaatttttccaattttaagaaaagaaggggagaatccctacatctaccctaaagaggatagaaaactgcctactctcctgtattataatactttggtcaagtaatggatctattgaagtatcatccctgaagtatcctcttgatacttcaaacataatactaagtcatagcaagaatgagactcacgcttacacagtctgactccctgggttttagcaagccatcaacttagttgaagccagcctgatggtattacattgtgtcgatagattcagagagcataggaagaagaatctaatcgatggatcacagattaattttgtgaccagctatattcagctcaatcttagtaaatcattactttgaatggtatgtgctttcttttaacagctgctttatgattctgcatgtgagtggccaataacataagcatgagtttgatatccatgaaacaaatatacctagcgatgctgaaacctggggctttaatgagttaagcaagtgtcatgaaagcagtaagcagcacatttttacgcttatacaagggggctgactgtgaggcacactggtctgcccaggtctctgttatggatttgatgtataaacttgggcactgttccacagatctactctggcttctcactggtcctctaacagcactgtaagtattgagattaataaaatgtgctcagcttctcggtgaaaagacacaatggaaatccaagttacaattgtgcttctcacttcattgaaaagggagaaagattgtcattcagagtatgctacagaactattttaagcctttagaacataataattagaacagcaaaattaaaggttctgtcacaattccacccaccaatcaaatgggaaaagagcagcagctaggaatttaaaagagtgtaattgctctctcagaacttaaaaaatgctacatgaattaaggataaaatgccttttatactctcaacttttaagtcttttattcaattattcagatgaaaccacataatccacgcatgcactaacatcatgggctcttcaaacaggaatagatttagagatcaattaatccaaagttctcaattacagctggtgaatttgaagccaggaatatagacaactccatagagtttccacagctagttagttatggaagctagttagttacagaactctatttatgatgtacaacatttattttatacattgttaaagatatcatatacatgtgcatattcagaaacacattggcctacatttgcctacacagaatatcacgaaatgtcctataatggaggcttaacccctggcatcaatgctataaaggcttctactagcttttagcagaaatagtcagaaaagtgcctttttgaagaaaaaaaaaatggctgccgcgtatttaggaaaacatcagatttcaatcattggaatcaaatttgaccttttcatcagcaagaacaaatttaagtttgcttccagatgcagaacaattcatatagtattaaaggaaaaaggggagtagaagaacataagggaagaaggaagaaggaaacaaggatgtccaaaaaaaagctgaaagtattttagctgaagtaagttatttttaaaaatcaggatgatcgtaacaaatgcatagaggtattggatgatggcagaacttccaacttctgaacaatgaaaacataaggaaaatgctgggtaaagctacaaaaactgatcatttcctatggcggttttaagtgtagatgcatagtgtatggttatggactcaggctctggaatctttgactcttggtcccactgtgtgctaattctgttattttttgtttggactattgcttaaattctcggagattcaatttctttatttgttatactagtgtctggcccatacaacacattcgtcaaatacttgtggaatgaggacccgcatttggaagtgtatagtgaaaaaggctgctctgcctatggagtagccattttttattcctttgctttcctaataaacttgcttttactttactctaaaaaaaaaaagaagaatatatagtgaaaagaattgagaatgagcaaattacttttaagtacagttacaggaaaatattagtatgacttaaaattaatatgactatacaaaagttatagctcctggcccaatgtggtggctcacacctgtaatcccaacactttgggaggccaaggtggacagatcatctgagctcaggagttcgagaccagcttggccaacatgacaaaaccctgtctctactaaagataccaaaaattagctgggtgtggtggcacacacctgtagtcccagctactcaggaggctgaggccagagaatcgcttgaacccgggaggcagaggttgcagtgagccaagatcgcaccaatgcactccagcctgggtgacagaacgagactccgtctcaagaaaaggtgttatagttccttttctcaagtaaccaccagtcttataagggaggcaagtaaacaacagactgttaaatggcaagaaatacacaaaatgagcaacatatgtgaggcttggagaatccggaggaagcagttgtctctcaatggcttttctcttttccccttcctcccccaccatctccatatgaagccttagagacctgggcagatcttcatcttttgttgggagccaccttcttatatattgatagactaatattttagtttttaaagacatatgcctcataaaaaacttctctgaaaacataattttgggaagtttgggtcagggtatgactgtaaggtttaagctggcagccaaggtgtttcaaataaattaaaaaaaggtttttttagcctgtcaaaaggtacttgtggtactatttcagaattaaccaaactctattaagtaagggctacttaatcaaaccatgaatgattttatggttagtttttgagaagatcaaattaaagcatggtttcatttattttaaatttttcttaaagatttaaaaaatactccttgttccaaaacacattttaaaaaaatctcatgaatcgtttgagagaggggagccatgtttaaaagaaagacacaaaaagatgtctatagtttgttatgctaatagtttgctgtggaaacatctaaaggtaagacattaggtactcagtgtaatggtcaccttcattcctaacagctgccctctggcagtgaaaagagcgtaattctctcttgtctgcttttctccaggacaacaatgagtaaagccatcacacagaagagggctgtggtgaaggaccagcatggaaaacgcattgacttggagcacctggaggatgtaccagaagcactagaccaggacgacctccagcgcgatctccagcagctccttcggcatttctgcaaggaggacttgaagcaagaggccaagtgaggggctgcccagttctcacaccagaaaccacacattcactcaatatgcagcttcctgtttcagtaggggagtgacctaactggcctaattaatgggataccccgacatttccactgttagcaaatatacggcattttgctttagttttcccccatcctctttaactataaagctaatttgtgaccaaagatggcatccttcatactggatgctgtatccaatactttgttgtgtctgtgctaacctgggaactggccacctccattgttctttgcttctgcacaagatccatgaaaatccattgatcagaagaacttcacctgcagacctcttcaagtgacactatgtaggaatccttccaaggaatatctatgtacaatgtatatagctgaaatgctcagatgaacaacatattaaaattaaaaccactgcctattgtaactacactgggcatcagaataaaaggcctctagaaattgctgaacaatggttaattaagatattgctaacacaatcgagtgataatacagttttactgcaaaagaagcacttcaaacctattatgtccttagaacttccagagtagccactgctcccagttaaaggtgggtcagtagccttgcagaactgtcctgagaagttattgctggtgctggccagccatggcttaggactccaacagccactctgagggaggggagaagggagcagaggccacgcagaatgaaccgatggggtattcagttgctggcagctacattgtgtggcattctagcatcttcaggtctttagatcttggacaagttggcagggtattttaaaagctataactactgtagttttccagttttcattgctgctttagcaaaccacgctgtcttacagtggtactttcttctggccactgcactgtagataattcattggaaacaagatttacccactacataaaaggttaaactccttcagtatgttggagtggtttctttttttttttctttctttcttttttttcttcaggtttatatcttctctaatacctgcatgtggcgtttaaaaatcaagaccacggtcaaacccctcttctaatcacattaattgtttccattctttttaccctgagtgagcacttttcactttccagctaggtctgtttttcagcttgcagacaagattgagaaatccttgaaaatttggttttggttaaaatttttggtttatttatttgaaatccacactcccttggaaactcttaagtgcatttgtgcacttctgtttgtttgtctcaaagaagggactgtaacaatctgagtaatttccatgtcctcttccttattcctctagtggttgaagctgtgtagcattttaacatatatatattcacaaatatattcatataaacagtatacattttgaatcagtcatttgttaaagaaaagtatattcaatgaagatgaaatttaaataaaaaaggacagagtctatcctccagggattgaacattttccaattatctggtcttttcctgttgtgcaaaaatgactcattgctccgaatgtcaaaaacaaatgcgacaaacaatggcacttcatcatttaaagtaatgttgccaagagaaaaaatttcctgggagggaggtttcccacaagccaaatctcctaagcctcaaatgctagcactttttggcagttggataggaaatgagacattctttggcagccaaaataagagaggccgatggtgaaactttttgagacaccctatggccttcttgtcaaaaccttcactggagctcaagaaaagcatttctgttgtgttatttgcagtgcagatgatgtctgtgtaacaacataatggttattcacctttttttgattttgatttttgctgtgttatcaaaaacttgaatactgtgagaagaagtgaattttcagttgacgaatcagcatcttgttcccatggtgataacactaattgaatatatctatgagggcatgtattagttaatggaaaaaaaaatacaacactaacaatacatagctgcaatgtgtacaatggctgatttaattaaataaaatgtacaagtgtt

SEQ ID NO: 36286 - DNA, 334016 bp, Homo sapiens; identical to SEQ ID NO: 36285

SEQ ID NO: 36287 - DNA, 14360 bp, Homo sapiens
aggcgctgcggcaggagggaagatggcggacgaggagaagctgccgcccggctgggagaagcgcatgagccgcagctcaggtgccgcgggggtcggggctggggcgggactgcgcgggcccgcgtaagcagggctcgagctcgccccttgggcgcggcggcagcgctgcctccctcccatggggtcctggctcttccgcgtcgtccccggggtaacggccccggcccgccctgttgtggggactgcgagcctcaggagccgccgggaagcctgaggaagctgaggcagggggctgggcgggtgagggtccggggagtccggggcgatggccctggccctgccggcccggctgatacctctcggcctaatgcacctgacaccccgggggacgtctctgcaccttgctgggcccgggggcacccctgggagggagacaccccagtaccctgcaaagggcgtagggtgttgcccggcctcgggtccacaacctacccctgctaacacccctactgtgtacacctaatgctgagtctgcgacatcgcccgtgacattctgccagacgatggcccctgtgcttaggcccgatttaagggttagccacaatgataatattgccagtaacagggcatgtttttctctgtgtcaagcgctttaagttctctctgaattgccgcaactctgggagccaggtagttattacttccaccttaccagcaaggaaactgaggtcagaaaactgaaggaactcgtccaagatcattcatttcaggggccgggggttggattaggacctaggcagtttgcctacaaatccccctccccgtgtcactgcaaactcctgaggagcaggcccagcatctgtgggcaggtcccgagtcactctgctgcctctagagcccatagcaatcgcatttgcaataataattctccttggttgagtgccaggttctggtgaactgtttggatacatggactctcctcattaaccccatgaggtttgatctccttattctctattccccatttttcagatgagaaaactgaggtgcagggagattagagcccattgccaaggttttagagtgagtcagtagctcagctgcatttgcacctggaacccgcgctctcgcccaccctgctctagccctggcctgtggctgggacctccagcataaaccggatgctctgcccagctctgggcccatttctgctgtttctgctcagttcaaccctgatggcttcctttatgggtgacactccatgtcacccaggcgaactgtcagcctttggagtggcacccagtagggtctttacttccagtttcttgttcacagtcttcactccttcatacccctcactccctgggtaacatcgggccaccagtaatgctggttcctagctctgcaacaccatgcacggtgtagtagctaagagcagagctttcgggtgtgaagtacctgagtacagttcctgccttcccctgtgtgtgcctggaacagagtaaacactcaggaagcgttacccactgctgccattcccagagatgcaaaaggtgaggtctccgttttgccatctatacaatagagataataaaggctatcccactcttaatgtgtgccagtttctgtcctaggcattttgtagatgtgtgagcttatttagtgctttcttattattatttttggagatggtctcactgtgtggctcaggctgcagtgcagcctctgcctcccaggcttaagcaatcctcccacctcagcctttcaagtagctgagaccacaggcgtgtaccacccacccatggctaattttttattttttattttttattgtttgtttgtttgttttgagacagaatctcactctgtcacccaggctggagtgcagtggcatgatcttggcgcactgcaacctctgcctcccgggttcaagtgattctcctgcctcagcctcccgagtagctgggattacaggtgcctgccaccacgtctggctaatttttgtatttttagtagagacgaggtttcaccatgttggccaggctggtctcgagctcctaacctcaggtgatccacctgcctcagcctcccaaagtgctgggattacaggcctgagccactgcgcccagccagcctgttgtttttgtttttgttttgagacaagagtctcactctatcgctcaggctggagtgcagtggcatgatcttggctcactgtagcctccaccttccagattcaagcaattctcctgcctcagcctcccgagtagctgggattacagacatacaccacaacgcccggctaatgttggtttgtttgtttgtttgtgacggagttttgctcttgttgcccaggctggagtgcagtggcacaatctcagctcactgcaacctccatctcccgggttcaagcgattctcctgcttcagcctccccagtagctgggattacaggtgcctgccaccatgccgggctaattttttatatttttagtagagatggggtttcactgtgttggccaggctggtcttgaactcctgacctcaggtgatccaccccaccttggcctcccaaagtgctgggattacaggtgagagccaccgtgcttagcccttttaaaaatgtttaaaaattattatttagtcctttcaatgaccctaaggtaggaactgttatctccattttgcaggtgagaacaccaaggcccagggaagatatatcacatttgaacccagattcagatttgaatccaggtggcctggctgctgagtgcatggtttgagtcactccctgtcccccagcttcctctgttccatcactctgggttattttcctccttgaagttatcagggattgatactatcctgtgtttcatttgcttgtttagcacctgtctgctctcacctagaatgttagctctctaagggcagggactgtatcctgccacattggcccacgtctggagagcctgtggcacatggtggatacaccatggatttgttgaatgaaggcgccccctgcaagccaggccctcaccctggcttctggctgtgggcccaggggtgtcctgggagcacaaccctagctgaattcctgcctgccctcccctccaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggtgagcagggcgagggcaggggcttgggagggggtcttctcccaggtgagcctttgtagaagtcacatcagacccttcaccccagcttgctcagctgccaggcgtggtgttggccaacacaaaaacgccagtgcatgacctgaccctgaccttcacagcagccattctctttcttttccatctggcatttgagggtgagccaggtaggggcagaggacccagcctgggggctggcagacatgggttcaggtagtagctgtgcctctgtgaactctgtgacctttgggaggggactcgtgtcacctcccctagactcagctttctctgtaaaatgggcatcctctaaggaccattgtgaaggttcaagggaataaggcaatggattttgcacagtaggccctcagtctgtgggaagtgttgtcaatagtaatatcatccactaggggcctgagtcataaacataggtggatccagagagagcagtcaggaaggtagtgagtgcatgcagggtgcggtggctcacgcctgtaatcccagcactttgggaggccttggagggcagatcacctgaggtcaggagttcaagattagcctgggcagtatggtgaaactccatctctactaaaaatacaaagattagccagatgtgttgacgcatgcctgtaatcccagctactcgggaggctgaggcagggaggcagaggttgcagtgagccgagatcgcaccactccactccagcctgggcagcaaagtgaggcaccatctcaaaaaaaaaaaaaaaaaagaggtagtgagtgccagtagatagtgagttaattctgacctaagggaggaagctattccctgctctgttctgtgtttcctctgcagtctggcaccaaggtggcaaactttaaaggccagatggtaaatattttaggttttgtgggccatgcagtctctatcagctctgctttgtaactggatagcactcataactaatatgtaagcaagcacatggtcatggctgtgtgccaagaaaactttactatttacaaaatctgggaggatttggcctgcaggccatcatttgcagagccctgtctaaagctgtccagtttggctgccactcccaccctgtgcgggaggatcacttgagcccaggagtttgagaccagcttgggcaacatagcaaaaccccgtctctaaaaaaataaaaaaattagctggacatggtggtgcacgcctgtagtgtcagctacttagaagactgaggtgggaggatcctttgagcccaggaggcagaggttgtaatgagccgagatcacactaccgcactccagcctgggtgacagagcaagaccctgtctcaaaaataaataagataatatcaaaaattggtttctcaattgcactggtcatactttagctggtggctgccatctttgacagcgggaatataaaacatttacattcttggccgggcgcggtggctcacgtctgtaattccagcactttgggaggccaaggtgggtggatcacgaagtcaggagatcgagaccatcctggctaacacggtgaaaccctgtctttactgaaaatccaaaaaaattagtctggcatggtggcgggcacctgtagtcccagctactcgggagataggcaggagaatggcatgaacccgggaggtggagcttgcagtgagctgagatcgtgccactgcactccagcctcggcaacagagcgagactccgtctcaaaaaaacaaaaacaaaaacaaaaaaaaacacttttccattcttgcagtaagttgtgtctgatgcctttctcagagtccccaaacctgggctgtccctactccaaacaacccatctctcaaccatgcccagacagcctgggttgctatgcagctctgccacgtcctggctatgtgctcttgagcaagttacttaacatctctgggcttcaatctttttctccttcttcttttgagacagggtcttgctctgtcacccaggctggagtgcagtgttcatagctcactgcagcctcaacctccttgggatcaggtgatcctcccacctcagcctcccaagtagctgggactgcaggctcataacaccacacctggctgatttttgtatttttagtagagacaggacttcaccatgttgcctaggatggtctcaaactcctggcctcaagtgatccttccacctcagcctcccgaagtgttgggatgacaagcatgaaccaccgcccccagctgtcagtctttttcatttataaaattagtattagaataataagacccacttcacagggtagttgtgaggactcctggctaatacagtaaagcgggagtaacagctcctggcatcggtaaatgttctgtcattgttagtggtcactgtcattgctgttgttggttgtggtagcacagggcccagcacagagtgtacactcggtcagtattggctgttgttttactctctcatcacttggtccagttggcctgtaggatgttattacatatgcacacccccaacatggcatctaggacagtaagtgccacccgttagtcttatatgtaagcatggcagagagaagccgagttcttgcacagaatcttgaaggctgattgaagagccagcctcctgacctctgagggcagggactggatctctctctttcccctgtattcccatcctgccacacaaagcctggcccagagtcagccctcacagccttgtttcatgagccagtaggaagcaagaaggattcctggcacaggacggggcagaagtaaaggcctaggactaggatgtagccagaactctggggaaggctttgcagggagctagggggtgatgagacccttcacgggcaggtcccagccaggttgaggagggtccttgtcaggtgaggaggtttggttctttcctggaggcagcaggacatatgtggccatgtgggaccaggagaggaacccacagtgctctgctttcagcagagatctgtgaagctagaatgtcaagggccagggaagtggaaggcccagaaccttcaggggttctggttgccccagagcaagaagaagaagtggagggagaagccaggagagaattgcaagatgacccttcaggtcctcccagctctagtggtctctgttctgaggcttccggaccctataagagtgagcaggagggtgcaggcatttggggatggagcggcatgaagtgggctcctgggggtcagcagagcagccaggcgcaggacagagctgctccaagcaatcctgatgagagctggcagaaggctgaggtcggtggggatagtgaggagggcatgggtctgggtgtggtgggcgagggtgtctcgcccatctctgggttggacaggtgcacctggtaagtagccaggccctgaggcgtcaccgtaggtacctgcagattctggaatgtcagcaggagccttgcctgcccacctggtggaagctgtgggaggaattggagcaagaggcggtgtgacttgaacttgggggctggaagtggaagaagaagtgagagggagcagacccgagagagattcaggaggcaggatagagaggactgggtgatggattaggtgggcaagggtgggatgtctgggggagggtcagggcagaacagcgtggcccaccctgggctcgtacagggctggatttcagtgccagctgtgtggtcttcatttcctgagcctcagttgcctcatctgtagaatggggagagggtggctatgaggatccaggagctatgggctcagtggctggcgtgctctgcacggtggagcctcagccccagtcattggggtgtggacgatgggggagctgaggtcaagtcaaggcctctgctcacgggcagcccctgctgccaccccacagcccgtagaaagagttccggataggaccacaggaggcctggtgggctcagcacacagatgatgaccttggcacacgacctccctctcctggtatcctcctgcctgagacggtgctggggcagatctcctcagaggtcgataggaggatgcagtgaggtggccccggccgaggtacactcggtaacagatcatcatgtgcagtgtcggcgcaggcattgggcacctgggcctcattttctcttccatgaagtggatgttctcccctcgagggttcatgccgggtgatcaggagaccatgatttgggcagctcactccccagctggcagccgggctaaatctcatcagtgcccatttagatctggtgctccgcccttgccccgaagggacaggctgcctgcagagagagccgggacctccacattttctgctgaggctccttttcccagcattggctcctctgcagctgctgggccacagccagaggctgtcagagatccaagggagtcattgccagtgtccttgtctaaggaggatgggccatggagaagccctccctgcccgctctccacccagatctgttgacagccacccctcacatgcccagggcctggagggtcccagcaaggctgagactatgagcagctgtcctactcacatacccatcccagcatccaggtcagcccctttgtcctggggtcctcaaggtcactggcgcccttccagcctgctggccttgggccagcctctagcccctccttctggatcttggtcttctcagatctgaccctgtcacctctttccccgaccaggccccttcccctctggtgcctgggcagcctgggggaagtatgctggaagcagcgtaatgatctggcaaggcagaggagacagcacgtcttgaaacatttttggggtcaaggactaccccatttgttccctcactcccacctaggtcactgatgtgcattagcttggactgttgtaacaaaatatcacagacagtgtggcttaaacaacagtcatcactttccacagttctggaggccagaagtccacaatccaggttccctcagattctgttcctggcgagaacccacttcctggcttgtagacggctgccctctcactgtgcactcacatggcattccccaggcgcatgtgcacggagtgaaggagcacgagctctctggtgtctcttataaggacactaatcctggccaggcgcagtggctcatgcctgtaatcccagcactttgggagactgaggtgggtggatcacctgaggtcaggaattcaagaccagcctggccaacatggtaaaactccatctctactaaaaatactaaaaaaaaagccagatgtagtggcgcacacctgtgatcccagctactcaggaggctgaggcaggaggatcgctggaacctgggaggcagaggtcacagtgagccgagattgtaccactgcactccagcctgggtgacagagccagattctgcctcaaaaaaaaaaggggcgctaatcctgttggatcagggccccacccttatgacctcatttaaccctagttacttccccaaagtccccatctccagatgcagccacactggaggttagggctttaacacatgaatttggggtgacacaaacattgagtccataacggatgggcagcttggatctgtcaggggcctgctctgcaacagccactgcttaagcggtcactgattcactccttggaacaggctccaacgtgggagcagcggttaccccattttacaggccagttgagtgaggctccaagaggtaaagtcacctgccagactctcattgttcaggagcagcagaggtaggatctggacctgatggagtctggagtcagcacccataacatgtcctcctggaccttggggatacactgtgagcaggctggctggggtctgccagcacagataggtgccattctgttttgcatactatttcagggggtcctgaacaccttgaagcaggtggaggcccctgctccagactgggagctcctggagaggccaccctgtgtctgtgtggttctaagctggagccacatcgaatcaggatggggctccagcacccgacagtccccatcaaatttcacaggttttggcgccgtcgggcaaggctgacacattgtcttggaggaggcccaggaagtctggccttagggtcgcagcctgagtttcaggcagatagggcatgagattccagcatttctgcttcgagccccgtggtagatccctgtctccctccttccccatggcctatttctgtctcatttattcattaacttcttgaacattcgtgaacacctgttttgtgcacagtgctgggttctgagggtgcagcaatgaagaaggccaacccagcagcctccattcctgcactgtgaggcgggcaagcaacacaccaatgggacggtagtaaatgcagcacccagggggaggcacctaacacagtgggggattaggggaggcttcttggggagaccagaggatagctgatgagtttcaggcaggacaagaggcttaaaccaaggtctgcgaggtgggagtcggaggatgtcattgtcgcggggtcaggtacaggctgagctaacaagacacacaggaccaaacccctcaaggtcagcctcacagagcaggaactcaggaagaaagcgtttttgtttgtttgtttgtttgtttgtttgtttgtttgaaatggagtttcgctcttgttgcccacgctggagtgcagtggcaacgatctcagctcactgtaccttctacctcccagtttcaagagaaagcgtttttttgtttgtttgtttgtttgtttgtttgtttgaaatggagtttcgctcttgttgcccacgctggagtgcagtggcaacgatctcagctcactgtacctttctacctcccaggttcaagagaaagcgttttaaaaaaaaaaatcattccagctacttgcgaggctgaggcaagaggattgctgcagcccaggggtttgaggccagcctgaacaataaagtgcgaccccatctctgcaaaaggaaaacaaaaacagtcattgcaggctcccatcatagcagaaaattttccaagagagctggcaggtcagaggcagatctgggtgatatgagctattggtgtgccaaagtgtggcttttatttgtttttaagtggtatggcttgcacactatgtgtgtgagagaggacaacttgggcgggctgtccaatttcagggatccctgtggctgtgtccccagccctggccgctgggggctgtggcaaggtgatgcttgttcagggcctgggcctggctcctcagacgctcagtgcctgcaggcagtcctgcttccccgaagtaggtgggtacctctgggggcaccgtgcgatcccctggctggcttagtggtccagacagaaggggggacaggggactccagtgctctgtgcctaaggccaaggagatacctagaagttcagggagaggaggggtgggagggggtcctagcaacatctggtttaagtcggagtcactggtggatgtgtctggcacagaggaggaccccgtggcagccctggaagcggggcattctgatcaaaccagggcatcacgggcagaagcctctgtaatgtgccatcccaacagaagctggggccctgtatggcatcgatgtccctgtcagaccaggacacgtgggccggcagggccaaggatagggagagcagagcagtagaggctgcgtcatccctgggatgcagtccccatggaggggaagaatgatgacagcaagggacgttggtcagggtcctgctcggtgccgggcactatgctgcatgtcacagccactggcacaagactgtcaggcggaggggcacagggatgtcagggcagcaggtcgtggtgacatccagctcagataccaggacactggtggctgccatgacgtgcagccaaacagggagctatggctgtgctctcacggtggtaccatttccactgcagtcccaagcaggttagagcgtgaggccgaggggccctggggacacttggatcagtccagtgtgttcagcaggtgccacggttgggtgtccaggcctcccagcactggctaggtcacccagcagtgttcccgtgggtctccaacaggctccaggccagtgtatcagctatgtatgtcctgggcaagttggccggcaggtgtgtcatggcatcatttaggtcagaaggagcaagggtagaagtgtcagggtgacattaagaaaccccctactgagtgtgtcagggtgaccttcacgttggagagaagaactggtgtccctggagagtggctgccaggccttagggtacacggggcgggtgcagttcacccagagggctgccctggcttgctggggctgtcgcaccactggcctagggaggacactggaagggacgcccgtttgtgtcagagcaagaggattggggtagggcaggctttggcccatgggcaccttcctgggggtggcctggagtcaggaaggcggtagccattcctcctgacctggcacgtgcacaagactgcatacacacacttgctcacacacagtcacaccacacacaccacgtgcacacacacgcagccctccccacttggcttccgaaacgtgagtcactcagatgctactctgctgccgtcttgccccctctgctggcagccctgttcctcctaactccaccagccctggcctcctccgcctcctggagagtcagagccgatgggctagtttgggccacacagggtggggccaccctgagttctgccagcatgcagactgtaggtggggagccgggagaagagctatgttgcctgcctctgggaccctggggctacagcccacgagtgtcccttgcagagcccaccagggtgccttggaggcccatcccagtgccaggctgttcttcccagatgggacagctggggccacaggctgccgtggcagtgctgggctttctctggacagctctcccacctctgcccagggggcccggggggccagccccctgcctgggtcagcctctccctgcctgctgctctcctctggcccatccagcttgtatgtagattttccctcacgtgtgtgtgtgtgtgtgcatgtgtgtgtgctggtgagagtgacagcgggagcagggatgtgagacctgcagggtggcagggctcatggatgactggcggggtgcattaagtgctcatgctcgtgaaaggcacctcttcttgggtgtgggtgaggacaggtgtgactgcgcatgcaggtatgtgtgaggagaggggttgtggggagcatgtgcgcctgtgaggggaggctttccaactgaagtgctgcctcccccgctggccagctctggagtcctccatcctgtctggtcaggccccccccaacccctgacctggcactcccattccgttccatgtccacaggctacatccagaagatcaagtcgggagaggaggactttgagtctctggcctcacagttcagcgactgcagctcagccaaggccaggggagacctgggtgccttcagcagaggtgcgcaaggaatgggcctcaccaggttgggggacccttaccaccctgaggggtagaggccaggagggtctgggcattgggctcccaggtgccacaccggccttcggggtccagcaggtggcagcacagccccttcctcaggcttcagaggctgctctgctgggcagggccagggccacacagggaggggggctgcagcactttcttcctggcatcatctctaccctggggggcatggtctcttgtgtgtctgtgcacagatgtcctcatcccaggcccaccaaggtgggtacatcctgtcctctgcctcttcctttttgtggtttaaggttgagggccctgagagtcccagggcctgtcccccagaatccctctcaaaggtggggaaaccaggggtgagaggaggtggccctgagtttaggcctgtctggccaggacagtggaaatcagggacagaggggactaggcctcctcctcttcctcctcttcagtcctcggggtctacagaaaaacatcagggagaggccaggatgggttgcagggtgtggtgtgcaggtgtcttagtggggtggggcggcagcatggggccagcagctgcccacctcctccgaggaggctggtgggacagatgacatggcagggctgggaaccaggcccagggagacgagttcactaccgaagtggcccctaaatgcacggcggcggccgtagccctgcctgctatccttcatgctgtcctcgggcttcccagggcctccttaatggccctgccacccccagctgggccgccgctcagcactggcaataaacatggtgacggatgagtgtggacgagtgtgaggctcagcgcaggcaggagccccatctgtcgcggctgccacccgccctgcctcatcctggcctctgccagcccagccctgacacccccaccgcccctcctggctcccaggtcagatgcagaagccatttgaagacgcctcgtttgcgctgcggacgggggagatgagcgggcccgtgttcacggattccggcatccacatcatcctccgcactgagtgagggtggggagcccaggcctggcctcggggcagggcagggcggctaggccggccagctcccccttgcccgccagccagtggccgaaccccccactccctgccaccgtcacacagtatttattgttcccacaatggctgggagggggcccttccagattgggggccctggggtccccactccctgtccatccccagttggggctgcgaccgccagattctcccttaaggaattgacttcagcaggggtgggaggctcccagacccagggcagtgtggtgggaggggtgttccaaagagaaggcctggtcagcagagccgccccgtgtccccccaggtgctggaggcagactcgagggccgaattgtttctagttaggccacgctcctctgttcagtcgcaaaggtgaacactcatgcggcccagccatgggccctctgagcaactgtgcagcaccctttcacccccaattaaacccagaaccact

SEQ ID NO: 36288 - DNA, 8459 bp, Homo sapiens
gatcccggtgccagggaccctgcccagttccaggcgtcgccctgacccagaaacgactgggcgccgccgtcctggaaaggccccagcgcacggacatctgagggttcgttcagagctctgtttctcggcgctgcatggtggcggaagggagggagcgaatgggatcccctaaaagggatcttagagtttcacccagtgggatgtgacacttgcaggtgtcccaaactggtgggaaccttgactggaaggctggggttaaggatgaactttctgccgtccagactgtcccctgcagagcagctgctgccagacagcgggagctgccagacagcgggagctcccacttcgtgcacaggatgggggcagggagcccgcagccgcgggaggcaggaatgactgtccgggaacctcctttcttctccctgaatcccagccctggcatctcaccagggggcacagtgatggtccagggctgggcccgggactctagctgaatctttcagagtatcccatccctctggccagtggcccaagcgagtgaaccagaatgcttccttgggagttttgaaactggaactggagagaggagctccctatggggaggtaaacgggagctggggccacctgtagtgacatttcctgagttcgaggagtagacgagactgagagagaaaagctgactcagagaaagggagtgataacagggcatgctggcccacacctgcaatcccagttactctcacgggatctgtttctctgatgtctgggtatgaaaggactttctaagcctcagaacagtgggagaactcaacaaagaaaaaaccaatacatatacaaggttactttgtggaggaaaaaatggattaaccttaagcaaaaaactgggaaggatctcggtaaaagatacgtcagaaggaagtaatgtcctttaagatgttcttagaaacccatcagacaggtggggtgtggtggttcacgcctgtaatccctgtactttgggaggcagagatgggcggatcagttgaggtcaggagtttgagaccagcctgggcaacacggtgaagccccgtctctactaaaaatacaaaaattagctgggtgcggtggcacactcgggaggctgagacaggagaatcacttgaaccttggaggcagaggtttcagtgagctgagatcataccactgcactccagccgggccactgagcgagactgtctcaaaacaaacaaacgaacaaacaaaaagaagagaaactcatcagacgaagacacaggaaaaaaatgagcgaaggaaatcagcagaggtttcattgaaggacaaagagaaatggtcaatacatggatgaaaacatgtttaacttcagtaataatcaaggaagcacacaccaacacaacatgcacatactgtttttatttatcaaaggcacacatatttttgaaatgagtactcctaattaatatgtacagagcacttacccagtgcccagcacaggggtggcaccctgtgtgtgagacagcatgaaacaggtagacacgcgccctgctgaaagtaagggaccgcctctctggaggatccatcgggcaataaggaggtttccacaccttaactgtgtctgccttgacctctggggcctgggagcagagccccctccagctggtggggaaggaagcgtggtgtgtttgaggacagaatggagagaagttgagtagagcaagtgtagactcttcctatccaaagtgtggtcaatggactgggagtatcagcatcaccagggagcttgttggaaatgcagaggctcaggccccactctgaccttactgattgggagcataaactgtaaccagattccagggaggattcatacacacattcccgtttgataagtggggggtagtaggaggtgaggtgaaaagtggggaggggatggctaccgcactggagaaggctggctttgtgttgaggcctttctcatgagggcagtggggagccatggaaggctttatgcaagagagggtacgggcagattgagattacagaaggatcccactggttgccttgtgtgaggacccagggagaagggggaggctgtccctgtttgagtaggagatgagagctactggtggctatgagtggaaagaagtgagcagaggtgagcagaaatcccaaggactggtgatgataggatgatggtgggaaccaggatgggctttgggcagaccctgacccctctctctgcctgtcggcccaccagataataatccctgtgttcctgggcgagtcagtgccacccgagatgttggcggccactttggctgagctggacggatgcctgcagctgctcgaggacaagttcctgcgggaccaggccttccttactgggccccgtatctctgtggctggcttggtggcaatcacggagctgaggcatgagagtgccatggggtgcggtggcccgctgggcagtggtgtatccgggaagggagctgacatcccagctcatgttgtcttttctggctgtgggaccctgtgtgagtcacttctccttctgagcctcagtgtcctcatctataaaatggggctttacaaacccctcaccgcagctatattaagaggcttccaagtgtccccagggagggggacatcctagcccatcacacacatggtggaggagggaaaatccaatcagagaacccctaaagcaggtcatgctgccttacacttggctatgcccagcccctccgctgactctgtcttcccctagcccatcagtgctggctgctgagtctttgaaagcggacccacggtggcagcatggtgcccaacacgtggaggctgcagtgcgggaggacctcttccaggaggccctcccagctgtcctgaaggccaaggacctgcctccagtagaacctgctgttaaagagaatctgaagaccttaatgcagcttttcttgctgtgagtgcgtgtcccacacttgctgagccactgaggggatgctgtgttggtagaataaagacatggagctgtccgtctccttggttgaagagaagacatatctgcaaaggctctggtccacagttcctccagatatcatgcctgcattccttttgtctcctaccccattccattctagcttccatgtgacctctgaaaagagcttgggcaaacgcttacttgaccctgaccttctgtgtggaactttgtatggttcctcactgcccagaagctaaagtacaagtcattgaactttgcattcaaggccttgctcccactcctccaggtggccccttctgcctgcacactcctaacccctctctgggctcccaccttggcctcttggcctccgctcatgctgttccctcctcatcttcgcctggtgcccttcctggtcttttggcatttggcaccctgtctcttctccagggagacttccctgacctccccagccccagtccaggtcaggcgacctctctgggctcctcagccccagtgtttccttgcgggggatacccccggactgagcatgtatcatcgatgaggggtgacctggtggaaagatgtctgaatcaggatcagccttggtctcctcggtctctctcctcactgtggggcgatgttgtgttccacaagtggggtgcagggctggttcatgaacctccttgcaggaagggaagtccctggttatttcctggccctctcccatgcctcctcataaccttgaccacagtcttctctacaccccactcccggaccactggcttgtccatgccccacacctggtcccagacttgccacctgtccctgccctctccccttaggactgtcatatttacctgtcgtgtgtctcagaccttctgatatctgagtcatctaataaacaaactgctaataggacaagatcatgacagacagagactctgtcggcctttcagtggaggctcctttaagtatgcacacttatagagaattttatacacgtagttgaaattgtacatataaacttgcaaattttttctttcttttttgtgggggaggggggagcctgggtctcactctgtcatctagggtggagtgcagtggcacagtcatagctccctgcagcctagatctcctgcgctcaagcaatcctcctgcctcagccgcccaggtagctaggactacaggcacacaccacagcacccagatttctttcttttttttttttttttttgtagaaaataaagaagagaatcttgctatgttgcctagcctgatctttaactcctgggctcaagcaatcctcccttcttagcctcccaaagtgctgagattacaggtgtgagccacattgctcgaccacaacttcagtcatatttgtaatgtacaattcaagtgattttgccacactgaccacactcatgtttaagccacgccaacagagttccatgttttctgatgttttttcgagatggagtctcgctctgtcacccaggctggagtgcaatggcgcgatctcggctcactgcaacctccacctccccggttcaagcgattctcctgcctcagcctcccgagcagctgggattacaacgtctgccaccacgcccggctaatttttgtatctttagtagagacggggtttcgtcatgttggccaggctggtctcaaactcctgacctcaggtgatccgcccgcctggacctcgcaaagtgctgggattacaggcgtgagctaccgtgcccggcctttccatgttttaaagaacatattttgccaccccctggtggacagtggctcaccaccggcacaagaggctacacaggcagatgtcaatggggaccaggcagggacaggtattgtcgtgagcctagccctacccgcgcccccgcgagtaaccacatctcctgactgcccaagcgcagatttccatactgaacatgaaattgcctgacttcgaaatggtggcaaatcattcaaaaaaactttaagctcccgttgtattggttattagggtcgagcctggggaagacccctataggtgtgtgtgtgtccttgtgtgtcgggggtgtggtgttcagacctctaatagggctaggaaccgggcgaccacagcgcggaagcttgagagggaaacccacctggcgccaggcaggagggtcgggggagacagggtgggtccactaccgggttaaagacctgtagtgggtggggctacacgtagggcggagacgatgggacttccggaaatcagccggcacacgtgacttttgtttgcagaagcgggaggtaccctaggcagccaatcggggagcgccgagtctctgtccagccaatgagaagccaggttgctgtggcgcctcgcccctcctccctggtccgcgagccttgggtacccccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggacgtaagcgtgggccgggcagcacggggcgaggggaggttggtgggccaggggtccggccctgtccctgctccgcctccccgacagtgaccccgaatcttttccccagggaccactccccactcctttcctcacgccaagctctgactttccgtgctccacgatcccgcggctccccctccgcacgtctttcccttgtcgccctccccagtcatgacccgggcgtgaccttcagggaccgcggcccgtatcgggatccctgccccgcgaacactgcgcgtttcggctttcgcgcgctcgggtcccgtccccagaggtagcccggccggctccaacttcgggcaaaacttttcatgtccccctcagcgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggtgcgtaggggtagtaggggatccatgtgggactgccgcagactggagccactgatcctgcctcagggggaaaaacccatttcttgccctgcccagtaaggacacatcagggtctggagctttggggccccctgaccccttaggttcctgctgttaggaccatcttcaaagtgcgagcaggattgaatgaatttctggctctgctcctcagtgtgtaagtctgtgaaccgggaaggctctcttttaacacccccggggcagtgcaagggtcatgtgggattgtctgtgtgctgtacctgccttggcacctgacagggtaggtacacgtggctgaagtgtgattttctagaacttttccaggctggtcagaaggaattctgggtatgttctgaagttacgtattttggacctgtgtcccagccaggttccaggtgaagttcacgggagactcacagagtagtgaaagaccattggcctggatgtctagacatctgctttctgggtcctgcatagctgggggaccccagacaaacttggaaatgaaccatctccagttggcaacctcctcttctgtgaatacaggggaaaagacctccctcccccacaagaagcgtctgcaacccaaacctggcgttctgtgaccgagttaaagtttcctcttgggtaaaagatattcttgagccacatccatgtctaggaggaagtaagggcatgagaagcttgaaaggacactgtccaggcacggtggctcatgcctgtaatcccagcactttgggagaccaaggcgggaggttcatttgacccaggagttgtagaccagtctgggtaacatagtgagatgccatcccccaaaacagttttaaaaattaaccggacatggtggtgtgcacatgtagtctcacttagttggcaggctgaagtgggaggatggtttcagcccaggaggttgaggctgcagtgagctatgattgcgcattgcactccatcctgtgtgacagtgagaccttggctcacaaaaaaagaccttctgaaatggagcctttgttagtccatgaaggtcgatgaggaatggctgatcctgctgggtcctccctcaagctacagaggaataatacagtcagccccctgtatcactgggttacgcatctgttgattcaaacaaccatggattgaaatattagaggaaaaaaaattgataattgcatctatactgaaaatacgtatagactttattccttgtcattattccctaaacaatacaactatttacatagtacgtacattatattaggtattataagtaacccagagattatttaaagtatatgagaggatgtgtgtaggttacatgcaaatattacaccattttatgtaagggacttgagcaaatgtagattctggtttcctctggggattctagaacaaatctcccacggatactcagggaaaactgttactctaacaacaagtgttatacacttaccatgtgctaggtcctctacaggtactttacactcatgatcccatttgatccttacaatccctatccactctccctttgctcagacaagacatgctatccccatgaggtagataatctccattatgccaattttatgatgagaagacaggctgttcatactcccgcccgccccaaccaggctgtcccaagttctggttttcctcactggaaacttgctgttacctctgagaggggcatgttcacttatggcccagacattagtggcggggttggtggggtggggggtcaccctgtgctcagcctttgagaaaacaggtggctgaggtactgtgcccttagggagcctgcaattaggaggcagggtacccctcagtacacaaactgatggagatgatagagtgtacggcacacacaccgaggctactgtattgtgtgtctgtcctagctgggtcatgatgtgcggctacctcccacacctgagtgtcccactgccctgctgggggttggggaaaatcattattgggatgagcaggtttgcaaaatgcctggtggactgaggcaggctgtcctgagtacccacagtgggagtacctggcaggggtcttgcaagatgtggtattagccaaggagctgatgatatctttttctctgtctcctgaaggatacttatccgctttttccccttggagtcctggcagattggcaagatagggacggtcatgacttttttatgattgggcacggagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcctcattca

SEQ ID NO: 36289 - DNA, 59258 bp, Homo sapiens
cgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggtgagcgagccggagccccagcagccgcggagtcccagccgccgcggagccccggccacctgtccccctatcctccgaccccggggcctggtccttcgccaggatctggtgctgtcacctctagaggagcgctttcgaggggcttcgaggtccccaggctgcgttccccggcgctctgggtgccctcttaggtttgcgtcctctgtctccccacacccggccggggcaggacagggccccgctttgcaccttcgtggctcggctgcacagcagtggccggccctgctccaggctcttctcaggcgcgcgctccaggctaccccgctttggaggccaagggccgggaggctgggaggccaggtggtgaccctcagctctccaggcccatgcaggcaacctaggctgggccggcgctcggggcgagagggagtatgtccctctgcccctggggacactattcccccggactcccaaggctgcttctcgaaccggcacccacagttccttccttcccactgcttctccactttcgttctccgtgggccgaaggagggattgggtttcctttcccgagaggtgcctgcggcctggaagctcccgcccagcccggccccaccgggagcccagggctacgcaccccgcaaggaggtgccctcgccccagcaggggcttagcgtttccggcggccggggagcgggtggcggcactggctttgggagcccacggccgggtggggagctggcctggaggaggcgcgtggaaggcgccacaggaaacccgacccctcctcgcggagagctggaatgggggatggagccggggcctcccagggtgcccagagcgtgcaggaaatgcagagattgaggggcgggggtctgcacccggtcagttgtctatcccaagccacctctggtttattgaattggatcacgccagctgctgacgccacttcccctgacgactccaactctgaaatctgagattgcagaatctgtgtttctgccagggtggccccccagtgccccgcggccaggcctgccccctctcccacccgctgcgcggccgccgggtggaggcgcagggacaggccggccttcccctgccaggcctggtggctgtttataaacaatgacttttgcttctgagacccgcgggctccctaaggatgcaaccacgtgattgctgggggatgggggagaggggggcgcctagagcttccccatacctccctcagagtcctactgctcatccctgtgtttcctggctaaggaggtgggtgggtgtgcattgaaggaagggccctcagccaagtccaggtttgcccagacccagctccccaaccccccaccccagggaaggaggaggaggaggaggaggaggaggaggaggagggattaaagccccaggaatagctggctgggggctgggaagacttcaggttgtggggtgggggggtggcagcacagatgcagccacccctgctccgggctgccatgactgggtaatccatctgtgtgcctggagcaggcagccctgggccagagcctgcttccttccctaaagggccagggagatgaatgggaagggaggttagctgagctgtgttccctgcccccttcccactggtgtcccaccccttcctggctccccaaggctcttggtgtgtctcctttgccctggttgtcttttctctgcagcagcatctttgatgtcattctcggggcagtaggcaagggctgtgtcccctccaaggaggtggtgatgtatcactgagctcctgagacaccatccctctctcttgagcccctgttctgtggccacgggcagttggctgacagttggtcagctaggcatgctggtcttggccaacagctgaccttgcccatgccgggcttcctgggactggagttgtttagtgttccagctgctctctgcctgccggagactagttagggaccctccccccatcagaaaccaaggcagcatgaccatcatgacaggcatccaggccaggtctctgaaagtagccttcccctccctttgggttgcaggccctgctcgcaggaagccccatgcctcaacccacagcagcctctgctgtgtgccttcctgtagagtctgtgccatcattggagggtcatcctcagtgtcttctgttggtgatcagtgccgcctctaactcccactgtcaatgaaactggaatcctagtctcttacaggcagccccaccactatacctaccttgccttggtgaaatcagtgggtaatagggcaattccagtttccctgtggctacaggaaggcgtttcctgagcaaggatggcaggagctgtgctgggaggctgggagagtcctggcgtcctggcgtaggaagaagggcccgtatcttgcatccacccttcacccccggccttcccacatccacttccagcccaaacaaacatccagactgtgagggtgacagtgtggtcaagggcagcctgcactcttgtagggtccccaagccagctcttttttgactgttgttacctgttgacccttctgcctccaccactggtctggctgatccctgagggcacggcagggcacatccaggtgtgtgcattgaggatgttacctggccccagtcggtgcttagtgaatgtttttgaacaagggatttgggcctgacgcaggctgatggtggattgatttgtgttgtttgttctctgccatcactcattcatcaaatcctgcctggacacaggcccagtgcctcctgggctgagtccccgatgctgtctcaggcagggtgcatgtgtctggcctgtctggagctttttcttgaaggtcccatggcctgtggccttggtgtgaggagggtatgagaataaattggaagggttgccagggcctccagcatggcaccattgctcctggccccctggccactgcccccggaatgcgtggggtgcactgtgtgtgctgggagcttgagcctgtgggcgccgtgaggtcatcttcccattgcgtttggcttgtcgaaccctctataaatgattgtgtccatttttgggcctcagaagagtggctaggcaaagccagtgtagggtggagcctgggtcagatgacggggaggattagaggttggcaggctgggcccctcgcgggatggggcgcctggggagaaggacagctgagggggtggggatctggcctgctggcccctgaaggcccacggcttgggagtcctcatggagccggcctgacggagctgggcctttctctgaccacgctgggctgacagtgagcacaggaggaaggctctggcagggtgggagtgtgcatgctgtccctccctcccggcaggtcctgagcatgctggaggggtgcaggctggatagtggggagggccagctgggcagagggagggcccagggttgtcagtgcccagcacagcgctgacatgccgagaagaggctcgctaaaggaaggtgcagtggtggcgattcctagagccttgatgcatggccatgaattgcactatgctcagctgcgtggtcaaggtctcctcacgcagtagccaccttagcctcctccggaggagccaggcctgtacaccaagcgttatatttgcagcaacctcagaagcagcaatgctacacctgagagtgggtgcatggtccctgtaatagaaaggacaatgggggcataggcaggcccagccacctgcccaagtcacccaggccctcagtgatggcactgggagcccacccagaggccctggtctcctcaccttggccactgactttgcaggggtcccgcccccttcccaggccctagcacaaagatgcccccctctacccacattcccatctctgtccatcttggggcccatctctgtccttctgtccttgaatgtctgaggttcttccctgccggctactgtcttgtctttttctctgtctctgtctgtacctccctgctctgggcctcttccctctgaacctgttcaggctcttcctgtatctctccagtctcagcttcccctggacccgagttacttatgtagatggttcatctcaccctgcagggaaggcttctgagctgggcatcttctgtgggtgggcccaggtgtgtgtgggttcttgggtgttcggtaaaggcgtgtgggcatgggaggttggaagcatggcttccagacttccccaatcccccaggggccctggatggcctgagtacagccttctggctcatgcagggaccaagccaggcacaggctacttgtccaggcacagcctacttgggaggctgcatggggcatggggaaggagaaggcattccaggaggtgcaggcatggtccaaggtgtggagagaggtgtgaggacattgaggatgccagctctctgaagagaaggggtgcctgggtggtagattccctccatatttcatgaagttgtgaaggccaggaagatctatggatcgcaaggattcttggagaagctgaggcttgaactctctgcgccctcttcaagatcaccacatcggggctcccttctcactggcatctgaccaggtccttgtccctggactcagcgtccagcccagctggtcccttacaagctgtgtgactgtccctgaggttctagaatccctgagtcctacccttggaggtaggccctctgtcctcatatctctgtaaggaacagcatgcacaggcgtgcacaggctctgggtttccctgacatgctgcggacccttcctgagccctgtttcttcatgtatcaaatagggaataagaacagttcctcttcacacatgtgttgtgggaagtaaagccccaggcaggtgcttggggcatagcaagtgctcattgaatgccagctctgtggcagagcggcaccttgagcccacatgtggcaccttcttcctgcatggccccgcttcctagcccctgtccccagagtgtccattacaggcctctatagacagctaatccctcctgagcctggggttgatcaggcttatgacgttcacagacccggggcagtgagtgtatgtgcatgcatgtgtgtgggtgcagtgtacaggggtggagggtttgggcttgggaatcagagagctttagagtgaatcttgactactcccaccataaactataagtttttttctgtctctgggcttaacttttcaccactggcatatgatgaagtttgtgtgttcattcctttattcatgcaacaaatattgagcaccaccatatactgggcactgttctagggagtggggacccaggagtcagcagaaccaagcccctgctctcctggagctgacattctcaccaggggagatggtgaagaaaccaccaagtatagtggcaggtgcttagaggggtggtgaggcagggactcacctgccctcaggactttctgcatgtgtcccgtgcgggaggagtgtgctaggttgaggattgagatgtggacgtgactgtgggagctcacacagcaagtggattgggtggagagagtcaggtgggcagctcccgtcccaggtgaggggcacccacgggaggatggcttccttttggatgccaccctggtttgttgtgttttcctaaagctgcctgtttggcaagcctccttttaggattaagagtgcagatgtgcagcctcgctgggtgtttgtgcagggcaggtgggcaggggtacctgtccaggatggaggatgggggaggcaggaggggctgctaaaggagaggaggagggtgtcaaagatggcctctgctgcccagggccacttgtaagattctcatgccaggcagcaactctgggtgcggtagaaagctctagacagctgagtttgagtctatccccaccccccgcacattcctacccttgggcaagtctcactgaattcttggaatcccggtttcctcatctgaaacaggggtcatgatctctgccgctggggctgtggtgaagacgaaatcgaaatgtgctggagaggctgcccactcaggtggggctccaggttctgctcctgcggagaccactggagggactcagcctactgctgttcttgtgctgtggaagaggcccagcacccgggcttctgagaggctgccacctcctaaagaggccgcagggttgtggacctgccaagggctgacaggggtcagggctggggagccgaggagagaaaggcaggctcttcctgctacagggaagcccttgtcaaatattaacttaaacataatggcattgtttcctgcatactggctgcatgccatcatcactgtggacaggtgagagtattatacgtcccatccacaaaggaagaaactgaagctggagtggttgtgtgactccccagtgggccgtctgggcttctacctcccttgtggtcagtaggatcagtagtggggtctggcctggggcaaggccttggagacaagcaaatgagatggaggcgtccagcggactccctgcataaagccctgatggtgaaggagtgtcattgtgacagactttggtccccaagaccctcccaagacttggggcccctgtcggacccccagctccacctggggtctaggcttgcactttggagtgtgtggtagactctggggtgatgggaacacctggggtttctaggtgcaagtccagagatgggggttcatgcacgcaaatgaggacagacaggaccctgtgctgtgtgttttttcccaaatagtaaaagttgtctccagtttattccagtctaaaagaacactcttggccgggtgcggtggctcatgcctgtaatccccagcactttgggaggccgagacgggtggatcccctgaagtcagcagttctagaccacagctggccaacatggtgaaaccccgtctctactaaaaatacaaaaattagcctggcgtggtggcggcgcttgtaatcccagctactcgggaggctgaggcagtagaatcgcttgaacctgcaaggcggaggttgcagtgagctgagatcacaccactgcactccggcctgggcgacagagcgagactccgtctcaaaaaaaaaaggccaggcgcagtggctcacgcctgtaaccccagcactttgggaggccgaggcgggcggatcacgaggtcaagagatcgagaccatcctggccaacatggtgaacccccgtctctactaaaaatacaaaaattagctgggtgtagtggcatgcgcctgtaatcccagctacttgggaggctgaggcaggagaatcgcttgaacccgggaggcggcggttgcagtgagcccagatcgtgtcactgcactccagcctggtgacagagtgagactctgtctcaacaaataaataaataagtaaataaaaataaagtttacgtccctctaattttgtttctgttactgctacagtatttctttaatgagatgatggtcatactagttgttttttaatgttcctgggggggaaagaaccatgctgccgacactgcccccgctaccacacacacacacacacacacatgcaccctgggaagacttcctggggggaatcccatactctgggcactttgctttgcttcctgacccaggcaggcccatgtgtctctggtccctgtggtcaccaaggcatctcatcccctcagcttggctcacagtaggtgcatacttgttgcacatgtggctgcatggattctttaggcagtggggagacagcactgatggctggcagaggccctggaggctccctgggtttgagggtgcagggtgggagcgggagggatgctgtgtctgcaggatttaggttggggctaggctagtgggtgcagatcccaccctgccccggccaccctggagggacccaggatcgctcctcatcacactcccccgtgataaagcagccgtggtcagctgctcagggctgtggtggggcctaacctgagctggtggctgtaatgcttggtgcccacaaatggggttcttgtgattggcccaggcccagccgaggagtcctgcctgattttaggccagatgccaaatagggcttggcctcggtcctctgcaggggcctgtcctataagagaaagctttcaggtgacagcagtactgggcagtgctggctgggggttcagtgtgatttgctggacccagacatcactgtgagagctgctgcccttggacacattttgctggctttttgcaaagcctcttccctctgcttcccgggcctgcaccttcggcccccgttgtgacctagatcccaagtgcgacagcaggtggggtgggattggggtcacagcaacagcatggggcgtgggggtggggtggttgggccttggagcctggggccacagtggccttggggcactgaggactgtcctgtggtgcccctgggagtgggcattcatgactccatactatgcccagcccccactgctgcctccagtctgcagacatctcccctctgctgtgtgaaggccgcagtgtctggtggctgagcccggattgttacggggagtgagtgggtggctgcagcagccgccacaggactgggttgggggcgggggaaggatttatcactaccagggtctgtggagctcaggccttccgttccctgcaggcctccccatcctcagagcccctggggcatccccgctggctcctgaaatatggtccttgttttgtgggtcaacttcttactctgaatgaagtcccccgaggagcctgcagatcacctgggtagaggcagcgatggcttcgcatttacaccctaagtcattctgtcatctgtgacctgcccactgtgggtgcctgctctcaggagctcccagccttgcacacagcactcatcccaggactgtgggttggggagggcactggagcctgaggggctttccctcaggccccagcagtcagggaagcctcctcagaacctgagccaagttcagagggcaaaggaggcaggtggtagtgtggggagagatgcttggatggcagcgggaacagtgcttgtcagggcccattcagggcctgagtttgaggagatgggcagaggctgggcctgggctgtagcccagggcccttgggtgaggcgggccctgccctgggctcttcagcttccctccccacgtgttgcctgaacctttcttctgtctcctggtctggcctcagccaaggactgtatcttaattgtcctgggttgcgggtgaggggatgagcctggagtctccagaaggagtggcctgggccagattagaatccagccatgcccagggtctggggcagggcttgggcctggagtccacccctgttagggctggggacacaggggccaggtgacacctgtcgctggaagggcaggtggaaaacatcctgtacctgccctgtcccatgcatgcctgcttctccacctgctgcacagcccagggtgacaccaggagggctgacgctgctgggcctggaggggtgacgctgctgggcctggagggctgacgctgctgggcctggaggagtgacgctgctgggcctggaggggtgacgctcctgggcctggagggatgacactgctgggcctggagggctgacgctgctgggcctggagagctggcggctgggaggtctatcagtggatccgctcaccctttttagggcgcccctgtatgcacggccctgtgtggccaggccgttgactgggatggccataggggtccttttgttgcagagctgggtcagagctagggaggggcctcagaggagtggtcctgccagctgtggggacccctggctccaggacagacccccgagtggggagtgggcacggtaacgtgaataatgcctcagtctctgttgtgtggatggagatgggggcagtgtctggcagcgaggggtttccaccaggcctgtggctggagaagctttgttggaaccacagggctggcaggagtgggtgccaggagagcctttgccagcccagcccttttttccaacagctgctgctactttctttggacctttgctcagctcaccatctctctggggctgaggccaagatgcctgagtccagggcaagcaggggcccttctggcacagagaggcctgggtgggaaagaccccttgagggtctttggcctcctatccatttggcccatggcagctccccttttttctctggcctgaagtggtatgagctgtctaattatgtgtcaggggccagatgcaggtgatggggtggatggagctcggagctggaccctgggaccacaggcagatgggcaaagggaggggagacaccgaatgagagaaaggggaagaggaaagttaggacatagggaggaaggaattcatccccttggggctgctcccccgctgtgtggcgctgggcaagtcacttgcctatggcttgttggagggtctgggaggatgtgtgagggaagcacgcagctctgccctccctggtgggtgatgcaaacgctctttcccagggagcatctcatgacagcccacgggcgtcattctggctttcgtgttttgagtttgttgtctgtgcttatgacaggtttcttgaaagtgaacttcagtgagcttccctgccattctctccccaccacctgtagaggctgaaaaagctaaattgggagctgatggtctcaccttcccaggacagaagtcagctctcctttgacttagaccctgatagaatggggaggagagggcgaaagattgcaggtggggccgaggctggagggggccagatgaggggcacagggctgggggtggaggtgagggtctggcatcatttattcattcactcacttgctcactggaggaacctgctatgtagcggaagaccacaggctccaggtgggccaccaagcctcagtgtacccacctggggaccgggaagtgggagactcctctctcagcaaaacaaggtgaactcccgactcctgtaagtgagaatggcagcagctgagttcctgctgggtccggctgggtctggaaggttcaggggggcagagccattgcacctctgttgcattatgtaatttactaagaaccatcacacccgccgctttccatttgtttctctctgtgccctgtgaggtaggtgggaccaaaccatggccccatctggcagatgagaacagaggctggagaaactctgggattcccttcctcttgggcctcagacttggccccaagttggcctttcccaggtgctgccacccccatccctgagtccagggagtgggaaggaggtggtaagaagagcttggaagggactgttaaggtgcagatgtcttcattgtcttcaaatgaaaatcagtgtgggggctgcctttgttggggaacacctggcatatgtttgggggtgggagtggggcccctgggtggctccaggaggctggcacaccaaagggaaggtgaacccacagagccaggcccttcaccttgggatttccatactccgggatccaccagtgaccccgccagggaggcatggtgcaggggacctgggtaccgacaggaatccagggacctaggaggatcagatttgaatgaagctggcctgactgtgctcctgagaagcatacctcccacctcccacaaagaaagagttgcagggatcctgggggatgttagtggcttgggaggggactccaggacgaggaatgagctgactcttgttctaaactgagaaacagaatccacaattaattggatgcatttgctgaacctgggacaggacccaaatcttgttctttttctgaaatataaaccaagccaggagtttatttatttgtgtcccctctccctgcaaggactcagtgaagcagcctgtcctggaaggcagcctggctgagctggaatgtcaccgccttccccgagttgacccgcccaccctgttctcctggtctggtgaaccatgggcctggaggaggccccatggttgagggggtcaacctccccaattgagggggtcctttcctgagggcattcggggcagcaccacccgggggctggtgggcagggtctgttgatcctgggctgttctggcctggggccaacttcagaagcctccctgaggaatgggtgtgggctgcagggctgggcggggggagctgagtcagcactgtgggagccctgatcacagcaaggacagaacctgatgccagcgtccggctttgtgccactgcacttgcgggtcaccctgcctgctgcactgcgagagactagggaggccttccccatagtctgcagtcggctccgcgccactccagtgcttagactgtgtgcctgagccatgcggggagagacagagggaccggagctcccaggttgcactggcctcctggctagcaggcagcgggacccccccaggttcctgctcctgctctccctcctcatctccttttgacttccataaaacgggctaacagcaaaccctgtttgctggtctcaatcctgaagggggaggctagacccatcgtgcctgtgttcctggcttctggcacatagtaggcacacagtgccaagtgaattggcatgtgaggcttcggaggataaaagcctttgtataaggctttgcaaagcaccttacacaatgcagcaaggtggaaagaatatgattttcaagtctcagagccccaggttcaaatcctagctctgctcttcctcagtgctttgaccttggacaagttactccccctccaagtttcagtgtccccttttgtgaggtgggatagtatcctgtgtgggagggttgtcatgaggattaaacgggagaacaggtgtctccatttcacacacgaggaccctgaaggtcggggtgccggctcgtggaccagccctgctccagggcagggagcagggccttaggccagtggggggtgtctagctgcacccatgccctccgtgtgtatcctctagggccgtcctgtctgagtttaggcctggggcccccagcactggaggagtccagggagtccaggcctagctcaggatccagatggtagggcttgaggccttgggaaggaaggaaggggaggggattgtccagagagagcggcaggggcggaaacgtgtggtatcgttctcacccatcataagggccacagctgacaccgctctaacgaaagacaggtttccaagagcaaagcatcacatttctttaatcaatgttttacatgacacgggagccttcaacgatgaagatgcaaggaccagagagaactgtctgttttcagacataagttggtgaggaatggacagccgtgtagacatatgatgggacaacgggtgtgacctaatggtgatagtccgagggggaacccagcaaggcttgtcggctcggcttctttccggcctctctgtgttgtgtggcttcctcccacatacagcgcaggacccctgtggaatgagggtcttcaggggtgaagggagtgggagagagtgaactatctgggtttcatggctggctttggggaaaaggggttttggtctttatgcttcaccttgggaaagaaaaattccagttttgatgactcacctgggcagggaaaaagaggggagagagacagaagggcaggagaaggtcacagagagcttacctctgaggcctttcacatgccctttgttcagagtctgcagtgagccacagcaccacactttggggtgctgtgttctgagccccgacagggccttgtgggggccaggctccaggtgatactgtaagcccccacttccccttccgccctccctccctgacccctctctctgtggacagccctagcgtgggggtggctgggggctgacctggcatctgtgggggggcccccaggctgtgccccactcctttggctccctcctgggatttttttttttttttagagggattggcccctctgtctgtctgctcagccccttactgttgaactgtgctgctcttgatggagagagcccttggggaggaggggacagtgcaggaggagctcctcttcctttcgggcacagggggtgcaggcgtgggctgtggcttctgggacctctgtcctctctccttcatggggtccctgcctccccttcccaagtgcactgcactgtgttggcccttccccgggagctttggaggaggactggatgtgttagtgaaggaacctgggcacactctggggacctttctagatgatgactgggactgcagggtggatcctctggaaggctggtgacttgcccggggctgcgggtcagtgggaggcccttgctgccccctgcagcatgcccctgagctggtggctggcctcagggctgagcctggtggtgctagggactgcgggcaggtgtttggggcctttagtcagcagcactgcctcccacacggggcagccagctgagcagcggtcagcctctgtgggccctgttgctcctgttacctccctctaaggttagtgggacctggattatgcccagggagggatggcacctgctgaagtcacacagcccattagggtggggctgggctatgtccacttctgtcccactgtgtgctgacatccttaatcgggtggggaggggcagtgcatttgtcccccacatccatgtccctctagcccttcacatttatgtcattccactcctccttaccacacagcacaggacgggcagggttagggggaggaagcccggagcccctctgctcccctgaacattcattccacctgccagggcctggggcaggggcagggacagggggtagaggtgggtgtaggggtgtggtggagggtggtatgtggggtaggggccaggcggagagctgggccaagagcctggggaaggggcaaggctaggggcagggccaaaggtaggggccatggggtagggcaggggtagccacgtgactccctccgcatgttcttgtcccctctggctctccgttccattccccccacccaccagcccctattcttttgttgtttttctgagacagggtcttgctctgttacccaggctgagtgtaatggcacaatcatagcttgctgcagcctccaactcctgggctcaagcgattctcctgcttcagcctcccgggtatctgggaccacaggtgtatgccaccacacctggctaattaaaaaaaaaattttttttttgtagaaatggggtctccttacattgcccaggctggtcttgaactcctggcctcaagcaatcctcccaccttggcctcccaaagtgctgggattataggcatgaaccaccacgcccggtcagccaacccttattcttgatctgaatacctgttgatcaaacacctcgtccccttctggttccttcccaactttcctccagccttgatttcctacttctggggccaaatacagtggaatcagccttggactcgaagtaggtccattctcctcttctctgggactcagaacctgccagccttggcttttgtttctgcatcggcaaagatggggagcccctgtggctgagaacagcactcacacttgtgtggaggggcagggcatgctggacaggccagggtgaggcagggaagcccctagaacagcactgggtagaggaaggcctgagaatgccccggggctggggtgagggcagcctcctcagtactgtgctgcgtggggtgcctgttggtgcctcagtgggcacttctgggtgggcgctatctaaagctgactctgggcattcactcctttgaatagcagaaatgacaacaatactgtttgaagtaataccaatgatgtgtttgagataaacacatacctcccgtaggcaccatttactagttccagtgtcatggatatagaaaccgaggactttgattaaggaatgaatagcctggttgcatgtataggttgagcttctcagacaggaacagacgtgtaagaacctgaaggcatccagaagaacaagtcagctcctgtgcctggagtggagtcggggaaggctgcctggaggaggtgatgtgaagggccagcatagcctggcattgctagggaggcaaagtttcctaatgaagactgtgggagtgtgtggcgacccgtggctgttgccttcccacccagctcagaccttcacttggccccaaggcaggtgggtgctggccagaccttccccctcccctgccctggctgctggggagctgccaccgccccccacccacagctgtgccctggctggggctgggctggtgctctgctcctcccagcacaggctgttcccccactgagctcaggaagcaggtgatgagggtgggaggcgggtgggctggagaagcagattccaccgtgtgtttatggccagtgtcctggagctgggctgagaatagcacccgcacttgtgtggagggacagatgggcggagggctggggccaagggtggggtgcgtgcctgtggagacaggctgtcctcagcgagccccacccagcacaactgaagtggtggagggtcgccctgtgtcactgatgccccgcggccatgcccttgctgcctgcctgcgggggtggcactgggatgtggagtagtagcaaggcccatcagggctcctcatgtggccacagcgggttgcaccaggctggccttgctgcgatggccactgtcttcagctgtttggttgatttccatggggcctcttgtcggtttacccttttcccaaaggggcccagcgtaatggggtggcttgcagggtccttgcagagctgcaggcaaggaggctgcagaggggagcttgattggagagaggaaggggggtggttggtatatgctgttccaaggaactggccatgctgcagtggactgtgagccgcaggagcaggtgcactgggcggcaggtgcggggaaggcttatgtgagctgggggttgggggagtagggcgttggggactagggtgggaagactgcaggaactttcagccctgggtggggggagcaggggggaatccagtgctagcggctctgctgggccctcttacctacatgatcatacttcacctttaaacacccttgagggagttcttggctctaagtgatgagacccagcaggtcagggaggtgagcttacttgcccagggctgcacagcctgggcctgctcccagcaccttctgccccagcagtgtctcctaccagaaggggttcctggccagctgcccagactagatgccctgagctggtcatccagagtgggcagtgggagggactgaggggcaggtgggtggggccggggtgtgatagaaacctgacggtggggtgtgtccagtccaccccagggttcctggccattgtgtctgcaccttcctcctggacatctctgggcactgcaaactcactgtgacccccagctgttaccccaacacgtgtccccatctcaggtgatgaccaccccttccctctagtagctcagatcacagagtccccttgcctcccacctgggtcagtgcagtcagcttctgaacaggcaccctgccccactgcgctcctgaagtgtgtacacgcgccagcctgggagctttgcaggctgcaaaatcaagtcttggctcagagctttccagggttccacgttccatgctgggttttaagggccagagtcttccaggggcctctgtggtcctgggggccgaggccgcatgtgcagtggttaaagctcctcaccgatggacccaggcctggggttgggatcctgggcctggctgcgtgaccctggggagttgttaaggcagtgcctcagtttcctcacctgcaaagtgagaatataatagtatttccttcatgaggttatggaggggtccaccatgaggctatggaatcatgcccaagggctcagcatgaagcctggcacctggtgtttcagggcctcctggtcctccctgccccctgccactctcagccacgccggtcttgctgtcctgtggcatccctcccgtccacctcagggcctttgcactcactgagttctctgtccagtgagttctaccttcttcttccttcctggcctggtgtcttgctccttcatcaggtctctgctcagctgtcacttccctgagttccttcctaagagcagccgccctctcccctcacccccagcccttcagtgtctctctttttttttttttttaagagatacggtcttgctctgtcgccctggctggagtgcagtggtgcggtcctggatcactgcattttttgaactcctgaactcaaggcatcctcctgccctagcctccccagtagctaggactataggtgcacaccatcacactcagctaattaaaaactatttttggtaggggtaggatctcactatgttgcccaggctggtctggaactcctgaccttaggtgatttgcccccctcagcctcccaaagtgctgggattacaggtgtgagccaccgcacccgtccccctgctgcatttttgttcggaggctcacagcacctttcaacattgcctccctcctagagtgctggctcctccagggcagagaccttgcttggcttcccatagagcatggccaggcacactgccaccagggcacgttgctgagtcttcaaatgcctgttgtgaggtgatagtgcagaagaggaagccaccttcgtttttgggtgggcgttggcaggggaggctctgattctgtgcctgtcctgctcttggcacccctctcaaggaactgagttatgagaagatccctcctgcgtctggccagctcacccacagtgtgaccaccacagccaccaggccctacagccgagaggccacgtcccagagccggggtggggactcttcacagtggtgggtctggtggaaggttcctttcttccactaagtgctggctgggtggggaagaagctggagggtgaggcctgggcagctggctgggcgcttgatgatggtctgggtgggcgtagcccttctagaaactcctctgtttgctggtggacacctggttctgctgatggctaagaatagactcagcttgggggatggtcccgaggggaggggagccagtcatgatccagggggtcctccagccctcctggttggaaggtggtggggtggctgataaaatccaagggcttggtagcggtgggccgtgtgcggattctagctcattgcttactgacatgggactctcggtttcctcactgtgaaacgcctccctcccctgccaggatttggagcacatgtggtctttggatgagcggttcctgctctgccgtccgtcctgcactgcccttggctggtccagccccgccggccactgtgagagtgctcaccccagccccctcccagcctgactctggcccctgctgcctccactcacgctgtgtgctctgctcggggctccccaggccaccgcagcccaccctggcttcctctggggtccacgtggcaccaccctggctgcaggccataggcttatctacagaaccggctggaatttcaggcaccctgggagggatgagagagaggacggggagggggccttcctggcctggagtcaactggacactcgttctctggggcgggagccttcccttccagctgcagagatgagtgtggaggaggagaccctgcaacttccttcccctcccccttctttctcaggggcggggctgggctgccagctctgatgcagacaggacctccaggggccggccgggctgggagggctctctgtgttttcgtttttgaccatcaaagcattgtggtggggctgacgtagttggtcaagtttttattgtcagttaaggatgtaaaagagaaaacccaacaccactttttgctctcaccagtatttcacaaaggaaagggaaaatcaccaaaaagaggaaggagatcatcattttagagtgacggcctcccaagagaggccaggcagcttcctcagtcagcctttctgagcaggggaccacggaaaagtgtgatgagtctttgtggactggtgtcaggggacggagcatgggggcttgtcaaaaaggtggatcgccatgtgggggtgaggccaggcgcttcctgggggtcatggacttgttaaaaagacggatcactgtctggacgcggtggctcatgcctataatcctagcactttgggaggtcgaggcgggtggatcacgaggtcaggggttcgaaaccagcctggccagcatggtgaaaccccatctctactaaaaattcaaaaattagccaggcgtggtgacgtgcgcctgtagtcccagcgactctggaggctgaggcaggggaattgcttgaaccggggaggcagaggttgcggtgagccgagattgcaccactgcactccagcctgggcaacagagcgagattctgtcttaaaaaaaaaaaaaagaaaaaaagatggattaccatgtgggggcgaggccaggccttcctgggaggaatgtcttcccggttttgtatttcatcgtgaaaatctttgtcagctttgcgttctaatccacaagctgtctatgttggttatgtcacaaaagtgttttctttaccagttcgatctttggatcaaagcaagatggagtgtgaatcttcttcagcaagctccagacacacgcccgctccccccagtgtctgtgtgccccagtttgggagtcaaaagttgagtctgggctttggaactgatcaggtgtggcatcctggctctagagctcattagctgagtgaccgccctgaccctcgatttcttcatctgtaaaataggaccaacggtcatcacctcagggtggcctagggatatgaacccaacgggagggggttcaagggtgatgtgtcccccaaggtgagtccttggaggagagattccctggtggtcatgctttgcactgtgagctttgtggagcttacctagaggggcacatgtgggggcctcaactgggctccatagggaaggaatttgatggggagggagtcccctctgaagtgagagctgagctggcagcatctccctcgagggagggcaggttgacagatgcctgtccctagagccagcccctcctgccaccacctcatatccagcccaggggacatgggggccccaggtatgggggcacagaggagctagggaagggggctgaggcctggctcagctccccctttcggagcagccctgagggtgtgagctgagggggaggaccccattcccccagaggtgctgggcccttcctgctgggggtgcgtctggccaccctgggctcgctcttggtttccccatctctggttttctttcgggctccttcctcattatgggctctccccgggcctccctctgcctcttgcttgtctctgtggcttcttcgtggttcctccactttcctactgtgcccaggagggccatgaacaggtggctctgccagggagggtgtgtgtgagcgtgtgtgggcgtcatctcacactggaggtgcttgctgcatgtacatggccgagcttgtgctgctgtgtggggccctgagggctggggagcgttcttgcctccagatggaatgcacttatctttaaagtcattgtgcctttgagaagttggaaggcatagcctgaagggtggctagccgctaagaagtgtgctgtgtgttctgggcttgcttcctgggactcacttcccggtgcccctgggctctgctctccagcaggaacctgggccacttctcccctttgcagccacagctggggctgctgcaaggggcccagctgcccgtagctttcccaaggagtctgggaccctcattctagcccctctgtccttggctgcaggtctgggtgccctcccctcccaacctgagggtgaagcagcagctctggggtggggcggggcgggggatggagggagaacaaggcctcaatcgtcaccaggagactgctagcttctgggttaagcactgctgctctgaagacgcctctgtacgtgtgacttcactgggttctgaggaggaagagagtttccctgggctggatgagaccaggaagctgccccttgtgcagtcaccagcctggggcaggtgccacagcccacagtcagtgtggcctcctaaggaacactgcaatgggctcagagggcagctgctaggccatgggtctgtctcctttctcacttcttgaagcagacagacctgagtgatgatgcttgttcaccaccaccacaaagccacagaatctgagctcggtcgcttcttcgctgcagagccaaatccttcagtgccgcagcctttcctttcttatctctaaagcaggggtaataatctgcggctctgagcatgagggaacgctgaaatgcctaagagcaatgagcatgcctctccaccgaaggaaatcagggttccttggagaaatggctgatgccagggctggggcagggacagtgcaggctgagcctggagaatctgctagtgccagaaagtaaggaagcgcctggagatgaatgaggacgtgtccgaaacctcccactggtcgcacttgggatgtttgagcatcaaaatgaatcacgaacgcaaaacgaaggactcacgatatcctcaccaccctcctcgcaaaggcaagaccaggggaggctcgtgtttgtggaatgccgggtcacgtggaggagattgggtaacagcgggttccagccaagatgctattgcagtgcttctcagacttcactgcgcatacggtgcgccagggggacttgttaaagggaacactctggttcagcaggtctgcagttttttttctcctccaggctcttggaagactgtcatgcagctgcccacagacctcacactgaatagcaaagaatgatggatagtaaaggcactgtgcaaaaatttcaacaactttttgccttgccacagtgaccgtgattgtcctgcagatgactaagagaaaagtgaccttcctttccaagagatctggcaaacacgactcagacccggcggtcaagcctaacacagctgtggtgcggtgggaaggctcagcctccctctgcaggactcttgccaaagcagcctttaacctgaacttcctcacaaggaaacaatcagatggatccagagtgtggggcattctccaagtgattggtttgcactcttaaaaagataccagtatcacgaaagaaaaaaaatggataacattgataaataggcatacggggaatattctggactaaaggaacaagagacccgacaatcagaagcaatatgtgaaccacagttggatcctagacccagacataaagggcatttggggggcacccaaggatatttgaatgcggaccgtgtggtagatggtattttaaaatacattttggatgtattgggggtgcttatggtatcatgggcattttggagcatgttcttgttcttaggaaatctgttggagtatttaggggtgaagtattgtggagcgaaggtcatcccagtgacccttctgctgcttaccttctgttggctgggcaaacatacaaatgcaggaacggtttatatatagagaaaagtgactgggcacggtggcttgtacctgcaatcccagcaccttgagggtgctgaggtgggaggatcacttgaggctaggagttccagacaaaactgggcaacatagcgaggccctgtctctacaaaaagtaaaaatactagctaggtgcagtggcctgtagtcccagctactcgggacgctgaggtgggcggatcgtttaagctcagaaagtctaggctactgtgagccatgattgcgccatgtactctagcttggacgacatagcaagaaaagagaaaagcaaaaaaaaagaaaaaaaaaaaaagaaaaaagcaaatgagtgtggccaagtggtaacagttgattggtgaatctgggtgaagggtagatgatagtccctgtagtatcctttccactttctttgaggtttatactttgaaaataaggaggtgagagggccacatgaaatgtggaggtgagtggtgggcttagaacctcttttcctccctctgctctctcgtcagggctgctgtggcctcctgcatggcacctagattgttggaggccaccgagactctccacccagaggtggggagcaggcttaggtggctccactgtcggagtggggatggggaggtgtgagcagcagccgggagaggggtcctgtgtgtctggttgcagggacagctcgcatttgagagatgggcttggaggaggggttgtgtgctggggaactaggtgactatgggatctgcgggactgtcctcagactggctccctctgcccctgggggtttaagactcccattgtacccctttcaccactgccaccccagcctgatgtgtcagacagcaggcagcatcttggggcaggagaggggaggcagagggccttgtaccccttcccctgcctgggcgcccaccatggcctgcccacgccaaccctggtctcggtgcagacttgtcctgcgatgtccctggtatccccagctgagtgcctgcaaggcctcagagcttgtgaccacggaggccttcagctggccatcctgccctctgtctcccctgcaggggcccctggagcatgagggcggaaagatccccgaggccagccctgtgtcatcatccacagctccccagcttggctgacccgagctgtgtgtgggagacgacggaggaggaggggcaaggaaagattgacagagggacagcccccgggagtcagtgagcgagcctggacccagaggtggggggcgggggtggggagaaggctcgcctttgtcctgttctaggggccctcctccctttcgcctcttggggtgtctccctcgggactgggcccagagaaagcctggccgggtgtctgacagtggccttccccctgcccgcctgcctgtcctctgtctgtgtctgcctgcctggggagcctcggtgtgagaacgccggggcacgagggtgtgcatcctgcctccgtggcccccgaccgcaggctctgctgggaggaaggggcgagacagggctcacttctcagcccgcccttcctgtgcaggcaggtggggaggagatgatgcggaaggtgagggccttatgcgttttctggggtctcagcagctgggtggtgggtgcctgggagggagatttgctggatgaggtcccccttccatgtgtgtgtgggggtggggtgttgggaactctgctgccactgcagggacgaggggtgccgctggctggtggaggagcccctagctttctgcctggccctggccaggaccagagtgactgggaacgcggccctcacccctccttccttaggcttccctcctgggcccctgggctggtccttctgatggccttgggaagtgcttatccctgccctgggccatgccattcagactgtgggtgtgtgtcccgcaagtgcagcaggcccactggtctctggggccgagggagggatcagagaccccaggaggggctgctggggcccagccgggtgagcccgaagacccggccctcctcactgtggcggctagagctcctggcccctcctgactggacggtgtcaggctgtgtcctgatttgtttgtgctcacctgccatctgtcacataaggacacttcccttctgaggaggcggccctggtgacttgaagtgcgtgcatggtgggtgggtgctgtacgtggtgagctgctcctggctcaaacaagacaggcctgggcacccttcctccttctgggttcggtggccgtgcactgcctgtgccccatgactcacgctgtgggtcagggccttgcctgccatgcgggggctgttggagggtggcaggactccctgtacccacagggagcggctgacgccagggccttctgccctctcactgggccatgacaaaggccttggcggagggctggggaggggcacccacccacgggatgctcccactgagcccctgtggacccgggtgccggaggcatggcgtcaactcagtgaaccacccagcctttctagggaggagccttgggagggtttccttccacagccgaggcccagcgaggctgaaccctgtggatgattgcaggaggaggttctggagctggccacgggttcacactttgtcattcctgccacctgccccccctccctgccctgccctggggtgtcccctccaaggcacttcagctccactcacatctggccttgggttgaggacatggtgagaggaagctctgataggaggtgattgggtgtggcactgataaagctcctgggactgttggctctgtggctgcctctgccgcctgggcctctgtgtgtctcgtccgccgccaagttttcaaaggctcccctttgtttatcacagagtgagtgtgcgtgataagtgtgtgatgagtgtaggtggaactgattgtctaaggggccctcacccagtaaccctggacagagtgcaaatcctggcctgtgccgccagaccctcctcctcacccaactcctgctcatccttcaaaacccagcacaactgtcctgcccagctttccttagtcgctgctgggccagcccctcctggacacctggagtcccctgtgtccctcagtggtctgcctgtgagctcggcacaggggaggccccactaaccaagtgtggaacggatggggtgggagatctgtgtcccagggctcacggccttgtcccagctcctgttctggggcagggggtgcccagattgtttttccctgtggtagccacaccaggagctccttgaggatggggaccccaggccacttgcctgcgttccctcatggatgaaatgggggtaggtgcagtgaggatggcatgtggccaaggccagcctcgcccatgggtcttccctgggcctcggccatgctgtggccttgttattcctcccatttccaaggcgggggcactggagcactgagagcttcagcagcctgaggtctcgcagagtggggagactggctcagcctcaggcttgctgtcacccctcagggctgagggctttctgtacattacccttccattttgtctgggaggagcctgaggctgagaggtgggttgttttgtttagggtcatgtctctgccctcaaagcccacagctcagatgagcagcagccgctgagaatatcttgtgtgtctgtcctgtgcttagccctgtgtgggtgttggggacacagagatgactggaacagtgtccctgacctcaagctgttccttcagggtgagggtgtgaggcacacaggcacatcacatagcagtgaggaaagctctaagtggtacagagtgttttgaggaaaggagagatcagggacagttcacagtgatgtcacctgagtgaggttttgaaggatgcataggagtttgccatgtgcaggtagagtgtgcgcgtctgtgacttctgtctcacatcttgggatgccgtcagcctggacccggtgtgagggctggcggtgtcagtcaggcccatcccccacctgtgtgaaggctgctctgaaggccttttagggatttgccatttcttgaatatcatgggccaggtactgctctgcactttatagacatgatctttgtaatccttgaggagggtgccagtgttcacttcattttgtagattgaggctcagagagtagctgtcccttttcccaagggtcttctcactgctgcgtggagtctcacctgggctggtgtctcgttctcaaggctggaagatctccccagttctccagctgtctgtgcagagcacacagcagtgtttgggaactgggtcgagtgtgtgtctgtctctgtacacctcaggagccctggtggccagtgtgggtggggaagactggggaccttttgctggctgagtgtgtctgtcttcctggggagagggagggcagggcgtggaaggggcatccttcctggtgctcttgccttgggagctgggcagtccctgccctgtttctgagagcttctggctctctctggtggctctggtagacttctgggagttcttttctatgtggtggtctattcctctctttggagggggtggggctgtggggtgggtgcctgagcagaggggctgagtcacctacccaagctctttgcagagccgggtgaggaacctccccagctcagcccactttctggggggtcccttctggatgtggctgccagggaggggcagcagtggggagcctgcaagttgtgcagtgtacattttcttgctcatgtgggggttttgttttggtttttctctcatccctgtgtcagcccttggcatccagctgcagttgcccaaggggctgtgtcccgaccgctgtagcacaacatcatcggtggctgcctcccggtgcccacctgccccctgctgccactctcactttcccactccatcctctgtgacctctagtcaccttgagcaattcaaaactccccagtaagatgctccatctttctggtctccttacctttgttgcaacctctcccctctgtctgagctgccacccactccaggaagtctcactgactgcccaggctagaagagatctctacccccagggtcccacagccttaagtgttcccccatgtcaggacagagacccacatctgattcctctctgctgtaccggccaaggtgcccaaggccaggcacagagcaagtgcttggtgagagatggccaagagcagctggccttgccaaggcttctgggcctggctggggggggaagtgcagcagggcagcacaggacctgcaagggccggcagggtgggaagggtcctggctgtgtcctggtaccaggcatccgttggtccaggaccgtggcctgggccctgggccccaaagctgatgttcctggcagcatgggctggctccgggtcttggaagggagggatgtctgcagacctactggcctcagcagatgctgggctggccctttgctcctggggctccccaccgctcctgggcccacctttttctccctttgctttccactcccatcccctacccccgtttccttctcattcttgtgaggtcttgcccactgcctgggagaggcctctgctgagacatcagtgttggcctttctgccgccctgatggaggtgcctctttggctgcagacgggtgtgtcccgccgccaccctggtcttcccctctgctctcctgcaaacccatctggcactcctcatcccttttctgtgccccagctctttgtctttttcttctcctgctctttcctaccgtgccccaccaccgctccttgcctctgtattttgtctccctgctcccacctctctctccgtcatgtggagctctgggattggaggagcagggcccagagagggaagtctgggagagcgtgatggtcagcatatgttctcagggtcctggccagcgccctcctttcctagagctttcccctctcctggtgtggctcctcttctctgcccttgcccacccatccttcatctccccctgccactcatcgtggggggttgagggggagtccacctctgagactcatggttgggagcagagctgtgagctcatgtgtgtgcccttgtgtgttttgtgtgtgtgtgtgtgtgtgtgggctgtgcagagcagagtgcctggggcaggtcacatctaaaaacccagtcagatcagaagcagactctgcgtggcccccggcagctcctggccaccgctcgctgccctccttgttccgggatggctcctgccggttcagggcctgctctgctgttgcctgtggcattcatgggcctgggcccagggaatagagtcatgcggagaagtgaggctgctcctgcttggcccctcccctgcgtggctcacttttcagcttccagggtgggggcggagcacccaggggtgcagtgtgagatcagctaggagggtgcccgatccttcttgccatctttgaagcctccctcctcctggctgtggtcactacgtcaagcctgtcctaagctccatttttggcctattgtcgagccctgggtagagggtggggaggcctgaaaacctgatggacccagccatgccctgggattgcagccctgggtgggcaccctgggctgggtgatgttggctagagacttcccagcccctggtctgtgctgttggtgactgagcactcttggtttgaccactctcctttccaaggtaacactctccccttctctcttggcttcggcaggttctccagaagctggggaaggcagatgagaccaaggatgagcagtttgagcagtgcgtccagaatttcaacaagcagctggtgagtgtgggtggcccttggccttagggagtttgtgaaaattcggctgccaggtgaaaaatggcacgagctgaatttgtggagtacgagagcttggaggagggtaatcagtgtgggctgacaagatcatgtaagacttcctagaggagggagcactggcaatgcatgctgggaaggaagagggatggggtatgtatgctttaggttcttggtaggagacatagaaacggtagttgggggagggggagggggagggtgggataggagcaggcaatagattgtggccagacttggggaaactttgcatgtcaggggcaagtgggagctatagaagcttcttgccaggagagtggcatctgcagcggttagcatgggggcggagcaggctgggtttgatttgggcatctgctgagcatggtgtgtgcctggctgtgtggcaggctcaaggctgggctgtggggaggcatccgcagccatctccaattggcctgggagcatttgagagagggctgagggcagctgggagggctggggagcagctgggagggcctgggagtagctgggagaggactgggagcagctgcgagggccgggagtagctgggagagggccgggagcatttgggagagggctggggagcagctgggagagctgggagcattctgggacaggaccaggagcaactgggagggctgggagcattctgggagagggcggttgggggcagctgggagggctgggagcattctgggagagggccagggaacaactgggagcattctgggagagggccggggagcattctgggagagggcggtggggggggcagctgggagggccgggagcattctgggagagggtggtggggggcagctgggagggctgggagcattctgggagagggccggggagcattctgggagagggctgggagcagctgggagggctgggagcattctgggagagggctgggagcagaggggagaggccccagggccaagttggccttggcttgccagaggggctcagcctgacaggcttccctggacagggattggggagcccccttagctgattgtcctttaggccagttatgggaggagtttcaaggcccaggtagaccctgtggcagggatatctactgcctctgtggctctgggcaattccttcccagagcttcttgggcctcagtttcctcacctgcagaatagaggcttgaacaagaaacctggtcttaggttctgattccatctctgggaagccccagggcatgtccctactcagctggcttcatcaggctgtgggttgctctgaaggacctttagggagttgctgtggccatgggccagagctgctgtgtttgacagagatctatgcaatccttgagatggggctgatattctcattttgcagatgaggcacttgaggctcagagaagttaagcacatcttccaaggctatgtagctggtgtgggtgttggggattgaaatccaggctctgtggcctttggttcactatcgagtttcctctctggagctgatcccttgtcctgagggcagctggctaggctggggagacaggttaggggtggaggtggtgggggccccttagaacaggctgagctggccgggcactgtagctcacgcctgtaatcccagcactttggggggccaaggcaggcagatcatgaggtcaggagtttgagaccagcctggccaatatggtgaaaccccgcctctactaaaaatacaaaaattagccaggcgtggtggtgtgtgcctgtagtcctagctactcgggaggctggggcagaagaatctcttgaacctgggaggcagaggttgcggtgggccgagatcatgccactggactccagcctgggctacagagcaagactccggtctcaaaacaaacaaacaaacaaaaaacaggctgagctttggcagagtgagggaagcacagttgggagctgagactctgtgtggcctggccccagggctgaaaccacagtgttgctgtctccactgtccctcagagtcatcctctctgggtctctgactctgggcaaacagtcactcactgctccttggacagaggggttgggcagagagtccagggctaaagatagccagtgctgcgggctgccaggtggctgctgggctgtgggtgtggagcagtcctgagctgggcctctgtctgcccccgggctcaggtttggtggggtggctggcttttcaggggccagggctggtagttggggtggtggttttaaggtcttgttcaaggctggggctaaggcagccagttctggatttgattggtgtgtggggatggcagggtgtggggaccaggaaggaatggggtgaaggtcactgttgttgggggagtgaattcaggaggctgcagtgggcttgggggccctgggaaaggagagagagaatggggcgtgggaagcctggaggtggagctttttcttgcctctgattctgtgagccccaagcctagtgggcccagcactacaagggacaaggatggcaggtgatttagtctttaaagaagtgaacctcccaccccttcttatggggtggggggccctaggagagggtgtagatcagcctgctgtcacctgctctccaaggacccaggtgcacagcccctcctgggcccacctggcgctggtcacagtagcatcgctgccttctgcccctgctctgagagcccatgggggcctgcttgcccctcccccagagtactgcacacctggcacaggcccttctggaagccatcctgggtctccagggcatcccagctcttcttcctagggtccgtctgtagctttccaggctgcagggctgtcattgctgtttgtctgtcactgaggtggggcaagtctgattccttcttgtccccatggcccacccaaggttttgctcaaaatgggcatccctgactattgagtgaaggtcgccccccgaattgatggctgaggggtgccagagggggtccacgtaggagggccgtccctgccccctagacccactgggagcacagggacttgggtgctcaggccacctgtggggactgatgtccagggaggtgcagcgagggcttggggatgctggctgagcccagccgcgctggagctgctccaggaccttcctgactcccccaagtcctgtagctgggacacaggctgaggtgggcagtggctcccgaatcttatcttcccccagctgggctctgtgaactctgggacctccagagaattctttctcagatccctgtttaggggctgagggagccacttggaagcaaacacacactgctctgtactggcctggacgctgccctgcggagggtagctggctggggcctccgtcgggggagggctgtgtctaccctggggactgatgaggagcttaggaagccagctgcagtgggcacagggaggcagtgctctggccggccccttgcacatctgcgtgccacgtgccggcgcacagcccagcgttgtttgggaaacacaaggagccctggtacggcctgaagcccgggggagcacaacgacccaccccatggggacccctgctgtgggggggaggtggggacggcgtgagaggtgtggctgggatggtggaggcctggcagggagagaagctggatctggaagattctgtgacatcagaggacacgatagcatcccatcatgaacacactttaatcctcgtctcgaccaacaaagcctttaattgtgaagacttagggtggctgtgtcaggagtgaggtggacccttcctcattccccggccccgcggggtctccatccgaccccctgatggaattccagggaggtctcagtgtccgtggagcagtcttctgtttcttcactcagtctcacatcggtgggccttggacttggatgtttgtaaagatgatgattagccagtgttatacaccctactctatgggggattaaaggaattttagagatttttttttttttcacacatgctctctttaaattatacatcttatgtgctgctctgaagctccccctgtggatgtctctactgtcacacggaagcattcatcataataggcagatctgtgggttctcagggccgcatcactacccattacccacaaaacaccctgcgggctgcgtgcccaggcttggagggtctcatgggctctccgagtctctgtgtgactgggccggtcgctgaccctctgtccgcttctttgctgtcaggtgggacagtggtgttgagaagactgcctggaaggtgctggcccctagggcaccagggcaggaagagcagccccggctaaggacagggagaggcctgtagtggggagacagaagagggtttcagggtgctgggggtgagcctgtggatgtggccgggtccctgctggccttcacctggaggtggacctgaatggatggggcccaccttccggctcttgcgcaagcatgaagctggccagactggagcgctgcaggcatgctgggtctcctgggaccatggccagctgcccctccttcagggcaggaggcgactggaacatgggtgtccctgaggcttgggctggcagcaggcaggggaggccaggagggtgcccttctactacgaaggtcagcctcagccactgccgctctcccgagtcccctctctgccttgtgttcctgtccttagcatgaaggccatctcctgaggcctgccttcaagctccagggcctggcctagctcactggatctgaggagtgccaggcagggattattcgccttccactgaaagacgaggagactgaggttcagagaggctcactagcttacttagggctgtgtggctagtaagggacacagctgggtctgcatggcctcaaagcccgtgtgcagcccactctttgcacgtggcttctggaaacttctgcagctcactgagcatggtctcagacctcagtgctggcctcacctattgttcacccctcctggaacctggagttctccactcagctttcctggctctggttttgatgtcccagagggacttgaggcctggcccatgcttctactgtctctgctggtcctgctgtctcaggaagcccctggaggacactctccctgctcagggagcttcaccacccagcccactgtcccctcagccttttccctctacatcctatgtccctgctgtcagctgggccagtgatcctggccatgaccaccgcattctgcacccctgctgtagtgccgtctcttccgcaggtcttctgtccctatacaggctcgcaccgggccctcttttcctagtacgaggcagtgggagctctctgtccttgggcaccacctgagcttgtggagcagggggcctggtggtcaccacacctgccttgcccatactcctgtgctcattggtcacttgtctgcaggtgtctgagggcaggtctgtgagtgccggggctgctgcacactggtgctgtgctgtttgtgtgtcattcagccgtacctccagcacgtcatctcggaggggggtctttgtcttcctgccttccttcctgggctgagaatggcatctggaagatggcaggtgcccacaagcatgggcaagggtgcctatggacgcagggcttctgaggcaggggtggtgaccgtagctgctgtcctgttgggaggtcagctgatcagtggctgctgtcaggagagcagcctggttcattcacgtgagggtggcaggaaggagagggtcagggactgggtgtgccaccagtccctgacctggtccttgtccttctctttgcagacggagggcacccggctgcagaaggatctccggacctacctggcctccgtcaaaggtaggaggcaggcagagcgcacctggcccgtgtagagctggtgggtgcagagctggggagggtgggacaagcgctatcagtgggaggcccacatacttcctttctgccccacagccatgcacgaggcttccaagaagctgaatgagtgtctgcaggaggtgtatgagcccgattggcccggcagggatgaggcaaacaagatcgcagaggtgagcatgggacaggtgggcctgcccttctcagagggccctctggtctcagctcctgtcccactctgccgtgccctctgggacaagcctctctggttctcgggcattcgcgtgctgtgtgccctggggcaagctgccctccctctctgagggcctttctcctgacacgccctcacaccaaggtgggtcagatggtgggtcgtggtcgtccttatttgtgtgttatggctcacaactcacaaagcctccctggctgaccccagtcctcagcgtatctgatcctcacagtcaccccaatagggcaggaacatttgcccccatcttacagatggggaaactgaggctctgagaagccactgagctgtgaagagatggggctggggctggtccctgcgaggtgagcgctggggcgggtgtggcccagccctcctggtggcactgtcgtgctcttgcctgtctcagaacaacgacctgctgtggatggattaccaccagaagctggtggaccaggcgctgctgaccatggacacgtacctgggccagttccccgacatcaaggtgagagacccacttgcagatctgccctgctctggcctggagggaactggagagaggacagggcctaggacgtgcggctcaggccaggaggaggctgtcctggaggcaggaagcgcctggcccggtgtttcacccctccggggttgctccctctgccaccagcccacggccccccattcctttcctgtccctttgggtctcagggctatgggaggaagcctcacggcacgtgtgtgtgtgtgtgtgtgtgtgtgtgtgtgtgttgctgcggagtggctggctatatgattgtggaaggtgtagaagggtgagtagggcctacacatgtgtgtgcctgcaggtcccctgtgtttacaccatgggtgcttggaagggtatgtgtgcatgtcacctgttgtctgggtctacatgtgtgggtgtgtgcgtgtggttgtgtgcattcgcaaagcctgctgtctctgccaggcctgggttggtgctcggagctggcagtgtctctggtatccaccgaggcgagtggtccccggtaacgtgcacatggaagcctgggttgaccattgggttggacgagatccccttggtgggcaggatgggggtgtcatgctcatgctagcctcaggggtccccagtgcagatgcctcaagctccctgagtctgatgttggtggctgtggagatgagaagccaggggccaggccaaggaaaagacttggctgacacgtcaccagctggtggacacggacacatgggctcatgtgcaaggaagtggtttcacacagtggggctggacggccaggagggggtgagctctctgccacgaggagggttccagcaacaagggctcaagggttcctgtggagctggggtctcctgcccgccctgcgggtccctccaggatccactggacctggagtctcagcaggggtgccaggccccgcttagtgccctcctctgtctgccccagtcacgcattgccaagcgggggcgcaagctggtggactacgacagtgcccggcaccactacgagtcccttcaaactgccaaaaagaaggatgaagccaaaattgccaaggtaagggctggaggcgggtcggggcagcgtctgcagggggctgagagagggcgggtgtctaggaccccgagggtggaggcttcctcctgcctggccccaggtggctgaactgggggtggggacgatacagggcccaggccggtgagtgagaggcccttgtgggtgcctgggtgaggtccaccctaggcccattcctgccccccgtgccaccctggcccctcagccctgatccaggccacctgccagcctgagaatgggcctcctgggtttccctggaacggcgccgccctgcctggcgagccgggtggaattcgtcacgcgatcccaggcgacctgtccctggctggagcgagccagtaggtgcagagctggccccactcatcctttggtgaggggctggggtggccccgtcctccgggcagggccgtgcttgctgggccccctgtgctgctaaccacgctcaccttttgcctctgcagttggagttcaccccctttccttaccccccgggctccccctaattctctcggcctcaagggcccatatctgcttggggtggcccccgcgcgtggggcgtgtggacctgcatttaatctgtgtgtctctgtttctctctccccacctccctggtctctccaccttcctttgccttgacctccccaccccagcctgtctcgctgcttgagaaagccgccccccagtggtgccaaggcaaactgcaggctcatctcgtagctcaaactaacctgctccgaaatcaggtgacactggcttctaaccttgcacgtgctggcgccttccggtctgtcgtcctgtcctctcgccctgcggtggaatgcagggctggcatctgagcccagctggggcagggtttttcaaaggcctctgctgggagagctctgcttcagaggagacctgaagtcaaatgtaggggtcaaagaaccggctgaggggctctgtgtgacctgggtgggggcatagctatgcccgctccgtggctgcatctgtggtcattcctggagactcctctgaaatcctagtggtccaggaatgcctttgagccattgtcctctgtgagggctcctctggggagggaggcgacatcatcaggcccctgtactgccatgcctgtccttcaagccacatgacaactctgagatcatcttgaatttactgagcagagaaagctgcccagagaggcacatcacagcctcctcccagggccccagagccggttaggggcagggttggggctctcctgactgaagcccctgcgtcattttcctcggacttgtggtccccgtggtgactctggaggagttactgggaggaccctccagtctggatgggatgctgagacgtggaggggaagcatgggtccttggcctttggggattcatggagggcaagtgaccagcaccacagtgttcctggggggcttcccggaggaggcttttttacaaaactcctgggccatctcaccatcctggccatagaggctatggtcttctcagccccctgccctccaaatgggttacagtgtggccagggaccactggatgcagtgccctgtgagaggtgggtcatgtggttttctcgccaatgaaactgaggcacatttcaggtcagtgtagtcacagcctggatgtggccctcacacttctccatattcccgagaggctggcgataggggcccggccccggaggttgggtttctctctgggcagctgccccattttttcggagcctcctcttgatttcatcatcttcattgagtgcctgtgacgtggagagctctgggtgggcttggcatggcttgctgtccaatttctttttctattttttttttttttttgaacgggtttctctccgttcccctggctggagtgcagtggtgtgatcatgactcactgcagccttgacttccccaactcaagcaatccttctgcctcagcctcccgagtagctgggaccacaggcacgcattgccgtgcctggctaatctttacgttttttgtagagactgtgcctcattatgttgcccaggctggtcttgaactcctggggctgagcgatccacctgcctcggcctcccaaagtgctgggattacaggcctgagccactgctcctggcctggctgtccagtttctcacctgatctgctgcctgatttattttaggccaaggctgactttggagacactgagtgttgacagcctcatcctgaggtcagggtgcccatggggaaccaggggctgggggtgatgcctagggggacttcagtaggcctgagacttcatctgcctctggaggtagaggaggaaccaggggctggagtgggtatgccctgccagtcagttcagcacttgggctagaagggaatgggactactgacggagggcccgggtttctgaataattttccctgaaacaggtgaaacatttttttgtggatgggagaacctcttaggaggctatggggcctgcccactgcttttgggctcctgggacaggtgtggttgggattatgctgggagggcctgcctccacgcccaccctgggggagcagcgagagggtgaggcaggtgatcacacctttgggtgctgggctgtgggtgtttcacattttggccaaactagctgtcccatttgggtcccatctttatttgagcacatcctccttgtccccagcccactcatacctggctggaggctggagagcctttggagtggcctgtgggcagctggctggctgtgagatggcacagctgggactccggggctgccctgcttgggaacttgactttggggagatagtgcatcctctctaggctgcaccagggggctggccggctccatgcagaccctgggctagttctgagctgctctccacacctgcctcagcgtcctgaatgctgtcctcgggaccccgggcccatgtgactctgctcttccccactgttagcttcagtggagctggggtgggggcactctctcctcatggcagacagccctcaccttactccctgccccttccacatgcttcctaaagagccagaatatgaggaatgtcacccaaagggaatacaagacacgggtcctgacttccaggaactcaagcggaactgtccccgctcttgctctcggcagcgttgctgagcggtgagagcacggctgggtgcagatgttcccacagacaagctgcggtgctgtcttcactgctgtccccaccgttgccatctggggagttgtgggggtggtggctgcatcctcatggagagggggtcctagtgggtacaggagccgggtggtccaggcaggttcttacggaatgtgggactttagacccactgttggcagttgagggcagggggtatgtgtgatggtgctcagctcacaacagtacccctaggactcactcattttatgagttccatagaaccatggttggcagcccccctgccaggtaatgggacacccaggggagtagggcagggatggcccagccatagcctggagacggaggaggggcagtattcccctcctggtgtggggtgcccagggtccctggatccaagagaggtgtgcatgttggaatagacattcttccccaccccccgctccccattctgcctttaaatttttattagattctgaaaagccaggcaaggagcccacgcccactctagcgagtagctggaggtaacctttcagaagccatggtggcccctcctccagtcccaacccaagtcactgggcctaggggctgacctgggctagtcctggtgtctgaggctggatgggacagctggctgggcttggggcaatcgtgtgctttgtggttaagtggccttccggccatctggctgcctttgccagaaggcggcccagcctgggccccagccccggcctgagaacgtgaggctgctggcgggaagtttccctaggcggggcctgacactttcctgggctgtgactcagaccccgaatccctgagtcactctcgccggcagtgtcctcccgcagtgagccagcacagccccttccctgggcgggctgggcaccgggcagggtctgtgactcacctgctgcccgcagtcccttccccagcactctgtggccgtgtgatggggcctgagcaccactgcctggtgggtgtgagtgcctggaggatgcagggcctgccctggggaaggtgtgggctaggagtgggaccaggcacagcccagctgcctggctgcctcctccctggccctgcaccctcctctagggtccccctgacattcctagaggtgcctgagtggctgcctctggtctccctctggtggggacaggtcccaggagagggctttgtgggaaggaccatccctgggaggtgaagtgaaggctggtggctgaggctgccaggagctggccctcagaaatggggagggagcactcaggggcgggggcaattgggggcagcgacagatgctgccctgagagccagaaggcagtggcagggctggcacctagcctgaggaggttcattgtggaagtgggcagggtccccacttggctgggtctggggtctgcctctgtgcatgtcccgtgtccagctcgccaagccccaggcttgcccctcttgttgtgccctactccacgctcactgccctcccggccacgtgggcctctctttggcaacggctgctcagccctccctttcccagatgtcctcagggtcctggagggctgcagggggaggtcgccagcatgggtgtccacatccagttcagcctctgtcttgcccggagccctggtcccagcgcactggccaagaggggtgggcaggaggtgggaggactggccatggggctgggctggctgggacgcccaacagaggggaatgacccgtgctgccccccaggccgaggaggagctcatcaaagcccagaaggtgtttgaggagatgaatgtggatctgcaggaggagctgccgtccctgtggaacaggtgaggcccagcacggtgcccagcctgcgtggggcagtgtccagtctgcgtgctgcggtgcccagtctgcgtgctgtggtgcccagcctgcgtgctgcggtgtccagtctgcgtgctgcggtgcccagcctgtgtgctgcagtgtccagcctgagtgctgcggtgcctgggccctctctggtttgtgcctctgatgagcgtgtgtggtcgctcgtgggtgggtatttctgagttgctgtcctgacctgcctgttcacctggcccccatccttccgcccttctgtagccgcgtaggtttctacgtcaacacgttccagagcatcgcgggcctggaggaaaacttccacaaggagatgagcaaggtaggccatggggacccctctgaggggccacaccccaccctggccgagggtcagagtcagagtcgtgggaggggcagcctgaactcctccttccctgccaggttcagcacacaccggtgaccacagggctccctcccggccctgtggaacagcccccttcaggagtgcctgggcccaggagggcagcagggcatgctggggaggctttgagagtgtcctgggtccttgcctgggtagaccacctgagaatgtagaccaggccctctcaaactgtgaatgtgttctctagcaaccttggcccagggagtgcagtgttagacaatggtggcagtttctcaatttgtaggaaaaaattactagcattttctcaattttaatttttctcccatgcttttgagacatttaaataggcctgtttcgtctgcgtgaatccactgtgcgacagggtctggtctgattagcgtacctttctctcttgtgttattttcattttaacctatctggcaactaaaacgcaaagctgttgaactttgcagttggagagacccagggctggcacccccgcccccagtggtgggtctgactttgtctcttgggcccagatggatgaagtgatgatggtggattccaggcccagggtcggaggaggaaaagcagcttggggcctcccctgactcacacttctaagtacggtttcctgccttttagactttctctttccttcttaacttttcctttttcccttcgaagattggagacaacttacgaaaagtttaaaaaatagagaaaggtgtttcagagaaggaacatttatataaaattagtctgtaaaaatatatgccacagaacatagttgtttataaataggatgaagattcggctctgagctccctagtggccaaatcaaagagaggaatattctcagtaatgagaatcaccgtgtgtgaggaataaacctccgctcgtgcctgtgctttcagtgaaatatctggcagttgtagtgtggtctgaaagcatcttggcaaaatgaccttaacaattaagattaatggtctgccaaaacaagttttaagagaaaaatgtaaaaacagtgcaagctctatgtggcattttaggatatccctataagtaggaggggaaaagatggcttccagagacagcaggcattagtgatatagcccacttgccccgttttgttgcccccttggtttttcggggtttggtgtgctagttccttgctctcacagatggggaaagaggagcttgttcctggcaggggctgggggtggtggggagaagcagaggtgtttggggaaggtggggccgtttggtggccttggaggccccccacctcctcactgtctctcctgcagctcaaccagaacctcaatgatgtgctggtcggcctggagaagcaacacgggagcaacaccttcacggtcaaggcccagcccaggtgcgtgcggggagagccctggcgcccctgactgtgtgcacggcaggggcagggctccttcctgtgaccctgttggtgccctccctggtcccccatgggtttggccttgggggtctagggaccttcctgtcttggcctctctgtgctcagggaggcaggtgagggcaggtctctgtctcgaatgtccctgcccctctggctgtgttcgtcgaggaaggagcactctggggagtccgcgggtccctgagccggctgaccccctcattgtggagcacgagcatccagggttggggtgggcagcctgctcagctttggggactggggggtgtgaacaggactgaaagactccggggtgtgcagtcctctcagagcagggagatagcaccgcccttccctctcctgctcctggaaaagctcatgtccctggatggcagcattctgctcaaccacacgagcatcctcttcctgtcctcagcctcagcccctccgggaatcccagctgcaaggaggcctctgtttcctgaggggaaaccatgagggaggagggaaatgccttgctttcctggctgtggatcagaggaagcagcgagcctgggacttcccctcccttctggccatgtgtgcatgtgtgtgtgtgagggggactgtgtgtgacaggtgtaagtgtgtgcatacccacacacatatcacagcagaacgcagagaacaccgatggactctgtaaaacagggcgactgtctgcttcttggggtattgcctgggatgatgagggtatcgggtggtggtgattgccccctccttccctgaacataaaatagttgtggctgagagaggggccatggtgacctgaggctgggagtggggaggttaggacggtggcgttgtggtggtggttgggggggtgggtagcggggtgggggttgtggaataaaggccaaaaggtgaattcaaggtcgggcagggagggacagctgcctggcctgtaggcacaggtgggaacactgggatggatcagcagggggtaagtggggccgtcctggccagaaccatggctcccctcaggaaggaggtggagggaagagagaggggcagtagaggcccaggagtctcccttccagcagagaggcctcttgtgcactctgtgctcgcctgggggccttttctggcactctgggcacacctggagctcctggggactgggaccacaggcagggtgactctccactgccccgagcctcctgcccctcaccaggccctgttagcatcacctcgggcacctggccacagcaggggccagtcagggcaccccgggatagcacgcccaggccctgtgcaaggcctctggcacttaggagaggcttttgcccctttgtcctctgagcagaagggttggcaaagagggaaggggacaggccagttctgcacctggcctttctccagaatgaaggcctccacctcccgtccgtccccacagaaagaaaagtaaactgttttcgcggctgcgcagaaagaagaacaggtaccggcagtgagtgctgcggaggggcgcagaggcccgcgccctggctggccctgtgcatgcgccttgcgccctgctcccaggtgccactaacccgtaatctggctctgtgtgcagtgctgcccggcagggctgtcgtgtgcgtgttgggtgggaaggcggaggcggcgcggggcgggctggcctctgagcatctggctgcatttagcacgttcctctgggcgccccacacttgtctagccctggtggtgcccgggccaccagcgcacttagcaatggaggacgtggctgggaaggaggcctggggagggccagggaggtgacactgcagcactgtggggttttttgttttttaaacaattctatgtgtataccatatacttatacatatattctttaaggagaatacattcccataaaacacaaattccagaaggaaagatggtgtcagcgacatctcttacgctgttccactgtttgccctcaggtgactcggtcactggttcctgctggatgcttctagatctgcactgtccagcacaggagccagttaccccatggggctattgagcacttgaaactggccagtgtgaccgggcagcggaacttttcatttgaattacacgtaaatttcattgctttgagtttgcattgccgcctgtggctagtggcaaccgtactgggcagcacttttctaggcgtctctgtgcaggttctggtagagaattttctccctgcaccttcgcccctgtgcctggggtgcacagcatcacaccacctccgccttgggttctggcactgaacgccatggctcaggacctgtcccctccatcgccagctgcccactcctctgtgatgaggacgcctctcttagtttgtccaggccctgcttgtggcctccagcagccgagaggacaggagagccaaggtctagagacatgtaccagggtgctgtgatggacaggcagggagggcagcaggctggggagcagaccccagaacagaggggctgctgcgtgtggtgtgggagactcactgtgcctctaggatgtctggctttctcctgctgtggatcttgggctgtcagcatgggccctggtggaccccatggagcctgtggggtggttggtctggtctctgcgacagatggttccaagggacctgcctgcactcctggggaccatagacctccagcctggagtcccaccttgtgctgttcctgtttctgaggcaggcttcccacttccagccccccaagcccaggtcccttggctccccccaccctcctgctctctctcacatacacacacacacacacacacacagtttcacacctccatatgcacacacctcttcacacagacgtcaatacatttgcccctccgtctcctgtgccttggccccccaacactgggctccctttcttgtcctcccccacagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcaggtaggagtgatgtcttggtagcaggtcccctgccctccctccttctcctccggctttgctgttgtcctccatcctcccactcctctgtcccctttctggcctgggcagctatggacccgatgctttgcccagtgggggttgggcctggacctgggtctcctttcccccatccagcctggcatgcttccgggaggcatctgtgacttgctcgctcctccccagcccccacccccactgcagcgccctccccttccctctccctggtcttttgtctgcttgactctttctccatcttcttttcctccctagcagaggctctgggccctcagcccacagagcatccagatctccagagtgggctgcctgtccctcttcctggcctctctctcttaaaggggcctgagggaggagcccaagccaggtggccatgcaggacctttaaagggacagagagaggaagggctcagaggagggtgtggggtggctaagggggcaggtcctgggcttctggactgtccttgtctccaccccgcctgcccccagcgggccctccaggtgtctgcagggccctaggtgctggctggccaggtgggggtgttctcatagccggggatcctgcagctccccgttttctgctgccgccctgctctgctgctgactaggatagcagggctaaggacatggtgggagcctgtcccaaacagcacttcccccggcctggacatggtgccagtgccttctgtgtattcgttcactgagtccccacaacacccctgtgaagcaggcgctgtcatcacctgatgcatgaggaagcccagcgtcatgggtgtgtgacctgcctgaggtcccccacctggtgggcaggggtgtggcctctgccccatcctggtgccacgctggcttcctctgggatacactcgtctgagctgggctccctgtgggcagccctgtgccctgggaggtggagagaggggcctgcgggaagggagaggtgggcagggggaggctggggcccggctgtctctcaacgactgtttgcttccccagtcttctcaccaggccagtgggagccagcccctcccacagttggccagtgggcagcctggggcctcttctcttcttcgctctccttcctcctctcccctcacttctctatctcttctctctccacacagcgtttctggaccgcctgcctcagtgtccctctcgggggtggcctggggtcttggtgtctatgttggggggctgggagggcagtgactcttcatttgctgcgtcctgctcagtggcctgggtgggactgtggcctgaggtgtgactaaccgtggctttgtctctgtctgtctcccccaaaccccgtgctctgctgtgccttcccgcgcggcccctcacccgccgccgacccacagctccggaaaggcccaccagtccctccgcctcccaaacacaccccgtccaaggaagtcaagcaggagcagatcctcagcctgtttgaggacacgtttgtccctgagatcagcgtgaccaccccctcccaggtcagccgcggccgccgcggcccagctctcctctcttcctgccctctcagggcgtgcatggccttcatcctctatgcttctgtctcaagagccaggaatctggccagagagagtgtcagtttccctctctcaccctttgttccctccatccatcatcctccatcatcctccatcacccatctctgagcatgtactaaggccagatgcagggccacagaggggaaggtgccgcctctcccggcgcagcagttacatcagcagcgccctcgcgacgcagtgggtgctatggcagaggggatcggggagtgtggaggacgtgtggctgtcagggaaggcttccagggccagggagagttggaaggtcctggaatggctgaagcacctggacttcagctcccacagctgctgtcagcccctcgagggcgggggcagcggccaggctgcagggcagaactgccgtgtgcacactccctaagaggcgtggaatgcccagatacagcagggagccacccaggggggcttgggtctctcccgacgggcccttggctcagcaaggagccacgcagagggtcttgggtctctcccagtgggctcttggctcagccgtggaggtgcctctggggagcctggcccacagccccaggtcttacgtccttcatggtggaggtcgggctggagtacctgtgctggaagcgcatcttgccagtgctggagtgggctgacgtgttgtcagatttgcccagaggtggccggccttccccgcactccccgagagctgactgcctcctcaagtccagccctcaaggcctcagccttcctcctgtgggtaggccaggacccttcccacacagagcctcgcctgtagggaaggctgtccagtccaggctgtggtggcctccagcaaacaccttcacacagctcagacgcctagtggggataggttggagggtgtgagtgtggggagtggccgctgggaactgcgaacagtggtcgctgctaggaagggttggggatggtgggcctcaagcccctatgcaaagactaggactagaactaaggaactgaggctgcaggtgtctgggtgggtgacgccctagttcaggggcctggcaggcgcgggagcccctctctgtgggatagtggcagagggcgatgtaggaagagcagtgtgggggcagggctgaggacctccagggctgcttgctgctggcctccccggctcgagcatgcctccgccctggtgatgcccagtgtgtgtgcaggcgagggagacgggatggcatggacactggcaaatactgagcagagaacggtgccagccacttcctataccccattgtttggttttcaatcaccctctgggaggacatcatgcccccatttaacaggtgaggaaaggaacccagggcctgtgccgcgggcccacgccagagcaaggtgtgccaggccaggaggtggtgcagagaccacccgcacccaggctctgagcgcgcctatccctccataccatacctgcctccctggccaccgcgtgtgccatctccaggcaactggtcttcccggtctggtctggggtcggggagccatgacctttgggtggggcatggggcaggggtgggcttgcctttgtccatgacacgggtgcccacgggcttcccggctgtggggtggtgagtagcctgtgtccctgcatggagggacagtcccgggcctgcatggcgaggtgccacctgccggggcagcacagcgaagggatggtcagctctctggcggatgaccctcccctcagcacatgacggatattgctgcctgggttggctgacttttctgagacaggagggaggggtgttgctggggcagggtgggggccactggggagagatgctggccgcccgctggtgggaggcacctcgaggctgtgcaccggcgtcctcagggctccttcagagacggccggttatggggcagagcagtgacctccctgccctgggttccccagacagggctggacctaaaggaaagtcagctgctgggattggcccagggcagggcttggggcctagggcccctggttctaggaagtgagtccacttggcctgagctgtctgacaccttggcttggccatgtggactgctccacgccttgtcccctgagctgcaggacagctgggtcctcttaggactgaggaccttgggtctctcccaatgggccctcggctcagctatggaggtgcctctggggagcccggcccacagccccaggtctcacatccttcatggtggaggccgggtgggagggcgcccctgtcagtgtccggtgcctgtcaagagtgtgtagagccgggaagccgctggcctgggctgcggggctggagttcttccagcactgcctgagggccccggaggggagcaccccggccacgtccctctccttttaaacctgggcaaagttctctctggcccccaaagggaagccccaggtacaagatggagaccgcagccgagccagtccctgctcctcagaaggcagcttgtgccctgggcatggatgctgccccagggctcaccggagtcattgtctccgcctgtgccgggggctctaaggaagccccttcctcccatgctagtctggcccagcttatggggaggcttgtccctgtgtggccagggccaccgtgtcccatccctggggccatgcctgtcacatgcctattcctgggctcactggaaggagatcttggcgaggggctgctgggaggggtcaggggcctgcagttttaacccaagtgccccgggtggttctgaagcccccgaatgttgaagaccccactttgaagcttggcctgttgggctttgtggctggctccactctttctccgtccctggagctgacggctggtggtgtcgccagagagtgacctccctgtctggggtggaggaaaagccagtgtgaagtctctgcctttggaactttcccagtcgggagcactgagggtggctgtggcatggtgttactctcgccactggggggtagcaagatcagcagaactcttggcgcagggagcggagaggaggttcgggcattggtggggaggggcccaccagtctgtggatggtggcggaagagagctggggcctggtgctggccctgcggggtggcggccacgggcggacctatgactgggagtttgaggcgggcactggggtcgtcctcctggtgtgggcgggagcctgtgccggggcgcgtggctttgggcagtgctcccgtgtgtgaggtggatgagttggtgcctgggctgtgtgccagcgtgtgtgcgtgtatgtgcgcttgctctgcatgcgtggtgtgtgtatgtgtgtgtgtccacgcgtgtgcctgtgcctgcagtgtctgcctggggtgagggctcccagcttaacactaactgcttcctcctctgctgctgctgctgctgccaagtttgaggccccggggcctttctcggagcaggccagtctgctggacctggactttgaccccctcccgcccgtgacgagccctgtgaaggcacccacgccctctggtcaggttggttgtgcccaccactgcccatgggcccaccagcttccaggtgcccaaccctgggctcatgttgcctattggccacgtgaccccagctaggcctgggtcactgcccttcccctggcacctcagccttcagccctcatcacctcctggttgtagggcaggaagcagcccctgatcagctgggagaactctcagtagggggttactgaacacttcctggcaactttgtgctcatcgcttggggcagaagcatcctggcttggggtcttgaagctccctgagaggtgtcgggagctcggccacctgcaaatcttggagtctacctggctccgagccactcctgtgcctgctgggctggatggcctggggcgagcgggggtagggtccctggggactgcttgccgccctgtctctaacctctgtgctaactgtccttctcgccctcactgctgcgctcagtcaattccatgggacctctgggaggtaagctgcacgtctgctctttgtccagcccctgggggagccactcttccgtatgtgtccaggcccacatgctcctagcctgttcacaggtgcatgcaccccacacaccccccacacgcaggacacacaggcacgtgctcacgcacagggagctggtgaagccacccgcctccagccattctgctgcttctccctctggcaggcccttggaaaaggggatcttcggtttagcttgagacaggggtcccctgagatctggtcctgttttcacagcctgtgagtgtttgcctccagacagaagtgggccggtcacccaggatggacgagtgtcctcagggtgtggggcaggagggcctcagggtagaaggttcttgccttctctgagctttttggcagtggggagctgtttgcgaggaaggggagaggggaggaatggatggtttgagagagtcagggaagacagggtgtggctgagtgccttctgagagcagggcctgcaggcaggtgcaaggccatctcacacagcaccatgtcactgtcacctgatagctcaggacacagaggctcagggaaggctcagtacttgcccaagaactggtcatggtagagccagaattccaacagggtctcctgggctctgtccctgagaccccctgatacaggcagagatgctgggaggggcaggcgggtgtgcaggcgcccttggggcatgcgctggcagcccaggctcctgggagctctggaggctccaccgcaggatttccctctggaggaagccagaaagagccagcctggtgcgagctggtagggccattttgacaagtggatttcggtaggtgctgagcttgggcagcacagtcacacctgcctgtccctttgacagtggtaggagagaggatgtgggaggcgggtggctggccgggctccgctggtacccaccctgcccccaccaaccccagccgctggtgacattttctcttgtcttgtgatcctgcccattgcctttccaccccggcctccccgccccctccctgttctctcctcgtggcctgttaccagcccacagagagtccagccggcagcctgccttccggggagcccagcgctgccgagggcacctttgctgtgtcctggcccagccagacggccgagccggggcctgcccaagtaagtgcccacctccagcccctgtctggcttgtccccagtctctaggggtgcagcatggaaggagagccccgaggaggggttgcaggagggaccaggccaccatggatgtgagggtgaggacagggtcctgagctaggctgccccagcacgggcttgtcaccaaggctgccagggatgagtgagcgcagctgggcgcatcagcccctcctgcttgcccaccccagcccagcctcccagcgcaggaggagcatttagagcacctactggtttatgccaggcactttccagaatcttctcatttaatcttcgtcatcacctttacagccagacacttcctccttttacagatgaggagatgggggctaggagggttgagtaacttggttccagcactcagaagtggccaagtctgagtgtcggcccaggtcagcccagctctggggttcctgcagggcctgccgtggtgcccgtgctgcggtgcccgtgctgcggtgcccattctgtgccacacccttcttggatttgggctgcgcacaggctgcaccgcaccacctgcgctgggttgtgctcaggctgggacagatgtgtgttgctgtcccctgccatggactatctataggtgcagcaagatcctgccacctgccgggtcaagcagggtgggcgggtggtggctgtggctgggcgaggtcttggtgccgagagagcagggcctgtgaggcggggttgggggtggcactctggggcttgcactgggcttcttcacagcattgtcactcacatccctgggcctgccagcgcctactcttcagctgcttccccggcccagggcccagcttgtccagcagaggctccctggattcttcgaggcactgggcagctctagaccctgctgccagccaggcgatgcccccggccctgtcgcttgggtgctgccctcctgtggcctgtttcctgtgtcctggctgtgtcctgtcctgtgtctgaccccaagccggcatttatgttgcagccagcagaggcctcggaggtggcgggtgggacccaacctgcggctggagcccaggagccaggggagacggcggcaagtgaagcagcctccgtaagacagcagggacaaagccctgccttttcctccctgccgcccgcctgcctgtccggggctcccctgtggcccctgctggtgctggtccaggcctggctcctgttgaggaagctggaggcgggccggtctggcaccaggcgcagacacctttctcccctccccgcccctcttctcctcggtggccctggctgtccctggaccacctccctgctcagctgacccgtacctctgccaccagagctctcttcctgctgtcgtggtggagaccttcccagcaactgtgaatggcaccgtggagggcggcagtggggccgggcgcttggacctgcccccaggtttcatgttcaaggtgagcccacagcctctgactgctgcagtccctcggtgccctggtgggcagatgagaaccctgagcctcaggagactctgtggtttgcccaaagttgtgcaggcgctactaggtcactcccagccagcaaggtggcatctgagccccatactgtcctgctgcttttgagcactcctggtctccatactgccacctgcacctcccacacgcaaggcccgtgctctgtgcagggctggaggtgggacggaaggtctgacttgcgatccgcatcctctgcaggtacaggcccagcacgactacacggccactgacacagacgagctgcagctcaaggctggtgatgtggtgctggtgatccccttccagaaccctgaagagcaggtgagggctgggtggggccgccagagcgcagggggaccacaggcatcctggctgcggctggcaccgccgtggcggagacaggccagcagggggcagcagaggcccgcgagcaccagggctcccgcgccaactgctcctccccgccctccacgtcgggctttttcctctctccctctcctctcccttcccttggcccctctcctgttaggcctctctctctccctgtccccatacccgcttcttcctgtagcctctgctttcttctccccacgtcccccctttgctcaggcgctctcagctctgcctctgtctctccccttctcctctcctggcagctgtgcctgaggcctgcctccctcctgggacaggatgcttgacccctcctgccccgcccacaaggtgcccaccctgcagccagccggagcactggttgggctcatgaagccccgtgtgccgtccctcgaggcgggccctgccctgtgcacgcagggccatgggcttcccagctgtgtccccggctgaggctcacccacgatgccttccagacccttctcctcctgctgtggcttcatgttaatctcctggaagtgagggctcctgttgagcctgggtgggtgctaagtgtgtccctcctaggtctgggaccctcctggatctgggtcagttgcccctcccagggggccttggactcttggcaggagcctccccgctgtgtagagccagctttgcttgtggggggtcggtggtgccatgtgggcatctggcttcctccacggctcagcccctgagcacctcgggctgtgcacagagggcctggccggcttcttcctgcttccagagaacatgtttagccatcaacgcttctgtgtgaataggttatcagagcggctgagggtgacagtgggtctgcctgggtcttggatgaggccgaccctactgggggtcctgggctgggatgtaggggtaccaggtacttattgaggtccggggcaggaggcctgagtgatgaggaccttgtgggcctggcactgatttggccctttctcctaagcccccaggtcttcatggacctcctagtgggccagccctggctgggtaggatttcaagcagactgctacccagagcccacagtgagaattggcctggggctgctggagggggctcagatagggcatgagtagggtctgtgaccaggctgacaatgacacagagggaaataacaaagacccaggtaggccccaggcacagcccagctgcaggggcagcctcggcccagccactggcaggagtggatggccatacggctccccgtgacccacctggggccaggggcctgtcagcactcccagagaaggccctgcgggtgtcaggattgaagcaaagggcaagtcgaagttggagggactggtgggatggccccaagtccctctagaacttgtaacttgttgtcactcccaaaactttctggggttgtttgagaagcctggaatcctggaagggctgatgtgcacatcatgcatgcagtgggactcatcaaaaccagccacgaatggttagatccacctgcggacgacaggctggctcctgtggtgcctctgggcaggagcctcagccagcagcatcagggagtgctgcctggaggaggtgttctcaaggtgggcttggcaggctgaggcaccaacagcaggaggaggggccgtcttcccagcaggttggagtgggatgcgtgccctgtggggtggagccccttgctcatccctgtgcgacctggtgctctgcccctcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcag

SEQ ID NO: 36290 - DNA, 5401 bp, Homo sapiens
ggagagccgaaagcggagctcgaaactgactggaaacttcagtggcgcggagactcgccagtttcaaccccggaaacttttctttgcaggaggagaagagaaggggtgcaagcgcccccacttttgctctttttcctcccctcctcctcctctccaattcgcctccccccacttggagcgggcagctgtgaactggccaccccgcgccttcctaagtgctcgccgcggtagccggccgacgcgccagcttccccgggagccgcttgctccgcatccgggcagccgaggggagaggagcccgcgcctcgagtccccgagccgccgcggcttctcgcctttcccggccaccagccccctgccccgggcccgcgtatgaatctcctggaccccttcatgaagatgaccgacgagcaggagaagggcctgtccggcgcccccagccccaccatgtccgaggactccgcgggctcgccctgcccgtcgggctccggctcggacaccgagaacacgcggccccaggagaacacgttccccaagggcgagcccgatctgaagaaggagagcgaggaggacaagttccccgtgtgcatccgcgaggcggtcagccaggtgctcaaaggctacgactggacgctggtgcccatgccggtgcgcgtcaacggctccagcaagaacaagccgcacgtcaagcggcccatgaacgccttcatggtgtgggcgcaggcggcgcgcaggaagctcgcggaccagtacccgcacttgcacaacgccgagctcagcaagacgctgggcaagctctggaggtaggacccggcgggggcggcgcggcagggtgggcatcgcggcggctgggggcgctggtcagggctgatttgccccgccccgcctcccatcgcccgggagttgccgttccgggagccggcgggatggggttgggagtgggaatggggtgtaactgtggctcagagtttgacaaagttcttgggctgctcgcggggacgcggaggaggggggtggtaagtggaagaggtgagggaggtagctggaggatggacgaagactggtgggagacggaaggagggggctgccagcctgctctccagtcgcctggaagctcaatcggggcggggaagtgaaacttgcctccctcctacccggcctcttaaaactgcactctctcgtgcagccccactgtccacggagatggggcaagggagaaaccgaggttggaggagacccttggcaggaactgggaggcgggaggagggaggctactggaaataggtgggagtgtatggtggggggtgagaattggggaccttcttgcagcttaagtaatttgggggaaagttttcaaagggggttggggttgggggcggtaagtcgagcagcaaaggcgtttagggggcagcaccgggagtcgttttcatctccagcgtttccaaaatagaaatagaaggggaggggagggagggggcggggagtgaccgctcaggtcagactgcaataacttatttatttatttatttttaagaaaagttatgagctgtggttgcaggcaggagggaagatggagttgtgtgcagaggaagccgagtggtctgggtcgccgcctcctccccgccgacctgacagtttggcggatttcactgacccctctccctctttttctctgtgccccccgccccgccccgagcagacttctgaacgagagcgagaagcggcccttcgtggaggaggcggagcggctgcgcgtgcagcacaagaaggaccacccggattacaagtaccagccgcggcggaggaagtcggtgaagaacgggcaggcggaggcagaggaggccacggagcagacgcacatctcccccaacgccatcttcaaggcgctgcaggccgactcgccacactcctcctccggcatgagcgaggtgcactcccccggcgagcactcgggtgagtcgcccctcgaccccaccggacaagctatctccgtcccgcctggcacaccccctgccctccgcctgggagattcttcgtggggactttatgcttcccgggagggacacactgccctttgcgcccgtcccgctcccctctctacccagagcctaagaggcatccaaacaacacacacacaaacacacacaccccaactcaatcccagcatccgaagagattaacttttttattgggaggtaaaatgcccttaacagccttacaagacctctcccttcttctctgctcccccaccccaaaagcacacacagggctcttacacaagtagcaattaggtcttccggaccctccgggccccagaccctcccctgataaaagggggctgtccagtgtgtaccggcgggttaatcattgggcgacttatctccggtgcagcgcgcctcttgcgcgggtgcgggcccttattacactttagcagcgagggagggtccccggagggtgcctaagactagggcgtctgcacagcccttgttgattttctcgtgcttgttcttttattgtccacagggcaatcccagggcccaccgaccccacccaccacccccaaaaccgacgtgcagccgggcaaggctgacctgaagcgagaggggcgccccttgccagaggggggcagacagccccctatcgacttccgcgacgtggacatcggcgagctgagcagcgacgtcatctccaacatcgagaccttcgatgtcaacgagtttgaccagtacctgccgcccaacggccacccgggggtgccggccacgcacggccaggtcacctacacgggcagctacggcatcagcagcaccgcggccaccccggcgagcgcgggccacgtgtggatgtccaagcagcaggcgccgccgccacccccgcagcagcccccacaggccccgccggccccgcaggcgcccccgcagccgcaggcggcgcccccacagcagccggcggcacccccgcagcagccacaggcgcacacgctgaccacgctgagcagcgagccgggccagtcccagcgaacgcacatcaagacggagcagctgagccccagccactacagcgagcagcagcagcactcgccccaacagatcgcctacagccccttcaacctcccacactacagcccctcctacccgcccatcacccgctcacagtacgactacaccgaccaccagaactccagctcctactacagccacgcggcaggccagggcaccggcctctactccaccttcacctacatgaaccccgctcagcgccccatgtacacccccatcgccgacacctctggggtcccttccatcccgcagacccacagcccccagcactgggaacaacccgtctacacacagctcactcgaccttgaggaggcctcccacgaagggcgaagatggccgagatgatcctaaaaataaccgaagaaagagaggaccaaccagaattccctttggacatttgtgtttttttgtttttttattttgttttgttttttcttcttcttcttcttccttaaagacatttaagctaaaggcaactcgtacccaaatttccaagacacaaacatgacctatccaagcgcattacccacttgtggccaatcagtggccaggccaaccttggctaaatggagcagcgaaatcaacgagaaactggactttttaaaccctcttcagagcaagcgtggaggatgatggagaatcgtgtgatcagtgtgctaaatctctctgcctgtttggactttgtaattatttttttagcagtaattaaagaaaaaagtcctctgtgaggaatattctctattttaaatatttttagtatgtactgtgtatgattcattaccattttgaggggatttatacatatttttagataaaattaaatgctcttatttttccaacagctaaactactcttagttgaacagtgtgccctagcttttcttgcaaccagagtatttttgtacagatttgctttctcttacaaaaagaaaaaaaaaatcctgttgtattaacatttaaaaacagaattgtgttatgtgatcagttttgggggttaactttgcttaattcctcaggctttgcgatttaaggaggagctgccttaaaaaaaaataaaggccttattttgcaattatgggagtaaacaatagtctagagaagcatttggtaagctttatcatatatatattttttaaagaagagaaaaacaccttgagccttaaaacggtgctgctgggaaacatttgcactcttttagtgcatttcctcctgcctttgcttgttcactgcagtcttaagaaagaggtaaaaggcaagcaaaggagatgaaatctgttctgggaatgtttcagcagccaataagtgcccgagcacactgcccccggttgcctgcctgggccccatgtggaaggcagatgcctgctcgctctgtcacctgtgcctctcagaacaccagcagttaaccttcaagacattccacttgctaaaattatttattttgtaaggagaggttttaattaaaacaaaaaaaaattcttttttttttttttttccaattttaccttctttaaaataggttgttggagctttcctcaaagggtatggtcatctgttgttaaattatgttcttaactgtaaccagtttttttttatttatctctttaatctttttttattattaaaagcaagtttctttgtattcctcaccctagatttgtataaatgcctttttgtccatcccttttttctttgttgtttttgttgaaaacaaactggaaacttgtttctttttttgtataaatgagagattgcaaatgtagtgtatcactgagtcatttgcagtgttttctgccacagacctttgggctgccttatattgtgtgtgtgtgtgggtgtgtgtgtgttttgacacaaaaacaatgcaagcatgtgtcatccatatttctctgcatcttctcttggagtgagggaggctacctggaggggatcagcccactgacagaccttaatcttaattactgctgtggctagagagtttgaggattgctttttaaaaaagacagcaaacttttttttttatttaaaaaaagatatattaacagttttagaagtcagtagaataaaatcttaaagcactcataatatggcatccttcaatttctgtataaaagcagatctttttaaaaagatacttctgtaacttaagaaacctggcatttaaatcatattttgtctttaggtaaaagctttggtttgtgttcgtgttttgtttgtttcacttgtttccctcccagccccaaaccttttgttctctccgtgaaacttacctttccctttttctttctcttttttttttttgtatattattgtttacaataaatatacattgcattaaaaagaaa

SEQ ID NO: 36291 - DNA, 5401 bp, Homo sapiens; identical to SEQ ID NO: 36290

SEQ ID NO: 36292 - DNA, 31619 bp, Homo sapiens
ggaaggtgaacagtgtggcccgccatgttcttctccgcggcgctccgggcccgggcggctggcctcaccgcccactgggtaaggaggctcaagctgagcccggcgctgccgccgcccttctcttgctctccgtgtctcccttagttttgggcgcaggagagccctgggctctgcacgggcctgcaggcggcggcaaggacactgcggccttagccctcttagggaggccgctgcagccccaccgtgagaagccccgagggagggttgccatactgggaagtgtactcctagtttggtcgaggaggacagaaaagaggggctgcttggtgatatatatatatatgtttgtttgtttttgctgttttgctgtagcgcagaatctaggcctgctctggccagatcagtttcgaagaccgtcgctccgaaggaggcacctctcgtttcaagcctagtgacctcgatgcttttaggttgcagcatactggagagctctggcttgcttcgtgaaggcttagggagaacttcattagggctggaaaagggtggccaatgtttgatttactgcagttgtgctttgcatatcggaaatgctggctaaataaacggtatcaaactaactctgaaagaacggcgccgcaaataacagcacccaattaaagaaccacaggattttagagattaaatgatctttttgagatccaagtacatctcatggtaggcaaggaaattgaattgcagagaagttgaaacactccttcacgttaatctaaaaatgcagatttccagaaatgtcgattataacaacagggcctgttacacaagtaatactggaaagaagccttagttttgtttgttttctaagagtgaaataggttaagtcagttctcagcaagagggagctagtgtatattcattgagaatgaattcagggctttagagttagactcgagtttggatgttagcttaactgccttttgtggctctatgactttgtgctgttaatcttcctcagtttcttcagttgtaaaatgggaatattcctttttgcagagttcagtctttcaataaacatttgaagtcttactgtacgtcatgcactgctgagctctagttaacagtgtggataataatgatagtcatttgataactgttttctgtatgccaagcaccgagttaaatatctacattccacatctcatttttgaggctggtattactttttcctcatattacagataaggaaaagatttagacagttcccgttcttttggaattgatagtctcatgtaagaggaactttaaggttgagacaatgtaaaagtacagtgttagagagatgaatagggtcatccaatgtggtttcaaggtgcataagatttttcctgaaggtaatactaacagattgggcatggggtccgagggtattctaggtggaaaggacaacttaaagtcttgttggcaagaaaaagatcggtatgtatgagaagccaccctctgctgttggaggtaaggtgtgttcccaaatgaaataagggagagacaggggccagatattggagctcctggcgtgccatactaaagaatttgattttagaggccgtcaggagtcagtgaaaggttttaaagtagaggaataagatgtggtttctgttttggataggtcactggataggactgagggtggaatgggtttgatttggacccagaaacagggagactaagtagataagaggctcttgcagaatgctaggtgaaagatgatgaggatcagacatggtagaaagaaaagaaattagagtgcttgtagattttgtttcttttgtttttgaggcaaaggggctagaagtataaattgaaaagcagttttaatgaaaaagaacaacttgaggtagtggaggaccattgtaatccaggtttaatgtttctggaactctctttctctccctccctccttccttccttctctctctccatccgtctccccttctccctcccccttccaccctccccccttttttaaacaaatagtacctgatatgcactatgtacacaataaatatttgagttgatgaataagtttaatttttattacacacgtcatacgtgtgtagaaaaaacaatactgagactagcaagtagagtaagctcaaaaaataaaaatcatccattgtcttgtcaacctggaaattaccattgttaacattttgatgtctacacataacagaccttacagacaatttgtttctacaaaaatggaaaggtatttatactgtttggtagcctgctcttttgtaatgtattctgaacagctttccttatcagtagacatttctatactgtcattttaatgctacatagcattccattgtgaggatgttctattacttatacaaccaggcccttctaacctttcacaagtagtgagatttcacattaaacctagcaagtatcaagaaaagtacaagaaaagtctacctaagttcctttcctaaatgagaaacctttaaagattatttacgctttcaaagaaattgcctaatctaatttctgctttgctagctgccattctcttgacgaggcttttcagctcatcattgcttaaaatatggctagaattaagtattagtttgtgtgatcttgagccatcttaatctctttgagcctcatttttcttttctgtaaactgagataatacctcataggtgattgtagtaattgactaaaagttataaattatggagtaatagataatcagaataagtttattcccttcttcagtaattgcccatggtttttctgtaatgttgatgccactttagaacttatcactgcctcattcccaagctgctattgtagtttcgaaggtgagagggttgtggtggcattttcaattacagatgctcctttacttacaatgagatgacatcctgattaaacccattgtaaattgaaagtatgtaaatttcagtttacagtggggttatctggacttaatcgaggagcatgctgaatacttatcattttcatacagttgtaaagttgggaatttgcaagacaggcaattgtaagtcagcgacccatctgtattgtgtattttttcattcatcgaggatattttcctttatgtctttaggcatgattatagctgtcctgaagtttgtgtctggtaatcttagttgatttttttcttgaaaatgtgttttccttttttgtttgtttcccatatgttgaacaattttggattgtatgctgaattttgtgaatgatacgttgtagaggctctagatcctgttttattcctccaaatagtgtgttttgttgttgctatccatatcccttgtgggcagcagatcaaatattggttccgttcttttagctaggctccttggagtctgcagcatgtacatgcatggttcagggttcagccagagatttccgtagaatttatatacagaatgtatagggctccctccccctttctggctcttccttttctaggatttcccactttaccatgtctgttgttccaaactctcactgaggcctgccttcaggctaaaagatgtgaagaaaaaacaaaaacctcattggttttttatgaatgtagactccccttctgtgtctgcctgtttggttgttccccagtgccttcagaaagcttttgtttttataaaatattttgtccagagtttatagttattattcagtggtttgccctgacagtgtctacttagccatactagaagtatgccatcttgtgtggtggtacttttccttccaaattttaagttttgtacaatgaaatgttttccccattccattagagattcttaaacttgattttgtaatgtcccagtgtatctccattgtgactcaaaggactctaaagaagttaatgtaggaaaaacaccccaaaacatttagttttttattcctgctgtaacaaatttccacaaaactttgtggcataaaacattatatttttaaccttacagttctgtaggttaaaagtgacacaggtctcagtgggctaaaattaaagtgtagcccgagcttcattcctttttggaggctctagaggtgaatgtcttttcttggcttttccagcttctagaggctgctcttggccccttctttcatctccaaagccagcaaaggcaagtctagttcttatatcacatcacttcgaccctcctggcattcatcacatatccttccttgcctcttggtaagaaccctgtgattgatgacattgggcccacctagataatccaggataatctccctattttaaggtcggctgattagcagccttaattctcttttgttgtgtaaactaatactcacaggtttccaggattaggatgtggttatctttgagagaccattattctgcctgccatagccataaattagcagtttaaggagagagagaatgaacaaactttagtttatgcagtgaggttcagtaggccactattgcaaactgcagactcggatctttttattagagacttgaactcagtttccatttcaaagtaataaaaagttgactttcctttctctttgggcactgtttagtaccttagtgctcagaacattgagtaataaattacaggtctgttgcccatgctgtataacctattgagtgacagtcagtctgattttccaatgaggaaccttgtcactagtttttgaatcagttcaggaagcatgttataaatcagttgtaggaaatgtctttcattacaaaacatcaaagacagtttacacacattttggttagggggaaggtggctttatctgtcggatattttgctaggtgttaccccattttatgtgtgagatatatgaagattgctggacaaataaatgcccaagatcacacagtagtaagggctgggtttattcgcaagtcctgttttgttttgtttttaatctacctttctgaagttgctcaaacaattgaagttgctaagggaaatcactatgtatggtgaagatttaaatttaataggcactctaataataaaaggtgtaccagtgtaagcagactagggaaatgatttcactttgcttagggaaaagagatggaggtttaggggctttaaaggggtaggagatggaggtttaggggctttaaaggggtaagaggaggaggttaaccttggtcatgatggatgagtggaaggtgtaagttgagataatgctgtaggtatagctagctacatatacaaagacactgaagtgcatgaggtgagactgaaccccgggtccactggatgggcatttcatttctataaattattcttgtccttagaacaattggttgttgcttatatccatgtgggattttagatatctaaagaatgttttctttaatatatggtcaagatggctggaatcattaatgctgttatcttaatctgtaatgcacagtgcctgtaatacctgggctcttcatgcagcttttctataatataaaatttagccaaattacatttgttaattctctcatagtatggtaaaaattacttacattttaacctgaattaacatttttaggtaaattactgatggaactttatttggaggatgtttgtaaaagtcctcctatttctatctgaaaatacagcaaaacttaaattttagtggttaaggcatgtactgaagtcaggaaaatctgtatgtggcatttcatttatttagctgtgtgagctagggaaagtttttcccccttctttgagccttaattttctcacctgtaaaacaagataataatacctacttggtaggcttgctgagaggaataaatggattatagtgtagatttgtagtttatagcatgagatctgacatagagtaagcatttgtatttatgattatccttgaaatagatttcacaattattaacccagcatcaactttgttaaaataaaatgcactgaaaaacttttgtttttcatggaatttttttttttttttttttgagacagagtcttactctgttgcccaggctggagttcagtggcgtgattttggctcactgcaacctctgcctcccgggttcaagcgattctcctgcctcagcctcccaagtagctgggattaaaggtgcgtgccaccacacccggctaatttttgtacttttagtagagatggggtttcaccatgttggctaggctggtctcaaactcctgacctccagtgatccacctgcctcggctctcaaagtgctgggattacaggcatgagccactgcacccagcctcaaggattttttttaaatgtaaaattacctagtctgaatgaatgtattgcagaccctgacttttttaggaggtttcagttttcttgcttgagctggcaataggggaggctgtaggtaacaagtcagcagatgttgtgaacagtgagaggaaggcacggagggacctcagaccactttggattcactagagatgtttcatgtgtgcactgtgactcttgcacaggcaaatagatatcttggtggatttaatctgtaaatattagggatcatctaaaaggtatattccttgccttagttggcctctaataaaggaaaaaagaagggtttttgaattgcctgaccttagtcttgtctttctgactaattagattactgcttctgtcagttttgtcttacagcttcttagtctcttattaacttctcttagctggatgcatttataatgcaaatgtctgatagaactgaaaagtgagcttcgttggatggtagtattgtttgaacaacagaagaaattcagaaaaagagtagagcccatgaaaagacaattaaggaatcctattggggagaatataaaactttaatttttgtcattttgagctattggtattgccagtgacagtaaaagggaaaggctggtagaaagagcacagggcccttagattgaaagagcctgggctcaaaatccaggtctgtcactaattgtgcggtatggggcaagttactgtctttgagcctgagtttctctaaatgtaaaatggaaataatgactcactacagattttttaggaatcgacgaaaaaaagtatgtagaagagcttaacacagaggcactcaagtttacttgactccaacgaaaaggcagtcactgttttggcctgcttaaatcttttcttttccttctgaaacactgaaaaaaaaataagctagaattcaaacccactgttaattttgagctgtatattaggttatgatcttatttacttaaaaaagttacttggttgcatgcttttcttcttaaaaaaaggaagttacttggattttcaattggactcaattggaatttcttgaggtatagacatttcagagtctaatgagaagctagattctagagaaaagactagactgtactcaaagaagggggtgggtgggaactcagcttattctttgaatcattccagcctagctaggttgttttttccagttttaagcctggtcctggaatgcctctttatttcaaagtgaaacaaaattgaaatggcccagtaagtagtgtaaagatgttaatgagaacttttaatgttttattcctttattgaaagtgtctgacgtagacattacaatgaatgtaaaataggtgatattctttaaacacaccaaaaaaacaattttcaaagccattttcaggccacctgtaacttgatagggatgaataacagtttatgccagttgaaaaaaaccgagagctaagatttatcagtttatcttcactatttagtttgtttctttctttattgtttgtttacttactacttttttgagacagggtctcactctgtctcccaggcttgggtgcagtgcatgatcatggctcgctgcaacctcaacctcttgggcgcaagcgatgctcccacctcagcctctcaagtggctgggactacaggcatgtgccaccatgcctggctaacttttgtattttttgtagagacagggtttcaccatgttgcccacgctgatatcaaacccctggcttcaagcgatctatggggcttggctttccaaagttctgggattatgggtgtgagccaccgtgtctggccagcttcttttattttataaacattatctcagcccttcttatacaactttgaagaggtcgacttcggactttgaaattaagttgctcaaatgttatgctagtgtgtatacgttcaggttttttgcaggaatagaagagaagggtggcaaggattaaaaaaagattaaataacttgcatctttctctcttaacaggagcattgtaagccaaggaggcagggcttttcatttcttatctgcctgcctgtatatatggaggcctgattttcttccttaaactccttggtttcttagacctactatgttcttttaaagctttgatgtcatcaaacagtcaggtggctaataataaggtcatggcctttgtaatcatctggccctaggatctaacataatttctgccaataattagtgatgtgacctaaccttgagaagttttcataactcatttaaatttctgggaataatacccaccttgcaggaaactttaagaattaaataatgtgtaaaaagcttagtgcctgacacatagtacttctaataataatagctaatgatagccaacactaatacagtacttaccatctgccaagcagaatattaagcactttacatgaagtacatcttttttttttccccccgagacagagtctcactctgttgcccaggctggagtgctgtggcacgagctgggctcactgcaacctctgcatcctgagttcaagcgattctcctgcctcagcctcctggttagctgggattacaggcacgtgccaccacgcccagctaatttttgtatttttagtagggatggggtctcatcatgttggctaggctggtctcgaactcatgacctcaggtgatccgtccgcctcagcctcctaaagtgatgggattacaggcatgagctactgtgcccggcctgaagtacatcttttaatgctctcaagaaccctatgaagtacatgccgttatttttctgtttttataaatgaggaaacaggctctagagctgagcttttagccattttgctatattgtctctccatacataggatatttatggaatattagataacagtgatacatcccaccttcagaggtgctagaatgtggaaaatgtgtttattagaaatgatgaaattgacatttcatatactagaacgtgtttggtgttggtcatcttttacaccacactcagcatcagaagggtttttttttttttttttttgatagagaatctcgctctgtcgcccaggcaggaatgcagtggctcgatctcagctcactgcaacctccacctcctgggttcaagcaattctcctgtctcagcctcccaagtagctgggactacaggtgtgcgccaccacacgcggtgaatttttgtatttttagtagagatggggtttcaccatattggccaggctgatctcgaactcctgactttgtgatctgcccaccttggcctcccaaagtgctgggtttacagacgtgagccactgcgcctggccagaaggatggtacttttaaaattagtttggtgatattagacaggatgttttggattgagaaaaagggatcagccagaagacttacagtaatgcacagacatgaaataatgtctgaaatagtggtgatagtaagacagggaaagaactaaagacttcattgggtttttttgtttgtttttgttttgagacagggtctcactttgtcacccagactggagtgcagtggtgtgatctcagctcactgcaaccttcacctcccaggttcaggcgattctcccacctcagcctcctgagtagctgggactacaggtgtgcgccaccacacccggccaatttttgtattttttggtagagatgcagtttcaccacgttggccaggctggtcttgaactcctgacctcaagtgatacgcttgccttggcctcccaaagtgctgggattacaggcatgagccactgtacccggcccttcattggtttttaaaagtttaaatgtaatacatataatggcaaaaaattcaaacagtaagcaaggctacatattatagtatatatacataacagtacagagtagggatacaagaatatgtattatgataaaaaatatatgttgcatatattatatatgttaacccatgatacatcccaccttctaactttccacattctaacacctctgaaagtgggatgtatcactgttatctaatattccataaatactctacatatggagagacaatacaacaaaacagttaaaagctcagctccagagcctgtttcctcatttgtaaaaacagaataataacagtatgtacttcataggtacataggtacttgataggtatttaatgcttcttgagagcattaagagatgtatttcatggaaagtgtttaatattctgcctggcagtaaagactaaattttcttcccactccagatcttgattcctctccttagagacagcagctgttactggtttcttttatgatgtctctgttgagatattttgatagaaaaagcagtaaaaaatggaaactggcacatttctagattttattgactttcttaagaactttgacagatctgaaattttaccccatttgtaagctaacaagttaacctgcctcagtttcatggatgctggcaggaggcagcatcctgggtcagtaggcagcatgaacttcatgtcagttccctttgacattcatatctcacggtaagggaggagaccacccctcatattgtcttatgcccaatttctgcctccaaaaaaagaagaagtaaaaactaaaaggcagaaatgaaatccacaagcagatagcccggtgccacaccctgggcctggtaaagatcaacccctgacctaattggttatttatagattacagacattgtatagaaaagcactgtgaaaatccctgtcctgttctgttccattctaccccctgcttgctcaatcgatcacgaccctcccaaacagacccccttagagttgtgagcccctaaaagggacaggaattgctcacttggggagctcggttgttggagacaagagtcttgccgaagctcccggctgaataaagcccttccttctcagtgtctgaggggttttgtctgtggcttgtcctgctacaatgggagtgacatggaacagcctaggtgagtgctgtgcatcactgctaagggaccttgagcttgggaaaccctgtctgtaagaaaactcactcaacttttgccccaggagaaggtattttatacaaaaataatagaaaagatggtcttaaacaaaagctgttcagtgctgctgctcaccaaatgcacaaacctaagacccatggaaatctttctaccagcctatttcttcctccttccccactttctttaactaaaagagaaatttatgaattaatttcagtggagaagtagatggttttttaaccatcaaatacattataattttactagaaaaagtataagcattatacatatggatataaagaaaaaataattatgtgcaaatgcaagaatattggcagtatgttgtgtttgacagtaactctttgataaagtcaactaacagcacaattttttaaaaataggtgtagttttaaaatgcagttgtttggatcttttttttttttttttttttagttattaaatgttttatccttgtgtcagttaagcaggtgataatgctttacaggttatatagtactttcagagaaactttacttaaatctcaaaatagtccaataagaagataaccctgttttataggtacagaaattgaggcttaaaaaaaaattaagtgagttgttctaggtcagatgttagtaagtggcagaatggtaatctaaacccaaggcctcaacaactacaaaaaatctgaaagtctgtttttttcctagagtttagctactttatcctgacccttctcaatcagtagtctgtcttcaacgatttggacttcaaaccacttttagaaatatgtctgtgaactcatgtgcgtatccagagctttacaagtcagcaagagaatgcctcagaatagattttccaatatgtagcaacataagcctaaagaataattttcaagattatctctatatttttattttaagtaaaagtacatgacagatcctggattaatgagaaagggatcaaatattaatccaaaatggaagctattttaatttagacatttggtggtatttaatttgatatacaaggaggttagaaggagaaataggttttacaatagagataagtttttcttatacctgctgagtgttttattttaagtaggatttttttggccagttaatccatgctaataggaaatttggaaaatagagaaaaatataaaaaatgtaaaataagagtcccttatttcattaacatcgtaataagagataagcacttttaattatttatggccttctagtcttttaatcagtgtctgtatttaatgtaattgggatgataatttatgcatttttgttttttttgttttgtttaaccctgattccagtttctacatgattatttttacgacatatttttgttagctacataacgttctagtgtcagaattattagtatttagttaaaacctgctcagattgggtttttaggttgtgtttttgctgcaataaacataataggaacaacatgttttcatgtaaagctttatcctcattttgtactgcaggaaaaatacctaggttagaattactaaattaaaaaatggacacttggggccaggcgcagtggcttacgcctgtaattccaccactttggggagctgaggcgggcagatcacttgacatcgagagttcaagaccagcctgaccaacatggagaaaccccgtctctactaaaaatacaaaaaattatccagacgtagtggcacatgcctgtaatctcagctacttgggaggctgaggtaggagaatcgcttgaacccgggaggcagaggttgtggtgagccgagatcatgccattgaactccagcctgggcaacaagagcgaaactccgtctccaaaaaaaaaaaaagacacttatttaggctttccatatatcatggtaatttgctttctaaaaggctatatgaatttttaagtgtgcttgtttctctatatgctcaacagaatggaatgctatcttaaaagaaaaaagatacttggtagtttgataactagtaatgttattttaagttgtatgtttttagttactagtaagcagtttgaattctgtgaaacttttgttcatgatctttactcattttttaagtgcatttatgatctcttcaggctattagcctcttgtcatcaaatgtgtgtaagatttaagactcatcactgtcaagttaatggatgagttctcagaggcaaaggctttatagagaaaagaagataggagtgtgaactgagccctgaggacagcctgcaaggagtggataaaaagccaataaacagaaaatgttagtgttcagaaattaggagaagactgaatactttccctactcttaaaattaatccttttattataagtatacagtcttttctctcagaatttagttaagtaactcactgatgttactcaaaaattgttactcgattaaaaaaattttctgagctaagatgacagtgactgtcttctaaattttagtttcagttaatttttcaaaacaaaaccaacacaatcaaagcccccttgtgcacctctgactgtatccctccctgccttccaattatcctgaaattgatatttatcactcccatcttttgtacgtgtgtctcacatcctgtaccttagtcttttcttgttaattaaagcagatgttccatgtaaacttatttattaatatttcttcaactgaaatatcatttggacctagggtaaagttaaatatactattgtgttatattactccgtttactttcttctatgtttgcctttgaattgtccaactctttgctagttccatgcttggtttaacccagccagtgttctgccgtctgtggttagtagaactcagaaattggaggaatccagaacagtagttgaaatacttgggggcgggggacagggtaggagtggagggtaggagcaagagggcaaagagaaatgaaatgcagctgagagaataatcagattccttccaaagcaactgaacattgtcagtccgcatagcatcataaatagctttctgaaactacttttttttttttttttgagacggagccttgctctgctgctcaggctggagtgcggtggcgcgatctcggctcactgcaacctctgcctcccaggttcaggcgattctcctgcctaagcctcccgagtagctgggactaccagcgtgcgccaccacgcccagctaatttttgtgttcttagtagagatggggttttaccatgttggccaggatggtctcgatctcttgacctcgtgatctccttgccttagcctcccaaagtgctgggattacaggcatgaaccaccacacccggccagaaactactttttacggctggagtttcagaactaatttagtaaaggattgaaaaggaaggaggatacagttgactcatttgtacagagtatatgactcatttgtacagaatgaaaacatgtttatgaaggttcacactaagtgaaagctggcatccaagttgattcagacaaaagtgaaagtcaagaagttaatagtacattaattctccaaatgcatgccagcagagcgtggcaggaaggtacacaagtcagcagatctgggttgtcctggttctcctattgactcgtgtgtgtgatgttaggtgggtgaatcttggctttgaatctccatttgtaaaataactctcctgaaatagagatggatagggtagaataccatatttcttaagatcttttataagttgattccattgttgtaaattatgaatcctaaagtatttctttatgaaaaattttttaaggctatgatttactaaactttcttaaaattttaaattttagggaagacatgtaaggaatttgcataagacagttatgcaaaatggagctggaggagctttatttgtggtaagtaattacttagatttctttggaaagaaaagacttggaaattggggtaaatccattgtaaaaatccaaaatatcttaaataccattgtctttgatatatgatggtcatcgtgagaatttacatacagctaattgaatttactacatttcaaaagatgttggttccagttgaacctcatgagtttaaattagtatcaggaaaactctgggaataagaatttatttccagtgaaattactgtgtgagccctaacctgattctcatcacactttgggttctcagtcatgttggcttactgagagtttggagattgtaacttgttgaatcccaaaatgacactagtttgaaactcatggattttagtaatgtagtaactagattagcagctggtctttatatttttagtttccggagttttaactataaatagaagtctgtgaactccccagattagttgcacaatttggaaaggataagatattatatctcccttttctgacaaggtgctgttttcagggattaatctagtataaaggcaatatagtggacttgtgtgatgatttagagttagtggtgtaagaagtagcttcctgctatatatcaagcatcaaattggccacatatttgagatcattgtccagagtgtctgttttctttcctcttttggcttatgtcctttaaaaagcagaactccgagagttaacatatcaagagattcatttctgtattcaccacacatacataacattaattgatcgtaagtgttaatctcagtgtgactcatttgatttcctgttgacatgccatttcttgtcagtttttgaagagggcctgcttctgctcttttaagaagagataaagcttcttgctgttggctattatggaaaacgtgggaaagagatggtgctgtttttttttttttttttttttttttaagatggtccttttgtaccctcctaaagtaatgggtcttaacccttttggatcccagatccctttgacaatctgataaccttgcttttgggaaaatacacatatgttcacatttaaaattttgtgttttaatttcataaaggcttccaataattggtaatgttttggtaattctatcagaagatcttactctctaatgaagctggataacactttttgttgtttgggtttttttggtcctaaaggtacttctcttattctttaaatggtcctttgtaaatttttaaattctgctaactttactttggtaatcatacttatcaaatgtgtgtttagacattctttttgatggaaggatagggtggtatatatcatgttggaattaaaatggagagattaaacaataagtaatagtatagtaatgtacagtgtcattcacacttgagagaatttggataagtctgaaaaactgtttttgttgtgtagcacagagatactcctgagaataaccctgatactccatttgatttcacaccagaaaactataaggtatggctaaattaacattataattaatttaccaaataggtaatattttctagatgtataaaatgatgttctttcttttatacagaggatagaggcaattgtaaaaaactatccagaaggccataaagcagcagctgttcttccagtcctggatttagcccaaaggcagaatgggtggttgcccatctctgctatgaacaaggtactggattcatttttgccttagttctaaaagagaagagattgtgtatgataatttccttttatagaaattactctgatcatctccagtgtcagaatctaggattttggagccctttagccatttgtatgtttccttgaattgtctttgtgtttttgttcattcccttaatgcatagaggtgatttctaaccttgcaggaaataaggaaggcattatggtgaaagagggtatgtgtttttttttttccttttgaaggaaatggtcaaagataaaagattccaaatgtgtataacttagtgtcaagatattctgaaaattaatgtaatatttaaacactagaattacagaaaagaagatctgctcactagtatgaaaatttttaatattttacatctttggctgtaggctgtaagaaaaatctgtataataggtgatatttatacaatttgattatgctactttggaatcaacgacctatagaaatgctatggatgacccattttattcaaagttactctattcatataatattcatttttcctaatagttttgagcagtaatacaaatttcaagtttattcgtatcctgttaatacaaataactacatttgtgtggtgatgtattacagcatatcatttataaagtgccatacacaaaccacatactatttgattctgatgagaatcacataaccattaagctgtgttatataatggaaaatatttttgacttagaactaagacacctgatttttctctgaacttcctcattggcaatgaaagttttgaaccaggtagacctcttctaattattaagttatgatttctgagcggtagtgctaggactgaattcatttctaaatcagtgcattttctacttgactgactataacagagattttgttgtacttcattcttaccactttctaaacttaatttggttataactcttaggctagacaatcatctttctgagagaataggaatgtcctcaatttatctaatagaatcctaaatgcaaattttagatttagtttattgatattttattttatttgcattgtatagtactataacactggtttttccctatgaaaaatattataaagcaagtttagtgagttactatcctgagtaaacataggtggttatttcttcgataaattatgtatttcttgggaagttacttaacatttttttaaattaaaatagccaactttataatgatttaggtatatgtttctaattataatgttattattttgaaaaaatcatatttttagtaatggtaagcctgttggaaatcttgctgagtggcacgttagcagagcaaaataaaaataaataagaaactgaaagtgaaaacatttaaaaaataagacaggcatggtggtgcatgcctgtagacccaggtactcaggatgttgatgtgggaggattgcttgagcttaagaccagcctgggcaagatggtgagaccctatctcttaaaaaatatgtatttatatattgtcctattatatttagggttggatttgtgtgggggaaaggcaggaagtgtagggtatagggaatagactcaagattctttgcactttacatttgggacttttattttaatgttactgcccctccccccaacccatgaaacacctaaccttacaacaaaaaatatccagaagcttaataattatttatttaaccgtcactaaggtgtagggagatgtgcagaattccaggaaggagtcttttcctaattagacagtcagagcctcattccagatttattattcctttggtagggttccagcatgtatattttgatagagagctccccagattcagggatacgtccttgattcagaactgccgaatgaaatagcacaattactttatctgtcacaagtgagccatgattagatgtcttttgagaatatatttcctttagaattcctaatatgagaaagttaacatacttgtctgaaatgcccgctcttcttttatattagaatatggatatatctataatttttaagaatgccagatagtaagtcttaatgataataggtcacctagaaagttgtagacagaattataaatcacgatagacaaggaccagccctggcaaacagctagaaatcctcgttttccctaacagacttgccctaagaaaagatgctgagttagtgatccccttagtcctgaacaccagaatgtcaaaacaattgttttctattaatgtcttgacgtgaagggttagaaagtactagactatatgattcaactttcaaaagagtattgtgatatgaaatagaagtagtgtgctggattctgggagaggagtgtgtgattgtgtatgataatatgtgtatacatatatgtagagatataaaattttgagtttacatatttaaaatatgggccaatagtgagctttgattttcaacctttttttctgttgctgtaccatttgtatgtaggctgtttggaaaaaattggtgagagtttaaaaaatctaattgcttcttttattggggtttggccatcaattttttgccatttagacagattataaaatgtgagttgacatgatcaaagtagaaattcttaatagtgaaatacttaaagatttagagaaaaagaatatccttttacagaggtgagaagtagggtagaaggaggaagtgctgttaactccattaactttcgggctctgtatggtttaagtgtaagtacattgtctgcaaaaattgaagagtttatatctcccagttatccaagacaagtatgttttctgctcttgaagaacttttctgtttttaccaaattgagacaatattgaaattatactttgtacaacataattaaagctccattactaacactgtaattatcttatttttaaatgtcctaatattttaggttgcagaagttttacaagtacctccaatgagagtatatgaagtagcaactttttatacaatgtataatcgaaagccagttggaaagtatcacattcaggtctgcactactacaccctgcatgcttcgaaactctgacagcatactggaggccattcagaaaaagcttggtagggaatacatgatatttgtaacactgataaaaagtagaattgtctctctagatttggtacatttctatctaaaatttccaacttctgccatcttattggatctgtacttacctagtaatattttgtgttactgtgtttccacatctttatttcttcctatttggtattcttcctcagttcttagtgttaaagctgagtttttaattttttcttttttaatcagtatgtttgaaatgcttgtagaagttataaaatattcgttgtttagaagattgtttcacttagaaaattgtttcacttactattctatgacagcatgtggtatattaaaaagtgacccattattgtctttatattcttctaaagaagtcatggaacaaataagatacaagcatagtaagaatgctttgggaagggaaatttgaaacagatgttattacagtagcatttgaaaagtaaattagcattttaaaagtaaatgggcattttcccctacaaaactgccattgctacacttctaactatatatgtcaaatgaagtaatattttgttattgaatataatatgtgcatgttgtaaaaatagctgggtggtattgaaatatataaaacagctgaagttggctcaaacccccccacccccaacaccatcaaggtataaatcctgataacaattggatatattagttgtagattttatatcattttaattattaaatatataaatgtactacatgtatgcttgctttttagactttattttggctgtatttctacagcacaatatatatgtctgcctcattttttttttctgtttttttgagttgaggtctcactttgtcaccaggctggaatgcagtggctggatcatggctcactgcagcctccaattcctgggctcaagtgatcttctgcctcacccttccaagtagctgtagctatgggtgcatgctgccaagcccagctaattgatttttgtttgtttttgtagagaggggtcttgctatgttgcccaggctggtggttgtgaaatcctggcctcaagcaatcctcctaccttggcctcccaagtgctgggatcacaggtgtgagccaccatgcttggcctgcctcatttttcttttacaaacagttactttgatgtacacacacatctttgcgtacttgtcctgttgtatgctgagatagtttacaagaagtagaattgtagggtcagactttaccgtatttttcccaaatgccttccctaaatgtatgagactacccattttcttcacatcccttgataatctttgacgttaggagttttctgagtctttgccaaatctgataatgtgactgtgattttagtagtttaattattacaatcaaaatgaaaataatacagcctgatgcactgctgtataacagtaaacactggtgataagtcctctgaaatttgattgcttttaaaggaacaagtccactaaaaacttccttgaatgttaaaattacatagagttttttttttgttttttttttttgagagagtcttgctctgtcacccaggctggagtacagtagcacaatcatgactactgtaaaaaatttttactactgtaaaaaaatttttaatttttttgtagagctgtgtctccctatgttgcccagactggtctcaaattcctgggctcaagccatcctcgcaccacggcctcccaaggtgctgggattataggacggagccactccacctggcctaggatttttttctttttaaaaaacttttttttttttttttttggagatggagtcttgctctgttgcccaggctggagtgcagtggcgcaatctcggctcactgcaagctccgcctcctgggttcacgccactctcctgcctcagcctcccgagtaggtggcactacaggtgcccgccaccacacctggctaattttttgtatttttagtagagacggggtttcaccatgttagccaggatggtctagatctcctgacctcgtgatctgcccaccccagcctcccaaagtgctgggattacaggcgtgagccaccgcgcctggcctctttttaaaaaacttaatagtcttaaacttttaatatacctctataaaaattcttttttttttttttaaaccaaatgactattaaaatataacctggtccttagagtgtttatttgtatttttaggaataaaggttggggagactacacctgacaaacttttcactcttatagaagtggaatgtttaggggcctgtgtgaacgcaccaatggttcaaataaatgacaattactatgtgagtatttcaggtaatacaagttaaagttgtatgatgtcatatttaaaacattttaaatatttgattttgtgtccttagatgttggtttctgaattactcatttagaagaaatggttaccataaatatccaggttttaaaaaattctttaaacatttttgcatttaacttcagaagacaaattttaaaactttagattatgaaaaatttaataatttggatattaatacagaaaataatcctagtgtagccaactatcaggacttaactgagagtaatattttgccacattttacttcagatactatcatcatcatcatcatttgtagaaataagctacagatacaggtgaaatactccatcccaaatctttttctcttccttttatccccagagataaccattatcataaattgtgtctatatatgtatgcagctatactaatatgttgtatggctttttaaaaaaattttatagagatggtatcatacctctaagtactgcagctggatctcacaagttttgcagtcttttttgtttttgattgagcgtttctgttttttttttgtttttcattttgatttctttgacctgtaagtttctaaaaatgttcttaatatccatatatatggcgttttctagttatttctttaaaaattgcttgctaccctaattatatcaccgttttcattcaagataccttgttagctcatatttcttagaaatttgtttatggaaattttggagggactgtacttaaggtagattttcttttaagaagggatttgctttgtttctctcctgctcctggcagtactgctggccccagaaaagcccctctccttataccctaggcctctgttcctccggtgtgaaaggttccagactagcagttttctttgagggacagtttactcttataatgaggttaaagcttttggggaccttaactttgtgtagcttacatggtctcttgttagactctctggggctggctgggtcccttgcccctctaagctttgaaactctgaagcaaagtttgcttgatgttccactttctttctttggttttccttgagaatttggcgtctgggtacttatttcttgatttaaataggaattagacagtcaaggctttgtgtgaagcattgttaagtctaaatatagtagcctgtagatgggtttgtttgagataggtattctttcagttagcagtagttagatctttagggatagatactaggcatctacttaacaagttactacagctactttgtaccttactgtttcttcagtaatacagcatttatttagtatgtacgttgacactgttctactttatatattttctcattaatcctcaaaaacgtgctgaattaggtttacaaataaacaaacaaacttggggaggctgggtaacttgtccaagattactagctagtaagtgatagagccagaactcaaatgcaaatatgtttcaattcagagcaatattctgtattgcctcttcagctgcaggctcttgttgcatattatatttagcagtgtgtactatatataggagttacttaattgttgatgccttggtaactatcttgtgagctgagacagacaataaaatcactggcattagggatttacagatttcagccgtagaaagtaattttgtgccatgcgtggtggttcatacctgtaatcccagcactttgggaggctgaggtaggaggattgcttaagcccaggagttggagaccagcctgggcaacatagtgagaccttgtctctataaatatatcgatataaaagaaagtaatttaaatatgactattgttaattttttttccaggaggatttgacagctaaggatattgaagaaattattgatgagctcaaggctggcaaaatcccaaaaccagggccaaggtatgctttatttatatataggaagttttagtggctcacctaaattaatctttcagataaacttgatttaaaaaattttataccttaagttcataggaattggtaggagctttggatagtattatctatatgaatctcatctagagcaagaataattttttttctaaaaccctgtctgataatcatccgatacctgaatatttatagagaaggaaattttactacaaatagaaatctattccattatttaaaagttcatactgatagaagattgacccaaagaccatctccctctaatttctacctaaaaatccaattctgccctttgaatcaacaaaagataattttagtacctcttccaaatgacagctcttcaattacttgaaatagctaccctgtcttccccttatctttttctcagatggaatatccacaattgtttcattgtttttctcatatgacatagctttggtctccctctgtgggttttctagttggctagtgactatttaatgctttaatgtgatgcttaaactaatcatggttttttgtcttttttatttatttatattttgagacggagtctcactccgtcacccagtctggagtacagtggcgcagtggcacaatctcagctcagtgcaagctccacctcccaggtagaagtgattcccctgtctcagcctcccgagtagctgggattacaggtgccagccaccacgcccggctaattttttgtatttttagtagtgacggggtttcactgtattagccaggatggtctccgatctcctgacctcgtgatctgcccgcttcagactcccaaagtgctgggattacaggcatgagccactgtgcccggcctaatcatggtattttgagatacatactgagcagcacagagcattgtgggactgcctcctttgttccagacattatgcttgtaataattgtgcctaattatatcaactcctacttcagagacattacacaattaactgcacttcataatacctagatctttttctgttcactatttatccaggttgctcccgtcccatacctgtgttacattaattactttcctttcagttatgaacttggattttcacttttaaacaaacccttattccatgtatgtgttcaatcactcaaaattctctcttaatactagcaaatgttctcatggttttagtcataatccctcaaattttttgtttatgtatataaattttttcttccctcagcacatttggagtttttgatgtccatacggtattctaatgttttaaaacagctgtgatgtgctcttactcccgttttaaaatatttttcttaagctttattataaataacaattccctgaagtagaattactaagagggtatgagtggttctagagtttgctctctaaaactactaataataccctacttaatgagaaaatgaggtcagttcaggataacttaagtttagtaaatgctagctggcccctgttgaccattactttcttttctaagaaacgtatactgttcttaacaacctgagcctatagaattgaatttgcttaaagagtgttggcattttcttcctaattcctcactttcttgggtatacccctttttttaggaggtaaatcatttccctggtgaaaaatcattctcctttatggaggcaactgaagtaaaacctttagtcatctatcattacagtatctttcttagctagtgctcctatcccttacttattcttgctttaaatagacactgtccccccaaaaagtacaaatttcataatattttccacaagcttcatctgctttttaggattcaggtattttaaaataaattcatgctattcttaggtttgtacttcagcccataacttctttcaccttttgggtactctaaagaatatctcaagtgcagatttccttgtgaaatccacttgggttctttagatggcccctctcttctgattagatgttttgaattctatagtcataactttggtgttgggcttcctcccccccactcctcccctcacccgagatggagtcttgctctgtcacttaggctatagtgcagtggtgtgatctcgactcactgcaacttctgcctcccaggctcaagcgattctcctgcctcagtctcccgagcagctgggactataagaacgtgccaccaccatgcccagctaatttttgtatttttagtagagacggggttttaccatgttggccagggtggtctcgaactcctgacctcaagtgatctgcctgccttggcctcccaaagtgctgggattacaggcttgagccaccacgcccggccactttggcgtttagaatcttctgctttgcttcttgtgaactgtgggatctatggttcatattaatctagtattactctcctgccacacaaattgatacctgctttgtctactttgttatgtcacattacattaaatactcaacagtaatttttttcacaaatttttttgagtgcctgctgtgtgtcaggcattattttaggttatgaatacaattatgaacaagataaagttctcatatatcttctagtgatggagacagatgactagtgtaatatgtgagtgataaaaaggctacacaataaaatgtagcaggtgttaggggatagatagggagtaaatttagtgaggagaggccgcttagaggtggtaacatttgagccatgacctgaatgaagagctagagggaaccatgtaaagagctgaaggaacaatgttccagggaggggaaagaggatgtatcagggtcctggaagaaaagtaaggtaacagtatggctgcagtgaggtgctcaagcaagaaagcagtggaaggggtcagaggagataagggcccagataagtaatctgggctgaatcttaaatataataaaaactgttggaatgttttcagtagggaatggaatgagcaatcttaaaatactgccatagttgctatgtggagattagaatttagtagatatgtgggactaaggatttatgagtgattttcagctttttggcttgagcatctctgaggttcctttaccgaaaatagagaagatttgtggtagggcaagtttggggaagaaaagtcaaattttgttttagacatagtaagtttgagatgcctgttaagacatccatggtatgatgctgataggtagatacgaacctggaatatagggaataggttagggctggaaacacaaattggggattcatcagttactaagggtagtatttaaagttataaatctggatgacattatcggggtgaaattaaaatctgttatttgtaatatgaggtactataacattgtattttaacaataagcaggaactaagtactcagttaagcattttcaacaacatctgataataatagggatgttacttatcagtaatcatgaatagtttttcgctgagattttcttgacagtgttctggatttgagccaaatacttcaaaattattcgtgtccgaatctctttttttacttactacctcttatttaaaaagcagacaaaagtctacttaggtttcaataattgcaagcatccaccaatgctgtattatataaagcttgtatttggacatagcaatactagaatgtcttgtcagcatatgaaaacaagaacttttcactttacttacccaatatcttggatatataggataatgacagagactgggatagcaataaccataatatagttatagttattctaaattaaccaaagctgtctaattcttttttattggtattttaataataaatatctctgctctttgaaagaggtactaattgtgcgtctctgtaatgaaaaaccgagaggaattaaactggttcaatagtaactgattcctgagtaccactgccaggtcttaccctggccaaaattagtaaaagactgatgtctatatgtggttcaaaactgcttttgtattatcgttggtgaatgaccactgaaaatattaaagcagtggtaagataatacagttgactcttgaacaccatgggcgttagggacattgattgctcatgcagttgaagatctgtgtgtaacttttgactcctccaaaactttactcatagcctgcagttgtctgaaggccttaacaaataacatagtcagcacatattttgcatgttgtctgtattatatactgactgtattcttaccataatctagagaaaagaaaatgttattaaaatcataatgaaaatatatttactcttcattaagtggatcatagtacaagtcttatcattttcatgttgtataggctgaggaagaggaggggttggccttgctgtctcagaggtggcagaggctgaagaaaatccatgtacaagtgaacccatgcagttcaaacctgtgttgttcagggtcagctgtagtctcttaatcttgacattactaaatatttttgtgctgagattgttcttattttcagtgaatttaaagtactgaaaaattctaaacttgttttcaggttactaataggtagaaattttttagtatggattagtttataactcattttaaatccaactttaattcttcatatttagagctaggctacagttccaatgcggttggtagatgactctagacaataacatcacttttggttttttatactaaaagtagggacagtgctggatatatctcagcaatagtaaaaagcactaaacttttataaagtaatttgtctatgtaaagtactttaagccatgaaagtttacagaaaggccaagttttctagaaagcaaataagttaaaatggtacacatacgtatagtgttggaatgactgacgaaccatactttttaaattttagtgaagatgtaattattagatggcattttaagcatgagatatcaggaaaatcattttttgtttagtaagtgaaaaacactagtgtaaattgtggctgtcaggtgagtggatagggctagctcactgcctcttgagtgttctgaggcatgtttacagatgaaagggggggttacatttttagtagattaaacaaaattataggctttattggaggatttttgtagcctttgtagtattttaaggtacactgtgtgaatggcgaggaagggaggtttacagccagacatactggatcactgggactcccgtttttctatacaatgccatgggattgtaattttatggaacaaactttaggaaactctagaccagattatttttaaaattacttccatatataaaattctataatcctgtgaagaactcaggaagtacttacgattaattctcccatttattgttccggaaacttcagtttttataatcttcctaaattgatcctttatgttgataaacagtgtcgatattaaggagctcattaattttggaagatccatatctatccaaactggtaagaggctttaagataacaaatgctcagctttcaggagacgtctaaaatgaaacttttaaatcatattccattctgatatttgatcaagagaaaagttttaggcagaaaagaagaggtagctgagcttaaaccgtaagaagaaacctagtaaaggtgaagaaagtttctccaaaataatttcattgacatttaaagagcagcagtggtgcctatcaataggcaacataaaaaattacaggccgggcacagtggctcacctgtaatcccagcactttgggaggttgaggcggacagattgtttgagcccacaaattcaagaccagccagggcaacatggtgaggtcttgtctctacgaaaaatacaaaaattagccaggcatggtgacgcacacctgtagtcccagctacgtgggaggctgaggtgacagaagcacctgagcctgggaggttaagactgcagtgagccattattgcatcactgcatcccagcctgggtgacaaagtgggaccctgtctcaaaaataataaataaatttaaaaattgcaaaatataatactgttgtcttttttttaaagttaagtatcattttgctgcttactctacaagtttcaggctcttacagtatacaatgactgcttttttatctgtttttgtagtgaacaagacctataatccaaagatattaactaagttctgactttgtagataattgttcattacttagtaacttgtattatatgctgtgacatcttgaaagatcttatattatgtggtgtcactttcctggctccaataaaaaatgattccctagggctctaaagaacagacttaaaggattgatgacacaatgtgaagggcaaagccagagggggttgaaaagatataaactgaacaagttctttctttaggtaaatctgtggcaggaacaggtaaattagcaaagccagggaatagtggtggaggggtgacatacagtaagtctgagctgggctctagaaacagaggtcagacagggcagaggtgagcaattacctgggaaagcgtgtgtggggttgacagacaggttcttctccctctatgctgcctgtcttcataaattgctccatcaggacttgttcttgtttgcttccttttgtggctgctatggccatcctggtttggaaacttttttcagaaaattactactactaatatagtctttataatacataaatacaaactgattttgacttcgctgcttctaagggacattgtcccaaatcatatttcctcaaggaatccagtttctatttccaaatacaatgtataagtgtgtgtattccctctattcactgtgactgtggatcttgatctaaataaaattcaactctaaaaagaaatacagtgctctagtttattaaaacatggtttttaaaaatgttctctggggttgggtatttttgccgtagttctttgctttgattcttgggtagatgctgaatctcccaaatttggtttctctaactgtaaaataaagccagtatcacttgtcttgtggcatcgtaaggattcaatgagctagtgtatgcatactgctcagtaaataggaactattattagggctacttttgtattttttatgtttatggtgaagtctgatgtttttccatatttaaatttaggaagagaaaatcttgcatcagttgaaatgtttgaattaaataatctatgctagttcttagggtaaaaatagttacttaactgggctcttgtgaggtaaccattacaatttaagtaaaaatttacaaatgttaatcattaatagtttaatattacttttcatttcaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctacgt

SEQ ID NO: 36293 - DNA, 21182 bp, Homo sapiens
accctgtaagtggctgcggcgggaagatggcggagctgcgcgtgctcgtagctgtcaagagggtcatcgactacgccgtgaaggtgatcgggcccccctctcccacatccctgagtcccgcagccgtgtgcttccggggccacgagcgcacactgggtgggggtcttctcgtaacccccgacctctgccgctttaacccccaaacgtcaaagtcacctgagggcaaaaatccaagagtgaagttctaacatccgatccctccggggtcacggccatgttctcttttccctcgttctggattcactctcttgataactgttcagagtgagttgctttctctatttcttacccactggaagaagtcacggtccctgtttaatgcacggagaaactgaggcacagagaggtcacccagctagagaagggcagagccgagagttctatccaggttcctctgactgctttcacccactaggctgcattacttaccattgtactcttatattacccgaaatgtgctatagagggagtcagacagggtcctgtggggccccagaagctgctttccaccctccatagccacagggtgagccaggaggctctagctagggagagagaagtgtgtttgctagagatgaaagttcaaggagccaacctgactgagctgggggtagctcacattctccatgaaagaggtgggggagggtgctctcagcgcctggcttgttgtccccagagggaagctggtgtggacagaggtgaatcagacacggtctctcaggcccgtttctctcaatgcttggcctgaactggactgaagatggtgactgtctgtccatgtctgtccttcccatcagcctggggacttacctccgtgtccccagcattacctagcgcagggcctggcaccctggaggcctcagggtgggcaaaaccagggtcacaaagttgacactgatactgcccctgcctgcttagggagtgggctggggaagagggtacaggagccagacttgagcatgaaagtgtcagtgatgatagcagccagcatttagcgggtacttacgtggcaggcatcgttccaagtcctttgcagagattaacccattcagtcctttcagtaccctttgtattatttattatttatttttattttttgagacggagttttgctctttttgcccaggctggagtgcaatggcgcagtcttggctcactgcaacctcagcctcccgagttcaagcaattctcctacctcagcctcccaggtagctgggattacaggcatgtgccaccacacctggctaattttttgtatttttagtagagatggggtttcaccatgttggtcaggctggtctcaaactccagacctcaggtgatccacccgcctgcctcggccccccaaagtgctgggattacaggtgtgagccaccgtgcctggccgaccctttgtattattaattccattggatagatgaggaaactgaggcctgtcagatctcccagccagtaagtggcagagttacgatcgaaaccccgggcaagtctggctctagactctgctctcccatctccctcaatgccccctgtcctaatgatgcctctggcagcacatgacagggatgtcacctgtagcccttttgagacacattcctcttggggtcctgggacccaacacttggtttcctccctgctctgactgttcgttactgtcacatctttggagtcctacagctccctgggcctcttctctccatcccagccctggccttccacgcctggcatgtctgggattggatccgtctcccccatggtgcaggcccacgtttgactcagctctggtcccagcatcactcagcacagagcctggcacatggatgtctctggtgtgctcagggagagaacagaggggaagcgtgaaggccgcgttgaatcagctactgtcctttccagagggtgctgccttcccctcccgcagtgccccagggctccctgcattacatcctgtctcactggatgtgtctgttgatgtccttttcagaacaaataaatgattcagaccctgccagcttcctaaacaccagattagacctgggtactgtcccaccctctttcccttctcccaaagctgtcagttctccaccccccacccttcttgccctattgtctcttggtgtcattgtctcacctggaccctcacccgggtcctccctcactcccagtctctccctctcagcccacctctacccagccttaggggcctttctgcacccagagctcaccctgctctcccctgctcccagcctgcctgtggctccccagcaccctcaggacagagtcgcagcccctctgcctggcatttgggatgctttgtggtccagcctcctcttcatggtctgcttcagccgtccacttccctccttggaccctcccttaccctttgtgcttctgccactgtgacctgctcctcctgtcctgacagaccaggccgcggcttgcccgttccatgccttcttccagcaccaccctcctacctctgctttctgtcctttgtcctgcccaactccaactcatggattatatcaaaatctagtgattctcggccaggcgcggtggctcacacctctaatccctgcactttgtgaggctgaggcgagtggatcagttgaggtcaggagtttgagaccagccaggccaacatggtgaaaccccatctctcctaaaaataaaaaaattagccaggcatggtggcacgtatctgtagtcccagctactcgggaggctgaggcaggagaatcgcttgaacctgggaggcagaggttgcagtgagccaggattgtgtccctgtactccagcctgggtgacagagctagactcagtctcaaaataataataataataatttagtgattctccctggcatcgcctcctccaggaagcccctgaccctacaccctcaggttgccttggtatatccctgggggcttctgcagtccctagatttgcttccatcagccctcgccagactggattgggatcctctgtttaccccatgttccccactgccctactccatcatccccaggctggtagctccctgcagagaggggccatgtctgatccacctctgttcccagaatcacgtgctcactccctgacctctttcacctccttttcaaacatcaccttctctgggaggacttccctgcttgcctccttaaaatcacaggccccaggtccctgtgttttgctgtgttttcccctatacttagcaactagaaagggagaggaaagtatgtttgctagagatgaaagttcaaggagccaacctaactgagtggagggagtgactcacattctccatgaaggaggtgggagcaggggcaccctctgagagcccagcttgtccccagagggaagctggtgtggacactttgtaatccacagtgttgtttacttattgattgctctggtgtctgtcgccccttctggaatttgagctccaggtgtgggggagacagtttgatgtggtcactgcttcctgagacagtgggttcactactagaatagtgcagacctcagactccaagcccagcgcctgcgtccacttcctgctgtgtgaccttgaggaaattgcttcaccactctaagcctcatttttctactctgtacaatggggatgatggtactatctactttattgagttgtaatgaaaattaaataagcccttggaacagtgcctggcacacagtggtttgttttgttttattttttgagacggagtctatctctgttgcccaggctggagtgcagtggcatgatctcagctcactggaacctccacttcccaggttcaagcaactctgcctcagcctcctgagtagctgggattacacgtgtgagccaccacgcctggctaatttttgtatttttagtagaaacgaggttttgctatgttagccaggctggtctagacctcctgacctcaggtaatccacccgcctcagcctcccaacgtgctgggattacaggtgtgagccactgtgaccagctgcaataagtgtttttattgggagtagtagtaatggatgtttagttagtcatttattcaaaacataacaaatgctgtgctcagagtgtattcgtgtgtgtgtgtgtgtgtgtgtgtgtgtgtgtgtgtgtgtgtatgtgtgtccggctgtgtgtatgtttctgggtatgtgcgtgtatctaacattttaataggtatttggcaactcagtaacaccctgtcctgttcaggggcacattttacaggaagctgatgaagcttaaccttcagggcctctttcaagaccccaggagaaaggctgggcctggtggctcacgcctgtaaacacacactttgggaggctgaggtgggtggatcacgaggtcaggagttcaagaccatcctagccaacagagtgaaactctgtctctactaaaaatacaaaaattagctgggcatggcggcgcgtgcccgtagtcccagctactcggggggctgaggcagaagaatcgcttgaaccagggaggcggaggttgcagtgaaccgagatcgtgccactgcactccagcctgggtgacagagggagactccgtctcacaaaaaaaaaaaaaaaaaaaaaaacccaggagaggctgggcaattttgtattcattatctgggattcattttcttagagatgaccccacaggatagaaactccaggcccagaaaacgtgtttccatctcggggcccaaccccgaccagccacaccctctcgtctgggagcgcctggtgtttcttcaggttttcctctttgggctccacgcacttgcccctcctgctctcagcaaggccaccttgtctgacagggcacacgtggggctcacatgtcacctcagggacgagttctctgtctgccccccgccgagttagtgatctgtcactggggtggctccctggccttggctgtcctgcttgctgagtgccctagcacgtgcccagggactcgcttgacagaaaagcctagaggacagaaccacacaagtccttgagctgtgtcaggggttcaggaagagctgtcgaaaatcactttataaaatccctcttgggccgggcgtggtggctcacacctgtaattccagcattttgggaggccgaggtgggcggatcacctgaggtcaggagttcgagaccagcctggccaacatgacgaaaccccatctctactaaaaataaaaaaattagccaggcgtgggccgggcgcggtggcccacacgtgtaatctcagcactttgggaggctgaggcgggtggatcacaaggttaggagattgagaccatcctggctaacacggtgagaccttgtctctactaaaaatacaaaaaattagccaggcgtggtggcaggcgcctgtagtcccagctactggggaggctgaggcaggagaatcgcttgaacccagaaggtggagtttgcagtgagccaagatcatactactgcaccccagcctgggcaacagaacaagactctgtatcaaaaagaaagagaaagagagagagagagagagagagaaagagagaaagaaaagagaagagaagaaaatccctcttgcctgcagtggacaacaaataggaagactggctctcctaacaccgtgggcacacgtagcctctttcagagtctcacagttcccaagacagatttggggttagacccgtggtcctgccacttccatgctcagtggccctggccaaggtacttggcctctctgtgcctcagttgcctcatctgtaaaatgagaggtaatggcagtaaccaacctcacaggctactaggatggtcaaacgagttaatgcatataaaacccttgactcgttgtctgcatgggtcagtgctgcttttaaaaaaattttttttttcttttctttttttttttttgagatagaatctggtctgtcacccaggctggagtgcattgatgtgatccctgctcactgcaacctccacctcccgggttcaagtgattctcctccctcagcctcccaactagctggaattacaggcatgtgctaaaacgctcgactaatttttgtatttttagtagagatggggttttaccatgttggccaggctggtctcgaactcctgaccacaagtgatccacccacctcagccccacaaagtgctgggattacaggtgtgagccgccacgcccagctttgaggctgtttttgatattggtggatatgtcgtctctttaagagaaagccagcacttaatgctgaatgatttacctcaattataaaactttttttttttctttttgagacaaggtctagctctgtcacccaggctagagtggtacagtcacagctcgctgcagcctcgaccctcctgggttcaagccgtcctcccacctcagcctcctcagtagctgggactacaggtgcacgccaccatgacctgctaattttgttttttggtagagatgaagtctctctatgttgcccaggctggtcttgaaatcctgggctccagtgatcctccttcctcagtctcctaaggtgctgggattacaggcatgagccatcattatttaaaaaacaaacaagctatcatttttcagccctaccattgtttcctgacttatgtaatataactaaactgtttttgaagcttaaaatcaactcaagcttaattgagaagatgagctagtttgtttcctcaggtgtgtgtgcgtgcgtgtgtgtgtgtgtgtctggaaagttcttaccctttctcctcaggagtcaggagcctgggaatcaggagcttagggctgggagttctgccagagcaagagcaagatgtggcttgaggcccttcagaagcctccctgactcacagcaagaagcttggggcctcttactgatgggtggatgaggttcttttctgtcttaaaggggcaactcctatgttgtgtttttttttttaagaaaaaaggccaggcactgcgactcacacctgtaatcccatcactttggtaggctgaagcaggcggatcactttaggccaggagttccagaccagcctgggaaacacggggaaatcctttctctacaaaaagtaaaaaaaaaaaaattagcccggcatgatggtgcccgcctgtggtcccagctactggggaggctgaagtgggaggatcacctgagcccgggaggtggaggttgcagtaaggcaaggtggcacctctgcactccagcctgggcaacgagagagatgaaaataacagttctttctctttcctctcctcttccagctccttctcctctttctcctttttctttttctttttcttttttgagatgaggtcttgctctgtcacccaggttacatgtagtggcatgatcacggctcactgcacccttgacctcctgggctcaggtgatcctcccgcctcagcctcctgagtagctgggactacaggtgtgtgccaccatacctggctgtttttttttttttttttttgttgttgtttgtttgtttgttttgaggcggagtcttgctctgtcgcccaggctggagtgccgtggcgcaatcttggctcattacaacctccacctcctgggttcaagcaattctccctgccccagcctctgagtagctgcaattacaggcgtgcactaccatgcccggctaattttttattttatttttatttttagtagagatggggttttgccatgttggccaggctggtcttgaactcttgacctcaggtgatccgcccaccttggcctcccaaagtgctgggattacaggcatgagccaccacgcccagctgtttttgtttttgttgttgttgtttgtagaacctgttgcccaggctagtatccaactcctgggcacaagtgatcctcccaccttggcctcccaaatttctgggattacagacaggagccactgcgcccggtctcagtcctccatcttttaatgttaccctctccatgaggcacagccagagtgggaagccccttatgggtcccaccttctcatctcggattctgtcctgcctgtgggaggaacagttacacccacagccccagagaaaaaggggcagggaaatagcaagagcatcccagtgtcctcaccaggctcagctgccacccgagatctgctctggccaagccctgggtggcggccacatgggagaagaggaagagggcaggctccaggccaaatggggcagctccctagcaaggcttctgtggatgtccctggaggctttttaaaaatttgtgccccaaaccaaactcgccgtcttcccggctctggctgatgtactgactggaagcccctttttggtgtcatcttcccatcacgaaccatggcctgtcagttgcacctccagaaacctcttgcatctgtctctgctgtcacagctgtctgagccactgtcacctctcactttggtgacaaacagccacccagctctctccccacttcctctcatccttttccaattttctccaccaagaatccagaatgaccttataaaaactcaggttgggccaggagcggtggctcacgcctgtaatcccctgcctttgagaggccgaggtgggtggatcaccagagatcgggagttcgagaccagcctggccaacatagtgaaaccctgtctctattaaaaatacaaaaaattagctgggcgtggtggtgggcacctgtaatcacagctactcaggaggctgaggcaggagaatcgcttgaactggggaggcagaggttgcaatgagctgagatcatgccactgctctccatcctggacaacagagcaagactccatctcaaaaaaaaaaaaaaaaagaaagaaagaaaaaaaggattgtggtgggccaagaaataaaatagccctccaaaacagccaggtttcaatccctggcacctgagaaggggaaatcacttagaaacagggtctttgcaggctggccatgttggcttatgcctgtaatcccagcactttgggaggccgaggagagcagatcacctgaggtcaggagttcaagaccagcctggccaacatggtgaaaccctgtctctactaaaaatacaaaaattagccaggcgtggtgatgcatgcctgtaatcccagctacttgggaggctgaggcaggcaaattgcttgaacccgggaggcagaggttgcagtgagccgagatttcaccactgtactccagcctgggcgacagagcgagagcccatctaaaaaaaaaaaaaaaagaaattagaaacagggtctttgcagatgtgattaaattaagcatcttgagatgggggcattatcctggattatttaggtgggccctgaatgccatctcaagagtccttataagagagagacagagggagactagacacgcagagagaggagaaggccacgtgaagacagagctgaggatgctggcattgaagataaagcgatgcagccacaagccagggagtgtcagcagaagctggaggaggcaagaaacgtgttcctcccggggcctgcagaccccttggtctcaccctggtgacactgactttggacttctggcctccagagctgtaagattctaagccaccaaatatatggtgatttgttacggcagccgagagaaactaataggagagtggttagtggttcacgctacaccctggtctacaccggaagcctctctccctggcacatgatggtgtccccaggatccagctcagagccaggcacacagtggggcccaggagagacaaaaatgatgtgcagaagcaaatgggtggggtttgccacccacctcccttacctcccttgtctgtttagcaaagaggtctttcatgctggtgttttccaaattaggttgtgaccatgtgtgatcatgacatccaggcagagggctggcatttttccgaaaaagggtagaaaatgtcagagtatggtgtgtgtgtaggcagggtcagtattggtcactgacccttacactgcagtggcatttgtgaaataggtcagggtcactggtcacgttgtctaaggtgttatccgagctcgtttcacaaccaagagaattaaagagcatagaccacccaaaaggtgaggttggagcgaaagtttaataagcaaaagaagaaagctctccacagaggagagggaagcccaagcgggttgccatttttacagttgattccaaaagctttttttttaaaaaattatttatttatttattttttattattatactttaagttttaggatacatgtgcacaacgtacaggtttgttacatgtgtttatatgtgccatgttggtgtgctgcacccagtaactcgtcctttagcattaggtatatctcctaatgctatccctcccccctccccccaccccacgacagtccccggtgtgtgatgttccccttcctgtgtccatgtgttctcattgttcaattcccacctatgagtgagaacatgcgttgtttggttttctgtccttgcgatagtttgctgagaatgatggtttccagcttcatccatgtccctacaaaggacatgaactcatcattgtttatggctgcatagtattccatggtgtatatgtgccacattttcttaatccagtctatcattgttggacatttgggttggttccaagtctttactattgtgaatagtgccgcaataaacatatgtgtgcatgtgtctttatagcagcatgatttataatcctttgggtatatacccagtaataggatggctgggtcaaatggtatttctagttctagatccctgaggaatcaccacaccgacttccacaatggttgaactagtttacagtcccaccaacagtgtaaaagtgttcctttttctccacatcctctccagcacctgttctttcctgactttttaatgatcgccgttctaactggtgtgagacggtatctcattgtgattttgatttgcatttctctgatggccagtgatgatgagcatttttcatgtgttttttggctgcataaatgtcttcttttgagaagtgtctattcatatccttcgcccactttttgatggggttgtttgtttttttcttgtacatttgtttgagttcattgtagattctggatattagccatttgtcagatgagtaggctgcaaaaattttctcccattctgtaggttgcctgttcactctgatggttaaactaaagagcttctgcacagcaaaagacaccaaaagcttttataagaaactcctttcatctctgtagctgtttgagtatcttatctgtaaagctatctgcataactctccgttatctatgtagttgtgggtacgtctttaggcaagcacaaagctccgcttctcttgtttctgtaaccgtgggtttgttttaggtaagctccgcccctccccgtgcaagttcccacagagaccaccatgtacgtgcctgaaaaggggagggaacttttcctgggagcctgtcagtcacgcaaagaacaaaaggcttctgtgctgggcagcttgagttttccccaggctgctctattgttgcctgtagctgtgatttttcaggcaggctgctcctctgaggaccacccttaactgtctacctaactggtttttccttttcttctcctcatttgtatttatgtatcagtgtattatgtatttatatacacttggagatacagtaaaatgtacctctcactgtgggttaccataaatactgtaaatttgagaaacactctttcaggcctgagaggagcagtgacaacagtagggatgatcaagtcagatgtccctggtacccaggaatggctggatgagagaaggagacagggtgacctgcccctgcctacaaactctaacccagttctgtccctggagctgtgtgaccccggacaaggccctgcccctttccaggctgtcgttgtcctcatccagcctgggagagggttggcgctgaggcccccaccttcttgcctgtttcctcctgaccccaccccttcccctcctgctgggcagatccgagtgaagcctgacaggaccggtgtggtcacggatggtgtgaagcactccatgaaccccttctgtgagatcgcggtggaggaggctgtgcggctcaaggagaagaagctggtgaaggaggtcatcgccgtcagctgtgggcctgcacagtgccaggtgatgaaggtcttggggagggggctggactcctgggtctgacggaggaggggctgggacctggactcctgggtctgagggaggaggaggctggaagtctggacccctgggtctgagggaggatgggctgatagcctggattcctgggtctgaggaagaaggggatgggggcctggactcctgggtctgaggaaggaggggctgggggcctggactcttgggtctgaggaaggaggggatggggccctggactcctgggtctgaggaagaaggggatgggggcctggattcctgggtctgaggaaggaggggatggggccctggactcctgggtctgaggaaggaggggctgggacctggactcctgggtctgagggaggaggaggctggaagtctggacccctgggtctgagggaggatgggctgatagcctggattcctgggtctgaggaaggaggggatgggggcctggactcctgggtctgaagaaggaggggatgggggcccggactcctgggtctgaggaaggaggggatgggggcccggactcctgggtctgaggaaggaggggatgggggcccggactcctgggtctgaggaaggaggggatgggggcccggactcctgggtctgaggaaggaggggatgggggcccggactcctgggtctgaggaaggaggggatgggggcccggactcctgggtctgaggaaggaggggatgggggcctggactcctgggtctgaggaaggaggggatggggccctggactcctgggtctgaggaaggaggggctgcgagccagactcctaggtccccctgaggatagcagccaagtcaagcccctctgtccttggcaggagacgattcgtaccgccctggccatgggtgcagaccgaggtatccacgtggaggtgcccccagcagaagcagaacgcttgggtcccctgcaggtggctcgggtcctggccaagctggcagagaaggagaaggtggacctggtgctgctgggcaaacaggtagctgtggtcagccctccctgtgcccccttgctcatccctgctcgggaggagggtggtggagatacggggtgagacagcagctggccaggcccagggcattcaccactccaggctgagcagcttgggactttgctgacccttctgacagagagtttgagcagggaggacagagtccctctgggtgttagaaagatcctcttgggccaggcacggtggtttacgcctgtaatctcagcactttgggaggccgaggccagtggatcacttgaggtcgagagtttgagattagcgtggccaacatggtgaaaccccatctcttctaaaaatataaaaattagccgggtgtggtatcacctgcctgtaatcccagctacttgggaggctgaggcatgagaatcactggaacctgggaggcggaggttgcagtgatacaagatcgcaccactgcactccaggcaccactgcactcctgcctgggagcagagcgagactctgtctcaaaaagaaaaaaagaagaaagatccttttgggtgagtttagaggctgggaggccgaggtgatggtcacatgggggagaatgaggcctcagccaaaggtgacaggacagagcagagacatgatgtggcaggagagactgggcttagcatggggagggagggcagggaggaggcaaggacagtgcctgggtctgccttggtaacacaggtaggaaacccaggaagaacaggaggttagaggaggatcctacaaggggagtgtgaagagcccaggagacatcgatgcaggttcaggagacaggcctgggcttgaaacaaagacttgagaattttggagggcactggggagctatgggagttctatgagcagaagaggggtgggatcagcactaggtgcagaaagagcccccctgggctttgagaatggactggaatgggaaattggaggccaggagttagggaaggaggttagggctgggtgaggacccgaccagaaccttccctgccacactggtgctccccactgagataggggtacatggagctcatctgttcccccaggagaccctcgggcaccacctctgctcaggggtagctcatctcatttgagggcaaacctcatggcctcaaccagggaaggggcagaagagggacgtcagaagagccacaggcagatgggagtgagaagaggcagggaattagggatgaggctgagaaggaaggccaaagactgcaaggtatgtcaagcagagcacggagacagcagagcacagcaggctcaggtagagctggggcccccggagagagatggggatcccagggccaggtcagttctgggacaaagaggaggctgatgggtccaggtaggtcactgggtgtcctgcccagccctgagaaagtcagaagaaaacagagagagattatcaacagcaggggcatcagagtacagatcagtcaactgtggccgaagggcctacccggagaacaggccaaaaaggcagggcctgggtggggctgcagaggccgaggtgctggaagcatggcctttgcagccccctgcatttgctggtcgttctcagactccgatgtcctacctgtcctgggccagggacagttcctggggccagggcctccagctggggaaatgccggatgaactggtcaggatgctgtttgttctaggaagcagattcacaactcaaactggcttaagccagaaagcgaatttattatctcacgtaaatcaggggcttcaggcacagcttgatccagggtcacatatgagctgtaggctcccctctaccttgtcttcactgtctgcatctccaggctcagatcccaccagcccagtgaccccagcagaaagaaaggagcatctttcccaagggccccagcaaactcccagggctgactcttctttggtgcagcttgagtcatgtgcccctccctgaaccaatcactgggctggggctagaatgtccttgctggcccagaccctgttcatgcagctgcccaggggccacatagggtgggactcctgagaggctttatacagagggcagagacttgacgacagggatgccaggtggccccacatgtccctggacaagtggctgcttatctctgggcccaagtgaggggatcgttctagaccaaaagtcagtgaactatggcccagagcgacctctgatttgtaaataaagctttattggaacatcaccacatacattcatttacatattatttatggctgcctgtgtgctacaacagcagcgctgagtcaccgtgacagagaccgtatgacctgcagagcctgagatatttactacatctgttccaccatagaaaaggtttgccaacccgactggctgcggtgactcatgcctgtaatcccagagctttgggggatcatctgaggtcagcagttcaagaccagcctggccaacatgttgaaaccctgtctctactgaaaatacaaaaattagctgggcgtggtgttgggtgcctgtaatcccagctactcaggaggctgaggcaggagaattgcttgaacccaagaggcggaggttgcagtgagccaagattgtaccattgcactccagcctgggtgacagagcaagactccgtctcaaaaagaaaaaaaagaaagaaaaagtttgccaacccctgttctagacagaggcctgaatggtccatgagctccactgattgtcatacagtcttctgtctctccccattcaggccatcgatgatgactgtaaccagacagggcagatgacagctggatttcttgactggccacaggtgagactggagtggggagcacctgctgagggccaggccctcatccctcaaacttcatttctgcctcaaggcctttgcatttgctgttctctcctcctggaacactgttccctcggattgcctcatggctttcttgttcccctccttgaggtctctgctgaggtatcacctcttcaaaggggccttccttgccatcctacgtgaaatactcatgcccacccgctcaactctaggttccccagtccccatctctgccagtccaatagaaatgcaggctggggccaggcatggtgagtcatgcctgtaatcccagcactttgggaggccgaggcaggtggattacttgaggtcaggaggagtttgagaccagcctggtcaacatgttgaaacctcgtctccactaaaaatttaaaaattagctgggtgtggtggcgtgcgcctgtagtctcagctactcagggggctgagggagaattgcttgaacttgggaggcggaggttacagtgaggcaagatcgcacgccactgcactccagcctggcaacagagggaggctccgtctcaaaaaaagaaaaaagaaatgcaggcttggcacagtggctcacacctgtagtcctagcactttgggaggccacggtgggaggattacttgagcccaggagttcgagaccagccttggcaacatagttagaccccatctctaccaaaaaagaaaagttagctgggtgtgatggcacatgcctgtagtaccagcctcaggaggctgaggtgggaggatcccttgagttcaggaggtcaagactgcagtgagctgtgatcataccactgtactccagcctaggtgaaagagggaaaccctgtctcaaaagaaaaaaaaaaaaagaagcaaggcacatagacaaatttaaaatttttcacagctacataaaaaagtaaaaagaaacagacaaaattatattttatttcaccccattatatctaaaatattattttaacatgtaatcaacataaaaatattaagatacatatgctctacaagcaatggggttacgtcctgataaatccatcataaattgaaaatattataactgagagaatgcatttaatattcttaatctaccaaatatcatagctgagcccagcctaccttaaacatgtcacaacacttaacgttagcctacagtggggtaaaataatctaacataaagcacattttataataaagtgctaaatatcccatgtaatttatcaaatactgtactggaactaaaaaaacggaatggttgtacggacactggcagtatggtttctactgaatgtttatcactgtcacatcatcggaaaactgaaaaatcttaattcaaaccatcataagtcagggaccatctgtattttacgttttttggattttctttgtactaaatcttcaaaattcagcatgtattttatatttacagcacatctcaattcaggtgctaaatttctatgagaaacacattcctaaagatgacagttgaaatagatttacacacccaagttgttcaaaacaaacttaaaagttttctagtaactgcatttccagtaactgcattgggtatctgtgtttttttgtttgtttgtttgtttgtttttgttttttttttaaacagcttcgttgagttatttacctacaataaaccgcacatatctaagttgcacaatttgttaagtttgcttttcttaaactcttttatttagatagagatgggggtctcactatgttgcccaagctggtctttaactcctgggctcaagcaagctgctcacctcagccctccaaaatttaagttttgatatgtgttacatccatgaaatcatcaccacaatcatgataatgtgtcttgaattctcagtatttatttatttttatttttttgaggtggagtcttgttctgtccccagactggagtgcagtggcgcgatcttggctcactgcagcctccgcctcccgaatttaagcgattctcctgcctcagcctcccgagtagatcggattacaagcgtgcatcaccatacctggataatttttgtatttttagtagagacagggtttcgccatgttggccaggctggtcttgaactcctgacctcaagtgatccacccgccttggcccctcaaagtgctgggattacaggcatgaaccactgcgcctggccaaattatcagtatttaaatttaaataaaatgtaaaaattcattcctcagctgcactggctggacagccacacgcagccagtggctactggatgggacaacacattcaaaaccattatcctgttttatcttcaaagcatttaccactgtctgactagcttctccaacgtgcgcccttcttgctctcatatcatgtgtcttattttcttcttattccttctgattggaaatgatctcatttgtgtgtgtgtgtttttccctggtgactggttgtcttccctggcagaatatgagcccacccaagctggtgcttcactggtcgtgttcacagtgtgtctccaggggcaggttcataagggcactaggaggaggttgtgaatgaagggaggtgatgttcacactaagacctgaaaaatgtgtccagttaataagtggacagggacaaaggtcgttagacaaagaggagtgtaggtggcatcagttaccaggggaggaaatgttgattcaggactgagaggcaaagggacctggctagaggacggggtcccagaaggtggtttaaggactggtgtggacacacacagttctgttgtctgcccagcggaggggcctcacggggggccgttgggagccagattgtcagcttttggatttaccagctgtgggtggcagtgggcgtgtaactcagcatcttgctgcctcagtttctctcatctgtaaagtggggataataacatttacctcataaagttcctgcgaggattcgatgacttgatacatcagttgcttagcacagggctcagcactcagtacatgttccctgtcaggaaggcagggaggcctcactggcagcatcaggacatgggacatcaggacatacaccgtggctctcagggaaaggaaaaagaccctctcccaggtgtacaagctcgattctaaacctcatgggaccctgcattgttcgctccctcattcattcactagtccatgcgtgtactcagtagtggcataagcagactgctcgggtcggacctgaattagcctcacccactctcctcctacactgtccctccccagggcacattcgcctcccaggtgacgctggagggggacaagttgaaagtggagcgggagatcgatgggggcctggagaccctgcgcctgaagctgccagctgtggtgacagctgacctgaggctcaacgagccccgctacgccacgctgcccaacatcatggtgagcccctggccagcgggcactgagggcctgggggtggcaagcacattgccagcccagtgccccccggtggtcgcacgtggggagggaaggatccaaaggaggtctcgtgcacaggaagccgtcacctggagtttggctgatagagagagtttgctgggtcatctctgccaatactgagagttcatgggggctgctttggctagcagggagggcttgctggtatctaggccagtagaaagccttcgctgggcagcagaaggtgttccctttgtcattccagccagtggaacaagttcactgggtcatctaggttcattagggagggtccccttggtaatttttgccaatgtgaagttaccatgtagatcatcttagttaactaggaagggtgcatggggtctcttggctaacaggtagagttcactaatcatcatggccagtagatgggttcgctgggtcatcttggccaatattaacagtttagtgggtcatctccgccaatagagaatattcatctcagccaacagggagggttcactggatcatctcaactaatggggagggttcaatgagtcatttcagccattacagagtgttcactacatcatctcagcctatagggagggttcagcgcatcatctcagcctatagggagggttcagcgcatcatctcaacctatagggagggttctgcgcatcatctcagtctatagggagggttcagcacatcatctcagtctatagggagggttcagcgcatcatctcaacctatagggagggttctgcgcatcatctcagcctatagggagggttcagcgcatcatctcagtctataggcagggttcagcgcatcatctcagcctatagggagggttcagcgcatcatctcagcctatagggagggttcagcgcatcatctcagcctatagggagggttctgcgcatcatctcagtctatagggagggttcagcgcatcatctcagcctatagggagggttcagcgcatcatctcagcctatagggagggttcagcgcatcatctcagcctatagggagggttcagcgcatcatctcagcctatagggagggttcagcgcatcatctcagcctatagggagggttcagcgcatcatctcagtctatagggagggttcagtgcatcatctcagcctattgggagccttcagcatgccatctcaaccaaaagtccactgagtcattactaccaaaaggatgggtttgccactctgttgcagccagtgaagggcttcctgatttggttacctaaaggaggactgctgcagtagttgggcctcccagggcctcctagccagcaggagttgtccacaccaggtgtggccctgtgagaagtttcgcgtgtcctggccagtgggtgggtccagagggttcagcccatgggactggtctgcaggcctggcacccatgggaaggaggtggcaggaagggtggcaggagttccacagccctgtgaacaatggcttcccatgtgcagaaagccaagaagaagaagatcgaggtgatcaagcctggggacctgggtgtggacctgacctccaagctctctgtgatcagtgtggaggacccgccccagcgcacggccggcgtcaaggtggagaccactgaggacctggtggccaagctgaaggagattgggcggatttgagcccctcccagagatggcaataaaactgactctcaacatc

SEQ ID NO: 36294 - DNA, 35767 bp, Homo sapiens
gcgtgcgggtgcccgccgagcccgccgggcgctggatctccgagtgccccggccggggcctgaggagcgggcacagggcaaggcggcggacggctgcgtcgcccgaggcgaggaggagcgctggcggtgagtgagggcgccgcgggcgagcgggtcggcgcctccgcgcgtgcgcagcgcgggaccgcccgggcaggggcgcgcgccctgcggccggccggaggggccgagcgaagcgaggagaggccgggctggtggccgcaggtcggcctcggacccacgggaccagaggatcccatatccgtcccccgggctcgagaggcgctggccgcgcgggctggctttccgagggggggggggtcccagtggggcgcgtcgggcccgcgcggaggtcctggtgccgggggcggaggggcagggccgcctcagccgaaagaccgcggggaggggcgcacgagcccgcctggccgtgcggacgcccgcggggtgcgcgaccccggaggtggcggaggtccaggcagggggcgcggtcgggaagcctcggcgcctagcaggtggcgggggccgcgcccctctcccggggaggcgcgcggtgggaagcggagcaaacttcccctaagtaactttcctgaggcgctgccggcggggactccggggaccgacgctccgggtttgcgcggcctcaggcgccgcgggaacccagcgagtggcggcgggcgatggcgggggcggcttcctcctgaggctggactagtcctccgagttctgagtggcatttgtggcccgtttgctctaaaaatagacgtacaagtttggtgttcgggaagaaggatgtttgctctcttgggaagaaaaggcttttacctcctggccttttcaaagaaagtattgttcgggcctgctggggatccctatttatcaagcaacccattgtcctgtgtgtgcctggtgaaagcgagctaattctattattagtcctcaaaagaccaagggagatcacggtgctttttcttttttaaatattccccgccacctcgccaaatcctgtaatacagtttccccaaacttggctgcacagaggagtcgctggggagttttaaaactcttaaagcccaatcgcacaccagaccaattaacacagtgtattttttaaagatccccaggtgatcgcgcagccgagtttggaaacactggtttaatataagaaagtcaaggctttagtttcacatagtagtagcattcagtttgtaattggtgagatgaaactcaaattcattttcctagacaggaactcacaaagagcggtttgtttcccaccagggagggagggaagcgtctctaacggttcaaactttgtgaactataatgtgactctagcactcaaaacaattgttctaagtgttgttttgaatttctgttgaggttactaagcccgctttcactgactccctgcccagccaagggctttccccttcttttaaccctacctcagtcccctactcaaccctctgccagatcccctgttttaactttaacctgagggaggatcttcctcccccacaggttactggctttaaagggttactgcgggttcccatagcaacgagtcctccaggggaagtgggcgggtcctcttacccttgggtttctgaacaggactcttccttttcggaagaatttttgaatcaccctttttcatttcttggcctcagcaggtaagggtgagcttatgcagttccaagatgttctttctgagatacttacagattattaacgccgttgtatgggatgataattactagcagccatgttctttcttgatttctcattctttcccaatccttgcactgataacttgtttaacaaacttccaaaatgaagtggaaacaatgttttcttttccttttttagcatgttttcttggaggtgcacatgcctaagaattgtatgcactatttctctaaagccctaagttatatcttatatttaaaaatttaaaaaaaatataactccacatctgtgcggaaaaacttttgataatttgtggcaaaaatgccatgcttagcttttaagttgttttgttcctagaaagtactctgccaacattctttacaaaatgttaaactgcttgtaatgttatactttaacaaaggaaaggcacaattagtctacacattctcctacttccctgcccaaacacatgcatccaaagatcaatttgaaaaaatgttcatttttttttttaatgctcaaaacaggtatgctatagacatctaattccattttgccttgcaaggaactgttaaaactcttctgaacaaaatagtacagaaataggtcatttaacatacttgtttttaattgtgttttttaaaaaatattttaaactttgtaagttatcagactttagtcaattccaaaatacctttaggattccagtgatttttgagtttgtgttgggagttgaaatggttttctcttactaaaatctattttatgtgctgtttaaatttctgttaactgagctatcaagcaaatcctgtaaggtgaatttttcccatttactgtgagaaaggaatactggtggaaacccctatcatgtgatggaccttgtagttccagcagtgatgctgggctgctaaaataataatctttcacttaatcttcccttctttcatcacacatttaaaaattacctttaagccttttcaatttagtatctctttcagcatagttgtccagtctcaaattccttgaaggtgtgcattaatgtacatttatcgacatgtcctttgtttattcaaattaagcaaatacagttgagaatttgttgttgctttgtttcttttaaaaaattaaataaaaaaatatttcctgttgggagacattttgggaatcactgaaaaaaattaagaaagtaaaaatcaccgtcatatcatctaaaaagaaacaactggtaattagatgatgtgcttccattttactctgtttgtctgcatagacatacttttgaacaaaattggcctttaattttatctgtagttttaaatattgcacttttatttaatatgaagtaaatattagagacgtttcctttttctgtaaaccctttgaaaataagatttttaatgatgaatacacccaagtttattgaactagttttctgttgttttacgtattatttttagttttagtggcttgagaatacagtattaaaccctttggttgccaatcctagcacggccacttcctaagtgaccttaattacctctttaatcgcatttccttggaataagggtcatggtgcctgcaccatagagttttggtgagatggaatgaactaagtagaggaaggccagcagggtcgaccaaatgacgtaggctcagtacgtaagagtggacacacaggtggagctgagaaaaatgcccttgtctgaaagtttaaatatttcggatttactcaggttagatttatagcagtggaaatcctggggcagaggtgaactcttttatgactcttgtggcttgttgccaaattgcttatgccataacattcccttacagagtgtatggtctacctgtagtgtgtcagcactccagtgttcatcatctttcctgatttttctataaaaatatgatcttttaatttattttttggtagctattgaaattgatcatctgttttttttcttttgttttcctttttgggagctctctcttctggtactttgcctactttaaagtggtgatttaaaaaaattaaatacccgttttatctaaagaagattgagtgtttatcatgtttttagttttcttttttttcttctccacaggccattatttctttcactttttggcgtttttcaaccaataaaatatttttatttctatataaacaagtctctaccttgtcctttatgattttttccttgtatttgttcatgcttggaaagcccagaaagaccctgcaaatggccccagtgaaaaactcaggagaagcagtaagcagtcaaaagtggatggggaggaagactaaggcgttgaggaagaccacttattttacaataaggcttttagactttaaagctgtatgcatatattaaatttaataatctttatctgaaaggtgagataaacaacattttggaaatatgttagatctttttacatttaattctataattgtacatggatatgaagcgctcctataccgccgctgcctcctcttccttttccctagttagcgagttctaccaccatttgttaaatagttcctcctttcttctttgctttgtggtctttattgttttttaagatcttgactaactttgaggtctgcttcagttttaggtcttgcttctctgtgtgttgatcctctagtcttaatcaatgccacatctttttaatcatagatttagaatatttagaaatacctggcagagcaagtcacactatccttttaacattacaattctatgcccttgtcctttcagataaagattattgtatttaatacatgcacagttttaaaagtctaggaggcttattgtaaaatagatggtctttcatctgcctcttcttccccccatcccttactctccctccccagtggcagctactttggattgtttactgtttctcctgcgtttttcactggggccatttgtagggtcttcttgggctggtcagagagtggtcttccagtaaagttttgcactgaggaaagagtgtaggttccagtgttcatggaggaatctggctggggtttcagcattctctgtgtagagtcatgttggagaaggttcaccatacagacttacctgtttacctactcttccaagaacaaatctctagtcttgctaggttctaggattgtctgccaatggtctacagtgaggaggtggggaaggcatcttggaattttagagcttctcatgcagcttttactgaccttattttaacctgtcacccttttaccctcagtctttgagcagactggagtgagtacttctcggcttttctcactgttggtatagcattccctctctcaagttggctgagacagttgccacttgtccatctgttttccactttcatgatttgtagtttccattacagttctttaagtccttgggtctctatgtcttctagaaagatctcttactgtcacttaagtggggtttagggaaagggtgtaattggatatgtgtgttaaatttaccgtcttaatctggaaggctcggaagatgaatccttagaactaaaaaaataccggatcatgttacattttgtttcgttggcaaggactgccatctgtaatcagtgtttcttttaagggtcatgaaagattattcatgaccttttatctctcagcagagttgttttcttcatctgaatcctaatgtttcctgttagagttcttcttaggtatttgtttttgttactttgtgatgggctcttcaaattggctgtcggtagtctaagatggtggttgattttggtgtatttattttatagctggcacttatgcgaaaagctttgcagtttatttttgtatgttcccaagttatatgagtggcagataatgacacttttatctacttttaaatagttatgacttttattttggttctgtggcggtttgcactagatttagcattctgtaacgttataacatctttctggaacattatcgaatagtaatggtgataatgtacacacttttattgttctttattttagtaaggaaaagaatagtagaatattggctttttggtttatcataattcttcatcaggacaaagaaaatctatcctttcatttccaagttgcctagaggtaattttatgtttttaagacatgggaattgaatattagcaagtgatcattagcatctgcagtttatctgctggtatttctgaagagtctactgatttgagtcccaaatattaaattggatcaaaattttccttatggatggttcttcagaaaaagaaattgaatgcatgggaagaatgtagtataacatattcaatgcatgagcatattgtcttggttggggtggtataggagatgtcactagggatttttcacaagcaaatattccaagttatagctgacactcaagtcacatctttacctgttggcagtatttgatgtaatttgttattcctccttttttaatattcttccttcatttgattcttgaggacaccacacactgttgccttcccttctataccgctggccttctggtttcttttcagttgtttttaaatttgtgttggttttctcttctcaccagcctatgaatttagaatgtgccaaggctcagttctcacccgcctgttgtcacaaatagtcacagggctttaataaaatactgtgtagctacttaagactcctaaatgtatatttccacctcagacatctccaactacttttttgacttcttaacgtgaatatgtgaaagacgcttcagcctaaatatggccagaacaaaatttctgatctttctctgcaaacctgctccatctgcagcctgccccattttattaggttggtgcaaaagtaattgtggttttttgcattaatggcaaattacttttgcaccaacctagtgggtgttagctccatttttttcatgttatttaagcaaaaaaaaaaaaaaaaaaaaaaaaagaacatggaatcctcctgactcttctctttctctccaactctgtttccaggttgtcagcaaatcctgctgttctgtcttcaaaatgtatccagaatcagtttaactacttttcccatccgtactaccagcatctttgtccaagtctcctgcatttcttgcctggagtattgccgtggcccatggcctcctaacagatcactggtctccttttccttccctggcttctctttgattttccatctgcttaacatcagagtgatcttttaaaaacataagtcaaattgtgcttaaaaccctccagtggcttccatgtcactcagaataaaggccagtgttcttatgattcataaaaccttacatgatctgggccgggcatggtggttcacgcctgtaatccagcactttggtaggctggggtgggcagatcacttgaggtcagcagttgaagaccagcccggccaacatggtgaaaccttatgtctactaaaaatacaaaaattagccagacgtgatggcatgcacctgtaattccaggtacttgggaggctgaggcaggagaatctcttgaacctggaaggcggaggttgcatgcagtgagccgagatcgtgccattgcattccagcctgggggacagagtgagattctgtctacaaataaataaataaataaaaattaaaaagccctacatgatctgattctcactaactgacctcttctcccgcttgtctcccactcggcactttccattccagccttccttacctccttgctaatccttgaacgtggcaggcacatttccattttaggtctttgcactggactttttcctctgcctataatatttatcctacccccccagccacctctttcaggtcttcactaaaatagcattttgtctgtgcgattactctagttacaattgcaatctgcatcctgtatgtctcttgcagtgctctgcattttatttttccgttgcatctgttaccttctaagttactatttatttgtctattttgtgaattgcctctctttcctacctctgctagactataaattccttgaggtcgagtatgtttattaatgtgtcctgagtgcctagcacatagaagatgctcagtaaatattttttgaatgaatgaatgtagtctgccttctccaatttttttttcagtgaatttcccataaagcaacacatgcatagtgttttagcatttgtggatctaacgttgacttatcccaccagcaagggagaagttcaagaacatttatagtttataatggagataataatacagagagtggttatgagaattaaatagggtgctctctgtaaagtactaatggataggaccaggtcacttaactgacaaaaaagcctggccaagtgccctgattcacatctgaatgatgtgaattgtattctagaatcttctctctttatatttcagtttttaatcaagagtaggtgtggcatcacctgggagcttttcaaaacatacctgggttccctggtaaatatcagtgatatactgttactatattttgttctttaaccagtctgcaaatatttgtcccttaatgtgggtgataactatttgctctcccccttttaatgccttcttgctgtttgggacatctttcatggccccttctagtcttttttcctatgaggttcttgctgaaataacttctaaggtgattttgaaatcctcagagccacttggatgcacgtaattgaaccttttactaaatccacaaaatcaaaggatctcagtcctttaccttctgttttccagacaagagaatgttgtagtcatccctacagcaatccttatagcagtcattttattttattgtttttaaaatacctgatttttattttttcatatgaattatattaaataattattatgccccctctagtcgtcacacaaatctgagaagtggatgagcactgtatttgatctcttggacacttccctttattttccatggctcctcatgtctcagacccttaaagtatttgcattcttttcttttctttttttttctaattgtattttatttttacttccaggatacatgtgcaggacatgaagatttgttacataggtaaatgtgtgccatggtggtttgctgcacttaccaagcagtcattttaaagttttgcttattgtgtttctaggctccttttgtgtccttcaaatccaagaatatctcaaaaacatcagactcactttcctcctctttcttaatagagcaagaaacatttgtagatttttactgttgcaatttactgtgcaagcaagtgctgtgatttgcaagaaaaaaaagatgattattttagagatggtttatgcaactgaagaatacacaataaataaaaaccatgatgtatgtgtgtttagaaatggataagcccaatagctgttacctatacacaaaaatgtgaaaattttcttcaactctactgtcaaaataattcaaaatatacctagctccttgtgtatatttgatctctccttaatttttctatgatgctatataagtaagagcattccccatatttaattaggtgtaaacattttagcggtgattaccatgcacattggaaataaaatgtcacaagttccattgctttgaatgcatctgttctacctgataaatttcccttgcctttgcaactctgattagatctactttttgttgtcgtgaagactcattcttttgaaaatagtgctgttacaaattcattttatattgaaccctaaatattcagtactattggccaaggctgaatggaaaaaattgacctatgtatctttctgatgataaatcacattgccctcagtttaggccattaacggacagcccagttggaaaacacatctcgtttaaagttctacacctgctttggagactcttgtaagtatttgttgcctttgtgagagtttttgtcttttaatgccacctaatttcttctactaatctgttttttttgaaagtggcggtcttgcctacccatcaccagcaaacatactctatagtgagggactaattttggccctctgctatgatgttgtactttaggtctctgtggatagagaaggacttctaatgtagactgccacctattttcatacctttgttcatggagaatgtagcaaaaagtcaaatataataaagtccacctactttttttttttttttttttgagacagagtgtggctctgtcgcccaggctggagtgcagcggcgacatctcgactcactgcaagctctgccttctgggttcacgcctttctcccgcctcagcctcccgagtagctgggactataggtgcccgccaccatgcccagctaattttgtttttgtatttttagtagagatggggtttcaccatgttagccaggatggtctcgatatcctgacctcgtgatctgcctgcctcagcctcccaaagtgctgggattacaggcttgagccaccgcacccggccaaagtccatctacaaatttaatgtgttgttggagaatgatctatattcctagaaaacctggaaattggtacaattcttaattgaggttatatcaggtgacttttcccaaaatcttattttcaatagaaaaaaatggtgagaagctacaaaagtccctccttctgctcaggatgcaggttcaggctacagggaactgttggtagcattctcttgcacagcacctccccgctctaccacttagacatcagtgttgggtggaggtgcattccagagtgctctgtctcttcctgtggtttttttgttcaccatcttttgtggccttgggagacaggatgaataagtgcttgaagctgaagatcatctgttggagagtgagctgttactgaaagtggtcaacagtggagggagcgtgcacatgtgcagtcacttttgatccctatgcagtcgcagtcagtctctcatggtggacttccttacccttccccaagatgatttcagcacctacttaataaatgctgtgtaatttatttatttaaattagtagattgtctagttaatttaataccattcaataagtatttctgtgggatcagctcacgcgtacttgaaatgttttattactttattagctactttctcttataagtgatccccccaaaatgtcagaatcagttctgaactcttagctagcaaatatctcctagcatatactcaaaatcatcaccaggcagtgatggatttgactaggtgggtgtgggttagggatgtcaatatataatggtgttcggtttggcttataggaaaatgagatgctcaagataaggacaacctatattttgattttacagtgtttctatagtattatatagttactgagtgtgaagtagttgtgaggatcagaatcctactaaaatgtacaacctcttaaaatttttttaagagtgaagatgggaaggtgtttggatgctagctctagtaaaagactagacccttgaacaacttgagcataaagaggcactgatgcctgcccccaccccaccaacctcccaccccgcacagttgaaaatccatgtgtaacttttgactcacaaaaacttaactaatagcttactgttgaccagaagctttattgagaacataaacagtcagtaaacgcatattttgtgtgtcgtatatattatatactacattcttacaataaactagggaaaataatatattatgaaaatcataaggaagtgaaaatacatttatagaaatgtactgtattcatcaatattgtaagtttacatcatctgtttacaagatgaatcatctgtctgaaatggtgggtgaccacagctacagacctcaatctacagtacatatcaagcaattcaacttttttcttgtagtgtcttttctatgcttctcggaagcacttctagcatcactaatggcactttgtatgggtctcatgatgttattcgtggtttactgtattgcactaaacatgatgagaaatgcacaagaaccaccagagatcacattttactgccataagcaatatattggggagagaaagtgctcatgctgagatgattagcatcatatggcactttaggcagatactggcaacacttgagttcaccacaggaataacaggagatggctatgaaattattacagtagaatagtatgtactacagttaattttatgcctttatgatttaatactgcatttttacatttgtttacatttctctggactgggaatggcactatatacagtcagtatgtgtttgtgtgcataaattttggtaactctcatagatgtgtgtatgttttatggtagtaaatgataaaatagactcacagctacatgttttacccattaatgaaatacaaaacttaaaaaaatttcaatatatctaggctgtgcagttcatctgttttttttaattgttacacaaatctccaactaattttccaatatagttattgaaaaaaatctagatataagtggaccagagcagttcaaacccatagcgttcaagggttacctgtatttttaaataaaatgttatttagattaagtatttcttttggacttttacaaagtcctaacctaaactttatttccaacaaactgttttcttctatttagtatataggaagatttcgatattttatggtatcaaatgccatactctgtagatacaatattaaaatggcactgtaggaagagtcatattctgcctgatatatctctctttaaatgaaagaaaaaagttaacaaattatcttaaacattggcagccatgcttgctttaggagaacaccaaagattgctacccccaattctcctaaggaaatgtgatgtaggagaaagcagattttcagagagagatgtttgttttcttgctggtttatgtgaagtttgtagggatacttgtctacctcaaagctcatttacaatttttttcttaatgtcttcaaagaggatgtcaattaatatgattttgcaccctaaattctgtgaattttctgaggttggggtattgacgagatgccaaacagtgccattgaacagatggaagattagctctttgactgttcttaattttttttttttgaggcggagtttcgctcttgttgcccaggctgtatgcagtggcatgatctcggctcactgcaacctccacctccctggttcaagtgattcttctgcttcagcgtccggagtagctgggattacaggtgcccgccaccatgcccagctaattttttgtatttttagtagagacagcgtttcgtcatattggccaggctggtttcaaactcctgacctcaggtgatctgcctgccttggcctcccaaaatgctgggattacaggtgtgagccaccgctcttaatttttgtggcagagattgtctcttgtatccttcattctgtctacaatgtgcaaaaatatattttggagtgaatggttgagatttgtgctctgagaattagttactgttttctaggagaatgaaagggaaaaagtaggtatgtgtaaaaagttggccctgatcttgtatatagttcattaagaattttttttgttaatagctgtatgagtccgttctaacactgctgtaaagcagctacctgagactgtttaatttataaagaaaagaggtttaattggctcacagttctgcaggctctacaggaagcatggctgggggtggtgctcaggaaacatagaatcatggcagaaagtaaaggggaagcaagtacatcttcacgcgctggcaggagagagcaagcaaaggggcaagtgttatgcactttcaaacaaccagatctcatgagaacttactcactatcaaggtggaaatccacccctatgatccagtcacctcccaccaggtccctccctcaacattggggattacaattcatcatgaaatgtggatggggacacaaatccaaaccatatcaaaagcctctagaggcttacaattacgcttacgataaaatccaaacttcttatgaagctgggcatcagcttttctcatacgttttggttttgggacctttttatactcttaattattttcaaaagcccagaaaacttgtttataggggtcatatctattaatatacttttgtcaaaatttaaaaaattaagtatttatttaaaaataattgttttcattgaagcatatgaagaaaatctggcctcaaacagatgtatagctggaaaagaatattttaatagcattttcagatgattgtggatatttgatacctcaccaaagcttcataagtagtagtttcttaaaggttaattgccatgtggaatctaaaaccatatcgatgaacgttttgtactcttgttatactttaaatccattggtcgaccattgtactttggatcttttaccaatgcatgattttgtattgtaattgcattcttattagaaaaggttggttcactgagttatgcaaatctttcaagtgttgacacatttcattatacagtatcaaaaatcatgttcatttaatatcactgctcttataagaacagtcttttgagtattgggaagctgtcaggctcatggtggtgtaatcaaggtttccaaattctaatttttgcttgaagccttgaattttattatcagcaataaatactgtcagttttccttgcagtgacaggctcacttcattcatttttgagaaaatgtctgccagataccttagtctgaataagcatactttgctgcttctgtcaagtaacaatggcatttcaagaaaaaagctgctggtttgacttgtaacacaaatagttgtacacgtgttttttctcaaggaaaccattctatttcaatttgaccagaaatgctttgtgcatacttcccaatttcatgacgtagaatattttaaaagtgtttactcaacagctgaagtttaataaaatcaataatttttactattgcatctcccagagattccccatgaaacaatacattgattatagcaaaggggaatgcacaatagctattttgcacttagccaggccgttttaccgctatgcgtaaataaatcccccatcattcaggtgtgggtgaggaggactgcggaaaagtaaggtgactttactgctcctttggcactgttcacttttgcttagtcactggagtgaccttcagatggcttagaaaccagcagcatcaatagtaataaaagttacagagccagactatggagccatttttatcttttttagttcctggtgaaactcttgccttttctgttaggagcaaatgatcccttccattgtggcctttgttctgcatcaccactagcagatgttgctgggaggttgcagagagatttggtcacttgttctacttactttcttaaccagtgcaagtcagaactgcttaaaaggcttcatacttttaagtcatatacacattgaacaacaggcacacatggaatgaatttacctcaccctgccttctaagaaatatacttttatggccagtgaattcgttattgaaaaatttgagcagatttatttatttatttattttggccaacacaaatctcaaaactatgactttacattttcaacactcttaatggtttttaaaatcattgctggtggtaaaggttccataaacacaccggcccagcaagatactttccagttttggccaaaaataagttattccactactgataccataatttccatttattattactccttttttttttttttttttttttttttttgagacggagtctcgttctgtagcccagggtggagtgcaatggtgttatcggtgctcactgcaacctctgcctcccaggctcaagtattctcctgcctcagcctctcaagtagctgggattacaggcacatgccaccacacctggctaatttttgtatttgtagtagagatggggtttcaccatgttggacagtctgttcttgaactcctgacctcaggtgatccacccagctaggcctcccaaagtgctaggattacaggcgtgagccaccatacccggcctgttacttcaatgttgtaagggaatatatagatggaagttgagaattctttattttttgtaaaaaagtcaaacacctgattacttgcctgattcttcttagtgaagtgagacagagactcatgcatgtaagcagtatacttttctacttgtgcttttgctctgcagtaatctgaaatgagacatcgcccatcttagaattgtggtttatttgcaggggaggcatgcattttcctactgccctatacacacaagcctattttattactttgtttgaagactgggtgtgtctaatgtagtggaaattcatcgattcagtgttaagtacaggtgaaacacatttcaggaccacattagacagtctttttaattatccttttttttggattattcatgtgactgctttcctcttttcacgtgaattgctgagaatttatcatcctttccagttcattaaatcattaaaattctttactagcactataaataaatatgccaggccatgagttgaggccggttgataaaggcagctttgtcctggtaatagttcttgttcctggttaacccacacttctctgtgaatatgtgtattacattaaattttagacttttaatgtagtgaagccttactctaagcatgtagggacttgctttaagttgagctttggtgtttacagttggattagctgtgagattaatgtggtattataatactgcatttgtgcttagacatgttcaggagagccccaggacacatttaataggtattcaggttcttttccactctacctagtctaagcttgcatctcagtcaactagaaacactgtagatcttagtttcagaccattttggtctaggaccagttgcaccccacaagtgtgatctggagttctaattggacttggaagtgttgggctttaacctcctcttgtgtaaccattgaaagccaggtgcatgggcatggcactgttgcagatatggagatgcagtcctcagagaaagcacactttaatcaggcaacataaggcaagatagaatgtgagaaagtactgcatttgggcatgatgagtctggaagcaccaggaaaccttccttgcttaggtatcctttggactgcgtcttgaaggatgggtgggtaggctttttatacgtagggttgtacagaagaaagggcagtgaggatggcaggaagcaatggacccatttgtagtgtgggaatagtctggtttgcagggtgggtgaatgaagaggatgagtcaaaagatctaattgggaattgagccaggtcatggagatccaaaatgcattgcaagccatgcttcctctcactgggaaaggtgagacagaatttcttcccttcttccggggcggatgcttgtttgcacttctctggtatgtgagagagaccttcctcaatttagatgatagccccttagggaagagcattatagagtaaagatttgaccacatgcctctttttgtctcatttttgatgctatattttaaattttacaagagtgttacttcagtcaaatactgacatcacccaggtctcctatacggaactcttagtagaaattatggcatctccgcagatgacaagtaaaatccttatgcagagagacctgactcagatgtaaattgtgatcaccattttcagagattgtccttccttggtctggttccagtcatcatcaccttggatcttgtatgagttcatatctctgttaactatggtggagtggttgcttctctgtggttttttttttttttttttaaataaggtactgacagttgagttgccactctttgaagatgtattttgactttaatgtttttaatctgtttattatggttaaagttcctatgtattataaatgctgtcctccctattgttatgtgatgcagagactggagaaactcaaatttaagaacatgttttcatgaatagtccccactttaagtgagacttattttagcattatttcatgagcaattagattattttactctaaatctctgggcagttcaagtactgacctacttatatagtagctcttaattaaaaaaataattatttttattttagagaatattagagaattgaattttttttgaaatactctattttcttagttctaatacatgtgataaagctaggtatggaacctcaatttttattctgattataatagcatgagaggttgaagcaacaaagaagtgctttatcagtgtcgaattattatttcctgcagcaaatggtggtagtttgtgaatgttacttggtgttattatatttaaggttataccaacatttaaagtatactgtgcctttctattgtgtacttcacaacagttgatggggattgtatacttttaagctaattaaaagtagcataaaacggccaggcgcggtggctcatgcctgtaattccagtactttgggaggcctaggcgggtggatcacatgaggtcaggagttcgggtggatcacatgaggtcgggagtttgagaccagcctgaccaacatggtgaaaccccgtctctactaaaaatacaaacttagcccggtgtggtggcgcattcctgtaatctcaggtatttgggaagttgaggcaggagaattgcctgaaccctggaggcggaggttgcagtgagctgagattgtgccattgtgctccagcctgggcaacaagggcgaaaccccctgtcaaaaaaaaaaaaaaaagtagcataaaatgtatcttttaatttggttctagaagagcttttactgtgagtttttgccagaaactggtttctgtaataatgctctgttacagccttctaattctacttgaattttttgttagggaatattattgttatttattttagaaatgtaggtgccttttttcatttttatttggtggtatctactcgagagaaggtatgttagaaattgagtgttaagctactttgtaacttcatgtatgtttaagttttcccacagcaagatttctcagatttcactcagcatagcagacctcttaatgttagatcttgtattgtttgcccaaaataactatatttcattctggtcgcatacattgtaaaacaaaggatagcatttcattaaatagtaattaattgagaccttctggatatgtgtatagtgtttgtcaaaatgtgaaattgtaactggtcttttctatgtggttttgcaaaacaaaacaaaacaaaacaaaacaacaaaataaaaagctttttctggccttgcctttcccaacctgtcctgttcattttacagtgagcacaatttaaaatctaagataattgatataattcaggtgtttggtgttgatggcggggaggcagtaaattgaaggacaggagagcagtgtttatttctaagcactgagtgactaaaggtatagaacttagttgtggatgttggggaaatttggctgtgatacttggaacctcactaataatcaggactgatgtagaatatctggtgatttgggagttgtctggattctttcttcccgtcccatgtgttcttggaaaaggtgtttttcccaaatagaacaagatactctttggttaatatgtgagagaagcttttggactttgatgatctgatggaggagatgttcttggtgactatctttcgaatatcagaaaaaaaaacaaaaaaaactaatactagccaaagtaaaacatatctttggaaacactttcctttttctttgaccgaaacatattattttcttcttctgttatttaaagccaacaaatgacctggagaaagccacagcaatggttgggtgaggttgttccattccagcattcccagtaggattgattgaagtcctttgttggaacagccccattcaggcctttttgaaagggacctcctgagccttgattttacttttctttggatagactattttcaagtacctagtagaaagtcatatatatatattgggatcattgtattatgataatgtttctctctcttaagctaacattttaatatggattctatttgtttgaaagtaagcaatatcttctaatgagtcatttagctccatatttaacctatgtataaagtagttgtaagttaataaatcttgaattgattgataaaatatctttagcaaatattacccagagagttacaggcttatactgatcagttttatgtacattttatgtacaattgtgtggcatgagaaaatactagaaatgcattatattaatgctggaactcttaccagtcctggcaatgcaaattctcattttgagatttccatctagatattctaccatatcaatggttgtcatagtagcagtctcaattgagaattgtgattatatactttatcaaataactacttgatgaaagctcaattattctaatgtagttcagccagaattctgagccatcatcttgcctggttaaggaaataattaagcaacctaaaaaaaagatttctttctttctgttgaattgtacaaattttaccgtatttcactgactgtagggtgccatcaggtgtaagacatgccattactttatgtactgctaagaaaggaaaaaaaaaagcctaatagttacactcatgagatggcatcaattaaaagacacaaaccagtttcagagatgttaaagtggcgagggtgggggaggcacaaggaatctacagtccataaaatatggcacttacatatgtacacagagttttagttgggtattggtcataatcatattaaaatgtaaagaaaattatattaagtaaataactatttctggcaaatattatacagattttttaaatcctagaaacctataattggaaaagataggcgatcatgtagtcaatacacctgaggaaatgtaccatgagatcatctagagcagagttgtctaaccttttggcttccctgggccatgttggaagaattgtcttgagccacacataaagtatgctaacactaaggatagcccatgagctaaaaaaattgcagaaaaaaaaaatctcataatgttttaagaaaggtggcgaatttgtttgaggctgcattcaaagccatcctaggcctcttgcagggccgcaggttggacaaacttgatctagagtatgtaaaacttagcaattggttgcctttttttattgaagtatcttcaactttacaaaagaaattataatattcctttaaatagccatcttcagagtatctcctggtaaactttatataccccttttcaagatcacttaatgtatggaagagaataatttgggatttagatgagtagtttagtattccaaacaaggtgcacactgagacacagtgtgtatgtaagagctataatcgtcaaatgtcatggtaagtgccatatggaattttaaaaagaatcatcgttccctgccttctaagaattaccacattctacctttgggcattcctccccaccccccgctcaccccaaatctaaagtacaattcaaggttaactggagctctgtgtggtgaaaaggtggcttaatgaaactgaccatgaaccttatactgtggacagcactgaggtatgccttggccaaatacttggccttagttatcaaccttggtgctggaattcaaactgggtcattgtcgagagaggccaaattgagttgctagtgagatatggctgggtggctagatgggctccttgcaggaggctgtctcaggaagtgggcacagcagtgaatcagccaacaggtggcctcatggaggtttgaagtccacaatgggcacccagcctgaagtgtgggttcaagtgcaggtttggaaataacactgtgggatttggacattgggtgtggaccggatcacagtgcacagcacaaatcttgcttattattgaaccttccctgcaaaatcagattcacagcaaaatgggacctgcttggcccataggtggggctagaggaagcctgcagataggatgaaatgtcagtagctgtgcagtctgaaaagagtacaaggatgaggagctagattaatctttgagattttgtgttttagatgattgcatcacaaacgtttcctgctttgggcacaattgctgctaatggtgagaacttacctttgtagactgtttttaactaaagtgctttcacaaaacatataatcttgccttcacaataaacctgagggagaagctgggtctaattaccccatttggcagatgtggaaaatgaggctcacaaatactgaccttaaggtcacttgttgttagctcttgcttttttagctatgctatgcttccagcgcttgactccatatttatttccaaatttagaaagcatatatagtctgttttccagcagcttctgctgactttggggactgccaacattttgttgcttatctttttacctcccaaatcaaaagcataatttttgctcagtattgaagggacaaataagcaaaaacaaaacactattccctcataacttaccagattaaactactctcctctgttaggttatgttaatcatttttggaagtgataggtatttcttcagtctaccttaccttgtttaaacctctgttaacctcactgctgttgctttttagcggccttgtagtaaaccatgtacaagtccagacaaggagtccagagttagagcaagttaaacaagagttgccagcattattagttgttgacatagaagttggtgttaaccgtgaatagctggtttctaactttattttacctggagagcctcttctgtttttgagcagcgtcctcactgcagttccttccttccatctcattccacaagtatcctttcagcattcttgcctgtagtgtgcccctacaggggtgcagactacatatgttcatggttttcatctttgtaaactttaaaagaaagctcttcttttaaagtagattagaaatatgacaattgagcattctgtaagtgtgtgaggtaattactgtgagtgaatattagagtgaatgaagcaaacaacatgacaagccaggagatccgcctcgtagtccaggtgttgccccacttctttactgtggaattttcacaaaccccttatacttctgacaccagttgccatacctgtgaaaaaagagttgcattaaatgatttctggagtcccgttcagtttcaaacctcattcaggtctgcaaagtgaatatgtcagattgtattaaataaaggtaggattgctgacaaaccttccagtggtgaaaaggatgatctaagtgagcttaaattctgtggataattttgttattattgggaattgaatggaaataggttaacagtgattcagctttctggcaattataaaatcaactgaaacacactattattagctaactttttaagtttggtttctagtcttgctcaccgccgtatgcccaacacctaatacactgcatagtcagtatgttttattttgggaatactttcatacaaacttgatggacttcttggcctatttacctcattagggcagacagctctaaaattcaggaagtgtagaaacaagtgataaaatgcctattggaaagaaattttaggagtaaaatgtagcagtagacatcaggctgctatccttttttacccttcaacccagtgggtgatgtttctgggttacagactcaacagatggagttttaactatttatgtttaatcaaggaggaaaagaagccataatttgtatttaatgtagtagactatagaaatgaaagaataaagtgataccaaaattttgtatattcaaatcaatcttatagttttataacattttaaccctaacattttattgtattttgggttgcaattactcatggcagatgaaagccatggcttctctttctagaaaaataaatgcacacatactgccaatttcaccgacagcttgaggagtttcatgaacttgccatcatctggtggtccctagtctgaattcttgatagaaaataacctagtatgttcatgtatacatatgtaactaacctgcacattgtgcacatgtacactaaaacttaaagtataataataataaaataaaaaaaaaagaaaagaacctagtgtgttaaaccttaaatgcccttagaaataacctagaccagtgtttcttaaactgtggtcatgagatcagttgaatggattatgaccaacattgaaaagaaaagaagaaagaagaaaatagaaaatatcagagtgtatatcataacatgctaagagtaggttttgttttttgagccatgtctttccatttgtatgcctgtatgtgtgtttatgtttagtactaagtcagaatataaaatgcatttcttactgtggattgagtgtaaagtttgaaaaacattcattctgggtgaatctctttcatcttatagctgaggaaaactgaggcccttaaaggctaaatgatttgttcaaatactcgcctttctctattttaagtggcccagccaggactgaactagattggttgctaattttaccatgctacattgctaatttgttgaaatacaattgtgaagtagaccatttaaaagtactaagtgattatctgcttcatagttgacattttttaattccttatttttcctgccgaaatcatcactgtcattatcttttaaaataattggggctggcgcttcctttccagagaatatcttggtccctctcagttggctgtctgcacacctcaatcctagaatttgacatttggggcctaatcagaagaatttcagaacaagatgtgaggggttgttaagtttttaatgtccaaactaaattaaattattttgagttattttcaattcacttaatagttgaatgcaacatatggcaccagatgttggtactggatcattgggaagacatctagtagtcagtagttatctatgtgaagtttttttcaaccttgaatactgtatgaaatgcagattctgatccagagtctggctgagattctgggtgactaataggctccctgtagatgctgctgctgatccttcaactacattttcagtagcaagaacctgcattacttgccttattaccgtggtaagaaaaagtagccgtcagataatttttctgtcttgattttaaacagccatgctcatcagtccttacatacattggagtaataatgcccttctttgtagcactcttgtagatgattcagatttagcgctacttcatttaactagtattgtcagaattttctacaaaacttatttttctaaataactgatatctgtaattttagaaaacatgttctacaatattgcatacttctctttctcaaactgttacatccactttactttttttctttaacttagtggtgtaagagccatgtgttttggagacttcttggtgatgggtattgagccatatgcaaaatgagtaaagatcacaaacccttctaagttcttgtatctgtgttttatgttttttctattttgtctccatccagctaccaattaatagtatgtctgcctaaaagcagctggtttccctttccattctaattgattacttctgacctgaaaagccagatactagatttgttagaaatatttatgagattaatcccagtcagaaaggcctacctggcatgggagctttcctgcaaggaagtggtcaaggaagttcagtggcacttgagcaagagagaaatcctttagtgttaaccctattctgaataattaggtcaataggagcttacttgtttcttcatgactttctctatgtgctttttaaactggtttctagatccctctctaacattgtgtgttaaagtgtgtatgaagatgatttggaggtatctgtatgtgtgtgttctgctgttgagaacatgataatcataataaataagcagtgcttcaggatccatctaaaatggagacaggtaactgtgctacaggccctggttctcttacagaggctttgcaaatggttttaagaataataataacaacaataaagaggatatttcttggttcaatttagtgttctagggatttaaagactgatttctggtaaccgcctttagcagattattaattataacaataacaatcgtaactcttatttgctgagccctcactgtgtcaggtagtcattattcagacaaatgttaaaacaaggagggctgtggtcatgaagggtgcatttgcctgaggggtagcaaatggctgctgtgctttgaacaaatgagcgtgatccaaatagataggggtgagattaaatattttaattagtccctctttacaataaataagcatatgcagaacctattgccggtgtttttgttttttttactcaccaacgctagaaatggttggaggattcacacctacaaaaatcaaatggtagcttatattcttctaattcaaagcagagagaacctgtttgcattttaactaggtggaatccgaacatttatcattttgaatagccttgttatttgttctgtcttagaagttgtggattatattctttaaaattaagacaagactaaatgtagccttaacagttaagttgaattttgagatcctgaacatggccccatctgaaatatttttagtgaattacagcctttgaacattgatcatcagatttgtttttatttgaatcttatttttacttctagagtttatcttatgctttagtgtacttaggtgtacgggtataatcttaatctaattaacagtattttgtgacctgagacacctgtcaaagaccattatagaagctagaaaacattgggaggtaaactgaacacatggcctcagttctcttctttagcactagactatgacttgcactcaaaagaggctaagaaaaagaaaaataacgtcctttgcctttaaagtgtaataaatgtgttttgctattaatagcccttttcagtttatagactggaggattttgttttaagtatttgaaactaaatgctgctgggaaaaagattttagtagaaatatagatatctgtccctaccctttgttaattgatcctgcttaactggggacataatgtatgtctactgaagagaaatctgtgggcataaactcctcccttcctgttgtcaaatatatttcatatgttattatcttgtttaaatatacagtagacaagaaaatgcaactgctgttcctttaatatcagaactatgcatgttacaataggtgtcactgttttgcttggtccaatcatgattggtgacttcagctattggctcggagcactggctgtctgactccatctgcagggctgtaatacctactctcctccgatccattcaccacacaacttcagccggctgaacagactcacgcagctccagcccatcttgctgacctaattcagaaaagaagtgctacagctctgtgcctgtcatctttgcagtgtagcattttcaggtgatctaggaaacagttatttttatgagcaaataagagaaacaggaatcatgatggggatatatttaacagacccagtactggataaaacttaaagccagtttctattcaacatagtgaaaaggtcaccttgcctggctgagaaaagcagcaaaatatcagctttgttggtttcagttaacctcttagcccgggctaatctcttttccttgatgttcaaaccaatttgggatatctaactctaaagagagacacactgtactcatggtagatgacaaggaaaagaacatgaaatgtctcaccttcttcttgatgcttccagagacggtaaagaacaggtccaagaaaagctcaaagaaagcaaataccagcagcagcagtagcaacagcagcaagttgccaccagtttgttatgaaataattaccttgaagactaaaaagaagaagatggctgctgatatattcccccgtaaaaagccagccaactccagcagcaccagcgtccagcagtaccaccagcagaatctcagtaacaacaaccttatcccggccccaaactggcagggtctttatcccaccattagagagaggtaagtgccgcgctagtctatttactttaaaagttttcctgtgttgaagtttctgcttttgcaaaacctgtaatgtatttgaacacaaatctgtttcctcttttcccagaagctttttattggtaatggaaaattgccttgtatcttttccaaaacagtacagctgttttcctcttagataaaaatgtttttgcaagctgtaacattcaagtgacagggttgtctatgggccatagaaaatgggaaccttttatttgtccttagctttattaaaagtttgtataacttttattttaaactttagttacttcccttatgtttgcaatgattatgaacagtttagttagaacctttatttgttgttttgccttgaagttactggactgttgcttagcttgcaagtcttttgtgggttttgtatgttggggaaggggatgttaaaaatgcaggctgctgtgaattaatgagttgcctctgtttatagaaatgcgatgatgttcaataatgatttgatggcagatgtacattttgtggttgggccaccaggtgggactcaacggttgccaggacacaaagtaagcaacagctgcatgaccggtttagtcctgacgtttacaaagagggaccctttccataagcctgtaacttggtgtgggcagcttgccgatgtcaggcagtgcatgtttcactcgattagggagagagcgcaccctctccagagggctttggccacgcttaattttttctttgtttccttctatactgctttatatctcacacatcccctcttaactctccagacatgggaagttgttgtgacaggtcaggaaagtcgtatgtttacccttctcctagaaattagttatgtaagctattattgtatgtatttagtaatgaggggacatgtgcattaatctcttaaagctttgaaataattagcagcatggtcttatgcttccatggcaagctaccctgtgtaccttggctttttcaaagcagtagattttaggtacgctatgtttactaaacctgattgcctagtgttgtttttctgcattgatttgctggaaatgccttcaatttagtgtatgaaataagatttccctttctacacagtatgttttagctgttgggagctctgtgttccatgcgatgttttacggagaacttgcagaggacaaagatgaaatccgtataccagatgtcgaacctgctgcttttctcgctatgctgaagtaagcatcattcgtgtgtttggaaagagtttgtttatgctgtatttgtaccctgctggtttcacagttaaatttaagttctgcataacagaaaagaagactgatgaagaaagagggtgctgcttaccttgtaaatgttttcggaaaagaacactttagctttccgtggaaagcatatggaattatgcagcatttataatcgcaccttgacgtagaatttgggagcaagtggcatgtatagtgatgatttttaacaacttaaaattaaagacaaataactttctggtattagcattatttaatagaagatgttctctctgaaagcattgtgtgtgaaaaagtctttaaacaaatgtttttgcttcacaatttcagaagttaagtaccttatttaagtaacaccagttgggagatttctgagtattctaagagttattgtctcctaagagcaaatgaaaaacttaccatctgttgaaataatctgatctttgtgtacacatacatatacatactcatataaaatcagacactctcaagggtaaaaagtacttgcatttgacattacaggggaaatcttagaaagatatggatagtctcgtacagtttcatgtggatttatacagaagaactttcattggtaatacagaagtatgaaacttaaagatacgttatatatttataaaaaagatagttttctgtctggtgggtcttctgcaggcaccagtatgtgttaaacaggttatagaatcagcttctttatcatgtacggtactagacagtgtggtagttcaccaagtgatcataatctaattattattctaagtagtatttatatgatttttcctaatctttattctagcacagcaaagtgtattactttaaggttatctgttgctctagggatttcagttcattggaataagtaaaatgtttgttgaaaaaagtattcagtgggtcaacaagttggacagtactcctacatatagttaaaatgttgccatacattgtttactgtcttctgaaaaataagtactgtagttagttctagaacttaaaagtatttaattcattattcatcttacagttttgaaatataattgtcactgacaagaccttcacagtaggggatagggaaattaaaggcaagtgagcatgtgaagtaccaaaatgtaaactaatctgctacttttaacctttgtaatcttttggagatatatgtacagaaaccagttttacctgcaagtatccccactgcatgaagtcagctttgtattttttatagtgttttctgttgctgaggagattgctagcactagttcagcattttgtcttcactgcagtcaagtaggatgttgtatcattcctgatatatacataattaggaaacatgaacaagaatggcagagaattacatctcacctaagtcatttgatgaatcatttgacaagtatcttttcccacagatgcattgcctatagcagatattgataaagctttataaaattatacatgcagtccacaaaatgtggtaagatcagaaatgagtcaggtgccatttgctctagtgctgtagttgtgaaagcggtggcctgcttcatcgagtatgagtagccagtattcctggggttgtcagaaaaagaggacagctgctcccttgacagttccagggtaagagctcgaaagtgctgaccatgctctaggatcctccccagggtcctggctcacagtcagagcatcactgagccgcaggtgtactatcaagtggccttgccatcagtaggtgacttcgcctatcagagaagagaaaggttcctgtgagcaaaaaggcaggtttcatttgtgctcgtggacatttttctcattgccattcttgtgttttactttcttatagaagctgttgctaatttcttaagttttatgtgtttcactaaggtgaaatacaataactaaaggaaaactcaagataaagtagctgtagaccttaggtagaagagaagcagatgatgactacctttacgtgcctctttgggagactgccactgtctcccaaaaagtgtatcctgtgaagtgttttatatcctgaaataaggacagttcacagaagcacaggaataatacatatttaagctttcctactttgtcttttaattaaatatatctggaaataatgtaatcttgaattctgaaggtagaaggaatgtgtggagaaggaagagttttgagtttaaaaaacaaaaacaaataaaaagtctgttggattctatgtaaagttaactggacgatagcattgcagtccatacttttgataatccattgaacttggaactatttggaaaatattaatctcaggttttattttgtgcttaggaaaactccaaaagcatgaagatgcaataattgctcttaaaacataacgagactattcttggttaaatataatgtagtatatataatagaattttgctatttttttgtaatgttgactattcaatatgcagttgtttttcagtttcaatagcttctgttttgttgagatgacactgaatgcagcttataaaatagaggctagaatggtagcacaaagttaatatctttaattatacaaactttactactgggttaaaatattaataatttattaatatgtttcgaatgttcctttactctgcaaatatgtttgtattaactgtcacataagatgatgttctcagaacaaacttgaaagtggttgtatcttttcttgctggatgtactcattttgtgaaaattccacttacatgttatgtgctttttacagatatatctattgtgatgaaattgacttggctgctgacacagtgctggccacactttatgctgccaaaaagtacattgtccctcaccttgccagagcctgtgttaatttcctggagaccagcctgagtgccaagaatgcctgtgtgctcctctcccagagctgcctgttcgaggagccagacctgacccagcgttgctgggaggtgattgatgcccaggctgagttagctctcaagtctgagggattctgcgatattgacttccagacactagaaagtattctccgtagggaaactctgaatgccaaagaaattgtggtttttgaggcagctctcaactgggctgaagtagaatgccaacgacaagatctggcgttgagcattgaaaataaacgcaaggttctaggaaaggcactttacttgatccgcatacccacaatggccctcgatgattttgcaaatggtgctgcacagtccggggtattaactctcaatgagaccaacgacatcttcctctggtatactgcagccaaaaagcctgagcttcagtttgtgagtaaagcccgtaagggccttgtcccccagcgctgtcaccgtttccagtcgtgtgcctatcgaagcaaccaatggcgctatcgtggtcgctgtgacagcatccagtttgcagttgataaaagagtgttcattgctggctttgggctgtatggctccagctgtggttctgcagaatacagtgccaagattgaacttaagcggcagggcgttgtcctggggcagaacttgagcaagtacttctcagatgggtccagcaatacctttcccgtatggtttgaatacccagtgcagatcgagccagacaccttctacacagccagtgtgatactggatggcaatgaactcagctactttggacaagaaggcatgacagaagttcagtgtggcaaagtgactgtccagtttcagtgctcctcagatagcaccaatggcactggggtacagggagggcagatccctgaacttatattctatgcttgaaaactcacttcctgaagcagcttgagctccaaagtgcacatctggttccaacttgcctgatgcttagctcatctgcaaatatgtgatcagtgccggtaatttgtaatgaatgaagcggtaggcaggttctaatttcttttaaccttttaattatgtacaggcaaaaatgcagcattccgcttttaactatctgcttaaaagagctaacgttcttattaaggctttgtggtttttagagttgcatctatgaacctggggagattatgtgctttcccaagcgttccaccaccctctcagttttgtccctctgaagataattttggatcaccttgaatttccttttggacgttatttgatgaacagaaataaagtgataacaagagttatttttaaacagaactcctcttaccccccaaaacagataaacctcagtgtacaattttgaaagaagttttgccttgtaatgagtaataatttagaaagtagacagtggttgtgtttggctctcgttttattccttttacatttgttgcttctgggatttaaaaaattactaaattcataagatagttaggtattaaacacttcagaatatcaatgtaaaattggaaaataaggaactgggggcatttgtttaggccatgacttctacaagcagatttcttttcttttagtttagaagacaaaaaatttcaatacagatacttcttttagaagtaaatttttagattttattgtcagtagaaaaaagttaaactcctactaatttaaactaagacagtttaaaaaggaagcctgaaaaagactcatactacaaataatttaattgatggcatataagaatatgcagtttgaaaaagccaaactcttctctccacttagcttttgatccccactgtttgcttatttgtataagtcatactgtgtagaatttctattttctttttccccattaaaagaggaccaaacaattctttatacaaatggagtagcaactagttttgtagcactacatttaatgtaatgagatacctttgttcatttttttaaatttgaaatatactttacctgatccactttgattgtatactatattctttgttaattttaattttgtcctgttcctagactgctagaatctggcccctggccatcttaaagtgccaacatatgcctgcagggtttataaaaaatggcctggagtgacacattttattatacctaatattcactgcatcagtatcacatctagctcccttacttgtccacagataatgtaaacaaaggagggaaaaacttattaaattctccttcgctgctggcttgtgctggtttagtgcctgtgtccctggcagtgtccagtgtgttcacttccagttgaagtatccatgtgtttctgggcagcttttctgctcagtgtgatcctgagatggcttccccgccgccacccagagtgtggtccttggccgcctcctgctcctgctctgcaagcctgaaactggcttgtctggagccaggagttagtcctggggtgtgtgtgtgcctgcgcacccatgcgcatgcaagtgtgtttgccagctcaggagctgtctcctctctacctggctagtaagaggtgggacagtaatggtcctcctgctggccccagcaaggcccatgagtgactgccctgacgtattcactgtgcctctgggccacttcttcccctgtagatgtgggcttgttgccttcagccggcttccctgagggaggagaacactggattattggaaatgttttaatcactcttgccattacctacatctattagcatagatgatgaaaagctgttactggtgattatagatgagtatttccaggacaacgttctaaaagtacaattatttcttattggggagattacaggtagtttggcaaagcattgaagtacaaaggtacattttcaattaaaaagcacacttctacaaaagatttggtttttaaattatggttacacatttcagtaactcatagctgctgtgcaaattggtagaccttataagaaggcacttgtttgtaagccagagaagaaactttaattgcatcctatcagattgttgaggtgggtgtgatagtcttcaggtgcagtgcgttcattcactaacgctcactgtcagtgcccatgtttgctagctgcctccatgtgactagtgagctgctggtgaaagtcgtgtgaaatcctgtacactgtgtatagaataatgtaattttatgttaattgttattactttaaaacatatctaccatctgattggctggtaccgagagctgtgggtaaaatttgaaaattgtatttagaataagaaattttacattttaaaccctattgtcctttatgcattttcaatgaaatggaatgaaggctaatatgcttgctttatttacttttgtaatcttggattttgtagcttttaaaactagaaaccattgttctaacaaagcaggcaactttattctataaacacaactttattaagcagaatacactgtagatgcttttccccaacgtatctggctggcagtctttgtcgttgttcattctggggataaaggggaactaggctagcagttctaatgtgacattctttaagcatatcttaaaatagtatttaagtaaatggtctaatttctacataattattgcactgaacttttttgtttattaaggtgtttaaataagctcagctaattcaagacactgtagccacttgtgcatcagtgtgcttgaatttagtagcttacagcattatttatgaaggaaaaaatacataaatatgaagtacctcatgttgaatgttattgtactgtatttttaatgtaacagtgcagatcttgttagacacatgaatgtgtataatcatgttaaatgcaaataaaactagttcataga

SEQ ID NO: 36295 - DNA, 40562 bp, Homo sapiens
gagcccctcccctcggcccgcgcgggaggagtgtgacccaggtgccgcttcctctcgccgccgagggtcaggagcccgggagcgcgaccctcccccggcccggcctggcccggcctggccagtccccgcggtctctgcccgggctgacgcccaggaatgtggtcgacgagaagccccaacagcacggcgtggcctctcagcctcggtgagtacccgccgtggggaagggtcctggggacccactggaggccgcggcccgcagcagccaggggccgagccacggccacggacgccctggtgtcccggtccgtgccgggcctccaggcggaggaggcgtccgctgggctcagatccccgactccagccccggttccccggcgcctgggctgcgcggagtccctgtcccgcgtcccggacccctacgcgcagcctccacgcgctccgagctggagaagccgccagcccgccctcccagggcgtgtcgcccgctttctgtttctttgtgcggggcatgtgaaatgtgtggggccagaattgtctccctaaagaacagttaggtgagagttcacatcacaagttgcttctgtgctgctccccagccagggtccgaccggccaggctccggtgaactccaggcaactccagccttgcccagggacttgctcgctccgctgggcgccgcaaaggcacacagatgcgagggaatcctgcggcctggatcctttggggatttgtaattcctcgctgctggttttctcttttaaaccatcacgttttcttgctgagaggaaatcatctgtgatgaaagtctttgtagatgcttggaaacattgctgggcctctctctgccctcttcctctgccgttggacttttgcaataaaaactaccatttgattttaccaaaaaacgtaatgtacatccctcttacccccaccctgccgcggtctgattcttagagtctgtcagagaggagataccctgagcctatcatgtgacaatgataccttattgatatgataatgatatgggtattggagacaccaactcttttataagtctttgaaatccagggggttgtgaggcctcacccctcaccccgcctgagcttggagcttggcgtggaggagtgctgcttcggtctacgtgtgtacacggcactccatgtgcctgtggttgtgcttgcgtcagcctgggagtgcgcaggcatcagtggtgcttgggagcgaggcccctcagtctgcactgggatcatctgcactgcctataaacaaggcagcctctcttagctccagtttcctcatctgcaaagtaggaaagtaggaataataacaggagataactcatccagcagcacgaagtgcgtataaatgtcccggcacggagtctgacacatcctaagtgctggatccgtgctgggcatgtttatataattgcacatgagactgtggttcccggagcacgtaacttgagcatatgtttatgtgtgtgtatacggcaggtcctgggttaaagggacaggagccactgtcattattccaattcagtcactgaggaggtgaggctgagaggcattctcatgtctgaagaggatgggcttgcctgacccccgcccccgtgcccagcccagcccagcagcccaagcagttctccaggactcaggtttcagaccttcaacacttgccttgggagacaaacagcggtgcagcccttgcttgcaagccattccacattagacttcggattgatttatggcaggatccctgctgtgcgagaactgcagggggggtggggggcggctatttcttgctgctaactcaggcaggatgtgtctatatcctgtctcagtttatgtagctgctcatcagagccagaggttagagcggagaggacccacttccgccaggccggcctgctctgctcagctcagctgggctaggccccaatgccacagttactgcgcgtgagtcatgcacagcaatccattgccttgcccttggatggaaggggtcaaggctcagtgagaagacggccaggtttggcagctttatatagaattcaccgcctctggcagaagcagaggattgcattaagtgccaaatgaaattccacctcagccattgctcaattcctccagatgtcactggcactgggagtcacatgatgctggtggtcagcagctggacccttccaagggtgcccgtggttgggcaagtatttctggggacttgcagagctccctggggagcaaagggttgtgaagtacaaggcattctgcgcttgtggtgggaacaagtgaacccatctgcagtgagtaggaagaggtcccctcaacagaggtgagaggttgggccaagtcaagtcagtttgcctcttcaggtggcagacctgtatgtacatctatgcctcaagtgcctgtctgaggccacagccaaaacatcttccagtaactgagcatacccagtgggccaacaagcacgctctaaatacaaaaccaaacaaacagtaaagttaacagtgaatgaagagttaaaaataggagaaagacaccttctccctacctcaatggcaattactttatttattgaggataatccttctagaagtaaatttgctgatacaaatatttcttattttacataataaaaatgcattttatatattttacttcatcttgttttttttccatcagaatatctcttaaaggttataccttgttattttctttaatcagttcctctgctgatgggcatttaggctgtatgcagacttcatttaatttttttaaaccacacacagcagtcctgtgacaatgagtaaggaggattttacatgcatgtgtctgtaaactgttaggataaattctcccacctcagcatttgatttctgggacaaagtgtgtattcatttaaaatgttagtagatcttaagaaactaccctcctaaaggtcacaccggtttctcatgctcacaaatagcctatgaaagtcactatttccctgcgtcctcactcacactgcattttttatcttggccaaactgagaggtaaaacaacaaaacaaacgctgtcactttggaatgagcctctgtaattaagtgagactgagcatgttttcttacttccataagaggttgtattacttttcggggaagtgtcggttgatgcttttgtccatttcctgtcagcaccccacccccgtgaggaaacgtgccccagaagtgaaaggacatgtcctcatcacatgacgagtgaggggcagagcagaggccagagcaacatccgtgctgtggagtcagccctgggtttgactgccctccaatgttcaccagctttgggagagagaggaaatacctcagcacctcagttttcccatctgtgagtgggaatgataacagccacttccccagagtcacccgaagagcaacagcagaagggcctggacctgctcccagtggcagaggcttgggaggtggcttttgttagcgaaatttattggagcaaacctggcctgaggatgctggtaatttcaggagtcaccctccagacagctgttgtttttcgcttttgataaaataacaacaaacttagatgccgagccctggtaaggggctttcctgggtctcccctgcacacctgctatgataggcattttcttttctttttctttcttttctttttttttttttttttgagacagagtctcgtgctctgtcactctggctggagtgcagtggtgtgatctcaggtcattgcaccctccacctcctccacctcctgcgttgaagagattctctgcctcaacctcccaagtagctaggactaccggcatacgccaccacacccagctaatttttgtattttttgtagagactttcggatgaaacaccagaggctcgggggagataagccgccatagggcacccagacactgagggcgcagccaggctgtagttacaaactgccagaccccacaggcaactgaggccaacccaaggagagagttgcagggtatgtgggcccacagcttgtatgtgccaggcagggcctgctgctgtggctctgcacactgaggaactgcatgcacagacactcaggacccgcctgcctcccccagctcctcagccgggcctgtgtcccaccccagtccaccgttgtgtccatgctgtgctttctgtggtcaggcctggcatgctctgggctgctgctgcccttgcccgccttagcagctggctcggggtggccctcgagccctccctcacgcaccgtcccaggcttgctgcctttccagctgcacctctcacaactgttcacgacaggcccctcaacacgccgcgggcctggcacacactcacctgctggtctgctaggacccagtttcccaagcctagaaaacgacccaccacagccttgggcacagtttgcagccctgacagattcctgagtctgccttttcccagaattctgacctctccaggggctctgtgaccccgcctgtcccccactcagggcctgtcacagacaggggtttgctgagccactttgaggcaggtggatgattgcagggatgacccaaggcccacgctcccaggactgccaccattccaataccaaaagagcctttaaaaagccttcactcaggagctcctggtccagaacttggcatggacttggaggccagtaaatactaagttgaaatggacaggagtcaaccccaaacaaattctaaaggcacagttgttgggccccaggaatcccacctagtccttcccaccttctcacccagctggggttcattttcatatccactcccttcccctaccccacctccctctcatcttggcctggggttttcttcagatccttacataatcggaacttctgacagaatgctggctcctctccttagactatacattttcatttttctacattcttccagaacaatgttcctatacaaaatcttaacccatggcagaaactggcaagagcccatttcccatgtgcaggcagagccaggccggcgacactgggttccttcttaggcaaggcgagggttgggtggaccctggcatgacttctccagcccctggagagcctctgcagttctgaccccttcacaagtgagccctgggcttggtgaggggtgcctgcctcgcctggcatcccccagctgtagatgggggcagagcaagacttgctgccaacctgcctggctctgtggtccctgctccctctcccgttctgctggcgtcaccacccctccttcagaactctctatggaattgcattctagtctctcctgcttctgcttatgcatgtgaaagccagatgccccttctctctctctcttttttttttttttgatacggagttttgctcttgttgcccaggctggagtgcaatggcgcaatcttggctcactgcaacctgcgtctcctgggttcatgcaattctcctgcctcagcctgccgagtagctgggattacaggcgtgcaccaccatgcctggctaattttgtatttttagtatagacagggtttctccatgttggtcaggctggtctcgaactcctgacctcaggtgatccaccctccttggcctcccaaagtgctgggattgattacaggcatgagccactgtgcccagcctaccagatgccccttctcttattgccaaaacactgtggtcacacactgcttggggcccagcaggcacaacagtgacctctttccagggctcaggggaggaagctccgcttcggggcatgtagagccagccctgggcagggtggccttggttatctccctgcacccctggcacaccctgatggctctgtttatctgcactttgcacatgatggtcttgactgacacatcctcgcagagagccactgccagggcgcctcacacccgctgctcccacacgcagtgggcatttttacgaggggctcaggcacagggtctccagctgacccagcccagcactgccactcttcctccttgaactctggcatggagaatcttcacattttgtcagcagccgatgagcacatgtattctcagcacagtcttaaaaggggggaaattatgggttgccagatcaaaacctgataaaacaatgatgcctctggtgtggggcccagccaagcccttctcctgtattcaccgggcaacaggggcccattggatatgaaatccactttcgcttgagaaactcatccagtgctcttgctgaaacctacacacaggccttagcaatgcttgaagcttcaagttcaggttccccttctgtattttttcttaaacctttagctcaaatagactttgtgtcaatttgctagtgataaagggttagctttgaaatctgaggatgaggttttgggtctggatccactatgagctggctgtgacctgggacaagttgctggtccatcgtctggcacagggatggcttcacagggatgggacctgcccagcagggtcccgcacttcctaggtttaatgctctgtcactgctatcttcaaattcttctcttttgaataagaggcctcatgtttttattttgcactgggctctgcaaattctacggctagtcctgaacctgtcaatggagctaataacagtctctacctcagggctttgttcggaggattcagtgcattctcacagataaacatcctagtgtagtgcctggtatgtgctcataattgtgcttaattgcttccgctcactgagtgtgtgcgtgtgtgcttaaacgccagcttcctccccactgccctgctccctccttgctctccagactcctcagatgtttgcccctttgccactgaaagtcatacccaatgacagggggccatctgcatctgtgtggtcccacagagaccagggaaaggccctctcgctcccgatgctgctccttcatggtttttattgtttttgtttttcttttgagatggaatcttgttctgtccccaggctggagtgcagtgacatgatcttggctcactgcaacctccgactccctggttcaagcaattctcctgcctcagcctcccgagttgctgggattacagacatgtgccaccacgcccagctaatttttgtatttttagtagagatgtggtttcaccttgttggccaggattgtctcaatctcctgacctcctgatctgcccaccttggcctcccaaagtgctgggattataggcatgagccaccacgcccagcctccttcatgtttttatccaagagtcagcactgcggtggagacagcccagaaaacacacgcaggccctgctcttggccacgcacgccagctgtgtgatggggagcaagcctcttaccttccggagctccatttcctcacatcaccctggagagaggtcatctttgcccccacctcatcggggcaccagcccctcaaccactcatacctgggccatctggttctccatggagaagagtaggctctttgaaagcaccgtatgagtgaaggaatgagtgaatgagtcagcaaacggatggagggatgtgaaggtccatccatgtaggcaaacaaggtctgcaaagagtgccctgggccccagcattcactgcaccctctccctgccctgggcaaggccctgaccctggtgcactctaagctcctctcagctcagcccctgacctctcccctgtctgccagtgcccctcccctgagtgtgaagccgggggcctccttccctcggctcacctggccctcatgcgctctacctttcaatgtcttctttaggcagtcatttctcctttttccttcatgctcccctttgaatgggcttggagctgggtctctctaaggttctggtctctctctctctctctctctctctctctctctctctctctctctctctctggagaaagctccttctcagccttttccagcttttccaggtcccaaactcctgggaggggagccaggccttgcttgatcatgccctggatggatttgtcatattaatccctttccttcaacttcggcaaaacttctcattttagcgaaattaatttcagttatggttgaaaatcctgagtattccctttttaaaaaattttcatagtcttttttttttctttgtcactgattctttacactatcctgagccatcctcctcatctggtgacagtagccctgtctcagagagtagagatgaggctccactccacagacgccatctcatttagccctctggcagccccagggaggtatttttatctccattttgcatgtgatgataccgaaactagcaagtggatgtgacttccagagaacctaccagcccctcacacctccttctcttccccctctacattgaaagctcagccagggcctgaccccagacgcagtgctcagagaccacagtgcttctagaggcccacaacagtattagagcttcttttaaaatcagaaggaaggaaatgaacctctaagatcaaatagtacatttgcctttataccagtgcagctatacaatatgatttctaatatttgggaggagaagggacccataaggtaaagcaccttggcccatggaagtcaccctgtgacctgagctcagcccattggaggttgaggggctgaagcccactgcctctgctctccctgcctgaatctgccccttgctcccagggctctgatcctcctctacgttggcagtcctggttccttagcagttctgtctgtcacgggaggactccctgggctgggcatctgcaggggcagcctctacctctccctgtgggacttcactaacacagctggagtagatgctagggaggctcaggtcatgcactacttgctgtctttctctctctctctctctctctctctctgtgtctctctcattttctgtctctatctttctcttactcttttggccttttaagtcagaagaataggctactcttcacttacaagtttaaaaataagttgtctttgccctatttcattattgcagaagcaattcatgttcattgtagaattgtaggaacaagatcaagaggaaggatgtaggaagaatctctatggggaagagggtgactttgagatacaatctcttgccctgatctgagctttcagttacctaaggtacagtacagtaagatactgagagagagagagagactagttcatataacttttatagagtacgttgttacaattgttttacttcattattcattgttgttaatatcttactgtgtctaatttataaaataaactttatcatagttattcgcatataggaaaactatcatgtatgtaaggttcagtcgtatctctggtttcaggcatccgctgggggtcttggaaagcatcccccataggtaagggggaaccaccgattcatgggacagatagatgatcacccagtggcagctcgaagggagattagggcacagataaggctggaggacatcagtgtaaagaggccaccctgtgaggggcccagaagggagccctggagaccctctgggtgcattgatcacctcagatgggggcccaagggatgccgacgcagggcaaagcactacagcagactcggcacaggtgcctggggctgtgcacgccctggcaagcgcccactctgccctgctccgcacctagtgaggacgtgtaacacacacagtgcctcctttaatgctgaaggcatcacacagatgcagatattattaattccagtttaggaagacaaaaagtgaggctcaaagaggtgatttccccagtgcttccctgtgcatcactgacacgctctctcctggaagccaggtgtgtcttcctccagctctgggactctgcagcctgccctgctgggagggggctgcccatgaccccttgcccttctgctcagatcgttacagccctgaggtcgctctcctggcctctgaagaaaaggcctttctttgttccccccacacccggaaccacttgtgttccctctgccgtcctccgcaggcacccacctgtgtcccagcagctgcgaatgcagtgctcagagtggtacacaagggctgggttgtgacagtcctgccagcccaggccaacccactcttcccccggggaaggagtgggcagctgcctcccaaggtcactacaggggcactgggagagaataatgcccccaccaactcctggccaattcctggaatgcctccaccgtggaaccacccctgggctggcaactttattctgtgttaaagtacaacaagccagccggaggatcattgtcactgcatgactgcaatttctgttacactttgctaggcactttcaaatctgtttccactcttcattcgagacatactagtctccctcttttgcaggtaaataaagcagacctcaggaaagttcagtgacttggcagaatttacacaaccaggttgcaatagaggagccagactggaccagtcctcggtccctgtctcctttgtgagtgtactgttcaggccactgaaactcattcatcattcttaagtgggaggggctgaggctgaagagtcattgcaagtaagaaactgtgatgctggccttccattctcctgcccccctcccctccctccctacacacacacacacacacacacacacacacacacacacacacacacacatatgcacgcacacacacaagcacacacacatttcttcctacacaccatctccttgcgtttcttagcagcagacaggtatcagccccagacctgaggcagacacttggggatctggttcgggacagggcagacaggcatttggtgcatggatcctactgacctcccagagataactagaaacaaatgtaagaactgctgcctacaacatcttttggccttgggtgttaggtgccacatgcttttgaaactttttctactccactatttttaggactctgttcccacttctttgctcagtgtagagcatctgccatgtagaatatctcctcatagcctcttctgtctgcttgtcactcaaggtcattgtagccatcagaccccacctagcagacagaggatttagagacagaggatttagagatacgtggatttagagaattcagcaaggctgttttgcttatttttggtttgggttcagcactaagtctcccatacccttctgcaatgaatccctctggagtgtatcagtaaagaaaacagaaacaaccttccccaatcataccccagcagttaaatatttgggtcagtttccagacatgactcctacatgcattgcctatcacatgatctggatatcttttttttttcttttttttttttttggagatggagtctcgctcttgttgcacaggctggggtgcagtggcatgatatcggctcaccacaacctcttcctcccaggttcaagcaattctcctgccttagcctcccgagtagctgggattacaggcatgcaccaccacgcctggctaattttatatttttagtagagacggggtttctccatgttggtcaggctggtctcaaactcccgacctcaggtgatccgcccgccttggcctcccaaagtgctgggattacaggcatgagccaccacgcctggcctgtggagtccttttctaagttccaagtctgcagggacctcttgtgtagcaggtgacctgagccctgagccttgaacttttcatccacttatagtgaatacagtcaagagccccaccattcagatcatcccagtccaatctgatgcatttgattttaatccagggagtccctactgcatgcaaggtgctgcacaggagacataaagggacaaagaccatatcttcaaaggggcttcagcctagtaaggaaggggagatccaggagcatcagaaaacagaataagtcaaaaagctgattagagacacgtggcccagcagactgcttgctgcacctggctcagacacaggtaacagtgccaggctgctttgagattaaggccacatcttcctgaactttcaaaagaaggggttcttcacctgggatccccaccctaaaagtcacacacacacaaaagagcgtcacaactacaaatctctgttgcagtatttttgtttttgactttttttgcagcagtggcaattttataaaattaattcttagatgaagtctagaaatacataagagataaaagtccatctgacccatttgagtaaggaataaggcctggtggccacacccccagggccccttgtgatggctcactcccgagacaagtttgagatctcctgcctggtgccttccagagccagagcagttaactgatgctcggtcactgtttgctctcagggaggacactttgaggcctggatctcagatgatccctccatagcagacgtctctaccccatgcagttgtgaaatgctctcattgtggttaaatatttgcctacagccaactacaatgcacacacagctgtttatcactttaccaattagttccatgagaaaaatgctatcaaacttcagaaggtttacgctcaaactccaggaagaaatctgaaatgttaaaaaagagactggatacaaaattggattgcgagagcaattcatccgcaagcaattactaatcactttagacatccctggttccaccatcattggaaacacttggcgttatggtggttctcccctgccgtcagtcctcagaattgagaggggacaaaggtgtgagatgagatggctgccctcaaagccttgttgggcttcttgggacagcaaggttcacatcatgacaggaataaaaagcatccagtcttcctggtgagaaatttcttatcacacgaattcaggtttcggatcgaattgcctatgacttactgcgattagttgctgaactggctcaatagctatgtagctacttagagaataacttcaaggagtataattcccccaacgtaaatgggtgcttttctagctaataggaaattatagtaaattttgacctagttagacatagtcgcagcttgttgaattaaaatcctgtgcttgaagagacaggttgttggtgatcaatgctgactgctgaggatgctctaactctggagaatgaattggtaaagacaagttgcagggatacgaagcaggaagaacagtgctgatgtccagagctcactacgtgcgcagtgttgcctggcgacatttgtccctggtcatcatcctgtgctgcgagtggatgctccaggccatgccccctcctcagggtacaggacatgtctgtgagtgtcagggctgtgattcaagcccaggggttccaacccctagtctatctcttaatccctgcacggcaccacccctccctcatatgtgcggaaactggggagtttcaaggaagaacagagtatcctctcccaaaaggagggagagaaagttggttcaagcaggctgtcgagtacattgatttatatcaggccttggtaattcgccctgggtcatttcttatttcagaatcctggagcctctgaaaaacccttttgggacaggatatttttaaacaatttatttgagcgaaatgaagcttgtcactcactgagaaaactaacaatgctagaggaagtcaaaatgcctctttcaggacgtggcggtcacaggaggatgaaatccacggtgttccttcgaagttccgatgagctagtgtttcccgctcatgggcacttctgagccttattattattatttcctggaggcttttgtcctctgcctaactctcttcatggtcctaatctcttctgtttccagggtggtgcttttggtaaaagccttctctgaggttgcaacatcccagaggcacaattatctgagtttctggccacatctcgtcttcctcggcccagggctgtgggaacagaggctgaactgtctggaggatgaaaggatgaaaggctggcctctcactgccctgcctcctgccctgagagccccagtggttctcaaagacggttctcctttgaattccctgcgtgtgaggccctccccaaggaaaaacaagttctctctgctccagttcatgatgtctccttctgagaccgcagctcccactcagggaggcttgtgctgcagcacgccactgcccagagctgctctagcctcactggaccaagccttaagtttagccaggactcacttgctggggcccttctgggacaccccgattccaccctggggctcaggattgcctggagaagtctcactgtgcagcgcctctccaaccagtgcactcacagaggggcacaaagagcccagcaggccacccacctcacctccccattgctgtctcggccctgccatgagccagtgagggtggccttggggtactggtttcaccccctttggcctctgcttccccagcaatgcctgtgtcctcacaggcacttctgtaatccctagaagggactgaggcagcagggatgtgcctgcgctctgacaagaagcaggatatcgcatgggtcacaggcttcgagggggccaggctgggctacaggcacagctcagcctcttggtggcttagtccccacaggcaccttgcgtgagaggctgtggatgaagtcccagacctagcacggggcacacactcagtaaatgttaaccagggagggaccagaaagactcagagacagggagacttcaacaggagggctgcaaactgagacccactgccaaatccagctgccccctatctgcacacttgaagctttcttggggcccaacagcacctatcatttacggagtgtcatgtgctgcttccctgctacaatagcagcattgaatctttgccatagagaccggtggcccccaagcctaaactatttactgtccagccctttatagactcctgactttaaccaacaggagactctctgatggcacaacttctaggcctgggcccacctgaccccattgcacctcaaccccgtgagtggatgggaagccatggaagaaaaatccaccctgaggtcagggagcaggcagcagccagggaggcccactaacctgggcccacgagaagagcatcagttcccgttccctgaccttccactgcccaggctgctagcgggtaggaggggctcttgtagtcttcccctctctcctgccctcctcctacctcctctggaaatacaggcactcggggctttgcctctgccctgcagaaaatccccacctcactgggcaggtgccggagggagagccagagcaggtgcaagcatgcgaggcaggcttccctgagcccgacagccagggacaaccagctaacacccaagttcagaaaacagtgctttatcacaggcacgagcacaggggagcaacctctccacgcacggggccaggtgtcagctgtgcacttgcatgcttccttattggaacctctccctaccgggaggccatcattagatttggagatggagcctcgggggtcaatgtgtgtccgtattcttccagtcataacctggtagctccagagctcaaccgtggtctcctggagtccacacttctgctgactgccctagcacacacgtggcctgggagctcagattccacaaatggtcactgagcaccagctgtgtgtcaggcccaggccaaagccctgggaataagacagtgaacaaaccagcaggaatcccaagaggacctcacactttggcgaggtggacacatgggtaggatgcccagtacatcagatggcactaagggctgggtggccagtgaagccgggaagggagatggaaggtgaggagtgagggggtgccatcttatagggtggccatagaaggcttcactaagggtggcaatgtttgagaaagccctgaaaaaagtgagtgatccagacatggggccatctgagagaagcatgacaggcagagagcacagcaagtgcaagggtcctgaggcaggtgcaggcctggtctgaccaagacacatccagggccaggtggctgggggatgagggagggaaaaggtaactgagagatgcaggtggacaggtgaggtggtagagagatgaggggaccacctcccggcacctgttacagcatccagaattccaccatcccctctaagtcttggagccttcaaggcccctccagaaggctcatgactctgaggaggtgcccttctgcatctcaccttagccctaacaagagactgagaggaaggcccgggcaacctgtgacatgcggtgggagctgggaaggaggaagagaatagtgagccctcctgcagtccctgaaatggggggcttcacacagtgcccaatttgcacattcacctgcacacacacaaacacacacatacacgcatacacacacaaacacacagaggccagctttcagagcctgtctgaaattgtcagatgtatctttcgggtgcctggccctgcagggaatgagtgtgagtgtgggtcccctgtcccctcagcacctgcagtccacagagcacacaggacccttagggagcagggagaatgtgcatggacccctcaaccgcagctctgggtcagtgcgagccctggaggcatcagcctcagagagagcacagagcagcaaccttctcccctcagggtggaggggctggcccagcagtggacagagaacagaactgtgaaaggaggtggataagggaggtctcgacctgatgcttctaggtccaagctgccacctaacctgggggaggaaggccaggaaccacactcagccccacccacacttccctggcacaatgaaagcacagcccatatacatagcctccttctcctctctgaaatcagagaggcagagagaacagctcggcctcacacagctcaggctagaacccagtattccaccacctcagtcttatcctcacccatgtcagaggtacagactaatgtaactcacccagaaggcaagtcacactcgaggtcaggatcctaatacccagaagggtattgggagacccagaagggtattgggaggtacttttcatctgcttgatgtgatgaacggtccagggagggcaagtgagcgaagccctccaacccaagcacaagggctctttctgtgctctttctgtgtgcctcctgtcctaagtaatatgatgccaggacaagaatccagttgctccggaagagactgactcctgattcctgcgcttctcatcttcacctaacatcttggaagttggcccccgggcatctgtctgtacttggaatcgctcatgcacaccaaaacacattcacatttcttatccctctgtcctcaccacagcctgggacagtggcagggtgggggtggagaaggtgatcacgttcactgagccctccgtgtgccagtcgagctgccagtgtgctctcgggaggagagtgtcattatgcccttgtttaaaagacaaggtctggggtcctaacacaacttggtatcctgagtgttcctaaataaatgggattggaaaggtgtgaaataacaatcctaaagccacaccaatagcaaatggcggagccacgactagaattcaggtgttttccacaacctctgtcccccacagattcctgggcaggcagaccgtgccaactcctcttctcagttcaaccaggtgctttaggtaccataattttaagtggacaaatggtttcatgcttaaacactgccagatcctctccatgagatgcacatgtgtacacacatacatgcacacacactcacacacacacatgcacatgggcacaggcacactgttgggagacttaaatgacacctcttaaatccaggaggatcagcctcttggatttaagctcgagtctctgctgagcttggaccctatgcgacctgagggctcccaagtccttccagagcaggactgtggtgccttgtcctaagagaccctgtctctgaatagaaagtaagacacccgcctcctgtcagcaacatcaggacacaaagcccggactcacaggcaggctgtatgtggctgtgtctgagtgtgcctgggcattgtattataatatttcttccaagggccttctttccatcctcttattcaagcagatggaaatggctcctccacccaggcctgcctctgataagcctccgagcgggagaagcagaactgagcctcttatcagtcagctgcaggggtacctggtgggcctgtgctgggtggcctggtgttgataaaatgggcttgggccagccgctcaccagcttctccctcagacccatccccaggccccaacctcttagaaatgggagcagtgagacccagaaaacttccttactttctgagataccaaagcaaggcaggcttctgggggctatgggcaacaggaaggacctgatgggaaacaagtggggggggaatacaggctcggcaaggccgcgggtggagaaaggggcactagagaggccctcgagccctgaatgtggtggtgggagctggtgcctcccacaggtgtgacaggattttgcgtgtgctgagaattccctgtgaggcagactctactgctcccatgtgacggcactgagcctcagagaagatggaagcctttttttaagtgttttgttcatttaaggtatgatgtggtgtggtcgggttggaagccagatctgctggtgccgaaagcccaagcaccttgctccttcctgggagctctggctggaggggttcacccctccgaatcccacccctgccacacacacacaccctgtttgagacagcacattttaccttcagaagttaacttttttcctcagcttctgttactgttaaccccccaacacatttggtgagttcaaacggaggctggcatgcaatatttgggacatacttgtattcaaacaattttcattttttatctgaaagtcagatttcactggcttcctgtattgtgtctggcagctgtggtagaaaaggacctgaacatgggtgtttctgaaagggtcccagatgattccaaggtgcagccatagctgagtgcccagggtgagtggctcctgctgagcacacccacctgctgcagccctaccaggccccgccacaaagcccagggtggacggacccttcgtcatcagaaacatcctccaaggggctttcccagattcccttcccatcctttgcatccatctcgtggattcctcccacaatgaacagaaatctattttgtatgtaaatgtagaatctgagacacatcttaatttttaatactttactgtaattgtggaagtgattcaataacggggcatgtggaaacatagaataataaataattattcataaccctcctacatctcccatcacactgatgttcccttcattcgcttctactcacactcctgcttaaaccccaaattctcagaccgccagcctctcctgcagctcctacctcatacccagacccttgtctctgtccatcatccactcctgtgagcctctcattgtgtcatcctgattctttctcagtagcttcaaagtgctattctaaacaatgggctctcctttccatccctaccctgcttcaaaactctagagaatccccttctctatgacctcttcacctgtcgtggctgttcgtcactacccgagaaaacgcagacttcttagtctgatcttcaggatccttcattgccctttcctcacccaagcaggtgagtaataaaatttattagtgatattcaccgtagtagtgatggtggaagaagtaataagacaaggaaaagaaaaagagaaaaataagctaatgatatgtactgggtttagccatttatattctttcattttttcccacctaaaaccacagagtttatacttcccaaaacaactcagaagtagttatgttaaatgtgtaaagaaaaattaatgcatttgtttcattatgaaaccatctatacttgaaaatgatacaattatttgaaatctgtacaacctggcttcttccagctgtgctgtgagccctccacacaacctggcttctctaggagcctctaatcctgattgaagaaacagatccacccctgtaactgcctcatgtctttttgggtaactgctttcactctgttacttggtttgcttaagcaaaggtttcttgcctttatcaaggaaattagcacaccagtctgacagaagagtagattgtgtttgtgcttacccttcttctcctaaaattaagtgttagctttcaaacttgcttttgaagtgctaagaaccctgatgataaatgatgaacaaagcctcctgtttacattagaagcatcaaaacagcaggactgggccaattcacccattcctgttgatcattagacattaactggttgtccaacttcaaccacatcaactacaaaatcctgaagtgaaacaaagtctaagttagttgacttttctttgattagtctctagtgcatttatcactttctatgaaagaagcatctaatttagatggcagttgatttgtgtcatgggatttcttctgacaggaggcagagttatgtatgtgtttatggcttctttgcctttaaaagattaatgttgggcaaatataaatcacaagacctggatagggggctgggaagatggagcaggagcttgccagggtgatggattgagacgtattttagaggattttcattgctagaaaaacactgggaagatgtggcagaggggtggtggggcagggacagtgaagagagatggctttttctccctaagcacagagaaaggacaggatgggcacttgagccagggcaggtggctttctggctctgtttcagaagcaaaatgaaattgaattggtaacttcctgaagcttctttcctgccctgatacccagaagacaggattggaggacaaaggagggttcacagcacagctggaagtgctcaaggtacccagctgctccaggagataaagtactccctgcctgccccagtcacaggaactggcccctgaagccaggctgccacaccctatcttcccatagaccaagtctaggcttctgtcccctgaggctgtgtgtgtgtgtcagtgtgtgtgcatgtttgtgtgtgcacctgtctgtgcatatgtggaaaagtgtgagaggaatgtgcatgagagtgtgtgtgtgcatgtgtgcctgtgtgtgcatatgtgggagagtgtgtgtaagagtatatgtgtataagtgtgtgagtgcatgtgagagtgtgtgagtgtgttagagtgtgtgagtgtgtgtgagaatgtgtgtgatagtgtgtaagaaagaatgtgtgtgtgagtgtgagagaatgagtaggagtgtgagtgtgtttattagtgtgttagagtgtgtaagtgtgtgagagaatgtgagagagtaggagtgtgtgtgtataagagtgtgacagtgtgtgtgtgagcacgtgtgagtctgagtgtgtgtatgagagtgtgtgtgagtctgtgtgtgtgtgagtctgtgtgtatgtgagtgtgtgtatgtgagtgtatgtgtgtgagtgtgtgagtgtgtatgttcatccttaaatatatgaggacaataagaatagctcccatgtgccgggcaacaccccgagagccacactcagtgctgctttgtatgtgttgcctgccgtaatccttcgctagggatgagcacacgagggtccgggaggggtgcttggagttgggacccagagcaccaggacttactgtcaaatctctctggcaccaaaacgcatgctccctatgccacctatcaggatgcacccttaaagcacttttaagatgctttttggaaagagccatttgttggtgtgcatttgtcttcaccactgccccaaacatagctgtccaatattcaggtgaaaatgtcccccatcggccgggtgcagcggctcacgcctgtaatcccagcactttgggaggccaaggtgggcggatcacgaggtcaggagatcaagaccatcctggctaacacggtgaaaccccttctctactaaaaatacaagaaaattagccggccctggtggcacgcacctgtaatcccagctactcaggaggctgaggcaggagaatcacttgaacccaggaggcggagcttgcagtgagccgagatggcaccactgcactccagcctgggccacagaccaagactccatctcaaaaaaggaaaggaaaggaaagaggaaagaaagaaaagaaaagaaagaaaaaaataaatgccccccttctttccaacaggctttcaaatgcgagtctgacataaaagacagatcacagcatcaccaacagcaatggctaagatgtacagtgtatacactacccacaaccttcacaggcatcctttcctgcgagcctggtcaccaccctctgctgcaggctccctccccatcccactgagcctgtgtgcctctggctcatacagagccagtgtgcctctggccggcctgagtagggagaatgcagtggcctttcctgaacccttgagttctcacggagccctctctggctagggaggaggagaagccttctagggaatgaggagaagcggccccctgcatcctgctcctgcacttttccttccttccagcatccttcaccactgcatctccaccctttgtgcccataaactgtgggtcctgttgtctctgggccactttggcctccccttcctcagcacatctcctggggaagcacggctatctgccttgggatgtagccacgaacctcctccttggagccaatcctcctgaatgtttgaactgagtttccaggcagcagaatgttccctcctgcctcctgccgcccctgcggtcctgcccactccccacacgggctctgctgctcctgcctgtcaaacccggtggaggaaggagaaaaacactttccacatcctgttaaccaactgatgagccttctggaaacccaataacaaagcgtacctaactaaatcatcattatttacacatgcagcccaatcgaggacatttagtcatgtaattaagtacctaattatgctgaaaatgcaattatatgattttttaaatgaattaagtcctccagagaagtggtaaagattagcacgcagcatctgtctggggagcaggtacctcgaagggcacccaaatgtgacaccaagctgcacaggggccaaatggtctgaacccagatcacatgtgtgagcacacacgggcccacacaggctcacatgcagaggatgccagcttcacctctgtgtctccaggactctacaaaggtctggtgcacaccaggaacttgataaatgacagtcattaatgtcattggaagcatagtatacatctatggagtgactattgagcgacttagagaatcttaggaaggttatttatccagcatctgagaggcaggtgtgtagagaaagaaaaaaaaattgagagaaggatcagccaggatatgtcagaggatattttaagcaacatcactcattcattcagatgctaaagcaaaaaaacacagtcagtgtcttctaggagctcaaaaattagtgcagagttggctgggcctggtggctgacacctgtaatacaagcgctttgggaggccgaggcgggtggatcacctgaggtcgggtgtttgagaccagcctgaccaacaaggagaaaccccgtctctaaaaacacaaaatttgccaggtgtggtggtgcatacctgtaatctcaactactccggaggctgaggcaggagaatcgcttcaatccaggaggcggaggttgcagtgagccgagatcgtgccactgccctccagcctgggcaacaagagtgaaaaatccatctaaaaaaaaattaattcagagacagaaaaagcatcttaatggtgatatgaacaggttgttcagcaaactacaacttgtgggccaaatgcaacctgtggcctgtttttgtacagtcaggtaagctaacaatgatttttacctctttacggtgtttcctcacttccatcccatgcaactcaggttccgaggccatagtattaatcactcactgtacatgcacaactccagtggggggtccagagtgatcattgcatccaggagccaaatctcatatttctttataaatattgaaacaaaactgtggagccaaattgttaatgaaagaaagattcattatatcttggaaaaggaagccaatgatgtgaataaggatgaagaggttgaagatggtcacaggaattgtcagaggaggagatggagaaagatgaggccaagaggggaaactgagtctacacacttcagtgtagggtttccctccatgagcccaaaatccaagggacaacccggagcctcccctcaaataatcctggcagcggactctcaatgagcataggaagtgagaggaacctttccagtgtctctaggaaaccgttcacactggagacccctgagaggacagctgagtaacacaccaataacaaactcagggagctcgagaagcaaagtctgtggccagcggccctgtgattccaaatgcccagcctctgacctgctccctgagaggtcagaacttcccttcatttccacctgcagaagcaagggactgggggtgaaccatggactgaagccacagcgcacatttctcagtgtgcaattgcagcccagggaaagggtgaaaggagcagtggtcactgaatgtactgtctcttttccacaacatgcatgtctttcttgaaaatgaaaatgactacttggagcatctcctaaccaggttaggcaaaggatgtgtggacacgagactcagagggccattcagagagggtggtcatggtcctactatccaacaacagcctgacgcctgctcacgggagacaccgccaagcaggtgcaggcatccagtgggaacctggagcaaggcgggcaggtcagggcggcgggaagggaccttaacagaccttctagtcggcgactttgaagattcttcaagacaatagccagttctgaagattcatccccgtttcttcactgtaaaaataacacgttttttgtagatgacttggaaaatacagacagccatatgttagaagtaaacaaaaccactcctaacccgtctacttcttaaaagccggtacttaacatttgaagcgtatttcttttcatcgctttgttttaaggtttttgtggaatatttttcatcatttctatttagagggtcccgttttcttcacttaacatcaataccctaagcatttcttcctgttgctaagttcacgtgcaccccttccctaactgcataatactgggtcatatgggggtatcataattgacataaccaatgcccaaatatggaacatttagattgctctctctcttcaatttttcattttagactgcattaccatctactttcccgagcacggacttttgttcctgttccagattgtttctctaggatcaattcctagaagtggattgcttgattctcagggtgatacatatgccaaatagtataccagagtattgaaggtacttgtttctaggaatcccactttgacatatcgacgatgagaataattaatattcaaatagcctgacctatgtcaggcactgtgtaccacaaactagcttacaatggggctacactgttgtgccaccgggttttacatgtgaagaaaccatggtttgcagtgagccaagattgcgccattgcactccagcctgggcaacagagcaaaaacttcatccaaaaaaaaaaaaaaaagaaagaaagaaagaaaagaaaagaaagaaaagctacatagcattcctcaaaatggtctggccatgagtatcgtcactgaggggccactccctcacctgtctgcgccatgcctggcaagtgtgctgacttcacagcagggcggccagatgcctggccctgagcctggcagatgggtgaccccaggagcatggtgcgcaggattgcacaccctcaccctcctcagggaggtgtctgggtggagctgggactggaaataggtgtgtccagggtgttctgcgctccagccacctccggtggagcttggagctggcaagtcaagcagatgctgattgggatacacgggccttcctggctcctcagaacacctgcacacagccattttctttgccattttggtaccccaaacacctatttttggagaagcatttccctgctgcctcactggagctcagctatccttaaatcaatcagcagtggtctggtaggtggatcagctgggaacacatgcttaatttcccaacaacaaggccaaggagactgcagtctcaggagctatggagcagaagggtgtgtgcatggaccagaccccggcacaagggccccaaatccctgaacccagcaccaggcatgggggtagacaggggacacgcagaaggaatagattctccgagtcctccactgtgcccggtcctcatctctgtcagggtggggttcttgagagcctggttgccgctcactctcagatggtatctcccgcttctcccctcagcttcagttccctcttaaggactctgttctccttccacttccgctgtgaagatccctcagcgtgatgaagatgcaggggcaagtcagaggttacacagtgggggctgccctgctagtgtgctgaagccacgccaactgttcagggcagctttctgcttccaggaagaacacattgacctggctcctttcaacagtctgggcgttgtcttaagcctgagcttcttcagttgcctgctgaccccagacaccccctccagtccctacccatctccagcagccagatgctgaccaagccccaggagcttcccagacgtaagagccactagaatcgcctcctccccactcttcctgcctctttcaaatttgatttccctagaaatcttccggcagggtgtgtctgctgggggtcaggctgggggaattgtggttctgctttccttcagtctatgccatgagtaaagaaggatatttgtgaacaggtgagatggctcatgcctgtaatcccaacactttgggaggccaaggcgggcggatcatgtgaagtcaggagttcgagaccagcctgggcaacatggcgaaaaacccatctctactgaaaatacaaaaattagccagacatggtggcaagtgcctgtaatcccagctactcgggaggctgaggcagggagaatcacttgaacctggggggcagaggttgcagtgagtctaggtcacgccattgcactccagcctgggcaacagagcgagactctgtctcaaaaaaaaaaggatatttgctgctttcctgataaactacaaatgctgcaccatccacagctgacaaagtcctctccccagtggtggacaagggcaactccaccttgctcagccagcttttatccccagattcttcctccttcagagtgccttgctgatttctgctgttgtcaggatcctggactttggagacgatggttccactttttcatactctcgcctcacaagggagaaaaagcactctttccttttacttagatgtcatagctcaactgaggcagattggttatggtgttgaagtaaggttctgtttaaattttttttctaaggctcagggcgagtaacagggaaatctatacagaggaaaccctggaaccagacatttcaagttctaagtcacggcagcctcactttctttccagttcccctcctgggagtacatcccaaaagcaagtgactaggtatgaaaagttatccagcaagactccaagatgtacataaggaagagatgtcctttcctgactctgccttctgagtgttgagcctctgcttcatcccaatttactgacataggaatgactgtcttctccagggcagagaggccacatctcctcccccctcacctttgcaggcctctacacttccatccagatggtgcagtgcagcctgcgtgggtccaattctgtcatcgatgtggtgttttgataccgcagcagcagataagaccggataagggttaggaggaggaaagcactgctgatcatcttatagagtgtcaaagcagtacagctaaattgcacagcaccttggcagccttggggattgttgggggactgttgtaaggtcacccatacagaccttcagggcaatcattttgaccttgagactttcagacacgttctgaacaggctggtcaagttcacatcaacctcacctgtgtattccatctgcaagaccagacgaatgcacatgtgctttatgcacagataggaagagtggccatgcctgagagtgacggcagattgaagccctcatagcatacatccagcaggtccctggagcccatggtgatcaggcatccagggaagctctccacccaacccagaggcttactgaccactctatcatcatggccttcccttcatgtatccctcccaccaccatgcccactaccacactggcattgcccacccactatctcagaaggacagacttggggccacctcttcaggaagcctttcctgaggatactggagatctatgggttccaacagagagcaaccttttcccaacttacccacatgcatttgtccttgtcggttacacagcgtgctcctgatggcagggacttggccttaacggtggagcatatggctggagcgtagaaggtgctacaaaaggtttgctgaaggaaagaatgaaccggcacaattatgagcatccccattgccatagaatcctagagtcctggggctcagtctcacagttgtgtctccacaagtctccctagcacctcgtcaatgctcattttgacgcttcatcacatagagactgtgggcagtctgacttttgcacctccccagccaagtcatatgcttcagggggacgcgcaccatattctcctctcccctgtaactctgtggctgaataaatgctaactgcttagccaacactggctggcttctaggagaaatggatgcgtgggtaataagctattcatttatttcttgggggcactttattctgagaccctacagcctgtacactgcgtcttttccggaagcaatgatagccagccatcaagggcaagtaaacgcatttgacctttcctaccaaaaagaaaagttagttaatgtacttcaactctcatctgatttctgcttcacttgtgcaaggatgctcaggaatctagagtaggaagaaaaaccacagtgctagctgagaagcacttaccatgtccccaaaggttactgttccttcccccattgctgtctggctcttgaaccccaaatcagatttgcacaaagcctttctgcttcagagtgcttgttaaattgacttttctttctttcttttttttttttgagagggattctcactctgtcgcccaggttggagtgcaatgatgcaatctcagctcactacaacctccacctcccaggttcaagtgattctcctgccttagcctcctgagtagctgggattacaggcacccgccagcatgcccaactaatttttgtatttttagtagagatggaatttcaccatgttggtcaggctggtcttgaactcctgacctcaggtgttccacccacctcagcctcccaaagttgggattacaggcatgagccactgcacccggcctggtaaattgacttttctaaccaggcttgtaggttcctcgcaattgaacactccaggtaactgccacagcacctggccaactgtcaagcagtcaacgttgctgttgctgctgcatcactgtcatcaacaaggtttgtcattgcaggaagtctccaaggacccccatgaaacacctgcatttcctgtcatgattttgaggctgaaatcatcttcctcctcccagaacacctaggtgttctagtctgaagccatcctcactctcaactcccctccttcgagccctcaccctgtgcctgaattcttccttctttgctgggacagatggacaggaggaagacaggaagtggggaaccccttcaacaactcctatggcagaggggagccataggagatgggccgggaaatgtaaagaccagcccacgcaggaaaaaaagagaactttttagcacagtgtcatctgaaaatgcaagagaagagaggctcttggtggcaacagaggagtgtgacttccagcctcagggctagcacctgacccctgctctccgtccacatctgaaaaataccactggccctgagaatccattgcaactgaggttctgcaccccaacagctgcactcaagctgccaactgaagcagagagcactgcccgcactgcagggttgtgcctgtgtgccccgctgcctccaggggtggctgccttctgccagagaatggacagctgacatcctgaggacatagagagttagtaggaatgactgtagccaatggcaaatcccatggatgaaaagccactcccaactccacaaagatgagcatagtgaaggctgcagtttagttggttcgtggttccccagaaggctttcaaacattcagcagttgtcattcagtgccaggcacccagtctaatgctgagtatagagttgtgagcaagacaagcctgaacgtgtggagcttcctgtctggtagggtgttgcagggggccggggggaccttgcaacctggaggagggctgggaagaaaaaaagtaggatgcttgggtctttccaaaaaataggtcctctcatgtctgtccaatcgttgtgctgggtaattgtctatttctgataccagacccaagcttggccgtaatcaacaccttattctgccatgaacccacccccaaggctgcccgcagatcacccccatcctagttgctgagctcagcatgatcctaatctcaacctcagaagtatccctcagctccagcaaggggcaggctttcattccaggccccttaagctggatgcagaccaaccacctactttctgggctggatctgagctcactcagccagtcttctccaaagacctgatatcactgctgctagctgaatgggtacagtgtaagggagtgcgccaaggggggctctcacccctccatctccagaggcttccggagccttggagccgtggatggcaagcagacactggggagaaagctgagaagtggggagagctgccttagatgctgagctctctgcctggaatgcttataggctttgtgcagcaaactcctatttgcccttaaaggactaatcctgatgtcaccgcttctggaagccctctttacaccagcacttcccagcctacagcatgaatcagaatctactatagtaattactgggtcccagtcctagtgtttttcttcagtaggtctgggctggggcctgagaatttctatttctaacaggctcccagaggatgctgtgtatccagagactatgctttgagaattgctgtctcacagcatccacaccttcccagacagccttgagcttcctctctatgctgattctgatctatcaatatagggcagctctggttgggctgaaatgtcactcccctggagtctgtcacattgtgaaacatgtgtaaattcagctccacacacttggtggggtggggggcatggagagagtagttccagctgagggaactttcctgcccaccacgctcctcagagggcatgagcttggagggagcccacattgggaggcccagctggcaatcccaatggtctcccaatgaggccccgaagctctcaggtcctacctcccctcccagcctggctgccctgctggaagtgtgtgtagtctcccagtatacagatttgagtacaaggtccctaaccagaagccaagaaatgcaccccaagttgttcaagccaaatatctcacctggaaaccagcttaccaaggctctacactttgcagtgccctgtaaggctaaacacactgactcaaggctgccagggcttcaaatgattgacttctgactctcaaggtacaagccggggaaaataacacttttctgggacgcagctgccaaatctggaaaatggggctaataataactcctatcgaatggaaatgttgcaaggtctgagttaaaatacattaaatgttgagagcagcacctggcatttagtatgaaattattaactgttttaaaggaagggaaaataacagtcccttctaaccctgattgtgttggacaaactgtcataagaaatgctggtctttacctggaaaatttctaagggcagttctgggtatttgagcttctataaccatccatgcctacttaagcaagatgttattctttctttccgaactttgaggtgcatagtggttagaaaagtctagaactccaccactaaatccattcatttatacatgcatgcatttactcatgcattcagtgaatatttattgagtacctactatgagctagatactaaattggaggctgcacttgttcactgtaataaagtctagcacccacttgaacttgctatggctcctgcttcaggtcttgctactgagaagcactgtgaatgctggatcctctaccctgcctggttcctggttcccaaggtgctgactccagacccagagttcactgggtctcttggcggcctcagtgccttgtattatcttcttccccacctccaagctccttggtggccccagacaccactagcttggcccacctgcttcctgctgtggacccctagctgggagtctgttttcccctcacccactatgactcctgactccagcaggcagttacttataagaaagaggcatctggcagctgcactggggagaatgacctcatagcactataattaaagtgatcatctgagtggaaatgactattatgaagcatccttctctgttttattatgtagagccattgtaatgggaatacgggatttcctatgttaatgctgatatttctgtgatccaataaatccttcttcacaatcatctcccagaggaaagaaggcattctgtgcagcagctctaggaaacatcaggtccccaatgtcctagacatcctaccctctttggccaggccattaagctgtgaaaaaacacactcagtaacttggataatgtcatagagtggtccttcccacagcagagtcaatgtaaagacctatgggagggcttcaggaatgactcctcagacaggagccctgggaagggcttctccaagagagaaagtgcactccagaggcaagagcactggccaagtcctgacctgataccggatgagctgtgtgatcatgggcacatcacgtctctgagccttggtgttcttcctgtgagatgggccaataacaccaggcacctcataggatggatgtgaagactgcatgatagagtagatagaaggcagttaaagcaacacctggtgctatggtttggatgtggtttgaccctgcaaaagctcatgttgaaatttggttcccaaggtggcagtgatgggaggtgggacctagtgggggatagttgagtcacaggggcagatccctcatgcatacattaatacccccttgagggagggagggagttctagctgtcgtgagactggattagtcactggagagcaggttgttataaaagcaaattcagctttctaaactctcttgctttctatatcaccttgtggtctctttgcgaatgtcagatccccttctgctttttgccatgagtgggagcagtatgaggccctcaccagatgcagctgcccaatttggacttcccagccactagaactgtgagccaaacaaacctctcttctttacaaattacccaagtattcagctatagcaactcaaattggactgagacacctggtgtgagcatcagacactccacaaacattctttcttaaacacaacaagagtccctgccttcatacacagcacagatatctgttgagcatctaccacatgcaggcaccactctcagtggaggcatactgcagagaacttaaatgggcctggagtgacctggtggttcaggttcaaacagttccatcccagtcagtgaccaagcagaacctggttcctggtctgtgcacccctgctaggagtcggtgggtgcaccacactgtctctgtccacttgaacccattctcagagctgctcacacctgagcaaaggatgcagcttgggccaaggtgctgctaggcatggagagtcttcctctctgacctcagattcttgtcctctgttcacagagcctgatccggggatggcctctgcctccaccacaatgcatactaccaccattgcaggtgagttctcatcacagagcctcaccataatggaaactgccgtgacttcagatgagctctcatcacagagccctttaagcagccagggttgggggacttggtgaaaacatccaggggagaactgacctaaggacttggacaggggtggctgtggccattttttctctccctcagaggtggttttgaatgtggaatggaggagtctacccctgggtaaataaatatacataggtatgtcatatgtatctgtatttatatttattggcctttctcagggctgttgactcacaggaactcaggagctggagaggcagcagttttggtgagggaggttgagggtggaggtgagatgagggtagactgaccaggctacttagacttctccaccgtctccctcatcccacattattttcttccctgggtccatgacccccaaccctccatcctcaaggaaacttgagcctgcctttgccttgctttgaaccctgagcaacgggctccccatgggtcatggctgtgactgcaaactgtgtttgaagaacaaccaagtttgggaggtgctgtgtgctctgcgaccttctttgagatccacacttctcagcagcttattaataactcaggaaacatctacaatttgaaaagaaagaaaaagcagcagaagcaagcaatcaaagacacctgttggactctgtgtaacctggcattctccaactcattgcaccactgagcttttattcttcctaggtgatattattaacattatgcagatacaagtgttcccctgaaggcagtaggaagtttaggaaattgttctataaaggtgggacttgggagcagtttcagactttccatattcttcagcagtccctccccaaggcctccaaataaacctgcattctaagaaaagacagaggcttgctctgcagcttcaaagtaaatgcccaaactcaaaacacccccaccccatgagactgctgccccctcactctcaaggtcctgagtgatctgacccctcctgagcagccttacactgtacttccccacccctctggagtcccagcagaagtgaggggtgactgcccctcgcacagccaacaccttggcattctctgcgttaccctctcccacttcagtcctttgtgtggccaagtcctgctcctcctgcagactcaccccagtcctcaatcgccaggagggaatgggagcagggtaggctgaggagcagtcatcgggccattgaaaaacacaaaccacacaacctgccccaagcacagttaatagcctcatttttccccctgtatagtgtacatacagcaaccagctctgccctgttttctgggacttccctggttttagaatgaataatctccaagcagtgttcttgcaactgttgcaaggaccatgttaaattgctttaaatgttgagacctgcacctggcacctagtaagcgattgttagttgttttaaaggaagaggaaataacagtctcttctaacgctgattgtgttggacaaactgtcctaataaatgctgtcttcacctggaaaatttctgagggcagttctgggtatttgagcttctataaccatccatgcctacttaagcaaggtgttattctttctttctgaactttgaggtgcttgttgattggaaaagtctagaaccccaccactaaatccattcatttatatatgcatgcatttactcatgcattcagtgaatatttattgagtacctactatgtgctagatactaaactggaggctgcacttgttcactctatataataaagtctagcacccacttgaacttgctacggcccttgcttcaggtcttgctactgagaaacaccgtgaatgctggatcctataccctgcctggttcctggctcccgagacccagatcctgagccagtgttcactgggtccctgggctgcctcagtgccttgtattatcttcttccccacctccaagctccttggtggccccagacacccctagcttggcccatctgtgtcctgctgtggacccctagctgggagtctgttttcccctcacccattatgactcctgactccagcaggcagttacttataagaaagaggcatctggcagctgcactggggagaatgacctcatagcactataattaaagtgattatctgagtggaaatgactattatgaagcatccttctctgttttattatgtagagccattgtaatgggaacgtgggatttcctatgttaacactgatatttctgtgatccaataaatccttcttcacaatcatctcccagaggagagaaggcattctgtgcagcagctctaggaaacatcccggtccccaatgtcctagacatcctaccctctttggccaggtcattaagctgtgaaaaaacacactcagtaacttggatagtgtcatagagtggtccttcccacagcagagtcaatgtaaagacctatgggagggcttcaggaatgactcctcagacaggagccctgggaagggcttctccaagagagaaagtgcactccagaggcaagagcactggccaagtcctgacctgatatcggatgagctgtgtgatcaagggcacatcacgtctctgaaccttggtgttcttcctgtgagatgggccattaacaccaggcacctcataggatggatgtgaagactgcatgatagagtagatagaaggcagttaaagcaacacctggtgctatggtttggatgtggtttgaccctgcaaaagctcatgttgaaatctgattcccaaggtggcagtgatgggaggtgggacctagtgggagatatttgagtcacaggggcagatccctcatgcatacattaatacccccttgagggagggagggagttctagctgtcgtgagactggattagtcactggagagcaggttgttataaaagcaaattcagctttctaaactctcttgctttctatatcaccttgtggtctctttgcgaatgtcagatccccttctgctttttgccatgagtgggagtagtatgaggccctcaccagatgcagctgcccaatttggacttcccagccactagaactgtgagccaaataaacctctcttctttataaattacccaagtattcagctatagcaacacaaaatggactgagacacctggtgtgagcatcagacactccacaaacattctttcttaaacacaacaagagtccctgccttcatacacagcacagatatctgttgagcatctaccacgtgcagcaccactctcagtgcaggcattaggcagataactcaaatgggcctggagtgacctggtggttcaggttcaaacagttccatcccagtcagtgaccaagcagaacctggttcctggtctgtgcatccctgctaggagcagtgggtgcgccgcactgctcctttccacttggacccattctcagagctgctcacacctgagcaaaggatgcagcttgggccaaggtgctgctaggcatggagaatcttcctctctgacctcagattcttgtcctctgttcacagagcctgatccagggatgtctggatggccggatggcagaatggagacctccacccccaccataatggacattgtcgtcattgcaggtgagctctcatcacagagcccttcaagcagccagggtggggggccttggtgaaaacatccaggggagaactgacctaaggacttgggcagtggtggctgtggccattttttctctccctcagaggtggttttgaatgtggaatggaggagtctagccctgggtaaatatatatatacatgcatacatcgtacgtatctatgtatgtatttattggcctttctcagggcttttgactcacaggaactcaggagctggagaggcagcagttttggtgaaggaggttgagggtggaggtgagatgagggtagactgaccaggctacttagacttctccaccatctccctcatcccacattattttctgccctgggtccatgaccctcaaccctccatcctcaaggaaacttgatcctgcctttgccttgctttgaaccctgggcaaggggctccccatgggtcatggctgtgactgcaaactgtgtttgaagaacaaccaagtttgggaggtgctgtgtgctctgcgaccttctttgagatccacacttctcagcagcttattaataactcaggaaacatctacaatttgaaaagaaagaaaaagcagcagaagcaagcaatcaaagacacctgttggactctgtgtaacctggcattctccaactcattgcaccactgagcttttattcttcctagatgatattattaacattatgcagatacaagtgttcccctgaaggcagtaggaagtttaggaaattgttctataaaggtgggacttgggagcagtttcagactttccatattcttcagcagtccctccccaaggcctccaaataaacctgcattctaagaaaagacaggcttgctctgcagcttcaaagtaaatgcccaaactcaaaacacccccaccccatgagactgctgccccctcactttcaaggtcctgagtgatctgacccctcctgagcagcttcacactgtacttccccacccctctggagtcccagcagaagtgaggggtgaccgcccctcgcacagccaccaccttggcatcctctgcattaccctctcccacttcagtcctttgtgtggccaagtcctgctcctccagcagattcgccccgtcctcagtccccaggagggaatgggagcagggtagggtgaggagcagccatcaggccattgaaaaacacaaaccacacaaccttccccaagcacagttaatagcctcatcttttttccccctgtatagtgtacatagagcaaccagctctgccctgttttctgggactttcctggttttagaacggaaaatctccaaacaaggttcagtcctggggtatgattctaacgtgtctgcagagtgcttagagtggttagtagcagaactgtgaggaagaaaaagaaaagggagggaaggaaggagaggagggaagaggaaaggagaatcattttaggaaggcacaggttacagtgccaccacacaacaggttggtgaagcatggggaaggaatgaactggcctgtttggtgttggtacagttgtctccagtgtacacggttcaacttatgagttcttgagtttggaatggcgtgaatgcaaaagcattcagtagaaacggtactttgaattttgaactttgaccatttcccaggctggcaatatatagtatgatacactatattataaaatagtctctgggtcagatgattttgcatgactttaggttaatgttaagtgttctgagcctgcttaaggtaggctaggccaagcttcgatgctcagtaggtttggagtattaaatgcatttttcatttacagtatttttaacttattatgggcttacaggaacctggctcccatcataaatcaaggagcatctcttttggttgtggcattgtatctgtcctcacacaacccctgtgggtcttgaccaccatcccaggccccagagcccctgcctcagactgacccttgcacctcttcccacctgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccacggaggtgggagaaaatctgggcacatggggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaatttgaaatgtaaccgagc

SEQ ID NO: 36296 - DNA, 25933 bp, Homo sapiens
tagacgcaccctctgaagatggtgactccctcctgagaagctggaccccttggtaaaagacaaggccttctccaaggtaacagggctgagtcaccccagggtcccaaggccggccttttctcacaaatagctgaactcctccactctcagatccaggggccctggactatctcccattgtatgcaaaaatattttatttccgttgacacattactctttggggcagcttgatggttttattaaattttggaaggaggcttcagccccagtaacagccaatgcctgtttgctttcccaggtcaccttgactgtgctacagtagagacctgggaaatgatgggttccagtgctgtggccaagctctccccagtttcaaccccttccaggccttgctgtccatttttactccactgtcaccacatgttcaaattcttgctttctgctcgagtcagtactgctcacctcgttccaagagatctgggtctatgacactgtgggtgacaccctctgagcatcttttccgagctgtctgtgggtacctgaacctgccccccaacctggcccttgccctacctgccccgacctcagcgagtctggcccagtctgtccctgcttctcccctctggccccaagtgttctcaaatatgcccccgcctgcctgtctgtcactgcagctggcccagccctcatcctctctcccatgaacctctgtggtggcctgctctccctggctcccctgtctccagtttatgttccacacaggtgccaaaatgtctgcaaaaaatggagatttaacatacactagcccttggcttaaaacctgtacatgcttctctgccacctgcaaatgacagtcccatttcctcagcaaacctctgcatgttgtgggaacttatggcttctcagcctcccactcggaacccacctctggtttatgctccagaacatgatgttgttggaccctcccctccacctcctccaggctgagttagcctctgtctcccctcctgccctgggcatggctcttccagtagacacccccacatcacagtctaactctgtgtccacattccctgcaactgctgagctcctggagccaggccctgggaaccttgttcctgtttttgttcccagagccaaatagatatttgatgtatgattgttgaatgcagcagtgagtgaataaagacatgaatggttaactgaaaacattttatcaaaactgttatttgtcatcagagcatgggccggtttccaacagctaacatttaggagtgaccatttgccaggcactgttctaagccctttgcatgtggccattcatttcacccacatagcgccatcaatgacatgctgtcactgcattgcttgtcaaaagggggaactgaggcacggaggctgagcttttactcaacatgccatctatgttgagggacttctgacttggatagccgttcaactgcgagcactatggaggccagtcaggcctggccctgccttggaatttctgtgttattcagggacataatggggtttgtgttgatttttgttgggagtgtgtgggttaatctaggtgcaaccctcacctccttcccttctgatgtcctcactcccattggtcatgtgacccttaacgcccatcccaagctcagtgccaattccttgccccagggtcctggggattgacatggatcccaaaagcccgctgctgagaggacagggccactcccacccccctgactgtttcccagagcagctctggggcagaagtaaacttggacccagggggcataaccctttgcccttttatagtctattagaggaggatgaggtctgacatcagctggttcattgccccttgtgccccttgagcacactggggcccagggagagtcacatccctgccttgtggtacaggccaccggccctggacctgtgattaaacattgtccacaattaatttggaattattatctcgtgatacactccataaagttcagtcacacatcttctttttcttctcccctgcctaatgatcagacaagccaggtcttgtgactaaatgaaccgacagctggcagtgttcatctgattttgcaatgcccttattttgttgttgataaactaatgcaaatagctggttggcctggaactggtgattgggaaacattttaacccttctttccttcctctctatcctaaagacttaaaacacacttcacgcagtcacagaaagagctcatagaccagactgcggggcttcaaagccttctatcttatttaatcatctgtaaatagtttaaaggtaaatatggtaataatactagtattctagactattttgggaagccagctgatgtgaataaagggtcagagttaaaagatattgaaggaatgcagttttactgctctgaggtaggtttcaaggcttgagccaggcttagagatctttgtcctgatactggggataaagtgaagagaatatgaatgggtatgtctcgcatggttagaaaatctttttttttcctgtatttgtttaaaaagcattttgtaacttaaaaaaatacctatacaccttttttttttttgagatggagtctcactctgtcactcaggctggagtgcagtggcaccatcttggctcactgcaacccccgcctcctgggttcaagcaattctcccacctcagcctccccagtggctgggattacaggcatgcaccaccacacccagctaatttttgtactttttggtagagatggagtttcatcatgttggccaggcttgtcttgaagtcctggcctcaagtgatctgcctgccttgggctcccaaagtactgggattacaggggtaaaccaccacacctgaccataatacatcttaaatagaacattttccagctaatatttaaatgactgcatgtcattagaatctgaatgagtgttgtgttaaaatattttgtgttttcatatttatttacttacttatagctacggataagaatataggcaaatttaatctcccgtaaaaattaaaaggcagatgttttcaaagcacagaattacatggtctactctagacattgctcctaaggttgagcagaggggataagagctttttctcttttttcctttcctctttttttcatacaaagttcgttgtagatattttagaaagtatagaaagccccgacaaggggaaacccactcaacccaattttaatgttgttgtcatttcttttagtttttttgggtgcatttctatgtagctatatcctattgtacaagcaatttaggatcttgcaatataaaatgaaggcatgacctttgagctggccaaaagtatgggctgatttttgcaaatgggtcctggcagcaggggacataagtggggaaccaatccccacacaagcagaggtgagctggcttaggggcgagtgcatagctgactttggatgtagactagatttggggaaatttaaatggggtccaagactggaaatgtgtaatgggacagaaggtagaaatgtttaaaatcttaagttgttgagtttgttctcaattttgtgaaaactctttatccctttttgttccccaccccattttctaaccagaagtcaaatatgacaacattcatgatgtagaaaaaccagttcatcagtgtgacttgtgggtgagggtggggacagggccggtgttggtatatttagttttagagatttgctggaaaagtaacatttttgcttttgtctttctttcgttcctccatttctccagaagaatatgaaagtgttactcagacttatttgtttcatagctctactgatttcttctctggaggctggtaagttaagtatttctttgtgttcttgtctgctaagaaaatctgttatttagaatacatgaagtaccttccctaacagagtcatttctcatactcgtctctgttgaatctctgggcacagagcctcctggtcatagacctgtactgctggaagttcctctcagcatcttcgtctcattctctcccatatagagtgggaaactgaggcctagtgaggctgagagcccaaggtcatgtagctagttttggaacaaaagctaaaatctaggtctccaatctaggtccaggcctctttccacttggctgctggttgaaagtgtgatatgggaaattctgactttcatttggaggagatattatgtatagtctttatgaacccacagctggaagtcatcaagatacactactttttctgtttctttccatttcttcattttctctaatcttttctctttttgccaggtgctagctactggggatacagcagggaacagtgcacacagaaatacctgcctgcatagggtttatattcttgtagaagagagagataacagataagtagacatatattgtgtcatatgatggcaagtatagggaggaaaaaagagtataaggttttggcattacagtgggcagaaggttaattttttgaatgtggccagaaaaaaacctccctgagaagctgacttttgagttgaccttaaggaaggggaaaagagagctatttggatatcagattggggtgtggaaatattccagtcagcatgtgcaaaggcccagaggccaagagtatttggcaggctttcagaataaaaatatcagcatgtctggagcatagtgagagatgagggaagtcataagggaccaggctgtctgggtaatggggggatggcagagggttgattatatggaatgttgtgcccttttttagggtcttggcttgtagtctggctgggatgggaagacttcagggttctttgtttaagaccagagaggtgatctgacttacgttttgattcctgttttgagaatagatccgagggagccaaagagagaaatagagaagccagtgaagaggcaagccatgatgatggctttctctaggcaagaaatgttgatggcttgtcaaagggtggcaaggagaagtgagaagtagacaaattttgaaatattttgggaacagaaccaagagggatttggagttgggtcagatgtgagatgtgagggaaagagaagaatcaagaattatctcagggaattttggcctgcgcaaacgcaaggtgaaattgccattgatgagatggggaagatcaggttttcagactggatgtgttaagtttagctgtccattagatgtttaaaaggtgactttgactaggcagtctacagcctgagggaaaggtctgggttgaatatataaaattggagacctcagcaagcggctggtatgagaaccatgagactgaatgggatcatggagtgtagttaggaaagataagaactttaaggactgagccagagattgacttaaattccttggtccagtgagttttctcccctttgctgaggggctccatgtgtgttggagcataccttcaacattaaggctgtttaaggccttagccttcacttcctgcttgtgtatgacctcagagtcatccagaaatgagagcctggtgccttctatgcaatttcctgggcatgcacacagccctgcatacatgcccacccttctgggttccccaggaatgtgtcagagcttttcaaagccctctggaggttatggctctggtattgcagctttaggcagttgtaaaaaacaattaacactgagtttttccagcaaacgccttggggatagtgcttttgctgtggagctcttggtgaggtcaataacaccaccaccctatgaatgtgactttgaggacctgccagtcaagtcaaagagtggcagtgctctggaaatgggacttttcgaggagctccaaaccctctctcttcttgcaagcctgctggttttcaaagcctttgtgtctgcaaagctcttgatattcatggctgttttagagctgggaagagtaggatggaagtcatttaagttataaagctacaaaccctgctgatccgtgatttggcatgtttctgtttgtttccttattttctagtaaatgctcttctggttactgcaagcctttgatttttgaaattttttgccagtctttttgttgcctttatggaggaatgatttatgagacccccactccaccatattggaaatcttgcaaattcaatttctttgaatagaaaatagtattaatagatatagggcaatccaggctatctacttcttctcaagggagctttaatagtctggaaaatttgctcatttcatttacgttattaaatttattggcataacattgtttataatattccctcactaccctttacaaattatttaaaaaagagatgtcatctcttttttttcctgattagtctggctaaagatttatcaattttattgattttgtgaaagaatctgcttttggtatctttgatttttcttcattgttcttctgttttctatttcattgatttcctctctgatccatattactattttcttcttacttctgttatattaattatgttttttattttctgtatcttaccatattttgacattctggaagatgtttcatatctagggagagactgctccaccaggggctaagcagttcctaggtgtgttgtggacagcttacagcttgcccttcatgtgagactgcttgacccaagatggtaccccactcacctccttatccaactctcacacacccaaaccaatgttaccccagcctcaatcaacacagggctaggtaccagagaactagggacagcctctatgcccaaagcctgcaaaaatggttcaaatgggccaatctgaaactgtttatgctgccctgccttgcctttcccatgggaaccccagtaaagatgctggcctaggctttccttttgtttctgcttctgcctcctaacccaatctggtgattctccctgtggttttgcgtggtatggcacaccccttctgtccgaaccactaagtaatacaaatctttcaattgcattagtctctgttttgtcactcagtcaccttcgtaaatgaagacccaggcatagaatctctgcttgctgcttactttggaattactttgttctttttctagtttcttaaggtagaagctcaagtcatcaatttgaaatttttaaaaaatatataggcatttaaggctagcagtttccctctaagtactgctttcattgaatgccataagttttgatatgttatgttttccttatcattcagatacaaatactttatattctttttgatttctttgactcatgagttatttaggagtatgttaattttcaaatatatagggattccttggatatctttctattattgatttctaatctaattccattgtcaccagagaataagttttgtctaatttgaatccttttaaatttactgagtcttgggttatggggaagaatatggaaaatttgctaagttttatgtgtgcactttaaaaagaatgtaatgttctactgttgttggttggaattttctgcaaatatcaattatgtcaaattggttgatagtgttgttcaaatcttctatgttgttactgattatccgtttaattttattgcttgttctatcggtccttgtgagtggggtttctctagtttcttgcagaaccagtttctctagttcttgcagttctgtcagtttttgcttcatgtattttgaagcactgttagcagctacataaacatttggtattattgtgttcctgttgattaatgacttctttatttttttaaaatttatttatttatttattcattcatttttgggacaaaagtctctctgtgtcacccaggctggagtgcagtggtgcgatctcggctcacagcaacctctgcctactgggttcaagtgattcttgtgcctcagcctcccaagtagctaggattatgggtgcccaccaccacacctggctgattttttttgtattttagtagaggtggagtttcaccatgttggccaggctggtctcaaactcctgacctcaggtgactcacccgcctcagccttgcaaagtgctgggattacaggcatgagccaccacgcctggctgacttctttatttttatgaaatgccccttttttcttgtaatatttttactgtaaaatctactttgataataatagtcactcaagctttaactaattaatttttattaaggtatagttgacaaaatcgtgtatatttacagtgtacaatgtgatgttttggtatatgtatacattgtgaaatggttaaccctagctaattaatcaaactttcttttcatgagtgttagcctggcaaatatttttcttttctttttaatctatttttacctttatttataaaatgtctgtatgtaggtgtatgtgtttatgttaggcaccacatagttgggcctttctttagccaatctgatcatttccgcctttcaatgagagtgtttagactatttgaaattttagtgtgattattcatatattagggtttaattctgggatcttgctatttgtttttctatttgtcccatcaattctgttatttttttctctttttttgctgccttttagattaattggcatttttaggattcattttattttgctttttggctttttagtcataactgtttgttgtgtatgtgtttttttaatgactgctctggggcttaaatagccatctctaagttatctctgtctgccttcaggtaacactatacagtttcacatatagtatacaaagttaagagtatatacccatttctcctttcttgaactttgccctattatttccatatatgttacttctttatttgttttaaactttatagcattttattattttttatttaaacactcagttttctttaaagagatttaaataataagaaagatgatcttataattacccatttttgttgctattcattcttttgcgtagattcattttcatcttataatattgtgctttttgaaggaattaaatatttcttgtaatgcaggtctactggtgatgacattttacagctttggcaaatctgaaaaagtcagtattttttcctaaattttaaatatattttcatgggatatggaattctaggtagactttttctttcagtactttaacgatattgttttgctctcttctggcttgtattgtttttggaaagaaagctgcatcattttttgtctttgtcctctgcaataattgtgtcatttctcccgggctacatagaagattttatctttgtcactggttttaaacaattttattattatgtgtttgtagtttgctttatgtttcttttgcttggggttcattgtgatatgggggcctatgtatacatcatttttgtcacatcttgaaaaacttcaaatatgttttctgttttccacatttttcttcttcagtgattcatattacatgtattgaagttgtcctaagtaaaataattccctgcccattttattctgttatttttgtctctgtgcttaattttggataatttctaatgctgtgtcttcaagttcactcatctttttttttcctgcagtatcaaatctgccgtgaatcccatccattgttttttgtaactcaacattattgttttcatctctaaaagttttttaaaatctctttcatgtcttcactaatcatgtttgatctttcctgtagcatcttgaataaatggaatacaatagtaataaactattttaatttttaaatttattaggcctattgtctgtgtcatttctgggtcagttttgactgatcgatttttttcctccttatcgttggttgtatgttactgcttctttgcatgcctaattatttttttggatgttagacattgtggattttaccatgttgggtgctggatattttcgtattccccagaatgttcttgagctttgttctgccacatgattgttacttggaaatggtttaatcctttcgggtcttgcttttaagcttaattaggatcaggaaaaagtttattcttggcctaattttccctaatgactgagtcagaacccttctgggtactctgcctgatgccttatcattaatgaggctttccaccctggctgttgggaacagcaactgtttccagcattgggtgtgctccatgtgttactccctccagttcgtttggtagtcctccctctagccttgggtcattttcttatatgcttacactgactgatactcagctgaaaacttgggggagactctcagttatcccaagactctttctgcgtgtcgttatgcagctctaagtacttgggtactctgccctgcaaacttttctacccaggttctcagctccatctcctcaactcactgggctttgcctgtgttttttctcggcaatgtcatggcctagctgtaattttggacacctcctttcttctccgtctttctgggatttctctcctttgttttctgatgttcaatgtcttgaatactgttgtttcatatattttgtccattttttagttgttcatgtgggaaggtaaatccagtttctattactccatcttgtactgaaaggcatgtctctcctcctacattgtccccactttttagatgagtgaaaagggggtgaaggatgttaaataacttgccaggggtacagcacacaggcagtaagtgatgcagctggacttgaatatgcttctcagactccccagataatgatcttatcacaaggctgtaaagcttttatatgtaatgtgaattgatgtatttaataatcaatgtgtttcttcgtagatattaaatcaagacacactggcagatttttatgtaaattgcttccacccttcttccttttaaagataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaaggtaagagaggaattagtatgttacaaacatgttctagtttcctgcagttgttaaggacagaaatacttttaataatgcttaacttacctattttattttattttagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggtaattttattttaaatatgacatttcacttttccagaaaataaaatagttccctggacaatagaatgtatctgcaaagtacctttttattttgtatattgttttctctttaatggtgaaacttgatagggaacctaaaaagaattgtaagactgcattcacttaatttgaagcttaactagaaatttgtttgctgttgtttttatttaatttaataagatgtaattgagaaaagtactagaaatagatgtttaaagagaaggctgattataagcttaaggtattgaagatgtaactatttattacaaaacatactatgtgtgttttattgaagatatggtcttcaaataacctgctagtttccataactgtctgaaaagtgggttgactagctttccatggaacaccccatgttttggtaactttaatctacctagtctgatggaacttaaatggggaatcatcttgtagagcttaagacgtactaaatacgtaatatcaatgaagtgcagtattgttaagaaactatatagtgttaacatttttttcaaacatgtttttcttgcaaaataaattggccttcacttcatagtacaagtctcatagacttgaaaacttaatgtcataggaatatagttaactgtttccaaaaagccagtattaaaacttactatatgtaaggaacttttccagtcactttctaaaaatataacatttgctaaggtgaaaaaaatggagctcctttggcggtagattggggaaagttattggttattggttttcaatgcttctctctccctttatctaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctaggtgagtcatagctccagccctaaaaggtttagatctgggaaggtccagagactgtgattctaatactactttcattatccatgaagaaaccaaatccaagacgacctcaatgataccacaaaagtcacatggctttagttttgtttttttgttactaaatactatgtaatgtttttccattcctgcttcagatgtagttctaattaaatagagacattatgagctgtgttttccaactgatttaagagggttgttctttggcatggctaaaaatggttcttactgaaagctctggggctccctctggctggtatatgggaatgttctgagagcctgcacctggggaatctcagtgagtgtcagtgtctagcagcaagcatcggtgtggacactaatgagctttggaataagtcacatttccagaatctacctcctgttcattctgtgttaggtgttaacctctctaaccctgtttcctcttctgtaacaagatgatgcaatctcccaaggttattgggaagattagagatatggggtacacgaaacttgtgtacctggtgcaaagaaatgcttggtgcaaaacagctatgcaattaataggtgtaggatgattgttcttgttaattttcttgtgtctttcaattctgcgttaaccatgtttcatattgaaaactatatcacagcaaaatgaaacaaaatgcacaaattgccaggggatagtcagaatgctcaaactttttgtaaatattgagattttgtaagatttatgtaataaaataagagttattccaatcagaacttttttgcaggttataggggtgactattagtagttatgctgggacaacaggtataaattgggactatcccaagcaaactcagaatatgatcaccctataaatagcttcacttttccagttatataatactttattttcctaaaaatatttttattaaataaaagttaattccttgccatggtcccacaggcatcagtgaatcccaattttcaatggtctttgtatcaaaccatgttcttgagtttttagcagcctgtcattgggtagctctggtctgtctttcctgaaacatagtaacctaaccagcaagtagaacttgagagagaactgggcactggggactatttaagctaggttaagtgtttttttttttttttttttttttgagatggagtctcgctctgtcacccaggctggagtgcagtggtgcgatctccgctcactgcaagctctgcctcccgggttcatgccattcttctgcctcagcctcccgagtagctggaactacaggcgcccgccaccacgcccggctaatttttttgtatttttagtagagatggggtttcaccgtgttagccaggatggtctcgatctcctgacctcgtgatccgcccacctctgcctccttaagtgctgggattacaggtgtgagccaccgcgcccggccaggttaagtgtgtttttgatattctctgtttccttttctgatcccatttgtagaaacaatatactctactcggagtgaggtaatattttgttttctttccaaggcccacaccaatgatgcctagcactttttgttcactcaaggattcaaaaatatttattgagcatttactatgtttcaggaactgtaataggtatacattagggaaaaaaacagagaatatcctaccttcatggtgttcactttttttttgattgggggaataccgagtgctcaattttatagtttctcatagtttcttcatggccacagataaacccctgaaaccaatcttttcataaataagtcagattaatttctggggcttcttgatacttttttgcctattttaataaattacagcattattccataaccctgtagttctcactattgggtcattaacacagtcattaaatgcaagcaggtctagtattgactagcccttctggccaataacacccaattcaaggaagtgactttccactactctcgcctttgctgacatgctttcacttaagagaggcatttgtctggggacccagggtcctggtgatgtgtgtgtttttcagtagcaccccactctatgaattcggaaggtctagctctaccccgggattcacagtgtgctgtggcctctgcctcagctttcttccttcactttctgcctcctgtctcctggcatatgtgctttgaacacttgatggaatatctggccagaagtcatttagtatgttttgctaagtgttgtcgtcacttgagattctgatctataagagactgacaaaccttatggatgtttttctttcagaggaaaacaaacccacaaggcctgtgattgtgagcccagctaatgagacaatggaagtagacttgggtaagtgggcttcagtgagggtatgctggaatcggttttttttttttaaaacataagagtaagataaattgtatctttactatatataatctaagccatttactgtataaatctatcaatggagggaaagtgagacaaattatatcttaattttttgtatttcttgcctctatggcaaacatcttgccatgtctgatatctccagccctacttttctgtgaacacttattaccatgaaaacaccaaccagacaccaaggtcaaaaggcctaggaaccagcaatgccattgactggtacaggattggatttctttctttttttttttttcacagagttaaaatatttaatgacaaaaatagggtttgctgtaaaagtgaatcaatacagtaggtgttacttatctctgaattaaacaaaaattatatttgacatcttaaagaacttctgaagaattgatcattgtacgacagacatcagcagtgttacaatttcaggactggatttctcatgaccagatccaagctttgagtcggaagagtaaggctacaggccccaaagatggtagtcattctagaaaagtatttttccaagttagtgaacattttttattcaagagtaaagaaagaaccccacaagcatctagctctgcactgtttagtgcagtagttactaggcgcatggagttatggacatgtacaattaaattaagtcaattgattcatttagttaaattaaaaattagttcctctgtcacattagccatatttcaagggcttaatagccacatgtgacaagtgactactgtacagacaagcacaaatatagaacatttccaacatcactgaaagttctattggaaaccactgatcaagagagaaaaagtggttctttgtgtcagaggacccaaaataggttggccttggaattgtcctctgtaatagtaactgcatgacagcagtcaagaaccatacagaggttagaaggtatatgcttgtgatctgtgaattctgtacttggccaattctgtacttgttatttatggtggaaggtggtagaaagacattcttagacagaaacaaaaatgtcaaaactcaaaattaaatatgggccaataggctctagaacaatgtttctcaaccatctttttttgttttaaattgttcccctttagagtctaaaaagtcttcttccacctaattctctttcctgtctttaaatttcagtaccacagttatcttttatatttgctgatatactgtggccctttggagtaccacaaaccatgtaatatctaaggttttcttgcctcttccccaagaaccagtttttgccctgctggccacagcccctgttgaaaatgcctgccctagaagtgtgtaattgagagctctgatgcctaggctgcattgatctctcaatctacaaaaaaaagcttcaaattaggaaataattattttaatgtattatattgacagtggatcagaagcatatagtaccctgtcataggattatcctgaagggtgttaaacaggcaataagatccaataccattactcctaaaatgacttagaaaaatagggattgagagatatttccttaacttaataaataacatcagtgcaagccaatagtcactaatattcttcatggtgaaatactatagaccttctcactaaagccaagagcaagacaaagatgcccatgtaaccactattactgagcacagtctagaagtgcctactaatgcaattgaaggaaaaaaacaaggtatgcttaccacaagggaaaaaagacatttttattattgtttcctgatcataccaatcccaagaaaattcccgggaaaaactagaattaattctgtataaattagtcagataataaattaacatttagaattaatgttctaaaatataagacttgtttagcaataaccagctagaaaacataataggaaacaaatgccatttgcaccagtaaatgtcttagaagtgtccataaaatatgttagaaaaactttgaaaatatgtggaatttataagagaggaaaaaactaaaaaaaccaaaaccctgaatattaatctcagaaaaactgaaatttaaagcatgcatccagccaggcgtggtggctcaagcctgtaattccagcactttggtaggccaaggtggacagatcacttgaggccaggtgtttgagaccagcctggccaagatgttgaaacaccatctctactaaaaatacaaaaattagctgggtgtggtggtgcacacctgtagttccagctgctcaagaggctgaggcatgagagtcacttgaacccaggaggagaaggttacagtgagccgagattgtgccactgcacttccagcctgagtgacagagcgagactgtgtctcatttttaaaaatggaattaaataatggatagagggataacagtttttaaaaaggaaggccgatgagcaccaagctaatgaaaagcatgttgattcaccgtgaattcaagaaatgtagatgaaaacttaagtgacattttcttctctcaaaaggcaatgtctaaccaaaaacacttgttatctggtggttttggggaaaatcgtgctcacatacactattggagagagggtagactgacacagcctcactaaagagagggggttagcttttaaaatatgtttctttaattcaatcttgcttctagattttaatacttcaggatgtgtacaaataaggctattcattaaaatattaatcataatagtgaaaaattaggaaattgtgttcatcaataggaaatagttaatcatagtgtatatgtattatggaatgctaagcagccatgacagagtctattttggaagacaaatcatgtgggcccaaattcccaatccacagtaattacaaaatagtaggcaaaaagaccccatttcaaaaactgcacatgttcacagagaagataaggaatgagacgcataaggttactaatggtggttttctctgggtggtgggtttagggtaattttcctttttctttgtgcatttctatatctaaaattttaattcaatagccatttattaatctagatagatcagaaaaaatcaattaatgttaagattaaaaatacattctttgcaggatcccagatacaattgatctgtaatgtcaccggccagttgagtgacattgcttactggaagtggaatgggtcagtaattgatgaagatgacccagtgctaggggaagactattacaggtatgtatgctaagagttattcacattttggtgttaaatcccacgtgatattttatataaccttgtcggttcagtttaaaagcaagtgttagttgctcctaacctttgctgcctttttttttttttttttttttttttgctaagctaagtagaatttataagatcttgtacatttaaggtaaaaaatacttgtcattgtggtgcaaattacagaccacttagaagcctttctcttacgttatacatgttgcaacatttcaacgaagcaattatctttcattattcttcatattcctcaagtagcttagaagagactcattaatgagctcaagaatcaggcaatccactgctctcgaaagcctctactggtttcctactgctcatctatgggacaaggatctcctggcttcccatgacctctccttcacaacacctgcaaagcactttgtcatctgccccaatctcctcttgtttagtgtctcctctgtgccccatggagaacacaatgcatttgtctacatttttcttcttggaagtggtaatttttttgctttctctgctactgagcctgttactgacagtggtcttggggttataaaatctcagattagtgttgccagcagtctgaatgttgtgactgtgattgggcagggtgattatttcagtggcaattttgtcacaaataaggaaatacacagggtatacaggtcttatttgtagttgatgcaattaacttacacaagtttatttactctctctctcgaatagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccaggtaaacaacaaactaattgaaatgcagttttgttttactgtagtaagattccatgactttgaagtttgaaatgccatttcctctgcttagaacacgcttcacttcctcattacttgggtaacttctatttctcttttactcttctgctgaactctctcttcttggaagcttttctgtcctgctgcctgcccttaacccagctctcggcccaaagagaggaggttagggcctctgtatgtacttctgtagcaccatatgtcacaggatctatggtacttcgttttctgtacttaactataaattctgtgatggtggcaaccatttatcttagtaatcattctatttccacagctaatggcaagttaggtctggtacattgtgggtacccaatgaactacattgatgatgcatagggtaagactaaatatccactttcaaagaggacatcagaagtcactgggtttcatgaattggtataataaaacataatattgaaagtatttgtgaaacattttaaggtaatttgtggtttaattaaacataggctattataattgcgtgcatggaagaatatctgaaagactctataaattaacttctatgtatgtttaaatactggcagcatacaaatagaaattacatttaaaagataacatttatggtagcatcaaaaatcatcaaatacttaagaataaatctagcaaaagctgttcaaaacctctgtaatacaaactaaaaaatattgagataaattagagaagaactaaatggaaggatatacaatgttcatagattgaaagactcgatattatgaagatatcagttcttccccaaatgaatctatggattccaaaaaatttcaatcaaaatctcagcagtatttgtacaagtgagagtcagtgtttgtatgggtgtgtttttgtggacacctgtaaaagtcatagggaactgtaaaggaccaagtatagtcatggtggtcttaaataagaaaaataaatctggaggattattactacagacatcatgatcttgtatgaagcgacagtacttaagaccgtaagtgtgaactatcatttgggccagctggatatttgtctggaaaatggtataacttgatttctgttttatatccaaatcatttaaattggaaaagtaaataaagcttttagattcccttttctggatgcttttacatggttcctgatatttagagggtactttctttttcttccctctttcttcttctctagccccctccccatcacctactccatctgctccccagcttcctctttaattattggataactaagtagagaaggaggccaggagaatgtggaaatgtgaaacttccctaagcctccaccttattcgctttccaccagtctttaactttacccaatggactctctgacctcagggaacttttgtaggcttttgagtgattttaacttttccctgttttactgtggaatgctctatcctgtggtcttcggtattatttcccatgttattgtatattatgctatttaggtagaaacttcatagaatgcaccttagttttatcattgctttgtacattagtatccattacaaagtgataataatgaatgagttaatattgtctgaatgcaggccattcccagatatgggctctctgagacgaagatatttaatttgctgtgctcaaagttttaattctttttggttctaatattttttctcctttttttttctttttgctatagtcactaatttccagaagcacatgattggtatatgtgtcacgttgacagtcataattgtgtgttctgttttcatctataaaatcttcaagattgacattgtgctttggtacagggattcctgctatgattttctcccaataaaaggtataattttgtattccatgcagtatttcttgttggagataagggatagttaggagatgtagaagatgactaagagggtttttactaagagggtttctaaaatgaaaagtggcatatacaagaatactagttattcttacacagaattatagttttagaactcattaggctgaatatcattgttttctaagttcctgcctcaacattcatattggtagaataaacaggtatttagagcatctgtttataaattcagttatgcacaagccattggtaggccttgctctgtgatgaataggacagacagagatcataccttaatgaaagaaatgaaatgactagatcttcatgcatcagggaggttctctctctcctttgtttaaactttgcgaaaaaaaaaaaaggaataccacaatatctaaaaaaaaatgaatggatagaattcagggctgagacctctggggaagaagatgaggacagggagactttaaggatggctctatactaagagtatacgaggcagcctccaaatagaagaacaaatttgcagtaaaacacaagaaatagaaaccttgtaagagatgaacactttttaaagggattatatttttggtattgctgcttcagtcatgccattgtataaaaaaagatgaatagttcattatgtaatgaatgtttgtgatactgactttatcaaatctcttatttttgccttgtggttctaaatacattatgtttttcctttagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaaggtatgtgtgtaatggaacagagtaaaggcttattgttgtaaaactacttagtaaaatgtggattccatctttctagaagatcgtggcataggggtatatgtttcacaattttaagaacctcttcagaagtgtatgatgatttttacatttattaaatgcatttacttctctcatattttgtcagagcaataattaagtgattttcatttagttttgaaaaacttaatgactagttaaacccaacagttgctttacaactgatacaattaaacaggagtggtagagatcaaatgattgaataataagtttttaaaattccaacaaagttttctgagttctaaatgaaatatttgtcttttgagggccaatttttgagttagtctataaaatgggaggtttgcagtggctcatgccttttatctcagtacaaccctgggaggccagggtgagagggtcacttgagcctaggagtttgaggctgcagtgatccaagatcacgccactgcgctccagtgtgagcaacagaacaagagactgtctcttaaaattaattaattaaaaacatgggaaactcctttaattttaagtaagacaagaaaaaggcattaggagccatacggttgtgaaaagccttgtgtggctttggttcaggagagaatgatgataaatagaattttacttactatattgtgcttcctgtttttcagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgtta

SEQ ID NO: 36297 - DNA, 77676 bp, Homo sapiens
cagctgcacagaaggttggggccatccaaccaggcagtccgcctgcacagcagctgtccctgctcatcgggctggaggacagaagacagaaccctaaaaccacaggtaagggccactggttcccctgtgcccttctctcacccttgccatccttcccagcctgtctctgcagcagctctgtaggcatcttgttgcatgcagagggagtgtccagccctgggaggaagctctcaggcactgggagctcgctgaccccagcagagatgcaggtgttgctggcagctggctcccaccaacggcagagcccaagaacagaagccaccctgcccagagctacagggggtgtcagcttgaagatagagaacccctgctcattgggaatgaggagagatttaaataaaattgaacctctgccccctttcagtgggaatctgttttgaacaacggaaaacattttttaaggggaaagcaaaagaagaaatgttataaaataaacattggaaagggagaaaaccacagtgcacttgaactttttctccctgacagaatttccggaaagcctgggatgaaaagacaaattactgatgagtctgattactctgggaaagtgtgtttatgcaacatgactcttcgcagctgatggtttgaaagcccagagagctattgcatgctttaaaaaggaaatgcatgaatattttacaatttccagagcagggcaaactccaaaatgcacagtcctgagtaatgccctggccaattgtgtaataatctcaatattgataggatgccatatatatgataatagacatcatatatataaacatcctctagccagactccatgtaagacactttatcaagtctaatctaaaaagaaaaataaagttgtcagtccagtttatttttctaaattattctgacgtccaaagatagtgttaataaacacctgccttacagattaatgctattgtagctcatatttgctatatgtaagtttactatagttgttttatttgtttcttgggaatattatttgaattttattttattgctaggctttcaaaattttatcgatacataatattttacatatttatggggtacatgtgagtgttcggtacatacatagaatgtgtatcagtacatacatagaatgtgtaatgaccaagtcagggttttggggtatccaggatgggctggaataaggtctattatgtgttgagatccacccgaccccttacacaagtttttgtatttaactgagtaggtgactaatccactcaaatgattacactttggaggcattttcttatattaaaaaatattttaatgcataacttccatgaaaagttgcatattttccaatacggggttccctgactgctcacccaccatcttgcctttcagcaggtttcgtacttttaggtttcattgttctattcagggcttccagagttctccattgatttcagatccccaaggccaggccaagccatgcctctcactgcattcccatgacctaaagcacagggacctgcactctttctaccgatctctgaaatgtttcatatttacaagatatggcccagagactgattctaattcattctctccccaccaaagaaagaggtaaaattatattgattgtttatatctttttcactctacaaataatctgtttactataaaaaatacagaccagcaaaaagaagaaaatggaaaatcatatatagtcttactactcaaagataactatttttgcagttaattgtttatcttaattatttattcattctaagatatctttgattgaaagattaaccattaacttaatattcgttttttttaaaaaaataccactatgagatattttaaggtgaatccaaaaacattaaattatgtgggaaactgtaaataataattaacaaaacatatatatatgtatatataaatcaagttatttgctaatcttctttcttccaatttatggccaatgtcttttactgtagattcaaaatctaattccttgaaaattggttatctctatatatcattatgaccaatttgtttagtcaacatattaaaatattcataatagttggatagatgagaagtaaaaaaggataaagatttagataagacattttattagaatatagcaatataacatcagttcaaagtatgatctggtaattgacttctacactattactggtcccttttgaatcatgaaaaactcaaccaccttgcgccttgatctgcatgccctccacaccccacaaaatctggtttactgatttttttttattaccgttgatttgtcagcacctcctcacttaatctctaatacactaaaatgtggatgaaaaatagaaaagaactcacataagttctgagcaatttaatgttttacaatttgatacttcatttgaatttaatggatacattttagatggagaaaagaggaataaaaatccattttaacacaggacttttgttatagttaaaaagtaatactgaaaaattaaactgaactaagaccatatcaaggcaacaatgcataaaacatacttgatctgttttattaaggaggagcagataattagatattaagaagaaagtgcaagaatttcattctggtctttttttattgtttgtttgtttatttatttatttatgttttgagaaggagtctcactctgtcacccaggctggagtgcagtggcacaatctcggctcactgcaacctccacctcctgggttcaagtgattcttctgcctcagcctcccgagtagctgggattacaggcgcctgccaccatgtccggctaatttttgtttttttagtgaagacagtgtttcgtcatgttggccaggctggtcatgaactcctgatcccaggtgatccacctgcctcagcctcccaaagtgctgtcattctggtctttaaagagtaagcatgtctagatggtatctgaagcggctatgggaaccacctactttcacgttaagtagaagccatcatagtgctttttgcctgggcttagttctgtgcagataaatctagagtaatttcaaggtatcagttcacggtttcgtatgaacacaaaatagaaaatgacatgatttgaatgttctactccaagtcgtatcctttgtaggaagatgaaatggttaagatgaaggcacaatgggttatatgaaaacattacatatatgtaataatatgtaataactaaaaccaataaacagtgcaatagctcaaaagtgaagtatggttaaataaaatatgattagccatagtatggaatatatgcaaccatcaaaaataaagtttgcatagaacttttgatttttaaaactcaaactagaaagcaatattcataatatatgaactgaaaaaatacaccaaaatatataaaattattgattctgaaggataagattggtagtaatgttacatttttctctacattttaaatagtttactaaattttctatactaagtctgatcatgaaagttttcgtaatgcaaaattctatgcaaacataaaacagtctaattattaccaccaattataaaaatcataaataaccaaccagaatgatttagtctattaaaaataatagctagtttcggaggctgaggtgagaggattggttgagcccaggagtttgaaaacagcctgggcaagagatcaagaccccatttaaaaaaaaaagttgaaatttattgaaagatcattatatccagtaactatgttttagctcatttaatacaacagcactataggtaaacattattattaattttgttattattcctattttcagagaaggaaactgaagcttataaccatgttattcattgccgagggtgcaaccaagttaaagataatgtcttgttttttttgtttgtttgttttgttttttttttgagatggagtctcactctgttgcccaagccggagtgcagtggcaagatctcagctcactgcaacctccgtctcccaggttcaagtgattctagtgcctcagcctcctgagtagctgggattacaggcataggccaccactgctaatttttgtatttttagtagagacagtgtttcaccatgttggccaggctggtctcgaactcctgacctcaggcgatccgcccacctcagcctcccaaagtactaggattacaggcgtgagccaccgtgcctggtcaatgtctttctttccagtactttccgatccagttggcattagacttcaattgcaaaagagcaaccctgttgccatatgcaagggacagcatggtttgaatgacataaatgaatgcttcaggtattgagggcaaaatctatgaatgttttaaaatacttgggataaagtttgcagagaaagggacgtggtgcctcaaggaaaggagaaattagcagaggctgagaacattacaggtgagaaggaatgtgaacaatatggagatggaaagtgataggattcctttgaaggtaccagaaaatatgctaaatgtgttgaggggtgggtaatgacttaaggacaagggctacctcacttctctttgttctcttttggacattttgaaaactcaacattctgtaagatgaaataagaaagtctcttgactccccaaagtaaaaggggaaaaaagaaaaaaatcattttcataaagaatctggaataggactgatttggattccagatttaaaataaaataaagctctgaattagagagataatagttgttggcgttcgagtgctcatggtgtgtgcagcagtgttgtgtatgctgcacacacactcaggatgtacagggtggctctatgaggagtgttcctggtttccttgtttacaggtgaggacgccgaggcactgagaggcaaaggggcacagaggcagtacaggggaagccagatttaaatacaagcagtgcaatgccagtttcacactaatcccactagaaacttggaaaagtctccacaacggagaaaggacctcatcttaaaaatgaagccgggcgcggtggctcacgcctgtaatcccagcactttgggaggccgaggtgggcagatcacctgaagtcagaagttcaagaccagtctggccagcacggggaaaccctgcctctcctaaaaaataccaaaattagctgggcatggtggagcgtgcctgtaatcccagttactcaggaggctgagggaggagaattgcttgaacttgagaggtggaggttgcagtgagctgagatcgtgccactgcacttcacccagggtgacagagagagactccttctcaaaaaaaaaaaaaaaagaagaagaagaagaatgaggactttgaacttatttttatttttcgtttttaattctccctttagtttcagcaccttctcaagaggctgggaagggtattcatccatcctagttaaaccctgagagctagcactgtaacctgcacacagtgcacaactgactaataaatatttgctgaaccaaactgttgtgtttaattcagttgagttctaggagtgttgaaatccaaaggaaggagctagaagtttctcttcttggctagtacttttcccttctgcaatcctggctgggaaccaggtttcatattcactccctacctttcaatacgtagcacaaggacgtgttttttacatggaattttttggacgcaatcagtattaacatttgatgataatgtatgcttaaggagtagattctctgacttgaaagcttccatttactaatttattagtttgtgtgagtgtgcctgtgtgcacacatgtctctgtgtacacatgtctctgcgtgtgtctgtgtgtgcctctgtataagtctgtttgtgttgggggaagagaagaggatggaaatgctgaaaaaattctaaactctgtaaacttcctttttgaaaagcgtccaattttcttcagaatcttttaattaacttactaggaaactgtaatattttgctctctttaaatataatttaggaaccgaaaaagcaggtgagagaggatagtctctttccttcaactttatttacattgaatagagaaccaatggccaaatgttatgcccttccaatcccaaaatcaaagacagaggtcaaacaagacagtcaaatcagttaggttcagagaaaaaataatagcgagtgtaagacataaagctgagatgtggaaagtgcatgagacaaactccttttaggtccctgtttctctactcctgcaaattgaaaatgcaaaaatctatgagcaggtgcaaatgtgttgggactcaaatgaaccagcatgggcgatcatccaagtgaggggagaaataagcacacccacaatttcatgtctacaaacactctcagaaggaaaatctctgcaggcagcaaggaaaagtgggatgaggaccttctaattaagacagggctctccacaagtcagacagtttggaaactcatagtggcaagttcaacattgtttgaataatgaaagttgggtagaaggactgataaacccttcagctacttttattaacagcagcagcagcagcacatcctccactctggctgctgatgagctccggcaggatcctggcctgctgccctgagctgcttctacttttgtctgctgtgcttcactctttcctgggaagtgtcagcaaacctccgccagccttgggcaggagcagccaggcaaccccagaggccaatgtgagcccaatttaaccacaggtctctgtttaaaatttgcgatcatatttgtaacttaaattagacagtgtgtctccttttcccaaacgttccaatggcttcccaagtcaaaataaaatcctaactccaaccatagccaacagagccctacatgatccaggccctaggaatctgacctcatctcttccttctctctctgtccatctagagaggcaccagtcacactgccctgacccagctgtgccaagcactgccctgccccagggcatttgcacctgctggcatctctgtcagactcttccccaagacaatcacatgccttcctccttccttcattcatacccaatctgagagctacccctaaacacttcatctaaaatgacactccttatcaatctctagctccttaccctggttcacttgctatctcacacatatacacatccacctacatatatgtttatctctcctccaataaaatgtgaactccaatgaatgcagagactctattttgttcactgagatatgcccaatacctacagcagtgagtggtgtctactagatgctaaataaatgtctgttgaacgatgaagttgtgaataatctattttcatgtatttaatttgagatcttagaaactttttgactgtaattcatattgtagaggggaaatgttataaaactcttcctccccatcataagggtcatggcaggcattcctatcacaaaatctagattaacaagagaaaagcataactaatttatttcgtgatatgggaggcttgagaaaggaagacccaaagatcaaagagaaaactgtccatttttatgtttagagtcgaggaagagtgtacagtggtgtaaaaatgtgattggacataatgggtatggcctaatggcaacagacttagtggggaaccccagcaaggcctgtctgctctgattcatcttggcctctgtatggggcagtcttttctcccagacacagggcaggacctctgtggaatgaggtcttaggatctcctttcagacaaggtaggtttgggaatttctttatacccaactcctacacaaaagggctggggaaagcttaaagtaatatgtctagggttttgttagatggagtttcgctcttgttgcccaggctggagtgcagtggcgcgatctcagctcacttcaacctctacctcccagggtcaagcgattctcatggcttagcctccagagtagcttggactacaggtgcccaccaccacacccagctaattttttgtatttttagtagagacgaggttacaccatgttggcccggctggtctcaaactcctgacctcgggtgatctgcccgccttggcctcccgaagtgctgggattacaggcgtgagccacctcgcctggcctatttctaggttttattttggaggaagagtggttctggcttctctgacctgctttaagggaggaaaggaaacaagaggaggacaggagaagatcagacagagactttgcttcagaggcctttccagtgtgcttcaattcaaagcactcagcaagccacagcgccacactttggggtgtcgtttgctaagccccaacgatgcctatcactggtcacagtgttcttgttaggattcaagtctaatgtcccttgttcaccacttaaacttcactttaaaaatttccactacacttgcattttgtcaaggaagggaggtgggagctgacgagtcaggttgccagggcacaaggtcctagttctgctgttcacactgggcccaggcaagattttaacttcccagaaccacgtctgtaaaatgggaataataacagtaaccttgtcggtcacttgcagggattcaaggaggcactaacagccatggctaccatgaactgagcccacgttgtatcacagaaagtaccccatactcttgacttgctttgcactgtcccgtcttcacagcagccacctggtgcagggacaattacaattcctaggctgcagatgagggaacaaacctagaaaagtatctgaactaaggagctatagttgctgtactagtttcctatggatgccgtagcaaattaccataaacttactgtcttaaagcaacacaaatttactttcatttttggaggtcagaagtctgaaacaggtctcactaggccagaatcaaggtatcagcagggctgcattctggaggctctagagaaggaatgtttccccaccttttccagcttctggaagctacctacgttccttggctcatggccccttcttctatcttcaaagcccagagcatagcatcttcacatttctctttcaccctggctctcctgtctccatctttcatatataaggacactggtgattacattgggggatgtccagataatgtagaataatccccctatctcatgatccttaacttaatcacatctgcaaagcccctcttgccatgtaaggtgtcatattcatgggttccaggaattcagatgtgcacattttgggagaccatcattttgctaccaattactaagaggcagaactgcgatttgactcccagccgatttcttgaccatcatattgtggggcaaagtctttggtgtttattaagtcctttttcccccttgtggcagtggagggagggtggaaacctctggatcccagattcaggttttgtatgccacattaaacaggacaggtcatccccttctgcccttctcctctgcagtataggacgccaaaggctcacagttaactttcaacattgttttatcttatgaaggtaaggtttaaaacaatccatctcaccccatctccaaatatattattgacttttaagcaaccacagacgtttgataaaagtaggttacaaagtaaaaatgaaagcctagcatggggacaggccatgacatgcctcccatccaacagggtgtctgtacagagtacagagcagccgccaagggcagacctggaagcaggatccccacagtaagaggagcaggtaaggaagagctgaggcggcctagctcagagtgctccagtgagggacacagggtccgggcacacaggtgaccagggagagcgtggcaacccaggccacaacagatagaagctccaggaaccagcctagcaaggtggcagaacaagctgacccacacgaagccaagggacagggcaagcatggtcatggggcagccatgggcgggcctgtccgcaggagagggtagtagacggtcctccgagtcaggctggcggcctatgaggagcccaacctctcagggatggaaagatcccgaaggtaattccaaggcccagcaaaccagccaggtttgatccaccagggagggagcaagtcaacaggacatgagaattatttgggtacaaaagaagtggggttgcagggaaactagaagctggagatgagctgtagtttggggaagatggggtgttcacagctcagcaagcccctggctcccaaatctgtgtcagctgagctatgtccagacctcacctatgggtggcacgggccgcccttacacatatacgcatacctccactcacttgggggtggctcagggcctccaggactggaatctaaaaggacctttgttcctccaggtgggaaagactaggggccaccctcagcaggcttctagttgactgagaccttttatgaccatgagttctcagaacaggattacttacctggtacccagttgctttgatcctttgcttaatgtgagcatcacagtgttagaaatcagaggtgaatttacatgggctgtgtgtttttgtgacaaagcaataagaataaagtagactgcatactctagacatactttcctcagttattcatacttagagtgactattgaatttatggtccaaactgaggcacttttgagagcacttttaataagtatgtgaggtccacaggtgtaactgctggttctcggggccctgtcagagggggtcccttctctgagcccaaagcctcacacccaggcacccagggcctagtgaagctgccttagctgtaagcacaatggtttagagggattattcaacatctaaatgcttgcctgcaacctcaaacactctcattcctttcacatgcaagacaagaaatgctgaataaagtttcttttgaggcagaccaatgatgtaactccctcacaagggcctctgttcgaaagtcagggacacgtttatcctattgattattgacatttgagagttgcacctccatcccccaagccccggagctcacttttcttttgtgacattgttctaaattgaggtgcttttctgctgccctctccacatgttcacaagacactctctcttgtccagacttcactgaaacagaagtgtttcaagctccgggtgagtttcatagtgcatatcatgggtcatgaaatcagttcagtggattgagatcagcatatttttaacaacaaaatgaaattgactagagcaggaaaaaatagaattaaagggaatagaatgcttttcacatagtaagaaattctttccagaattttttcatgacagtatatttttctagcattaaatgtgagggtgattgatgtggttatgatgtaaaaaatgtacttcctggtgtgggcagccaccaaaatttgcagtcccctgctataaaccatctttgcaggttttctttttcctttcgcctggattcttacagtgccaagggcggctctcttactcctacacacccctctcaggcatcctccattctctgcagatggcttagtttgatcctttaggctagagccaacgaaatgccttcctatttgatcagttctatcaacataagtctttatcgaaaaaggaaaagaaagaaaaagccaaaaccttgcaccattcaccaaggagtgataagggccatgtgagtagagatctctgagaagcttcaaagcaacccggctaattctcagcaaccccacacctcctcggcagcatctgcaccccagcactatttgtgcctaagtgtgggagtgctgggtgttgctgtgcgtgtgttctcatgcacctcccttctgtgccacaacataagtggaaaatatctccgcctgagtgcctggccccccttctgcattgtttcggggtctttgcagcagcacaggggcttctagcctcttcctgtaattttgcagaaggtaggtgcaggagtggggagccctcacatcaaaggctgccttccaggactgctggctcagggaagggaggagggtgaccctggtgcagagcagaagagagcgaccctaggcaggatgtctggaaggagagataaaagcaaactgcaaaggtattttgatagaccatgctgtttccattctttaccatgtgtttttcattctgcttttggttacttttgacttgaattatggagcctggttaaggtaacatagatgcaattacttttatacgtcaaaaatgaatactgacttttcctagtggggctgggggtgatgggaagtggctaagacagaatgcacattgccttttagaaagctggaaagttcttttcttctcacttccttatggcagcagagaacctgtttttccaagagctaagagcactttgacaaatgcaccgggtaaaagcttgcatgcaagatagaaagacacccccgatgatgacatagtgtggccattacattgccgaagaggaagcaaataccaaatacatctatattatatatgaaggagtggcctgcccctccacacctgtgggtatttctagttgggtgggacgagagactgagaaaagaaataagacagagagacaaagtatagagaaacaatagtgggcccaggggaccggcgctcagcacaccaaggacctgcaccggcaccggcctctgaattccctcagtttttattgattattattttcattatttcagcaaaaaggaatgtagtaggagagcagcgtgataataaggagaaggtcagcaaaaaacatgtgagcaaaagaatctatgtcataattaggttcaagggaaggtactatgactggacgtgcacgtaagccagatttatgtttctctccacccaaacatctcagtggagtaaagaataacaaggcagtattactgcaaacatgtctcgtctcccgccacagggcagcttttctcctatctcagagttgaacaaatgtacaatcgggttttacaccgagacattcagttcccaggggcaagcaggagacagtggccttcctccatctcaactgcaagaggctttcctcttttactaatccacctcagcacagaccctttacgggtgttgggctgggggacagtcaggtctttctcatcccacaaggccatatttcagactatcacatggggagaaaccttggacaataccctgctttcaagggcagagttccctgcggctttctgcagtgcattgtgcccctggtttattgagactagagaatggcaatgacctttaccaagtatactgcttgtaaatattttgttaacaaggcacgtcctgcacagccctaggtcccttaaaaccttgattttatacaacacatgtttttgtgagctccaagttgggtcaaagtggctgaggcaaagtggctggggcaaagctacaaattaacaacatctcagcaaagcaattgtttaaagtacaggtctttttcaaaatggagtctcttatgtcttccctttctacatagacacagtgacagtctgatctctctttcttttccctacaatatatatatactttaagttctggggtacatgtacggaatgtgcaggtttgttacataggtacacatgtgccacggtggtttgctgcaaccatcaatccatcatctacattaggtatttctcctaatgctatccctctcccaggcccccactccctgacaggtcctggtgtgtgatgttcccctccgtgtgtccatgtgttctcattgttcaactcccacttatgagtgagaacatgtggtgtttggttttctgttcctgtgttagcttgctgagaatgttccagcttcatccatttccctgcaaaggacatgaacttatcctttttatggctgcatagtattccatggtgtatatgtgccactttttctttacccagtctatcattgatgggcatttgggttggttccaagtctttgctattgtgaacagtgccacaataaacatatgtgtgcatgtatctttatagcagaatgatttataatcctttgggtatatacccagtaatgggattgctgggtgaaatggtaattctagttctagatccttgaggaatagccacactgtcttccacaatggttgaactaatttacactcccaccaacaatgtaaaagtgctcctatttctccacatcctctccagcatctgttgtttcctgactttttaatgatcagcattctaactggcatgagatggtatctcgttgtggttttgatttgcgtttctctgatggccagtgatgatgagcattttttcatgtgtctgttggctgcataaatgtcttcttttgagaagcgtctgttcatatcctttgcccactttttgatggggttgtttgttttttcttgtaaatttgtttaagttcttgtagattctggatattagccctttgtcagatggcttagattgcaaaaattttctcccattctgtaggttgcctgttcaactctgatgatagttgattttactgttcagaagctctttagtttaattagatcccatttgtctatttgggcttttgttgccattgcttttggtgttttagtcatgaagtctttgcccatgcctatgtcctgaatggtattgcctaggttttcttctagggtttttatggtttcaggtcttatgtttaagtctttaacccatcttgagtcaatttttgtacaaggtgtaaggaagggatccagtttcagctttctgcatatggctagccagttttcccaacaccatttatataattgggaatcctttccctatttctgttgtttgtcaggtttgtcaaagatcagatggttgtagatgtgtggtgttgtttctgaggcctctgttatgttccactggtctatatatctgttttggtaccagtaccatgctgtttttgttactgtagccttgtaatatagtttgaagtcaggtagtgtgatggaagtaaatacctttaaccagaaagacaagacacagagataaacattcttcctgctacagaaatatggtggattcctcaatggctgtgatctttgaaaagagaagcaactgttgtctatcaaatagctaaaaatactgttagaagtataaatatgtcccctgatattgtcagaagtttcatcgaagcctcaggcaagcaaaatgtgtcctctgtttgtacctcaatctctactcctgcaaaatgcagataattataccagtaaaggactattgttagagttgatgcaataggtttatgaaatcttcaagtggcttgcaaataattcaaaatcgaactgtaatttccaatcattctaaaagcttcatgtttcattttttggagacattattgctctgttggctttttctaacatatgggtatcactgacagcctccattctgtactaaaatctagaagaatcttcattcctctgggggcaaacatcagagagaggaatggaagagctgccccagggacctgacgcttgataccacttcctgagtcaggcccaatgcaagcatcctcagcttgctttccactatgagggagttgtaatgggttcccatgccgtctgagctgcaggaaaaggaaagaagtgggagagtaaattagtgttctgacattattgacggaagactttactctcgtttcctagttatctgagaggtacagtgtctattgagtaaaactgtcagaacgaaaaacagtggttctgcaatgattttggtatcttgtacaatgcaacctgtagtataactgatacagacaatccttttctcaatcaagtaatcaattgataaaataaacaggacaaaaaaatcaacctaaagatgcaatctcgtggcagtattaaactccagacagtatttaattttgatttctctcacctggagcatttttttttttttttttttgccagagatgaatcacatctgtcacaacaataacaacaacaacaaattagcggaaaattgattttcatggtcctgttgtctctaagtggcttgtggtttagtttgtagatcatgtcttatctagagctataatcctataatgaaaaagtaaattaaaccaagaggaaactataaataaaaaaaatatttctcttatatgtgatccactattcccatcacagttttgcttcctaagtagttttgtcttatctgagaagcaccaaggatccatccacatagggcccctgcaattcccatgcacatgacatgcacctccatatgcatcttgccaccaacttgagaatgccaggagctggttgtggttcacaaggcatgggagttcttgccattctcaccaataacaccagcatcttgaaaacccaaagcataaaagcaaacaagttacaaacataagcaaaccaacacatcttcaagccaaacagctgtttcttactatggcttttcctttctggtccacaacgcggccaagattgctgctggacatgcatggtgttggaggacttgcatgtatgtggggaaggactgccctccaccgtgattctttcctagggcaactcctctgagctacgctgccaatgcacgcaacaggaccccaggaggggcaaaaagctgatgggaacaaaaagatgtaccagtgaactctggtcttaatataaaactagcatggtgggtaatagaaacatcttttccattaaatcaaagaaacagatctggaaaactaaatcctagaatgttgagtccctgatggcagagactgcattgcaagctcatgcatggaactgtgccctctgcatcacagaagtgcctccatttgacagttacgatatcagtgtcatgaggctgggatacctctcttggtcaatgcaagccatagtataactgagctagacactttctcaatcaagcagccttttgataaagaggacacaaaaatcaacctaaagatggaatttggtggcagtgttaaactgcagacagtatttaattttgatttctttcatctggagcattttgttgccagagatctgtcacaacaacaacaacaacaaaaaatgggcagaaaattgattttcatcatcctgatagcatttgtcctagagacagcatttgtgttaagagaatagtgtttgtctttttgatcaggagagttgagcttatggtcttaacttcaggcattgggccttctgtagcgtgcttgtgaatactccacccagcatctacactccagtgaccaggcttttgggttgctggtctttgaactttggcctgtaacctcaagcagggcagaacattgccacaaagccccagatcactgacaccaaatcaaatttgtgtggactctgtcccagacattccatgtgaaactggctgtccttacaagccagagagaacccagtgacgatgggaccagggacagttcactttcttcccattggattaccttctttatcaagggagcactggaccacatggagtctgaccataaactgcatctgtctcatgagctggatccagtataggacagggacactgggccaccactggctctgtacaaccccagtgccccattctcatggtgtggatggagccccgttttctcctaaaacttgtcccactagttcaggggtccccagtccccaggccatagaccggtacttggttcatggcctgttaggaacccagccacacagcaggaggtgagcagcaggcgagaagcattccccactgagctccacctcctgtcagatcagtggaggcgttagatacttacaggagcatgaaccctaatgtgagctgcacatgtgagggatctaggttgcatgccccttgtgagaatctaatgcctgattatctgagttggaacagtttcatcctgaaaccctctgccccccacctcccaattcatggaaaaattgtcttccacaaaatgggtccctggtgccaaaaaggttagggatatctgcactagttcctcctcgccatccctctctctgccccacatctgttagattcttcctcatgttactattagttatgaataatttgctactattattagtgaaggtgttatgggttgagtgtctctcccccaaattgatatgctgaagccgtaactcctaataactctatggccttattcggaaatggggttgttaccgagtaattagttaagaggaggtcattagggtatccctaatccaatatgagtggtgcccttgtaaaaggggatattagggggacatttgggcagacgcacacacagggagatactatgtccacgtgaagacagagatcagggaagtgagtctacaagccaagggatgccaaagattgccagcaaaccaccagcagctagggagaggcatggagcaaatgctccctcacagccctcagaagggaccaaccctgctgacaccttgatcttggacttccagcttccaaaacttggagacaataaatttctgttgtttaagccatccagtgtgtggtactttgtgatgacagccctggcagactaacacaatggggcattgggtggcttatctttgagcaaatgaagaactgaatccaagcagtcacttctcctcttgagaccttggccaatgcatcccctcccaccctcaactgaacactttcccttaatgacaatgcatgttcagtcatactggactatgtagtataggggaggaaaataaaacttttcctcaaccttcttctgttccttagctggggtctgttaattacactggcaaaagtgagaccatcaggagaaaagacagacaaatcttattttatgttattattttaatttttatgtgaagggacattcatagaaaagaagtgaagaaccaaagaggctgttagacccaggagtttatataccattttaacaaagggtgataaatttgcagagaagtaacaaaacaagcaaaaagcaacctgggcttctaggactgggagagtacacatataggggaacctaatgaaagataagggtgatattggtgaggtttgtttgtgcagacctgtcttggtgctgactttctgtttccagtgacaagagttggtctcctcttggtatggaagatgggaggagaaacaccttcacaaagggaaatttatgtcctcctttttctgcatttgctgcttcttaattgccttcacctcaaaacaatccttatacaaatgatgcaatagactttggggactcttggagaaagggtgggaagggggtgagggataaaagactacaaattgggtgcagtgtctactgcttgggtgacgggtgcacccaaatttcacaaatcaccactaaagaacttacttacgtaaccaaacaccaccagttccgaaaaacctatgaaaataaaaaaattttttaaaaatccttatgccaaagtggcatattctggtgtgacatattttggtttggcatattttgattctccagtggccttctatagatctacatgtctgtctttctgatgtatgggtataggaaagcctactttgtggacagacatatactaaagaaaatacttgtatacaaatattacacaccagtctccccttatctggtggggataagttccaagacttgcagtgcatgcctgaaactgtggatagtcccaaaccctgcatatactatgttttttcctgtgtatacatacatatgataaattttaacttataaactagtcaccgtaagagattaacaataaataataataaaatagaacaattataacaatatgctgtaataaaaggtatgtgaatgtggcctctctctgtcaaaatattgtactgtactgtacttaatctattttcagccccacagtggaccatgagtaactgaaagcgtggaaagagaaactgcagataaggggagcgggaggagggcgctactgtatgaataaatacactttatagagagatatatccttgaagaagaaatagaatactctatgtctgcgcatactttatccacagttgtattcataaaaatgtaaagtgcagaacggaaactgctcactaaatcagctcaactgaaatatctggataattagtggtacctggtcttttggacccagttctcatgaaatgtgcaactctgacctacttatgagattaaaatgggttttttgttttttttttgttgatgttgtttgaccacctgggtctctgaggcttattttcaataggaggaaaataagtggtttctgttggggagagtgtttccctgtggcccaggtggcttgccctggtgcttatctgcctggtccccacatctttcaaaccagaaggcccaggagttaggatatccagcttaacaagcccagcactatctcaatgatgagcccttggcagccttgggtggccattcgcagagtcaaaaataaggacagatatgaaacactagctatacagactgtgtctgaatctccaccatttacccacatggtggaaaatacactacctccagtcctattacaaaatataatgacttccccagcctaaagtgttttaattctgtggttctcaatgtgtggtccctatacccctgagtccttttcaaggagtttttgtggttaaagctatttttttgatactattaagatatgactcatcttttcactgtgttgacatttatgctggtacaaaagttgtggtgggaagactcctagtgccttagcaggaatcaaggtggtggctccaaaccaaactagtaatcatgatattcttcatcaccaagcagtagggggaaaaagaaaagcccagctgcattccagaatgaccttgacaaaacaacagtaacaattattaatgttattaaatctggacccttaaacacacacatcctctttttttcattctttctttcttttttttttttttttttttggagatggagtctcgctgtattgcccaggctggagtgcagtgacacaatcttgactcactgcaacctccacctcccaggttcaagcagttcttctgcctcagcctcctgagtagctgggactacaggcacacgctgccacacctggctaattttctgtattttagtagagactgagtttcaccatgttgcccaggctgatcgcgaactctgagctcagacaatctgcccgcctcagtctcccgaattgctgggattacaggcgtgagccaccgtgcccagcaacacattttttttttcttttttgagatggagtctagctctgttgccaggctggagttcagtggcaagatcttggctcactgcaacctctgcctcctgggttcaagcgattctcctgcctcagcctcccgagtagctgggattacaggcacgtgccaccatgcccagctaatttttgtatttttagtagagatggggtttcaccgtgttagccaggatggtctcagtctcctgacctcttgatccacccaccttggcctcccaaagtgctgggattaccggcgtgagccaccgcgcccggccgcaacacacatctttttagtattcagagtgatgaaagggaagatgcatgaagcacttctgctcatatcaaagaactgtgactgtcttgaggaaaggaagttgtgcagtggcccaagtcgtgagttcaacaagatgtttcttccattttcacttggaagaacaactgacagacaaagcatacttagattttggcagtagatattttcccaaaaatgcagagtagcctgtcattctaagggaaacaactgacagtatttgtttttgttttcaaggataaaatttgagttttcaggtgaaaattagcattttgggaaactgtgagtgtggcagcttcccagtgtgtaaaaactttcctgattagatggatggtgatatcaattactgtaatttgttaatattgtataatgaaatgtatcagcatttggaagatctatagaagcaatattttctaaatctaacaaaacaatgtgtaggttaaagatctgtttaaagcttaagatagaccaaatgggctttaatgtaatagaatatgaaaagtattgatgtgatttcagattccacattgcaatctttaagcagtagttaagaaacatctctttttcaaattttggtgtagaatctatccatttatagagagagatgatgatctgagatggctatcaagatatttctcttttccaacgacatttctgtataaggttgcatttccttcataaatttcaaccaaaaccacatactccacagatcgaatgcagaagcagacatgagcattgagctttccagctgtcttctattaagctcaatgttaaagagatttgcaaaaattcaaaaccacaccactcttcttactagttgttttgttttggaaagtgtaattatttttcatgaaaacattctatgttacctgttacggatttaatgttaattttaaatgaattaattttttagcttctaagttttattttctaatgcagtaaatataatagatataacctacataaacaaaagccctttgggattcttaataatattaaagagtagatagggctgtactctttgaggcactctttaagaacaggggttaagagtagctggtttaattaaacttgaaattgattgaatatggttccacacacagtttcaattcttgttaatattccccatctattcctattgtataaaacactgagtcaaagacgtattttttgctgaaatcatctagataattgtaccatatgggccattttcccaccatggggtaccattcggttccaaggagtccctggtacttaacttggggttagggccacaaagaaataacttaaaaacacaggaatcccggtgcttttaagaaatttgcattgcttacttcatttgtttatttatttattgttggttctattttaggaacagtttttcttcaggctgtttcccaacacattttaatgtgattttcagacacggttttcgttcttgcaaactgtgtcacatattatttccctgcccattgtgaagccaccttcaatctctgtttaaaagtgttattgaatttaattgtttaaagacattatttaaaccacctttgctgtggtaagatatgctgattatttatttactttatattattttagttattaacaggtaatcaatgcacacggtgcaaaattcagaagcaacaaaaagagaataattaaaagtaattttccccctccctccattctcttccttagttctccccagaagcaactactattgccaactccttgtgcatccttccagatattccaaacatgtataatagccacacatccttttcttacaaatggtaggatactccacacaatgacttgcactttcctctttcacttaacaccctgtcttggagattgtcccagagagtgagattttgcctcactatttatagcggtgtagcgcttgctccattgtatggacgaatgacttgactctgcccctacctataaacatttagattgtttcccaacttatgctaccttaaagaatgttctagtatctgtatacatctgcgtttgtgtacaacaaacatatactaatataactttaaggatcaaaagatatgtaagccaacattacttagactacagttgtattagagaaaattgtaagtcataggttactgaggaattgtaaagaagctggtgatattgtgaaacagatatttggtcttctttcagtttcctgatgtacagctcctaaaatcctttaaatctggccaggcacagtggctcacacttgtaatcttagcactttgagaggccaaggtgggtggatcacttgaagccagaaattggagaccagcctggccaacatggcaaaaccccatcactactaaaaatataaaaattagctggacatggtagcgtgtgcctgtaaccccagctactctagaggcggaggcaggagaattgcttgaactcaggagacagaggttgcagtgagctgagatcctgctactgcactccagcctgggcgacagagcgagactctgtctcaaaaaccaaaccaaaccaaaccaaacaaaaacctttaaatctcttgagtgacaagagtacttttgtatgctaatgagataatggcggcggagggggggcgggtcctagctagcttcaggatgggggttggtcactggaaagaacaaggcatgactagagggttgggactttcagccccaacgccaacctcccaggagggcagaggggctcaaggttaagttgatcactagtggccaatggtctaatcaatcatgcctatgcaatgaagcctccatgaaaaccctaaagggcagggttcagatgggtgtccggatggttgaacatagggaggttcctggagggtggtgaccccaaggaggaaacagaagctccacgtgtctttccccatgctttgttctgtatccctcacaatatcttcataatacatggtaaatattaataaagtgcttccctcagttctgtgagctgctctaccaaattaatggaagccaaggaggggttctaggaccccctccccaactaatagcctgttggtcagaagtataggtgacaacctactatttgcaagcggcatctgaagtacagagtggcagtcttgtgggactgagccctcatcctgtgggatctaactccaggtagatagtgtcagaattgaatttgaggacacccagctggtgtcttctagagaatcgtttgcagaattgcttggtatatggagggaaaattacccccatctggggtcacagaagtgttctgcattgtgagcatccagtagaagaaaaacagcttggggttgggcgtgatggctcacacttgtaatctcagggctttgggaagccaaagaaagacaattgcttgaggccaggagttcaagactagcccgggcaacatagcaagaccttgtctctataaaaacaaaaattaaaaaaagattagttgggtgtggtggagcacctgtggtcccagcttgtcgggaggctgaggtgggaggatcacctgagcccaggaacttgaggttatagtgagctgtgaacatgccactgtactccagcccgggtaaccctgcctctaaaaaaatttttgtaaactgttttttttttctgatatcttacaaagttctgtggtaagtagtgcttagctttgttgttaactgctagaatagctccagggagcggtgctgttcctcttttctttaaaagagagtggaaagaaaataaatcgtttcgttagtctgactagaaaaagaaatcaggctttatgcttcttgattttggaaatttttcagtccctttttgtcaggagagtgaagaaatagggaagagggttgcagagaggctttgcctttctgttttgactattgtatttcttgtgctggttgagaaggagacgctatgaagatgggtcatgagagctcagaaactgatcgctgccttgcttcaggaggcagcctggtggaagggatggaaccaggaaacgtgagcagtcacaccagtcacacgctgtcctcatttgcatcctgtccttctacaccattaactctgactttgagtacattatttgccctctctgggcctcagtttccttactgagctacgtggaatttcttcctttttttcccatcagacctcttacatcaccgtctccacaccctccattgtcactgaccctcagcccactgcaatgtgcttctgtccccatcatgccactgatcacattcagacgtcaccaacagccactgtgctgccacgtgcaacacactctcagcaccccctggccactgctcctcggctgtgtcagtcactggcttcactgcccccgcctctggctctttctcctcatccttccttgacgctgccttctcagccacctctgcggatgctgccccctaaaccttaggctcccctggagcttgaccttcgacccactcctaaccatccacgtgctttcttgcacgacctcactcactctcctggtttatttatttgctcttttgctctactggtttttacctaccatttggctaatgacccctatgttcataccatcagctccaaccttctccctgaatctcatccttctacaagtttgggaaaattttctatttggatggctgtccccaaactgcttctgtttcaataagtcaaaattgaattcatcctccaccaccagtttgtttttttctattttcctgatgattataccttttggttatccaagctacctctgccttctgggttcaagcaattctcattcaagcttagcataatgacctcaaggtccatccctgttggagcatgtgtcagaatgtccttcctttttaagtgtgaataagattccattgtatggatgtactacatgttgttcacgcattcacctatctatggaagcctgggctgcatccacctgttggctattgtgaataatgctgctatgaacatgagtgtgcaggtatttcttccaaaccctgctttcaattcttttagatatatacccagaagtggggtatactttcatatcttaaccttgaccggaacttattggagtttcatctttactcagctggctccctcccttctggtcacactggactttaacccttagaagggatggagtgagatttattcatcttggtggcattgtgaggatgagtcacttagcaatcaacaagtttctgctcaatagtttccctcgggctctctactcaatccaattactaggagaaggatgccatgtgaacttttttttttttgagatggagtcttgctctgttgcccaggctggagtgcactggcgtgatctcggcttaccacaacctccgcctcctgggttcaagccattatcctgtctcagccttctgagctcaccaccatgcccaattaatttttgtattttgagtagagacagggtttcaccatgttggtcaggctggtcttgaattcctgacctcaagtgatccgcccgcctcggcctaccaaagtgctgggaaccatgagaacttttaaagtcaaaaaaaaaaaaaaaaaaaaaaaaaaccctaagttcaggaccatttacaaattcatcatttcaaagatgaggattctgggtgagtaggaaaaaagaattccatctaaaaccaggagtaagagacaaggtttatcaagctgtgcttgaaaaagaatgagaaaaaaaaattgtacattatacttttttttaaaatttgctcagtatgtgacagaattgacagttcatagtattctttctaaagttacaatttgtctttatcttaaaaagttactttttaaaacaaactcaaagataatactaggaaattgtgctaataacctttaatgcatctacagtttaggacgcagtgggtgtcagtctgccttaattttagaatcagttttttgactgaaatgagaaagaatgaacctaaggattagagcgatggtggttatgcacacacctgtgtccacagaggctcgctggtacttctcttatgttgggtcatattactgtttccctctccccttcaaatttcacaaagattcaataagcaagctgtagattcagggtggacattttgtaaaggatgaaatggaactgtagaatcttaaacaccttctatgtactggtcccaaggcatctcaactgaggttggctctatgtgcagcacttggcttcctaaaataactaagtccattttcgaatgttggcagctgtaactgcaacctccaaggtccagcactgctaacttctatctgaaaggattactcatgccattgctcctcaccttaaatctggcagcattttttttccaccagtgtggacacctcaggtctccagcataagagaaacacaagctgatacaggaagacgcacataccacacacttccctctgcttgcctgtgccaagaatccttctcgtctgagaaagaccaatgtgttggttttggacaccaccaccaaataatagcatacgatgtgacatgtttcccagagattagcagtcaaaactttagacttcaaaaggcatcaccctgctaaatctgctagtaggtagcttagcaccattcgagtgatatctaccgagagactggtgctgttagagaccctccattaaaatgggtcatggcccctgacacaggctcacattcagtttaactctcacctctccaactgccaatagaatggtcatggaccctctagaagcagacaagagaaaataattcattttgcagctatgtggggttatctgcttggggaaagctggtgtgcaagtgaggccactagaaggtgaagcaactgccagtaacctgcctgggtttaagactgctcaggtgttctcctagctggcaagctgcctctccggcctccgcctgattccttttgggggacaaagctgtcctgctgacctcctgctctgaatctgaatctgattctgggttggacctaggttagcaaacttctcctgtgtcccgattctggtgtgatccctgaactctgtctgggtccagccttctggatggcagactcagcttccagctctgcctgagtgtgcacagtaatctcagcatccccagctcagcctggtaagtgggctgagctcctggtattcctgatccttggcagtgtcccttcattccagcgtacttggcactggccctcgtgtgggagtccaggcatgagtcggcttgctctcctggcggagatgctagggcaagtttcccaggcatgaactgtggctttgttacctacttcatggaaaagtgcagccacgtgtttttccagtctgattcacacaggcagctccaggtcttcagaggaatcaagaacaaccagccctgagatggctccaaggtggattttatatcaccccttcgcatcctctttctgggacaaagagcctagatgggcatgtgaacaataatatcatattatttactaacacatcagaaatgggattctctcaaacaatgatcaaaatggtagcattgatcctaagcacatacgcatatttaaactggcaccaagctgttaattatgttaatgcctttatggcacaaaaatgtaaaatttactattaacttgggggctgacctaaagagctggcaaatctcccctatccttccctatctggctatcttgctgggcttgcaatgccagggcctacttagaatagccacagccacacatgagcatcatgggagacttctgggggcaacttcagcttcttcctctaaaatgattcccgactcccagaaatcagcaggtgaattacacccagcgcccttgtttgcacatataaattgcacagctgccaagtgcagactccttgaatatttccccaacaaaaacttcctttggcttgctctccccatagtctctttctttccctcacttgcccatttttcctgcagagggtctccttttgttctcactgggcctgctcctcccaactggtctctgaggttccctctctgtgagctaaagcctcaaagcatgaaggctttctccttctttgggccacaacaccctctctcagccattcctacccccacctcctgctgctttcttgcacccacagagaggacaccatgacctggtgctgccttggctcagcctggtctcccctctgcccttgctctgctgcctgctacatcacgttggatgtagggtccctctgaaactgcctgtcttctgagagcttcagacggaaaggggaagaaagtaatctttcaagactctaagagtaagatccactctggatctcaccttcctataccaaaaatgtcaccctatcagcagtcaaaatatgctaataaataagatgaacatcatagtggcaatcatggtggtagtagtgatgacgaaagattgctcctccaaactctgcatctaggatcagggccatcatgtgtatgctcactaactgtctgccccattagttctgctccagccaggagctgctgtcctttctctgcatccacgtgccagttgtaagtgaggaagagtgacctgtccaaaataaatgaattctcgatacaaagccaactggctgggtgaagccgtacttctcgtaagggaaggctgtgaagggaaggctgtgattctgcaagtgccaaagtgctggttccagtcttggttggaaagtgttctaagacaggctgtggatgctcaaatcaacattaggattacatgacttggaaattcccagtcatctctgtgggtttggatggtgatagtcaaggaaggtgtgcatgtattagtcaaacttatcttttgaaaatatttatacatccaaaatacgtgcaagtgaggggaaaataccagtttctcaatccaagtgagtccaccttaaaacaggtagggttgaaaggcagtggtcatatgtgggccatctctgccggctgcctagcaaaagcacactgcaactgtgagggtacctctgcaaagccacagaatagttgttgtcatggcaagtaggcctgcttccacaaatgagacatgctcatgctggtagagatgaaagaacctttatggaatttctgtgggagacagaatttttgtttaactttgtatgttaccatttatgcagacagaaattttttaaagcatttgatagaaaatcaacaagcttcaagcagaaactaaagccatgaattccccagatagactcctaaaaattaagatggtggcttccgtttgcaggatgcagatttcaaggaagtccctcaatgagtggccttctctgcgattaaggcctaggctggtggtggtggtggcagcggggggaggattggggcaggagaagaagcccctcactagcaaagaaaagctggactctgagagagaagcaccatcccaagaacgtccacatgcacacttccctgcagcctcattttcagctcttcattgtatctgcggatgctgtaacctgggggttacttcctttaattcaggcagagattcccaagtttgcatctgctgatatctggaaggccaagctcttggctttgctttaattcaagttatttgccaactggatctcggtgcaaagcccagataactcgactgcctaaatgggaaatgggcttgatgtgtttgttctgagcagggtcatatagagccattatatagcagccttatgttggcttaggcattttctttccttcttcttttttttttttttttttgagacagagtctcgctctgtcacccaggctggagtgcagtggagcgatctcagctcactgcaagctccacctcctgggttcatgccattctcctgcctcagcctcctgagtagctgggactacaggcgcccgccaccacgtccagctaattttttgtatttttagtagagacagggtttcaccgtgttagccaggatggtctctatctcttgaccttgtgatccacccaccttggcctcccaaagtgctgggattataggcgtgagccaccacgcccagcagcttaggcattttcaagaaaactgaattaaattcagtaatactgatcaagctgcaaagtgctgtgaacacagattcaaatgtctcagttcttgcccctaaggagctcacagtctcctctgttgttataaacatgggaaagaaggagtggactggtcaaaaatgaggctatgatggctatccatgcagctttcctagttgggataccttatttggtctaaggataaacaggagtccaccaggcagaagagagtgaggaagggagttccagcagtcacaggatgaaaggctctcccctcactggccgcaggtagaacatgtgaggtgcaaagagagtgagcagcgagggctctcaaagactctctcctgcgcaggattgcagtgtctgctttcctgacctcatcattttccaaacatattcttagaaaaagaaaacctctcaagcattctttccatctgcttctaccctgacctggaaattcaagggaccagaagcaatacagcaatacagacagaccctccatgcaaagagcgtgagacagagaactgagtccagaaagtgttagcaatggctgggaagctagattacattacagccatgtgccaaatggaaattgaatttcaagttatcaaaaggaaggccaaaaaaaaaaaaaagataagaaaaagccctcgagtttaaagatggctacatgaatagttcagatatctgatggtgattcaccgctggaacccctccggccctccatggagacaatgactcctctggtcttactgaggagtaattgctcagcatctctgactgtacacacgattccaagtatatttatagtgttaggatggcccagaatttttgaaggtttttttatttttgccaaacagtcctgccaggagatgctgaaggtcagatattttagaaaatctgtttctggtacttcagcagtcaactactattgcaaggatggagaaagatgcttggttgttccaggaagctctgtcatgactcccaggtccaattttaaagtaccttctgaaataggtgaaaggtattcctaaacatgctctctagaacttaaagcataggttttcatcacacacaaatctgtaccatggggcagaattagccacaggagacattctcaattgtcaattagccataaaagtggcttgaggaaaaactagataatgtgaaataactctttaaaggaagaagagaggtggtacattctttatttcacagataatgtaaagaagacatacaaaggtgaagggtgttacctgtggccacatacactgctccataggagctcctggacctggggttcaccccctgcctcctagagcctggccagtccaggctctttctagttagactattgggattttctgttaatgaccctaatcaaagtggaaatagcacaaaacgaccttggtggcagtgaagagagaacttgggatttcaaatttttaatgttgactcataaagttaattcacaaagaataacagatcttggtgtggtttaaaataaacactcttgccagccatggtggctcacgcctgtaatcctagcactttgggaggccatggcaggggaatcacttgaatcagggaaggcagagtttacagtgagcggagattgctccactgcattccagcctgggtgacagagtaagactctgtctcaaataaaataacataaacattctgaggaacaagtgaggcatgagactcccccatttcagaaatgcctggaagaatctcccatttcaggtattttagggaagcaaaccgttcactcaaaagagaattttgccaggtttgcacagactttagacattaatacttcctttaaatggattttggaatcattgacagaggaaaaaaagagtaaaactctaagagaaggcaggcagagaagtgaatggattgctcctgaaaaggactgaaatcagagacaaagagatctcaaataagaagcaaagtttttcagagtctaccttacaaatacttttcatctgaaaccatccagcaacatttactggcccaaatgaactatgggtgtgaatagtttcattctattggtcattaatgtaccaaacagagtctttcttaaagaggtatcaaagccacagtggaaactgtatccgacgctccaaataaactctaaccaaggatgggaaactcggaatcatggagttgtttgtggatttggctaaaagtcaggcatgttttgaggctttaaacactgattatttatatccaacaaatagtttgtgaaaaaggagagagggaagaaatgggatatggaaattgtgtatctcaagaaagagccaatcattttccctcctaaccagagcatggcagaagggagaagaaaaggaaaagagcttgccctttgtggaaagctgagcttttcctgaaagtctgacaggcagagaaacaaagtttggatcctgcaagatcgttcctgtaaccagatcaagttcctcctgtttgctggaggcccttgggtctcccgtcacaactgcacccagctcacgggcacaggcaggtgcataccctgcccgtagagtcatctttcatagacttccctgctggatccgggcaaatagtgtttccagaaaaagcgaatccagctttctgtgccaccaccctgggatctggtactgtgtcatgggaaggcatgcagggacttgcctcctgaccccactgccaggaggggtgctggtttgatcactcctgaccccttcccgccagcatttatgatcttagacacttactcaccttccaaccatgtgaggcaattaagaatgattgcctctgaatcaagggcaaatcatccaccagtttcctggccaaggtttgagtgggaggaacagcttgtgtgaaatcctttaacggtgacaaaatgcttaacaatcttgatggcagtggtcagttagggtaacgaacatagggcggtctgacctccagctcatgttttcctgtgttcactttctacctggtaatggtgagctcatcctaatccccctggggtagcccccatccgggtaggaggctactgttggcccctgcacagatgggtctagcccaccagcctcccccccacgaccccaccacagggtggcagttgcgagcacacgcctagaagccctgcctttctttggcctctcccagagaatgaaatttcagcatttgtacagctcagacccactggctgaaacttctacctcctggctcaaacttctacctcctgcttccctgagtgaagtaactgacagaggaagtaatacttccaactggattttagagttcctgagtctagtctatgtttagtctatctctatttccctgtccctcccccacgccctaaactgacatttcgtaggtttctggtaaattaccgagtccagagttggaagccctaagtggtatttattttacttcaaatcacctttagtcatcagaatcacctggagggcgtgttaaagcaggagctggcctgagaatgtgcacttctaacaggtttgcaggggatcctgctgcactctgggacaaggctttgagacctgctagccgcaggaagtcttttcctctctttcctcccttcctagctgtgcctctccctgaagcccacctacaggagagacgggaaaacgttatgggcagtgttgtctcaagaaggaatgtcaggataattggaataaacaaaagaagaacttgaataactgatcacagtcaccgttgatcctttccccaggaaatagtactttttgtttttattttcttccatgaactagccttttatccatagcagagaggttttctctcaagaagaaacaggatctgaacaggatctgaaccttaattcttcttctggtgggagttcagtccatttccttcttattctggattaatttcccctttgccattgaataaaacagaggactttacaaagggcctacttcatgccaagtaatgtgttaatagttctaagtggtttatgtgcatctcaaaagaccttcgccacaatttcacagactatatgttattagcccattttacaaactagcaaactgagggttagggaagttttgtagttactggagatcatagtagtcatagatagaacagagattcaaatcctggcttgacttcaaagatcaagctatgctgccatagacagcattacgctttctatagtgaaagacttgtcacaaacaattctgtgatctgtcacttattcaatacacatatttattaagcacatactatgtgccatgctctataattaattaggtcctaggaatataatgatgtacaagatggatggaacttttcaaaacatattttcttagattgtctcatgaaaatttgtttttaatactttgtccttcgatggaattgctcatgaaagcatatgtcattaaacccagaaattgcattcccctcctcaatttcttgccatcctcctttgacttactattaatatcagtttaacaaatttgtttcctattttccttaaaggagtctgttgcttttatttttaaaatatatttagtttttgggccaggcatggtcgcccacgcctgtaatttcagcactttgggaggccaagtgggtggatcacaagatcaggagatcaagaccatcctggctaacatgatgaaacctcgtgtctactaaaattataaaaaattagccgggtatggtggcacatgcctgtagtcccagctactcaggaggctgaggcaggagaatcgcttgcacctgggaggcagaggtttcagtgagccaagacagtgccactgtactccagcatgggcaacagagcaagactccatctcaaatacatatatatatacacacacacacatatatatatacacacatatatatacatatatacacatatatatacatatatacatacagatacatatatacatatacatacatgtgtatatgtgtgtatatgtgtatatgtatatatgtatatatacgtgtatatatacacgtatatatacacatatatacatgtatatgtacatacatacgtatatatacgtatatatatattcgtgtatatatacgtatatatgtatatattcgtgtatatatatatttagtttttgaatgagtacattaacatagctcaaaatttacaagaaataaaaatgtgtacagtaaaaattaatctcctttccaccccatgacccctagccactcagatctccccagaagcaaccgcttataaatatacattgtcttcccccgtcctttctttgctcatgaacacaaatggttggtttctacctacaaagtgttctctacttttatttttctcagttgatttatcttggagatcatgccaaatcagtaaatatagttacctcgttcattttaacagccgcatatgtaaataattctaaaatgcaccatactgtatttaactaagcccttgttgacgaacacataacatggcccagtatttttctattacaaacaattctacaatgactactcttgtgtgtctatcgttttacacaggagcaagtatatctacaagataatttcctataaagggaaatgctgggtaaagagaaaatggtatgttcatctgtaatttaaaaatgttttcattatggaatttttcaagcattacaaaaggagacagactagtaagatgaactgctgcatatccatcatcaagcttcagcgattatccacaatccatggctgatagtatttcgtatatatataggccctatccatttccccaccccaaattattttgaaacaactccaggcataatgttatttcactaggaaatattttggcactgttcttgaaaagcaaggacttaagaaaagaaaaatatatgtgtgtgtgtaatcacattatcacccctaacataaattgttcattaatactagaaaatatcctgtcagtgtcatattttccaaggttgtctcataaaaattgattttctactagtttattctttgattagaatccaataagatccaaaaaaaaaaaaaaaaaagaatccaataagatccatacatggcagttggctaagtctttttttaatctcttggttctgtctccatctctcttgtttttctttgtgcatcgttgttgtagaaactgggtatgtttgtttccagagtccggattttactgaccctatcgaatgaccacagggtcatttaaaatgttctgctacccattaggtcaaaaattaaacacaaaattaaattgcagaatttcttaataataaaacacaacatagctgaacctatgtgacacagctaaagcagttattagaagaaaaataacagaactaaataactctatcagtaaaaaagcaaagctaaatggattacacccgtaagtcagaaagctaaaaaaaaaaaaaaaattaaaatataagacaaaaggaatcagaaagaagataaatgcagaattaatgtttcatcattttagggcttgtttttacaaactgaagcttaagactcaccatttgagaactaggagaccatttcctaatttgtaacgatatcaacaacacatctaggtagctgtcaggggctgggagccttttctacacaaactttgctctgaatttcaaaatactagcctgtcttgacacttagtggaaattcaggtagggtggccttaactcaggttcttcaggaaagcgtcctgtttcagggacacagtggggtggggtcgggggagggctgtattccgcacatctagttctggctgggcttatggcaagtctcagtcctctggagtcacctgagtgactgagggatgagaggcatttctgatcccgtaatatacttacatggctttgccatctaccacatcccagttcaaatctcagctggcacagttaccgttcacgtggcctggagcaaatctgagctgaactttcctcaccgtaaatctggtaaaaatctttaccttaaaggagtgtggatcaaatgagataccaggtagagctagtgctcaccgagtggaagctaaggtgatgaagcccctttattctcaagttctgtgattccatgatggagacccatgaggcctaccagacggagagtatcaattaaaagaaagcaatcacggagttcttcccgccttctctggaggatgtattcctatgagctgccccgaatgttaaaaataatacacctgcccccaaagtgccgaggacgcctttgtggtccacctactcatcgtccaccggtttctgcaagtggaccggttacctgctcaggagcaaatgtttccatcacgacgcaccctctcccagggatgggctcaacctgtgctctccctgcgacaatgctgaacagtgccatctgtccctacccagcgtcagcgtcacgcagagggcccgggcttggaatgtgggaggcacgctcccagctcactttggttttcccgccctggaggggaatccaagatgtctaactagtcttctggccccgagagggagaggtggggataggaccttcctttagtcccctccgtagtggaacgaaggattctttatggtcatctgtggtgttcatttcgtaaagaagcatctgcagggtaagaaggaaaaacgtccaccttgcaaatatatcccaggcacatgcctcctgagaagtgaccccctcctccctccgcctcccccggcacgtcctggggcttctccagtctcccgctcctgggaccaggcagagatcccggcgtgggcagacccctgccaccgcgcccaggcctcgtccgaaactcgcgcccgagagcccacgccggaggcgacgctcccgataactactgtgctcccaagacccggagggcacgaagaaaggagccctggcaaacaaagggtacgggccgggaccgccgcagcccggggcgggggcacggcaaccgcgaggcctgggggcgcccgccccccgcgccccacgcccggtgccagcgagccgaggcgtgcatctccttatatggtcaaatgacacggcggggtttctcgagggcgggagctgcgcagcgctccactcggccggcagcggagccgcagccaccagccgcccgcgccctccagccccgtccgggagtccccggcccgctgcggtgccgtgagtacctccaaccccctgcgccccggagggaggccgaggggcttagccaccagggctcggaagtgggggccgaatccggtgcgagacccaaggagaggggagcagagccggagttggggagactggtgagaggagagcagagctgtgggtccgggaagaccactgggagaggggacccgaaccgtgcggggagaagccgggagaaaggagttgagctgtggggtagacccgggagaggagagccgaaccctgggggttgggggtggggagaccacggggagaggggagcggagcaatgggaggggtctagaccctgggggcgctggagctcagaggagcccaccgactcatccccagagggaggactgcagcccgcgtcctcaccaggtggggcaccgccatgcgggcagggaccgggcgagcctgggtaaaggctggccgcgggtcccagccggcggctgcggggaggtgacgctgtccgcctgcttccaggcccgactcccgagcgggctgtcctggcacggtggtctgcgcgggggagtccgggccatttccctttagtagaaataagtggagtttgcagtgtgacctcgctccttgactcaggtagacatttaataactgaaccattcggttaaaacaaaaatggcttattttaaatgaaaagattctaagtttttcttaagtcgcactcgtgtgatatcttagcataccagaaatagagggaagaaaatattgagtgtttttctgattttaaatgaatcagtcatatttattttcatatcctcagtcgggttttaactggaagtaggctaatccggttagctgaaatgtgtagctggcttgcaagcagcagtgtacttagacatcactgaacttaaggcccgcactcccttccacatattttggaaggtaataaatcacaatttgggtttagaatcaggagaactgtcttcaaaacacaactcccaatacatctcacatttttggtgctgactctactaatgagtgttttataataatatattaaagaaaagaggttttgcactatcctgaagatgttttagacaaaaaaaaacaaaaaacaaaaaaacaaaaaccatttgcatcaagtcttagaagtacaggaattcctagtctatcaattaaactttaataaaaccaaactcaaagaacatttcattgtgcatttatataaaattttgtcaagtgttactggatttagatcaccccccagtttagaagatcatcagttaatacacagaattgtgtttccacggtgtttattagcctgccatggtttaaaatgcgtttacaccataacatgtcgatgaaggctaatgatgggcttactacagaccagaaactgttctgggcacataggttctgtctcattttagctcaccgtctcacaaatagccacaggcagatgcagtaggctaggggatgccggggactgcatgtaggctgcctaaatttacatccgggtccctcaacctgtgcagcctgggccaagtcacttaatctcgtagtgtctcggttttctccactgggaaacagggacaatgatgttgtctttttgttagggttgttaagaagcctggacatcatagacagtgtatacatatttgatagcctcatttttacaggtaaagacactgaaaacagagatcaaagtaactttaactcagggtttcccgggctgtaaatggtagccctgagatctgaccccaggcagcttaactggagaacctgagttctaaccactaaacgcaccacgggaggaacatttgaatatttatttattttttttaacatttgaatatttctatgaggccttatgatgcatactttgacccaagattgcgtgttaaaccatttccagtactgaaagatatttaaattgcagtcaaaaacgcccaatagaatattgccaaaaaaaaaaaaaaaaaaaaacagactagatatcaggagtagtttactcctgtcctgtgccgagggccagttactcagcctcagtgactcaggcagcctcctttgtcagcaccgggcctgagtcgctaagcggctctctgactcagatgccctgaggtacaaagttccttgagcttgggtgaatggaaacattagacattgggttcttctgtgcggttttattatgagaatttgatcaaagccacatttattaagtgtccatctcaagttgcattatactgagttcgcttcctcaagatgaccatctgaaacaaaacacgtgtgctttctctagtggctgagaactgtgtcttcctggagactaggctggcattttgactttggggtgagtcaagtgaatttcctctgttatcctaaattgtggatttcagttttagctactgtgatggttactttcatgtgtcaacttgactgggccatgcggtgcccaaacattcagtcatatgttctgggtgtgtctgggagggtgtttttggatgagattgacatatgaatgggtagactgagtaaagcaggctgctctccataatgtgagtgggccttgtccaaacagttgaaggcctgaatagaacaaaaaaactgagtaagagggaagcccccctgccggactgcttgagctgggacattggtcctttccgcctttggactcacactgaaacatcggctcttcttgggtctatagagtctcctcttttcagactgcaatttgcaccatcggctctcctgggtctccagcctactgactgcaggtcttgggactttttcaccttcgtaattgtgtgagctaaatcattgcgataaatctctctatgtacatctcttgttggttctatttttctagaaaaccctgactattacagctctctggtaacatctatttaaaaagtctccccaccaactgtcattctccctttttttaagatttgatcactactttgctcctgggagtcttggctttcctcttgctgtaaaacatgctctctgcatggggatgtcacgaggggtctggagcagcgtctggtctcccaggtccatcccagtgctcgtgggtggtgtcttgcctggtgtgaacttagacttcacactcatcctcagccttcggtggcccacgcctttactagcctgattctgtctgcggcttcaagatcctcccgtcatatggtcttgagtgagatgtgggatgtctgtggcagaagcagctgccctgttttcatgggtgaacagaattaatgccagaatgtccttgcagtatgtaaatatggagcttgtcagtcaacaaggaaatagacctgtctgcttgggttaatacaacttttggagtcactaagaagcaggcagtcaatgaaggaagcagaaggaactgtgcaagcctctcgggacagagtcctgttgcagtgcgccagagaaaccccacagagtggcaggactgcagtgagaaggaggtggccagtcattcatggaagctgctggatgccaagagaaaggccagcatgggggtgggggtcataggcacctcagatagctgggagagtgaacagtgagccgcacttgggaggtgagaggagacccctgccatgaagaagagtgggtggttttcgttttgtaggtgtagaagtgttcgtaactcactcagggaaggcatggtagagccatagcatgcaggatggagtctcccttggtccccacactggtgtgattgacggacccgaggccacccgccattctagcgtgtgcagctatggttgtcctgcatggctgcaattgatgtgttttgagattaaatgacaagatgggatcttaaaggtgatttaaattatttggagctagaactagactggaactccttcatagactgtgtgttttatctcagcttcccagtgcctcacgtagcacatggaaaacagtggttactcaacacattcttgtcggctgggttcaaaaggctgaacgacatcaaaacaagtgtaactcctcttgtagtcatggacttcagatcagaaatttgatatttattgttttccctttatttttagtattcaatattcaaaagataattcagaagacagcagtttaccttattcaaacattgcctcatgcagaaccaccagagatgaagatgtttatttattttttttaagttggaagttaccagtttatgtaaactataatacacctctgacacctgtctgtacatgcatttagtaaaggcttattaaattaatctgtaaatatattatacagtggtaagcatagtcaattttataccttacaaactaagattgtttaaaatccaacaatttaaaaatagatttcaagtggatgctagatactttttttctttctttcttttttctctttctttctttctttccttcttttcttttttttttcccagggtctcattctgttgctcaggctggagtgcagtagcttttcacaggtgccatcatagctcactaaagcctcaaacccctgggctcaagcagtcctcctgcctcagtctcccaggtagctaggactgtaggcacacatcaccatatccaactgatataaatttttttttttttttagagaccgggtcttacactgtggtccaggctggagtatagtggcagcactacagctcactgcagcctcgaactcttgggctcaagagatcctctctctttagggactccaaggcttgatccattattctagtttataaaacagcaactttccttgacatgatggccctctccgttttatcagaatttctgtttaaaacaacccgtttagctagacaaatgaagagtgttgggggtgagcggtttttgtgtgtagatactcccatccgtaggaaaataaaatggtgcggggtattctctgagcacatttccaggtgtgagagtcccgtgcctttgaatggaggatctttgattataggcatcacatgtctgtagaacatcagggccttctgctgacacctggagcccgtgttggggatctgtgcgttcttcccaaagtgggcacgactcccagctggctttttgcttcttgacctggccaggctgcatcctggactgtgcagctgtgtgttcacatgggattggagtccaaacacaataagaagagttatatccgctgcggaagcagcagcttatctggaaggagggacgagggcagcgatggaagctcatgatgtcatatgccaaaccacattacatgttgggtttgctatgcagagtggattgttcacataatatgtttctaatttttcatgcttgatttttgcctgtatgtttgtactctgacatgtttgtattcatccacccgtcaattcatttgttcatccattccacaagtattcacaaagcccctggtcctgtgtgtgttccctgctggtgaggtctcagcgacaggtagtgggcacccttcccaatgcttacggttggtagaagacggggcaattgcatgaaaacactgcacttttataatgtattttttaaaagagcccacatagaccagttttcctaattgtctctggaaagctctggttgattattgataagtaattgaatatcccttgcggatccccggtgacatctaaagatacagggactgacttaccgaagctgcttttgcatgtgttgaagggctgcatgcaggaagggcttggggacgttcacagatttctccttaggaaatggctatgttagaggagcctcctgcagcagggttgatagggagaagcacttggggtttcaaagggggaggagaaaatgggcccattggggtcagatcaaagtaggtagtcaataaaaggtgcattgaaaaggatgcttaaatagacttcttttgctaatctgacctcttcaggctttacctgtagggatctgccaggctcctggaactccaaggcctgagccagcaagccaagggaggctgtctgtcatggcagcccctcctttgatcgaaatctttctggttaaaaaaaaaaaaaaaattagctgggtgcggtgatgcacgcctgtaataccagctacttgggaggctgagacaggagaattgcttgaacctaggatgtggaggctgaagtgagccaagatagggccagtgcactccagcctgggtgatagagtgacactgtctcaagaaaaaaaaaaaaaaaaaaaaaaaagcttcctggcatgcagggtccttgcctctcttctgcctcatttcatttaccctcctccttcctttttttgtcctgtcaccacccttctccccttctctttactctttctgtttccttttccctttattttcctccagctttgatactttccccactcatactttgttttacagtttttgaatctgaaaatttaaaaatagatcacactgatgagcttgtgaacttttaaaattagtatgaattgtgagtagtagagtgcattgttgctccctggccctctgaacctttattcttacatcctttttatttctttttcttttttttctttggagacatggtctgtgtcaccatgaggctgtttccttgaggctggagagcagtgatgctatcatggctcactgcagcctcgacctcctgggctcaagatcctcccacctcagcctcctgagtagtagggactacaaatgcatgccaccacacccggcaaattttttgtgttttttgtagagatggggtttctccatgttgcccaggctggtcttgaactacagggctcaaacgatatgtctgcctcggtctcccaaagtactgggactacaggcatgagcctctgtacccgacctattcttacatctgagtcaaagctgggctagcgagagactcagagatcaaagccttccctgggccatccccagacctccgagctgcacctggcacctgcctcacccattgcagttcccttggcctggagtcaagcctgtaccctaagatccagctttttcaaataccctattcagggccgaaggggtaatgacatcatggaatgatttagcttggtgaggaataagaactccaggaaactgtgatttggaatttgattcagtgaaataaaaaggaggggttgcgccttatgtttgggcatctccctgcaggctgttgcctgatgctttcagcattcctgtgtaccagctaaggagcaggaattattgataacctgtcaggagggatgtggagttcacagagagtaaatggattgtacacaattaggttaataagtccttgtagaaccaagatgtcctacttttatttgaagaaatcattcagaaatgggctctgataccctgatacattttttaggagtcattgccccctgtcttgcatagtaaaggcaggcttccatgcagtaaactttcactgggctgtccgtttctccactgcctgcgaggcatacccaagtccatgaacaaggcatccaggccctcattgccttggctgttgactgggtcttccatcttcctgggctctctgcctaccctactctgtctctcatgtctctggctttgcctactccaccccttgacctgacctgccatatcacctggctgacctgttcctagcacagatagcatctcctctgggatgcctgcctgctctctcaggggctcctcctctgcgtgcccatcatacctgtgcacctccagcacgcactgagtaaggggcttggtagtctgtttggtatatatctcttttcctcactagataacaagtcccttgaggggaggggcctgcattttattcatctttgtatcttctgcacttttcatgactttagacacatagttccagctcaaccaatgtttattcagtgaatgaatgagcaatcaggtatttatgggatgtaaaaaatgcaagtggctcatgactgtaatcctagcactttaggaggccaaggcaggcggatcacctgaggtcaggagtttgagaccagtctggccaacatggtgaaactccgtctctactaaaaaaaaaaaaatacacatacacacacacacatacacacacacacaaattagctgagtgtggtggcgtgtgcccgtaatcccagcaacccaggaggctgaggcaggagaatcactgaaacccgggaggtggaggctgcagtgagctgagatcatgccactgcactccagcctgggtgacacagcaagactctgtctcaaaaaaaaaaaaaaaatgcaagttataggagatttctaatacaggacaataggtatacttttaaacatgttgtaatagaagggaagctctgagcttgcttattagctcatggactttttattctgatgctcagggcttgtgcagtatgtaactgtgtggaactccttcaggggcctgctttcacacagtgcatcctgctgtgctcctaggtagcagcagttgctcattttatgctctgccctgttggttggagtagaaatgctctctgctctttgtagaactctagtgtcctcttagaagatgaggaacaaggtagaagagggatccaccactctcagaaagaattctgtagaattaggagctgaaccacagggccaagtgcctcctcccaggtggacccactgagcagatagcagctgctactgttcctgctgggagctggtatcactgataatgatattcatcatatcactgatgatgacattcaccatgatgacattcataacctcagtcgtactttgagcaaatgtggagccctacttattttcagagtttattctcttagatttatttttttatttttttagacggagtctcgctttgtcgcccaggctggagtgcagtggcacgatctcagctcactgcaagctctacctcttggttcacgccattctcctgccccagcctcccaagtagctgggactacaggtgcccgccaccacacccggataattttttttttgtatttttagtagagatggggtttcaccgtgttagccaggatggtctcaatctcctgacctcgtgtttcacccgcctcagcctcccaaagtgctgggattacaggcgtgagccaccgcacctggccagattttttttgtttttgtttttttctgtcctggtcctgtagaatcagaggaagtggaaaacacatatcaggtatatgagcaccgtgatcacgattattacctcagaggaaaacaggtgtacccctttcaccagctgccaacataaatggagctctgcagacattaacagaggctgtagactgtctcccttccctagcagggctggtgcttgtcctgacccacacagacggcctttcaagttagactgggagttcattttctgtaagtcagacggctatttgagaaagctcagtggaccctctttttcataaatatgcgtgggcttcagtttttccatccatagaatgaggaagttgtcatagataatctggggatttgtttccagcttttacaattccgcaatttatagttctctgtcctttcatcgttcttatttcaaattcccaaattattattcttatgtttgtgggcatggaatgggcagtgagcctcttgtcccacagctaaatcacaccctttattggaaaaacatatatgttggaaaaacagctctcaattgtgatgaaataaatgacagcaactttcaaggccaataactgaacaattacaggaaagcattgaatcttgtgccagcatggctgctccaactcgagatggctgcggtacaaaggatatttatacgttgggcttcagaataataattcaagtgctcaagagcctcatcttgtgatgttatcacaagaatgtccagacaatgttttctttaactccaggaagagtgatttagaaggacggatcttgccgcatgtgtccagctgcatatttattgctcttggaagagaattattctgtaaacacagaaatatccaagaatgaattcttgaaagatgatcttttccttgcttacagttgtcaggatcgtgtatacgcaatagtacaaaattactgtaatcacaaaccaggcggcaatattttatttgcatcagaaggtctgattctggcatttcactcgcctatcttttgaagactgcaaattgaaccaagttttcttagatcctgtgaactcttgctcagagttacatagccaaccagtgtacctattttttttttttgagacggagtctcgctctgttgcccaggctggggtgcagtggtatcatctcagctcactgcaacctccacttcctgggttcaaatgattctcctgccttagcgtcctgagtagctgggattacaggcatgtgccagtaagcccggctaattttttttttttttttgtatttttagtagagacagggtttcaccatgttggccagactggtctcaagctcccaacctcaggtgatccacctgtctcggcctcccaaagtgctgggattacaggcgtgagtgactgcacccagcccagtgtacctatttaagaacagagaaaactttccacttttagcaaatggaatattgccatttattcctgaagaaaattgtctgtgtttttaatgccctatggccgtttctccacaccagctattcctgtggtaggctttttctctccaggatcattctaacatgattttataggaatggtcataagaggagggcccatcacttgctgcttattcacactgcgtattcatcctagaaaaatgcagtgtgccgggcatggagaccccttattttaaacttttattttaggttcggggtacatgtgcaggtttgttatacaggtaaactcttgtcacaggggtttgttgtacatattatttcatcacccaggtattaagcctagtacccaagtgttatgttttctgctcctctctctcctgccatcctccctccccgctcaagtagaccccagcgtctgttgtttacctctttgtgttcatgtgttccctcatttagccctcacttacaagtgagaacatgcagtatttggctttctgttcctgcattagtttgctaaggataatggcctccagctccatccgtgttcctgcaaaagacatgatctcattcttttttgtggctgcatagtatttcatgatgtatatgtaccacattttctttatccaatctgtcatcgctgggcatttaggttgattccatgttgtcggtattgtgaagagtgctgcaatgaacattcatgtacatgtgtctttatggtagaatgatttgtattcctctgggtgtattcccagtaatgggattgctgggtcaaatggtagttctgtttttagctcttggaggaatcaccatactgctttccacaagggttgaactaatttacactcccacccacagtgtataaatgttcccttttctctgcaacctcgccagtgtcctgttcctgttggaagggcttgaggtgttgcccagagagccactgactgcagccactgcatttctgactatttgatatcattgttttgggaagtgagtctttccatttatcctgctctcagggtacctgggcagctgcaggatgatcttacccgcagggagcaatgattcatcctcagggactttggcagtttttcttgtgcaagggcagcttgcactcccaggtcaagggtattagtgccctcattgcatctaatctcaggtttcccaggtcagatctccctcccttttgccactgtgatttcttcctattcaaatcatgaatcataaagaggagctcacggaaaatctttttatagaaatggacgtattatttctatgcctgcctttctattttggaggcagggagaaggggaagatgcaaggccgggtcacagccggacaggatgggggctctggtgtcagcccttacctgcatttaaaactgagatagctttttctgacacagtaaaaaataatttgtgcttttcaagaagtggaatgtgaccaggcgtgatggctcacgcctgtaatctcagcagtttgggaggctgaggtgggcagatcacccgaggtcaggagtttgagaccagcctagccaacatggtaaaaccctgtctctactaaaaatataaaagttagctgggtgtggtggcaggtgcctgtaatctcagctacttgggaggctgaggcaggagaatcacttgaacctgggaggcggaggttgcagtgagccgagatcgcaccactgcactccagcctgggcaaaagaacaagactctgtctccaaaaaaaaaaaaaaaaaaaaaaaaagtggaatgcattcaaacacaaaaccgccctagctaatgaaaaaaggtgttatcattaaaaattatgaccgattaaagggtgagttttaattattcatccagaggaattagccacctttcggctaaagatgacagacagtgggacagttaatgcctttgcgtgcacccctttcagagagtgcttaatgggacttggattttcttttctttttgataggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggtacctgctgcgggcctctgcgggtccccggcgctcccctaggaaacacgggtttctctgtggtttgtgctgaagccctgatccaccactgaagtctgtctcttgagccccctctgaggggcgtggaccctgcgtgtagcctttcggaagcttcttccctctagcgaatgtgatctctgcccacaagcactgggtgagggccttgccaggacttttgtgcttagtatctctaagtacattttctgtattctagcaattagtgcccttatctaactacccagctgcctaccaatactggaactttcttaagggtggtgctctcttcctcttgtctgtttgccccgtggtgagtaacgtggagcaggtgctgtgctcagtcaatatttgatgaatgaatgtgtacatgagagaaccagagttggttcctggataaatgggcacataaaagcacaaagtccttggaagattgtgagctcttttcctttaatgagagaaggacaggatttgtattgtttcctttcaatggggaaatgtgttcatggctctcctggtatgtcacagcgtggttcagcaaagaccactggtcacttgtaccaactgccccgtggttgagggtggtgaaccctgacctgcgcttctcagcagactcttgttccaacctggattgctgaaggacaccctgggggacccatccatagctctgaactctctgataccttcacccgcaaacggcttctaaaacactccagtgaaacccctcatgtggctgtcatcctgagtgccgtgaaactggctacaaaatgggattcctttggcatctctaaaggaattcccaactgaatgggcaccaagtcagttcatggcattttactatctcttttctgctctcgttgctttgtgctctgtagggatttttgctgctctcctccctggtcgttaatatcagcacattgccgctgactgattgacttaggccatgcatgcagttggatcattctagcacatccaacatgtgttccttctatttccttctctgatcacatcattcttaggaaagacaggaatcagaaggctgcaccatcactttctgttcccagggatttagtgacagttgagggatggtttccatcttgtagcgaaagagacctctgccttgagcagagacgaaagaggtacagcaccagccccctaaaccaatgctgcagccctgtgtcttttggcttcagggcagatgctgtgctgaatgtaaaagaaacgaaactcaacagtggtattgtgccaaacctttgaaataccataagcaaaaatagctgatctggctactctaaaagttgtgtatcttcctgtatcctgtcttgcctgctgcgtgtctcactgcacctgacgacttttctctgtcccttttcatgtatttaacaggacaagcatgagagctcagccaccagactgcccagttccagcccaggctctgtgtctcacttgctgtgtggccttgggtcagttacttgacccttccgtgcacatctccacatctataaaatggggagaaccaggccaggggcataggctcaaagcctataatcccagcactttgggaggccaaggcgggtgaatcaattgaggccgggagttcgagaccagcctggccaacatggcgaaaccctgtgtctactgaaaatacaaaaattagctgggcgtggtggtgcatatctgtaatcccagctacttgagaggctgaggcacgagaatcacttgaacctgggaggcagaagttacagtgagccgagatcatgccactgcactccagcctgggacacagagtaagactctgtctcaaaaaagacccaaaaaaaactggggagaaccaggggtctgcttcatagggtctttctagtatgtagatacaagcccttgcactcgcactcgtactcttctagcagctgacagggtaagctccagactgccacctttctgctgactacttccttattcttttcgtgacacgtcccttccacacacctttcagaagcttcaccctctctctttgtcgcttttcattttggaaacatcaataaaaatgtccagtttgaggaagaagtagatagcccgagaaaaatataattataaaagctttagctggaaaagaaatacttacgtaggtgagaggttcagatatcatctggcaaaaggtaagtctcactttcaaggacagattttggatatttggggctaatcatccctgaccagtggctgaaataaaaacaaaacaaaaatcacttgctgtttctccagtgatttagtggaaagacccttaaaagccgtcatccttccacgcatgttttatgagcaaataaacaagagtctcccaaatggagccaaaatcatcaaggctgctgtcaagccaggagtgaattgtgctgaacttttcaacccggattaatgttttgagatacgtggggttacactgtatgattttgtacattttggaacaaaaagagacattgagttgaagcgagaccttggcatttggggcttttgatgctttaggcgtgcttttcttgactttcaaaaataatcgggtagttgggtttgtagtggaagcaatgatagaaaaaaatgttcctgtttttttctggaagtaaagcccacaatcctggcaggcggggagatacctgatagaggaactgtgctcttaggtctggtggccaatctcttctcttaaaatagcacagccaccacaggcctcagctacttccctctaaaggacatgttcatgtgtgtgagttttaaatgttggcatgcctatgggaattaggctaattttgagagtcctgacctacttaaatgagacaggcaagacttcagagcctgttatatagtttgaacatcctctctatgtagccactgaattgtaatctttatttctattaagttactctgggaaaatgctgtgatctcaaagggtaaagattattgatttgtatggccagtgtaatagtggagaatagacaatgctaatacaattttatgatcctctgacattacatgcttcctgaaccttttcttggatacctgttagcattaacaaaatattttcgtagactgattacagagtttttgggggatctgcctacgttctgggcttcaaaaattcaaccaactaaagaaaaaatagggctgggcacagtggcccacgcctgtaattccagcactttgggaggccgaggcaggtggaacacttgaggccaggagctggagaccagcctggccaacatggcgaaaccccgtctctactaaaaatacaaaaataagctgggtgtggtggcgtgcacctgtaatcccagctacttgggaggctgaggcaggagaatcatttgaacctggaaggtagaggttgcagtgagccaagattgcgccactgtactccagcctgggtgacagagcaagactccatcttaaaaaaataaaaataaaaaataggctggccaataactccagagacagctgctaatactgtgcatttaacaaattggtgattttaagccctgggcgacacacgtaacctagactttgaatgttccatgggtctgcaagcaatgccatgaaattggactggccaccatacccacccatgtgcttggagggtgctacaaagagaaaaaaaaaataataaacaagaacaaaagatctgcagatcagaaactagcattcagggtttagtttctagtggtagtctttgaaaccactgtgtattgcctgatgacttgttccaggcacttgtaaatgcctaaactgcatgatctaaatttctcctaacaccctataggtaggaacttttttcattccattttatggagtagccgctgaggcctagagaggatgaggatcttgccaagggttaaagggattaggaagtatccgaggtacaatttgagcccagacccggagggtcctcacctagcatgtgatgccacctgctacctgcagcctcgggcaggaccctgtctatgtgactctcgggccagatgtggtcagtccttatgagtaagagatggtgaccacctggcctcaatcaagtgaccttcagtcagaggcccctactcttctcatgggcccctttagatggtgatgattacattgcagaattgaggctcaagttgtttcacaaactctctttccagcttttgtagctaataggaaacattgaagtgatgatcaaattggctgtaaaagtctcagttaatgtttggtaatggacagaaatgttcagtgatattttggcagaaagcaacctggcagggctctgaaataggagacgaaggttttcacacatacaggttaaatctagatgcccctagtatattttggaaggtttctgaccaagcctagtgaaaggtgtaaggtcaggtttgaaaaacccacccttctgtcctcggtgtaacacaggcctccctcgctggtctttctggacccttttctgggaagagcacctactccagtcacattctcagggtccagcctgccaacctggtgcttttttatttgttggggtggtttttaagttctcaatgagcaaattaccttcttggatcttcttccgtgtagaatttgtccacagagtttgtaacgagcactgaaaacgcgtatttatttggatttcctcctaaaagacaaaaatctgtctgtgaagggaatttaatcaagcagggtcctaggatcagaagcaaagctgtctggatggatttcatgagaagggcctgtcagtgcacgaacttggcctgtcagtgcataaaaccaaaagttcagccacaagacatagcagcagaggtgcacagcgctcagcagtgacctcgcatgcaccgaggctggaccccggaaccaaatctccctggctccacctttgacaagctgcgcgaaggggacaagtcctgccacctataagcctccgtttccatgtctatacactggggttcctagctcacgggactgtcggggtaattgagtgagttaacgtctagggagcacctgtgacatgccaacacagtgctgtcatttctgctgttgtccatttttctgcatctttatttgtaaggatttgaaagaatgtacagttggaaacctgatgatctcaagcagaaaatatcttttcataacgctgagcatgaatgacatgagaatccatgtctgaagtgaaatcgtatggatctgaagaatggttggtgccagccctggtggaatggggtgcgaaggagggaggatgagagccagacgtttcagtctgggtgaccctgccacccagagccaccttccattaactgaggggtccagggctccctccaggccacttgccactaaagctcagctaaagtctcaaaaaggacacattcggagccaagcaacaggcacagcccatgttaggaatgtttctgcaatggaaaaatacaaaaccagaaaggaagtgtgtgggcctaatcgtacatgtttatcaacattttactgcaatgtatgacatttctgtgagcacaagattagccttggtatttttttctgggaagtataaaagactttttttttctttctttttgttttcaatttctctctagaggaatttaaaaccggatatttccatcttaaagttcttgagcaagtctgtcaaggtgtccatatttcttaccctgttcctctcagcatcgaagtgctatctctgttacactcatgtttgctgttcacaatggagtactaatgaaatagcaaaattaagctaccggcatggtgctaataactgaaactaaaaatcggtttggagcttttctgtttggaaagagtcacttgagccgggcgtggtggctcatgcctgtaattccagcactttgggaggctgaggcaggaggatcacttaaggccaagagtttgagaccagcctgggcaatatagcaagacccctgtctctaaacagatagatgatagatagacagacagaacagatagatagaagaaaagaaaagggtcacttggcactaggtcttcacaggtaaagattcagagtgtgataggaagcacaggctcaggcacccgggtctaatcaatgacaatctcgcttctaggccttttggtggcattttctagtctacctctaagctctagggaatcgtgtggctaaaatcttccctcctgctgagactcagagaataccatgttggccaagatctctaaaacaatcaaacctggcagtattgagttaccttcctcttatcataaagtctttcctcacttcctccttattgtgaactttcttaagaagcgagtccaggaggaagcagtgacatgaatttattaacttgactcagacttctaaagacaacacaaactgggcgccccattcagagagtgacagggaaaccccgtggcataattagttacctacgagtttccaaataggatttggaaggagacatacaaactaggtcgccggcgtggcacatggcttccctgaagccagcattgccctggccaaggaagctttgcagaacagatgagatttcagctgggacttgcagccaagtgggatttggccttttggggagaagggaaagggcattcaaaggccagggacagagtatggtcaaaggcatggagatgaggaagaggggaccagagcagagggtcaggttggaaagcgagttggggtcaatctgcaaaggggctgacgtgccaggtaaaaaacaggagcacagtttagttttgtcggatcatttcaggtggaagggcagtgggaatgttggagaaaacactttttggtgtcgttacattgaatctgctcatctataagaataaaactttatttcatagagttatcgtatggctcaaaataggtatgaagaattaagaaaaagaattttagatttaaaatgaaaaagcacctacaaaagtagagtggtagagttaccaacgtggagctttaaggtggcagatattctcattgataggactgtcttcataaggaaatgtaggttcagcaagtgacacattgaggcaactcttctcattattagctgtggtctaaataatgacttatactaacatccattgagcaattgtaatacataccagcaactgttatacatgcttgttacagccagtagtgggtccattattcctgctgtacaggtcagaaatctggcaagagaggttcaattacttcccaatggtgatgtacgtggcatagggcagagccaggatttaagtttagtcaatctggcatttgggcccttgaattgaacccctagggtgaaataaccaagcaatttaatcacgtgctcctgggatcccagaggggcgggcgcttgacccacagtgatacaagagatgtggactgtgggacctcatgctctcccatcctgcttgcatgcagcaggcattcaggcatttctggcccaggaagcccaccaccctgtactgcagcagggaggtgggccagttctgttcccactgaggacccaccaacaacaatgatgcaagcttgtttacagagtatttttagttattgtacaccacaaaacttaagaacgtgagcataggttaatatttatcttcagggaaaagagtttcctttagaaggttttagaattaggaactgctgcacgcatattcactcaggaatgcttgtgtgtgcagtcataaaggtaggctgagagaaacgttgcggagctgagtgcagatggccccagggaatgatgccgagataacgcagccctgggcaggcaaaggcactttgtggaaggcactctgtcttttgtttcttaggacaaaacctggatctctgcatgccccaacccgaatgggatggggagcactttcaggtgtccactctacaccagcctgaagggaaagggcagcatctggcaggagccaaggcgaaatggttcccaggggatatagcagaccaggttgtcctgagagaatgcggccttcaccttgcgaggtgggatccgatagagcagggtgtggggggacaggctgcgcctgcagaaggtctccaagtcttgcatggatgcttagtccagtaacatgtggataatatccacatttagagggacagtttcaagtgtcacgtgtcaatgaatcagtcttaaactgtagctattgcatttttgtgccataaatattaactgtaggaaaaatggaattctgcagtgccttggacccatgtgcatgtcttagccagcttttccatgtctgtgcaggcatgctgatgtgctctttcctccatctggggacttaatgaccggagcactggctgtggtgacatctagtggctttgctttcctgttgaccttggagatttctctctcagtttttcttgaaggtcagtcccaaaaggcaaattttctagaaattgtatttctcttccctctcttgtcactgataacttgccacccctctgggcgtaatgcctcctccctgggcagggcagccaccatgtaaaaagcaactatcttcccagagagaggccaaggatctcctcccctctccctggcgcctactccttcaggtctcttgtcccagccagacagtgactcttgggtcatggaaaacattctgcagcttttccccaaacgagcagtcctctatgaggtggctcgcctgcacagggggacagaggtaacttctgaaacggtgttttttacctgctacataacaatcaaaacttacttttttttcttttggagacagtttcactcttgttgcccaggctggagtgcaatggtgcgatcttggctcactgcaacctccaccctccacctcccgggttcaagattctcctgcctcagcctcctgagtagctgggattacaggcatgcaccaccacgcctggctaatttttgtatttttagtagagatggggtttaaccatgttggccaggctggtctcgaactcatgacctcaggtgatccgcctgcctcggcctcccaaagtgctgggattacaggcgtgagccacctcgcctggccaaaacttacttttttattcttttaattatggtaaaatacacagaacatcacacttaccttcttaaccactgttaagagtactgttcagtagtaagtgcattcagatggctgtgcaaccaatccccagagcttttgcttcttgcaaatctgaaatactacccccatcaagcccatttacgcctagtattccattagtggaatgctaagcatgtgggagttatgtatatcttactgctcaagatcatcgccaaggtctgattgcagaaattcaaaaaattgcaacctcaggcatgaatgggttacagaacacattctcactcccattcccctctcatcccagcccctggcaaccactcttctactttctgtctccatgaatgtgacttccctaagtatctcacatgtgtgagatcatgcagtatttgtccttttgtgaccgatttgtcgtttcacttaacgtcatgtcctcaagattcatccatgctgtagcatgagtcagaattcctttcctttctaaggctgaataaaattccattgtatgcacagaccacattttgtttaccccttcacctattgatagacatctggcttgctcccaccttttggctatggtgaataattcttcaatgaacgtggatgtacaaatatatcttcgagaccttacttttaattcttttgggtatatatccaaaagtacaattgctgaatcatatggtaattctacttttaatatcagccatggtgttttccacacaaaatttattcttaatgcatttcttccacaatcagcattctaacagtgataacatgaataaaatctccatctcttcttaaattaggcagattactgttttgggtggatagggcttctaatgatttgttcaattttattcaaagtctaaacaaaggcaatactgagccacattcatttaggtacaaaatatgttctagaaagttgccagagtttggtcgtttctggatttttttaaatgaacacacacacacatctcctcaaggctatctgttttgaaagcaaagagtaacacagacccgaccaggattttgcctgggctggttcagtggaaataactttcgcatcaggaggacttgagctcgaagcttggcttagctccgtgccaggtatgtgactgggcaagttacggaacttctctgaccttcagtaataacatttaccttgcagggctgtgccgtgcctggagctcacagatggggtaatgatggtcatcactagtgtttcagatgtctttttgaagccggggcgtgtgcatggaaagaatggagaccatgcctgttcccgaacgatgatgatgtccatgtggattgtgggctttgctgtttctcatgagttcacatgtgtagacatcaactcaaatcaaagcagtttgtcctctatttcacttgtcaaaataaccaataaagcacaggtgatgttcccctcagatttctgaaaatactttaagctaaaaatacaaaagacaggttagccctctgcccccaactcccagtgcatacccagtttgggttctcaaggatgaagagggcttgggcatttcagcaacctgcccccgagtccccctgacaggcagtgcctaccccaggggacccacaatacccagaggtgctgggctcaggtgagaatgaattccgcagaaacaagggcatttagtccagctttgagagcactctatgctcctctcaccttcattccttttgttttgagactgagtctccttctgtcaccaaggctgtgcaacctccacctcccaggttcaagcgattctcctgcctcagcttcccaagtagctgggactaaaggcatgcaccaccacgcccggctaatgtttgtatttttagtggagatagggtttcgccatgttggccaggcttgtcttgaactcctgacctctccttcattctttatcgtcttgcgtcagcaataatcctattcccagatgttctaggaagcaaacttccaacagggatagcacaagaggtcacccctcacaaaggccatagtcatgactgtcttcaaagtgtctcagcgttcacatttttaaaattccttgaactaaaacaaaatgcgcaaagagatcactaaatcaaataactagtttggttccaggttccgggaaaacacacatacatgcacacatgtgcacacgcacgcgcacacacacacacacacacacacacatacttcagcaaaagagaactgtttgttctagttttggttccgagttagctggtgttttaggactttctaatcaaggccaagatccatgtcttcacatcctacattcagcataactccagcttcgacttcggtttcagtaacagagacatcgtgggcaggctcttcttcagggccatcgcgtgaacagccctcctgtgccctgttcaggatacctaccaactggaagcctgcccaggaaaccgtgcagagcctaatactctgtttctgcctcatgtataaatggatgatgatttggggtcagagctgggaacacaaagacagcaatagaaacatatcctttctaagataaagctgggcataaagagattgttattttaattttgtgttggcactttaaaaatgccgtatgtcatttttaaaaggcaaatatggagggttctcttattcctcaggcaagatgaagccaagtgtggagtcgagttttctgcggggctcctttctctccctcatcttttactcaaaagcacacgtctgtcttctcagggcctctctcatgtgtgctcagtttttgtctcacttctcccaccctcacgcccctccactcccacatccttacccgtcccccagtctgagcacttcactctcctgttgaaaagcagctgtccactgccttcaggatcaatggaatctctacacagacataaaaggcaaaaaggcagccatatcttccagtccagccaggccggggggccctcccacctcgcccctggcctgtggtccctccaatctgacatgccccccgtccccagatcttctgtgtctgtgctctttctctgcctgaaattcccttcctcccccagctcacggccacccacagaggtagcacccacacacacagtctctcctgaccgtctcccaccaaacagtccttgggcctcctgtgaacatcccgacacccagagcctctctgccatgccggtgaccacagtgatctgagttgggcagggctccctcagccaaggatgtcctgcagtctgtttctctgtcaccggatgtggtgtgagacgaattgataggtgttcatgttttctgtttctctttcttgcaggcaatacataagggaaatccctttgttttttagaagcatctctcacacacagacatgtgcatacatgcacatctgtctaacctgttgctctaaaatgcagcaagagaaaagcagcctagtcttaattgatttcagcagttaggtggtcctggggcatgaatgtgggtgcgccagggtgcctcggcccaacttctttccttgtttgccctgcagattcgcaaggggcccctatgctgtgggtccaagccctcctgtcctgcctctgactgtcttgtgtggtctggccccacaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtcaggaggcactcctttctcatgcgtgagccagtctagcttcaagccttgtgcacgttcctctgaccccctgttcacattgacttggttccagacactcgtgttgactttccagtttgaccttgaactgcagaggagtatttagagtacttacgaagcagggacatacaggttctatcatgggcagtaacgggatctttttgctgtgcacgtggggcagtgttatgcagtcaaattgttagagtaagaaaatggtgggtatcccccttaaaaatacatctcctgcatcagcccccactctcccaccaccatagatagtttctcttttcttcccttctacctgctgaatttgtactcattcagttatttcaccaagtgtgcatggtgcccttgcgtgccaggcactgggctcgagctgagcattcgtagggtgtgagccgaggtgcacctggtcctctgcccttgtagagttggtgttctagacggacagtcaaaaagggcacagccgcaactgggccaggtgccgaggatggcaataaaggtgccttgtgtgttgatgggactgtgtccctcatggtttttttgtgtgtgtatgtggggggagttatttgttttgttttgttttttatgtaggagagcagaatcttttattttaaaaagcaaagtggacaaaaatatgtggaatttcaaaatacagaaagaagctgggtgcggtggcttatacctgtaattccagtactttgggaggctgaggtgggtggatcacttgaggtcaggagtttgaaatcggcctggccaatgtggttcagtggtgcaatcttgactcactgcaacctctgcctcccaggttcaagagattcttctgccttagcctcctaagtagctgagactacaggcgtgcaccaccacacctggctaatttttgtatttttagtagagatggggtttcatcatgttggtttgctttgtttttgataataaagaaatactgaagagactgacatatgggaaatagtttagaaatatatgtaggatgccaggtgtggtggctcacccctgtaatcccagcactttgcaaggctaaggagggcggatcacgaggtcaggagtttgagaccagccaggctaacatggtaaaacgctgtctctactaaaaatacaaaaaattagccgggcatagtggcgggcgtctgtagtcccagctactcgggaggctgaggcaggagaatggcctgaacccaggagatggagcttgcagtgagctgagatcacgccactgcactccagcctgggtgacagagtgagactccgtctcaaaaaaaaaagaaagttatgtaggataaggaataatcattttttaaaaaggcaaggaggtaatctgacctttggtaagatggtttcttactgccactacatttctctggttaatataactttaaaacaactgtgacacactatgacagggaagaaaaatgcccaggctgacacagtcccagccctgttggcagctgtaagggaaaacagctggaagggctgcatggtgactttagatggggcagctccaggcaagaaggcctcttctaagatcatgtggatcctgcagaggctggaaactcgggccccagtgctgtgcgacagtgcaaatgagaattgaagcccgtagaaagccaggctgacctgtgtcctgccccacagggagtcactgcagagacacaacactcagtaacaataagaaccacgacattaattgaaaaacaaattaaacccttactagtttcctgaacaagggcccaaggaagcttccactggggactctaggggctgtttaaagactttaactgttagcaccaaccatgacataaaaagtatgcatatttcccggattttgaatttttcacctgtcttgactttctgtgttagtcacgttctccagagaaacagaatcaatcaaggaaatgtatacacatagatacatacataaggagagagagagagagagagagagagagagatttcaagggattggctcatgagattgtggaggcggtaagtctggaatctatagaacagggcagcaggctggaggctcagggaagagatgatactgcagttccaaatgggagcatttgaattccgtagggcggcaggctggaaactcaggcagggtgtgtctattgcagtcttgagaagaattagttgcccttagggaaaccttagtctttgcccctaaggcccactaccgattagatgaagcccggccctgatacgtgggtaacgtgctgcactcgaagcttgctgacttagatgttagtcacatctaaaaaacaccttcacggcaacaagtaaacctgttttttgaccaaacaactgggtaccagagcccagccacgctgacacataaaattaaccatcacaccttccctttctcatggtgtttactggggagggaaagaaaagaaaaacatgatcagataagaagtaaaaacctaatgttcagtgagaggtaacccatactgaatatctgagaattaactggccggcagcctcttctactaaggaatgggggaagcaagaattcaggctctgtggtaagaaatgctgtgtagtaataataacaacacagctacagcttccagcccctgagcacacacacaggcgtcagaccctgctgctttacagaatcccattgaatcttcggtgttccctgggttggatggcttcatccccattttacaggtgcctctgccagaagaaacggactgggcaccaaaggcagggcgtctagaagaatcccggtgtatgcaaaacaaaccagcaccgacaaaacactgaatcaaagcacttgcttgcctgggtttgatttttaaaagtgttagaacccattcaagatgaatatgggtttacagcgtcagtgcacagcttttgcggtgaatttacatttagaggacaagtgaaaaactcacccaccagctccacaccccccacacaagtcagtttcctgatgaccaatcaggaaactggaataccatcagtaaccccagtgctggggtttaccggctctcgcgcccctattagcagacgttgcttacagatgcaccacagcctctgagcagactcaagtagcgattctgtctccaaccctgcaaccaaatttctggctcctcatttgactttttttttttttgagccaggatctcgctctttcgctcaggcgggagagtagtggtacgatcactgctcactgcagccttgacctctcgggctcaaatgatcctcccacctcagcctcctacgtgtctaggacctcaggcacacaccaccacacccgcctaattttttttttgggggggtagagacagggactctctatgttgcccaggctggtcgccaactcctgggctcaagagatctcccgccttagcctcccaaagtgctgggattacaaggctgaggcaccgcagccagcctcatttgactatttgaatcagattaagacatcccttcttcaagactgcgcttccgcctgcgggagacttggttcagagtgtgcgattcagttaggagaaggaacgctcctgccacctgccggtattgctgcatatgaccatgcaggcttgcggccactgctgtcgccatgcctgaggtgcacgcgccatgtccctgaggctccaggtgccctgtgcattccctgcacgtagagttgccctcgaactggtgttgatctgatcagacttatttcagaactcgacaagaatgccatgagagtcataattgccccatattcattggcaaaatcctttggcttctgggctgcttgatcagaatgaatgtcagagatccaaagagcaagtgacaaaagtatgcatggaggttgaagaaaatctttgtgaattcaaagtccttccactatttttacttgaatttcaattgcttcatgtaatgtttgttttaggattcatcaccccacaattgaattccatagattgtacagcttagttttgaattaaaagatcgctgcgtgtcaccatcccaaattccctctcacacattgccccccaacacacaccctgcttattttatataatctcaaatgtctggtcttggaagtacaggaagctgagaaaatgatcctaaataacaatcgtgataattctcagcacattcctaattactggaggacagacatttcatgaccaactttctagccagctaaaatacaacccctagctttgtccttgggaccataagattttggggctgagagctatggactagtctatagactcctataagccacctgtgttactgcagctgcttccacctggtctggagcggggcagtccctctgtcggcttgattccccatcattccctgacccccagttgaagtcacatgtatgtgaccctcatgccacagtccccagggattggcaacatttttccttcaaaaatcagataaatatttggggctttgtggaccatacagtctctgtcacaactactcaactattacaactacacaacaactgcacaactgcacacagctgcacactactcggccgtctagcttaaaagcggatgtaaacaatggaagtaaattaatgggcgtggctgtgttccaataaaacttcatttgaaaagcaggcagcagtctggatttggtcttacacagtggccaggcccctcagctagtccgggcacttacaacactttcctctttctttgtccctgatacttatttccccagattgttctttacctttgctttatatgaagggtacttgtttatacgcctatctggaatcatccgttactataaatagatacacttctttctggcaaacaaaaatgaaaaaatgtcagtcaacagacaccgagcacttgcagtgagtccagcttggtggtggcaggggtgacccataagtgtttcagttctctagagctcctcagttcacttggagaaatggtagaaatgtatcaaatgctaatagttattcaaaagacaatggatggcgtaggtttaggcaattactaaatgggatgtacaagtaacacatgaagatttcagccaggcatggtggtgtgcacctgtagttccagctactcaggttgaggcaggagtttccctggagcccagatgttcaaggctgcagtgagccaggatcgcaccactgcactccagcctgggtgacagagtgagaccctgtctcgaaaacaaaaaaaaactacatgtaggttttaattatagcacttagtacagtgcataaaactacctagatacatcacaacttggttcaacaggcagtatgtaaagtgagtgttgtagaggctgctcactgaatcaggttcgaggttccaggttcattcacactctagccatttccatcctgctgtgaaccagacggggtgttcattatcaggtgtgcaataggtgaatacagtccctagactccaaaagtcatgctccatgggaattcatcggagctatgccacacttctctttatactttgcattgctgagagagacttaactttttttagatttaacattcctaaccacggtattcaataaataaatgttaagtgcctaaaatgtacacgtgttgttctaggagctgggtgtacagtagtgaaccaaaagacaaagtccacgccctgcacaaaataggaattacctccatgtagaggcgagccttcaagagctgaagtggcttgctctggtcataaaactagagggcagcaagctctgaaggcagattgctgggactccacacccctctaaccataactctgctgtgttcctcttgaccctgatgacaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaaggtatctcagatgcccccttggcccttgcacgttctggctggtttgcctccatggtccatgtctgtcagttctctttccaaaaccaaggatacctgtgatacttaagtggcgtgggagctgtgcctgtcctgccttacattctgagcatttatccatcgggtctgggtgtccatccttctttcaaagacatcaacattgttgagctctgtgatcaaatcgtttaaccctgccttcttctagaccatttctaaatatgttcttatgttgataacctgaggttagagggaaggggagccaccatcccaaagctgtcttgttcagcttctctccatgaataaaacaagaaaacaactgcaaacttgagagggagagaaagatggaaggaagagggaggagaggaagggaggagagagagacggatgtgagaagaaaagtaaaggagaaaagtctgcctccatggatatgggacagatcatttattaaatgtatctactctggccgggcatggaggctcatgcctgtaatcccagcactgtgggaggccaaggctggtggatcacctgtgggaggccaaggctggtggattaccttaggtcaggagttcaagaccagcctgggcaacatgatgaaactccatctctactaaaaatacacaacttagctgggtgtggtggcacacgcctgtagtcccagctactcaggagactgaggcaggagaatcacttgaacccgggaggtggaggttgcagtgagccaagatcccaccactgcactccagcctgggcgactgagcgagactccatctcaaaaaattaaaaaaataaataaataaacttatctactcgataatgtgctattccagtcatggctctgttagggttaaagaaagaaagggaactgcatatctgtaggaagccatctctctgcccagttgccccccgacctgcacccttcagggtgtagcttagttttctgctgtgccctctgactcttagacacacgcaattcttattatgctatagcttccagcgtctctgtcctgttaggatttgcatcagcctgttgagtggcaccctcccactgctcactcgccctgggcagcgccagctgtggaactcatcacaggttctgttcgctctcctcctgttattgactctgctcacccagcttctgctgttttgcccttggggcctctacccttgcgtctgggccatggagaaacatccccaatgctgctacctgtacctggctggcctgggcaagaatatccccaccttgcccacaccttttctaagtgctgagtattcttaccaatttccattcagtctttctctcatttcctttttttttttctttttttgagacagaatctcacactgtcgcccaggctggagtgcagtggctcgatcttggctcactgcaacctccgcctcttgggttcgagcaatttctcctgcctcagcctcccaagtagctgagattacaggcgtgcgtcaccatgcccagccggttttttttgtatttttagtacagacggggtttcaacatgttggccaggctgatctcggaactcctgacctcaggtgatcgacctgcctccacctcccaaagtgctgggattacaggcgtgagccaccatgcctggccccatttgttctttactgttattttaaattttatttctctttatttcctctccttttatgcttctgtttttttctttttttgagacagtttcactctgccacctgggctgtagtacagtggcatgatctcaactcactgcaacctctgctttctgggttcaagtgattctcctgcctcagcctcctgagcagctgggattacaggcaggtgccaccaccaaacccacctaattttttttttttttttttgtagtagagacggtgtctcactttgttggccagactggtcacaaactcctgtttttttctttattcttagattgagctctcattcctgcttttattttaggaaccctcttccctgttctctcccctttttatttttattttggtttgttcttctcatcaagacctaacggaagttcatctgagttgctcttcctctgtcatctttccaatgtgtgctttattcatttgcagaaatgaaagcaacacatccttctgggatgcatgctttttgtgtgcatgttcattaaatacacaaaaacattcatgccagaagcatccattcctcgacatgaacttggccctctcaggcactggggatctgatgctggacaagatgcagacacttaactgtagtctaggtggaagtacactccagtgtcaaacccgtcagtagttactgagcagtgtgctatggaggagaagagcagagtgtggaatggagggacctcaactaatctgaggagttgggggccagggtggtgttgagggaaggagtctctgagaaagtcatgctatgctcagaggcattgagttagctgatgtgggtgggaagcatggaatccggagcaagggaggactgaggacacatgttgcaggcagagatgtcttacacacacaggctactgcattcacatggatacgttgcaaccaagcgtgtttggtgttcattctcttgtgcagtggggtgggttatactaagatgcttcatgatttatggtttaatgaaaagaatacaagatagaagggagtccagaattctagttcctgcttcgtcattaaccagctatgaattctttggcaagtcactttttaatttctctgagtctcagtttactcatccataaaattaagataatatctttcctacttcacaagctttatgtaaagaccaaaggagttactgcatgatactgaaatgttcaaaaaataaaaagcaaaaaagtgtgattgtgaggtgcttgcactccatcttccacagccttcgtttgccaagctgaggccacctacactcctctctgatagcttactcagctccaccaagcactcatttttaaatagaatgtgagatgcaacatttggagaaaaatatcaggtaaaattgaggtactgatggccagttccacctcatgtggctttgcagcttcacctcacagatgttctaagaccacaagacaggtgagaatgaaggcatccagcttatttttcccaaaacttccaagatgcccatctcttcttgtggcatcagcaggtgctagtcccggctgtcctttaagcctcttccttctttcaccgtaagtggctggagagacaggctcgtgagtggcattggagaggttaccacttgccagggtttttgttttgttttgttttgttttgtttttgagacagtctcactctgttgtccaggctggtgtgcagtggcatgatcttggctcactgcaacctctgtttccagggttcaagcgattctcctgccttagcctcctgagtagctgggaatacaggtgcaccaccacactcagctaattttttgtatttttagtagagatggggtttcgccatgttggccaggctggtctcgaactcctgacctcaagtgatccacctgcctcggcctcccaaagtcctgagattacaggtgtgagccaccagccctgccaggcttctaagtaaggactcctcatcaacttgcccaattaacctcatcaccctcacttcctggatgagaaaactgaagtgcagagatctttatcatgacctgctcccagccacagggctggtaaggagtagggttaggattcaaacccaggtctccttgatgctgtattgaatcccgacccctccactgtgctgcttccctgctcagaaaggtggcaacaccactgaggcaccctatgccttagatccccagcatccctgggaagggctgagggcaaccccaagctccagtttcactaacgggaaagccagggcctatgacactggaatgaaagcgtgtggtgagggtgacgagtgactgtgaagtttgtaaagcagcttcttggtgacttaacaaactggacgtttctggatgaggatcttgcatcgtccagtggcagtagctgagactgaagatgtctgccaagcacagaggccacactaactctccccctcgtccctgcagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggtgagtgtcccggggttcccatttccaggggcgattggaagcttgaacaaggcctagcattttagcctgtgaccctgtctatatccctcaactccccagacctccctaaggctctgaacacagcagacttttctgcctatctgctttcctctccttggtgcactggctatgcttcagcaagtaatgattccttcctctgcagcccacctgatcacaaccatatggccagtgctccagtttagtttctgctttgggttggattatcgctaaaactgcagtctgtgagcctgtgacatcacaaaagcacaataaaaactggccttttcaggcttagcagctgtgctgtgttcttagaagtgtcccctagcatcttagtgggacggttgtactccaaaacatcttaatgggaaacttctaccacaaggccatagctatatgagggcagagggtacattctaaggagtttttcatattgtattcccccaaagaattcagctaagtgagagcccaaaatctggctggctggcagaccaggcttctggactagactattaagcaggctggagaaattcagtgtggagaacagaggagttcacactaaagtcctttaaatggtcaccacatatcgctacacaaatgagtgactgggtggggagagaaaagtgtgtgttctgtaataacacaggagaagttttatgatgtgggatttgcaatcccgttgcattcagttgactggttcgttcctatcagaggaaggtggcagacacttggagtacccggtggcctggctttcctgtgtggcttttcagtgtaactacagaaacacatctatacaccccctgtgtacttgtccttgactttcctttcccttaggcctagaaccaagttcacctaactcagctaactcaccttcccaggtcgctaaaacagtactctcatgtgtaatgcagagctcattacatttccatgtgaaattaaaatatgaagaaaagcacagtatttacactttacctatgttaaaatatctgtttctggtcatttatataccagatttcccttggaatcttttagggggaaaatgtaatcttttgccagaacatattcatctttaatgctgttttcagcagtaacttctgttgaggtaaatgtttataacattaagctttataaagtgatacaatctatataaaagcacttttaaatgtaaaacattagatatgaatgtgaattgtggttattgtggcactgagaaaaaacactaggtaaaaaccaactgtattataatcacggaccaatgtaccttaaatatttgattccattctatctgtctgcagctttctcaggatcttcccactgcgacaatatccctctcccctcattcccacccacatcgcactttatctgtgaggcctttcctggccatcccagggaggattaaccttttcctcttctacactcccttcactgcttcaatcattaagtcataaaaatttgagcaccaggcaacgtgaggcacctagtgaagacataagagaaatctgctccctcttctcatggagtttcattttgtgggaaaacacataacaaatacacagtcagcattctttgatcgcacttatcccatcgttttggaaccagtttatatatctcttctgatattcacgagatcctccaggctgtgcatagaatctgatttacatatggattcccaacacccagtcactagaaattcacattatccatattacacaatccaaactttgaaatggatcaaaccagaattccttcttcagtcccagttgcctgattctaactttcttcatccggtattattttctctctgttaacaggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacag

SEQ ID NO: 36298 - DNA, 8388 bp, Homo sapiens
ggctcctggtcccactgctgctcagcccagtggcctcacaggacaccagcttcccaggtgaggacggggcttggcgcctgggggaggctggcagggccaatatggcagaaagtggtgattccgtaagtgtgagctttgcgtcacctgcctcggagccagttaggctgtttaacagtgcaggtagctgggcccaatcccagacctatgggacccagatctctggggtgagttggggagtctgctgctacccagggcctagcggatgggcaggccacctaaagcgggagcctggcacataggagctttggcatcgcagagacttgagctgagtctggctctgcaccttatgtattggttatcttgggcaagtcacctaacctctctcagcccggcccccctacagagaacagaatctttcagcactgctgtgccttacaggagatcaagcttgcaaaagcttagtgcatgccctggctcaaaatttatcagtaaaccagaggcaggagtgggattataagccagtcgctcctgcccggcccagcatttccccaacaccttgcttatttcctcatactcgctgagaaagctcagcttgactcttccaaagaaataaggggatgtgcaggtagagttacgatgagttctcagctagtactgagtgagcgcaatgtttgtgcagctggggagtgggatgtggcactgcacggggcaggggggaccttatttcttctaagcgccttctcctgtcatccttctggcagccctgtcaggttgaaatcagcattgccaagaggctcagagaggttaaggcacttgcctgaggttatgcagccggtagcagatggggctttaaagtcaagtgggcctgactccatgttgcggaaagggactgctggaccgaaggagatggaaaggtcagagcctggggggaggacaggagaaaccgcgctggcaatgatgatgggctggcacaggcaggaggcagttaaaccagatgagttgtaagccctaacccaaggctgaaactcggtggcttttgaaatgggctagaaccagcactttcccactccccctgcccctggcttccccaggaagcccaagtcctgtcagtaccctgctccccaccctctctccccaccaactggtcacagctctccaccccttgctgcctccaactgacagagcccctccctctaaacacagtctttcaaagggattgtctttttttacttctccaaccatcttcccttctgttcaaccactcaggaattcttggatgacagtgataataataaaatagctaatattcattaagaatttccaacatgccaggctctgttggaagctgtaactcatgtcctcgcacataccctatgagggagagagtagcattatccccactttataggagggtaaactgtggccagagagaaggagtgatttcccaagtcccttagctaagaagcagtagagaccttatgtgaacgctgagtgttgctttccttgtgacactacaggctcccgccaccaggtgaatgtgtgctgcctaacaagagcagcaatcatcgtggtggtaaaaagccactttcaccgaacactgaccatgtgcctaccactacccttggtgtgtcccatgcattagtccttttatcaggctgtctggcttcaaagtttatgtttttaccaccaggtacagtggcctcttaacataacattgagttttaagatccagtggatgtgggtttgactcccagccacacaggagctgtgtgacttttatcaaggtgcttgccctctctgatcccgttgcctcatctgtaaaataagaaagcaagagtgcattctcaggggctgaatatcaaattacaggggataatggcatgcaagccatctggctcagagcctggcctatacgtacccaacttattaaagttgttaaattgccattttgtaaaacctttagcaagagcaagagtgagagctgatgcttattcatggataagcaggaccatgcccctgagccaccctgtcttcagagcatagagcctgacagaacctaaagctgtcaccagcattccctggccacactcatctttacagcttcctttccttggtgcacagtgtctggcataactcagggctttcagcaagaaattgatcaggactaggctgaggggctgaggctggtttgcagagcataggagccaaatatcagtaggccttgtctggtcccagggagccctccacatgccagactctggggttgggacagccagcatgtggcagagagggtaggagtttggccacaaccctgctgttagaatagtttgctgggtgatttttgggtaggttgctttctaagttccgatcctcagtttcctcatctgcaagatgggaaattaatcacaacccacttccccagggtgttgagaggatcagagaacagcagcaatagcagtagcagccacaagtcccaatgagagcttggggctcaaggctttatgactctttcccatccatggtctcacctgggtccctgtggccactctgggaagtaggcagagaccactctgctcccccattttaagagaggatacagttcagcctctgaggaaaggtttcctggaggaagaaggctttgacccaagcttcgaatgaagaaaaaacatttggatctgggcaaaggtggaatgggctgcctcgagaggtaatgagctgcccatcactgaaacggtgcaaactatggatggaagagcccttggcagagatgtcatttcctcacactctgctgagaaagttcagcttgactcttccaaggaaataatgtgatgtgcagctagcgttgtgattagttcttagggctgagtgaacacaacgtttgtgcagcaggggagtgcgttgaggcaccacacgggggaccttggcagaggtgtcattgaggaaacttaagaataggctgaagggtcctcaggaacttaaacatggaattgccataagcggtaattcctctcctgggtataaaccccaaagaattaaaaacagatactcaaatccttgttcacaaatgttcatagcagcactcttcacaatagccaaaaggtggaaacttcccaaatgtccaccaatgatgagtggataaacaaatagccaagcgagatggtgcgtgcctgtaatcccagctactcaggaggctgaggcaggaggatggcttgagctccagagttcgagaccagcctgggcaacagagtgagaccccatctcaaaaaaaaccaaaaaccccaaaaccaaattgtagtgtgtaagtggaaggtctgtaagtggaaagacacaaacggtattttcctctgctctcacaccacaacaatcaacacagaagacttctgtgaccaaatgtggggggtttctccccacacaccaagcaagcaatcaaatctgctgggtgtctttccactcagttctgacactgtctaggaatagcatcagaccccacaggctgagagctcagtcccacaagactgctccccctcagacaccatttgcaagtccaggcccccagaacttctgaccaatcagcttcaagttggggttctcacaaccccctgcttgggtttggattctttgctagagtggcccacagaagtcggggaaacacgtttacaagtttattataaacaatactataaaggatacagatgagatgctcagggtgaggtatgagggaagaggcgtgccactgtcatgcccaggtccctgggcatgctgcccccgaggaacctcctcgtgttcagctatttggaagctctctaaacctagttctttgggatttttatggaggctttattatgtaggcacgattgattaagccattgaccattggtaatcaatttaaccttcagccccactcccctccccagaggttggggggtggggctgagagtagaccctctaagcctgccttggtcttcctggtgacgagccccatcctgaagctacctaggggctggcagccatcaatcaatcattagcatacaaaaatacctcactttggaaattctaaggattttaggagttgtctgccaggaaagaggtagaagaccaaatatatactttgcaatatcacatgtacccatacaatggagtattattcagttataaaaaggaatgaagtactgatacatgctacaacatagaaacatggatgaaccttgaaaacattaccctaaatgaaatgagtcagacacaaaaggtcacacgttgtataattccatttatatgaaataataggaataggtaaatccatagggacagaaagcagattcatggttgtcaggggctgggggaaggaggattgagaagaaactgcttaacgggcatagagttttattttggggtgatgaaaagtcttggaactagatggaagtgagggttgcacaagactgtgaatgtattcaataccactaaaatgcttgctttaaattggttaattttatgttgtaggaatgttgcctcagttaaaaatatataggctgagggttaaactagatgaacttaaaggccactttgtcctgagagctaatggcatggaacactggccatgctgaccagtttgagacagcccaccggcttcttcctagttctttgggattaaaaaggggccatcactgccctcttgccagagtcacagctctgagaatattctaccagcagaaacagcctggtatgctggcagggacatcggcttcattccttcctgtatgactctgagcaagtgacttggcctccctgagcctcagtgtcccctttggtgtaggaatcacagtagatgcagggatgctctaagcatgcaaggtggcccgttcataagcagcatcataccctgaattcagaagctctactgaataagagctttcggggaataaaaccccaaactcatagtagcttagttgcctctccactcttgcttcctgtcacttgaactcttgctcccctctgtcatactggcctcctgctgatcctcaacatcctaacctctgtcctgcctctgggccttctccatattctctgtcctcctggaacattcttgcccccaccttttctggaccttcaggtctcagcctaatcatcacttccaagagtggcttccccttggagaagactttcctggtgggaggacttccctcacaaaacccaccacctcccacctccagcccagttactctgcctcccagcatccttctctttctttcagagcaccaatcacggtctatcactatttctatttactttatgctgacccatttatatctacctgtttatatctgtccccactaggggcacaagtccaggagggcagggactgtatccgtcttgttcttcactgaatccccagcaccttgcacagagtctggtagataggggacaatcagtgaacatatggatggaggaatggatggatggagggacagatggaggaatagagggatggatggatgaacggatggatggatagatggacagagggatggagggatgcaggggcagaaggatggatggatggatggatggagggtggatggatggacagatggacagagggatgcagggatggaaggatggagggatggatggatggacagcaggatggagggatggatggatggatggatgcagggatggaggggtagagagatggatggatggatggagaggaggatggatggatggatgcagggatggacagagggatgcatgggtggatgaatggatgcagggatggagggatagagagacagatggatggatggatggatggatggatggatggatggatggacagggggatggagggatggatgcagggatggaggatagagagatagatggatggatggatgaatggatggatgcagatagagggatagagagatggatggatggatggttggatgcaggaatggagggatagagagatggatggatggatgcagggatggagggatagagagatggatggatggatggacggatgcagatggagggatagagagatggatggatggatggatggatggatggatggatgcagatggaggaatagagagatggatggatggatggatggatggatggatggatggatggatggatgataggatcaccacggtggtaacctctcacattgtcttctccacaggaggcgtctgacacagtatgatgatgaagatcccatggggcagcatcccagtactgatgttgctcctgctcctgggcctaatcgatatctcccaggcccagctcagctgcaccgggcccccagccatccctggcatcccgggtatccctgggacacctggccccgatggccaacctgggaccccagggataaaaggagagaaaggtaccatgggatttagcaggacactggtaatactgaccaaatttcccgtctcctgcctcccaagtcacagttgcctacctttgagactgcaaaagcactggcaaatccagcagcttgctgaacccttgcagtaactttgcaaggagggaattctgattcccattttacagagaggaaaactagcatctagaaagtctgctgacttactcaaggtagcccagtaaatgttgaggctaagaccagaccacggatctcttaccattaaattcaggtggagagggagtgccgctgtggccacagagtcctgtgtttaaacttacctcctgggcaaatgacttctctctgaattgctatttcctcacctgtaagatgggggcaatggtacttttttggggttgtcatggggttcaaatgagactcccagccttgaaaacccctctgtaaaatttggtttattcattcatttaacctaccgttatagagcaactgtctgtgccagtcactctcctcacataatctcatctaatccttacaatcccacaaaatatcttcatccccatttcacagatgaggaggctgtcctcaggaaatgtgactcagtcaaggtgacaccactactaatggcagatgtgacacgcaaagcacatctctctgtccccagatcccatcttctcaggccctattctctgccactctactggaaaatcggtcttatcttgtgttgtgccaaaccaaggggtagtggctgcttggggggtggagtgagaaggagtctaaagtccatttccaggagcagcaagagtgaaggccatggttgattagggatgtctgccaggggtgagggatagagggagacagcactcattatccctgctctagctgaagaaggacccccacacaagctggggaggagggccggcctagcaccttccttagcaaggagccattcccctccccacgatcagcagcccccaagaaggtcaagcatatcacagactcaggaagctgggctggagggagacccagagcccctgcctgacactgcctccttcgttttacagatgggagactgaggctcagagagaggcagggccctgcccaaggttccagcgcaggcctccttcttttggtctcagtgatctcacttctttggtctctgcttttccagggcttccagggctggctggagaccatggtgagttcggagagaagggagacccagggattcctgggaatccaggaaaagtcggccccaagggccccatgggccctaaaggtggcccaggggcccctggagccccaggccccaaaggtgaatcgggagactacaaggccacccagaaaatcgccttctctgccacaagaaccatcaacgtccccctgcgccgggaccagaccatccgcttcgaccacgtgatcaccaacatgaacaacaattatgagccccgcagtggcaagttcacctgcaaggtgcccggtctctactacttcacctaccacgccagctctcgagggaacctgtgcgtgaacctcatgcgtggccgggagcgtgcacagaaggtggtcaccttctgtgactatgcctacaacaccttccaggtcaccaccggtggcatggtcctcaagctggagcagggggagaacgtcttcctgcaggccaccgacaagaactcactactgggcatggagggtgccaacagcatcttttccgggttcctgctctttccagatatggaggcctgacctgtgggctgcttcacatccaccccggctccccctgccagcaacgctcactctacccccaacaccaccccttgcccaaccaatgcacacagtagggcttggtgaatgctgctgagtgaatgagtaaataaactcttcaaggccaagggacagtggtctaattcaactctgtgtcccagcacctggcacaccagaagtgccatgctcagaaatgttggttacatgaatgaatgaaccatgaatgaatg

SEQ ID NO: 36299 - DNA, 6584 bp, Homo sapiens
aaggtggctacgaggtagtttctctttctcccttacctttattgttgcttgtgttggaaggcgactgttcagaggtagggaggggcaagatgagttgggaggagagcagaaaaagattgtagctgtattttcaacagcttcttcacccatgtgcacgtgcccggaatctgggaccccattcccctgccgggtttctgacgcccagcgcatgagttccgctaccccgccccacccccgctccactttgcagaaaccggggattgaatggagggggaagggaaggaggtgggggcgcgcctcaggatgggctgttgtgggagatgacgtaggggccggcgacgtggggagggggagcagcgggggaagtcgtggcgagattaagtaatgagaacttgggcccagttttttttccaagcctagaagggcagaatatgttcgtatcctttctgacctcccaggcatatgcaatggtgaggagtatttttgagaattagagaactttgttttgtggctgttattgttgtttttgagggggaggagggcagtatggggtcagaggcagaaatgaaaatttcttgctaacatggattcccaatccccctatctcttcctttacagttttccagatttaggagacttcagaaaggtggggcagatagaatggagatggcaaagatctctttgggcatatatgggcctggcgaagtaatggaataatttctaattttcggagaaggcaagtggtgagaaaaagaccaccggggaaattcggaggctttgtttctgtttctctgcctttctgggtaaagagatgaggagtgccctggggccttctggggaagggaaggccagtgtgagttacatctttatgcctgtccctctcaattctagccctcatgccgggatggcagaagatgagcctgatgctaagagccccaagactgggggaagggcccccccaggtggtgctgaggctggggaacctaccacccttcttcagaggctccgaggtaccatttcgtaagtactcatcacatctccaagtcctgtccaagacctgagtatagatccctgcagcacttcactttggctgtagatgaactgcctctcagcaagggcatgggagcagagggagatttttggccatggtagcaattcttgagcacctgctgggcatttcagtccttttccctccctagcagtcagataaagagacagggaaaatcttgtgtgtgacctccagctttctcctcttccccacagcaaggccgtgcagaacaaagtagaggggatcctggtaagtgtgttggggaagagggcaagagagggatggaaatgctgagggaggaggatgtgaggatgatgggcatcaacaaaacattgatgtgggagaggtagggtcctctgccttgtcagaagatagttggctttgcaaacttgctgccagtttgactttgtgcctctcacttgatctctgtgagcacttgcatagaagcccagcagagatgaagtcagagctgatcccctctacttccctcctctccatggtagcctatagggctcctcagagcacctagcatcaaataatttctttcttttttttttttttttttgagatggagtctcactctgtcgcctaggctggagtgcagtggcgcaatctcggctcactgcaagctccgcctcccaggttcacgccattctcctgcctcagcctcccaagtagctgggactacaggcgcccgtcaccacacccagctaatttttttttgtatttttagtagaaacggggtttcaccatgttagccaggatggtctcgatctcctgaccttgtgatcagcctgccttggccttccaaagtgctgggattgtaggcgtgagccaccgtgcccggccttgtcaaataatttctaaggtcctttttcagtctgacaccctgtaagtcagctagactttggtgtggggatcagagggtcctatattgggtccttcttggccttattatttctcctgcctctgttctctcctacctcagcaagatgtacagaaattttctgacaatgacaagctgtatctctaccttcagctcccctcaggacccaccactggagacaaaaggtaggtttgatagtagttttagatggcagaggttctgattcttagagaaaggttcactgggaaggggtgaggtgaataggaatactcgtaaatgctgtccttgatgaagaggaaaggtcctcgccctgacttggtttaccagggaaagttagattctgggtgaactaaatttggtccagcactactgaagtggtagtttgggaagaaccaggacaactgttagggtcttagtaatgcttgttccttttgtttctgtagctcagagccaagtacactgagcaatgaggagtacatgtatgcctataggtggatccgcaaccacctggaagagcacactgacacctgtctgccaaagcaaagtgtttatgatgcctatcggtgggtggaggggtgggtggtgggatgagtggattggtgggcataggaccccctcacccatgaagagcttcctgccttgataaagcctgccttcttaaagggttcctcacacttgatccctagggactcttcgagcctacccatggcctccttctctgagtatcttcccactctgctcccctctcactcaggaagtactgtgagagtcttgcctgttgccgcccactcagcacagccaactttggcaagatcatcagagagatcttccctgacatcaaagctcgaaggcttggtggccggggccagtccaagtatccttgactagagaggttgggggtggaggacctgggaggaagacttaggatgtggagagcaaggagtggaacagcttaacttgctcgaggggcttggagatcgccatgtgttggctgctctttaacttgcatcagatattgctacagtggcataaggaggaagaccttggtgtctatgccacccctgcctggacttgacctaaagggttctgagagtgtaagtaccaaatcaccttccaattccactcttctctcccaggtaaaagtcagaggtctttggggcatgttttgagggctaacagcctcagtcattatgtacatagcttctaggtatgatgttcccttctgccaaccctgtagctgaggcagaggatgaagagaacttgtgggcttctgcaatgggataggtagaggctactcccatccccagtctggtctcagctttggtcaatagtctttgatctctgacaagagaggaggcaagggttctttaatttggagtgtgattgggcatgtccttccccacttcagccagaaatgggcccagaagtaaccccagcacctcgagatgaactggtggaggcagcgtgtgccctgacctgtgactgggcagagcggatcctgaaacggtccttcagttccatcgttgaggtcgcccgcttcctgctacagcagcatctcatctctgcccgatctgcacatgcccatgtgcttaaggccatggggctcgctggtgtgttgaccctctcttatgtctcagcaaccctgagccactttcagcttcagtggccctcccacacactagaatagagacaccttggatttgccccctcttcctggagacccttctaagacatgctttagcaccccatttcctgtctctaccagtcagtcaatcagaattgcctcactcccctattcctcagtttcctcctcaccttcactctattacctttttggtacctctgcagaagaggacgaacatgcacctcgggaacggtcatctaaaccaaagaatggtttagagaacccagagggtggagcccacaagaagccagagagactggcccaggtaaggaagtcagtggccctgactttgctgtcctgggctgggggcttagtatatccttctccaattgggtcccttgcttttccacctcctgtgcctctggcgtctatgtttcccccaatactcattcttcacaccttactgtgttcctctctttactttttagcctcctaaggatctggaagcccgaactggggccggtcctctcgcacgtggagagcggaagaagagtgtagttgagagctcggccccaggagccaataacctgcaggttaatgccctagtggctcggctgcctctgctccttccccgggcccctcgctcactaattccgccaatcccagtctctccacctattctggcccccaggctttcttcaggtgccctgaaagtggctacactgcctctgtctagtagggccggggcacccccagcagctgtgcccatcattaacatgatcttaccaactgttcctgctttgcctggacctggacctgggcctgggcgagctccacctgggggactcactcagccccggggcacagagaacagagaggtaggcataggtggtgaccaaggaccacatgacaagggtgtcaagaggacagctgaagtacctgtgagtgaggccagtgggcaggctccaccagctaaagcagcaaagcaggatatagaggatacagcaagtgatgccaaaaggaaacgggggcgccctcgaaaaaagtcaggtggaagtggggaaaggaattctacccctctcaagtcagcagctgccatggaatctgcccagtcctcaaggttaccatgggagacatggggctcaggaggggaaggcaactcagctggaggggcagagaggccagggccaatgggagaggctgaaaagggggcagtacttgcccagggtcagggagatggtactgtttccaaaggaggaaggggccccggttcccagcataccaaagaagcagaagataaaattcccttggtcccctcaaaagtgagtgtcatcaagggcagcagaagccaaaaggaggcttttcctttggcaaagggagaggtagacactgcaccacagggtaataaagacttaaaggagcatgtgcttcaaagttccttatcccaggagcataaagacccaaaagcaacacccccatgatacaggtctgtggggaagagtgtttatatccctacgttaactttgcctagtagaggcccttctttgcacttgcttctcatttggctattcttttcctaaggaagtccattctcctctgtacagacagctgagtcacccagtctacttagtacctggttgctgcctctgaccttttcagcttgataccctgggctttagtgtaaccaataaatctgtagtgaccttacctgtattccctgtgctatcctgtgggaaggtaggaatgggctaagtatgatgaatatataggttagggatcttttggttttaaatcacagaaaacctaattcaaactggcttaaaataaaaaggatttattggttcatgtaactagaaagtccataggtagtgctggctccaggtgaagacttgacccagtagttcagtatgtctctaaataccggactgacttttttctcactgttgcatcttctgtaggaccatttaagtctgggccacttaatggctgccagcattcctaagattacacttttccccatttatgtccaatcagaaaaagaaggcatctttgtaccagaaatctcagcaaaagccctaatattcacactgattaggcctgggtcacatgtccaccctgaccaatcactgtggccaggaggatgatacatgctaatttgcttattctatatcatggacaacacctttggggaaaagggtgggggtcagcctccccaaaatcacatggattccccaagtggaaactaggagcagggagttgcttgggtggccgctaacaccaggctactcttattttagcttgctaagttgagatcagctagacctgctttcttttctcctcagtcttgcatttccctcaatacaagctgtagcctctttcctcgtttctagtctcagaaggaaggagagggaagccattctcctctagggactcttcagtctcatttagatgatagtccctttttttctacctccatattagagatggagctccttccttttcctgtttcttaatttttgtcttctcattcctgcttccctctcaccctattgccagttccaccaactagagtgaaagacttcctagccatttcattaaatctattctgtatccaccaggtggcagcatcttgtcatacgtgtcaggacttaggactgcggggtttaggttagatgtcacggaaaaagctagttctgtggtcaggcggcaccaatgagaaaggaatgcagaccctccagatgtatccttgggaaaagcagtaaaccaactaatatttattgaagacctactttgtcctctacatagggtagcttctgtcagggaatcttggttcttcccaagaaacactgattttctttcagggagacttcatgtgttcatttatttccaccacagcagattttaagaaattataatatgtaatatttgatatctataaagagtatatctaacgtgaataaattatgaagcatactaatgagtacctatgacccataacacatatacattaaaacattttaaatacc

SEQ ID NO: 36300 - DNA, 4034 bp, Homo sapiens
ggcgcggtcgagtcatcgcagggcctcaccgcttcgttctcccgtccctccccgcgccttggcgcggggggtcgactagccaagtgaggcgggaggcgactcggacctttccctgcatttcgtttcggccagtgccgggggctacccgccctggggcctgggatccttggggcccgtgaggcccactcttagcggccggggcctaccgcggcccgccgctggccctcatgaggcatagcctgaccaagctgctggcagcctcgggcagcaactccccaacccgcagtgagagcccggagccggctgcaacttgttcgctgccctctgacctgacccgggctgcagcgggggaggaggagacggcggcggccggatctcccggccgcaagcagcagtttggcgacgaaggagagttggaagccgggagggggagccgcggcggcgtggccgtgcgcgcgccctcccccgaggagatggaggaggaggcgatcgccagcctcccgggggaagagacggaggatatggactttctgtctgggctggaactggcggatctcctggaccccaggcaaccggactggcacctggaccccgggcttagctcgccggggcctctctcctcgtctggcggaggctcggatagcggcggcctgtggagaggggacgatgacgatgaggccgcggctgctgaaatgcagcgcttctctgacctgctgcaaaggctgttaaacggtatcggaggctgcagcagcagcagtgacagtggcagcgccgaaaagaggcggagaaagtccccaggaggaggcggcggtggcggcagcggtaacgacaacaaccaggcggcgacaaagagtccccggaaggcggcggcggccgctgcccgccttaatcgactgaagaagaaggagtacgtgatggggctggagagtcgagtccggggtctggcagccgagaaccaggagctgcgggccgagaatcgggagctgggcaaacgcgtacaggcactgcaggaggagagtcgctacctacgggcagtcttagccaacgagactggactggctcgcttgctgagccggctgagcggcgtgggactgcggctgaccacctcgctcttcagagactcgcccgccggtgaccacgactacgctctgccggtgggaaagcagaagcaggacctgctggaagaggacgactcggcgggaggagtctgtctccatgtggacaaggataaggtgtcggtggagttctgctcggcgtgcgcccggaaggcgtcgtcttctcttaaaatgtagggtcaagtaatctgctctttatccgcgtttacccctttcaactcccttacaccatgtcaaacttaccttagtgggacatcttcaccggacacatttcagaggagagaaaaaaagtaatattgaatcttaaagtgtttagctaaaagcatgaatgtgacacagtaaccaactcctaatgataacatgtgactattaaatctctctgacagtttcttttttaggtgatttccttcctgccaggctccgttgtaggggttacagaacagtcgttcccgcctcacaacctggtaaggatccatctcttcccgtaacgctcatgctctgctgctttgtctactttaatgggcaacatctcagtttgtgtgtgtgtgatttttttttttttttctgttttggaaggtgggagggaaatctaatttgggccctgtccaccctggaaacagacttgtgctggtcaagaatgtatttaagatgcctcttctggttgaaatagctattaatgtgtccccttattcagacttgcgtgtacctagctcttctgtccccagtgtggacatggccttggatgacatcggttccaactgtacactgaaacctgcttatagagagacagtttggagacagtgaaacaggtgaagttgaatggaagttccgagttgtacaaggtgcaaattggaattccgattttagggcaacttttcagaggttgacagttaagtatttggggcatgcacaaatgtgatagttattttgctggaggtgacaggtatctcttaaatatcaacaatgccttttagttttcagtatgagatatagaaacagtctataatggagtaacattttaatgtctcaccattagagaagttggaaattaacatacatatgagactcctgcgttttagttaattggagaataagaatggctaatgtttctttgaggaccagcagtgattaccctatcactgagattgaataaattgttgaacatctttatttttgttgtattaaaattttaggttaaatttatatatgtatgattagatattgaaggttgtgaaatgtgaatgaaaacgtgtaaagtgaggcttcacaaagaatcttattctctgtgtttcaaaagtatttgtcctattttaaaataattttttaaattgagtggttctggccacttaaatgacacgattggtactattttcctaaggtgggatttattcccttgaatctattaaccagttgtataaattgaattatggtgtccttcagtgtaagaggcattaagaaattctttgtgaaacatcactgcttgataaagtatatacgtatttagcatccttgtttttctttgtgctaaagtggatacagctgttggggcagaagagacgggaccagctgctggccacatttcctgctttattttaaaaggtagtataagaaatgaggaaaaagaggtaatatcagggcttctgctgttttttatttttaacatgttcataattaaaaagtattttccagcagtccaaagatgtaagttatcttacacataaaatgttttattttgttatttggttatgaaaatggaatccttgttcttgcacaactgtaaatgttttgttgctagataatacgatttgagacctgaattggtctttggtttccagtgcatcacagcatattttgtaaaatcatctactactgcacttgagcatgaatgggtagtagccaaactcacaaattggagtgatgaacctgcttatacctaagggcaggagcaagcccctcacaatgcagctgcatgggtttttagtgcctactgaattatatatatatatacatatatatatatatatataaaccaaaagtagttggaaagattatttgaaatgactaatttgtgctatctttatgaaatatgttaaatgtagcttttttgaaacagaagccttgaattgaaatttaactaatacttgaacattttgtatatatttctttgtatataattttgtgcagtaccaatgacaaaaatatggtgtcataataaaaccaggtttgttgatcttttagttatgggctcaaagaatttattcatctctaacatgatattggaaaataatggatgaaaataggaaaaatgattgttaatgctgactgtgggtcttaaaaggttctggaaagcagtaagttcatttttctaaaaactataacattctgttggagtattttcttccttacgtcaatacttttcctgcattatttgaaattgtgggctggggagaaacagtagtcaaagctttctgaattgagatactttgaaattccaagtgtagatttttagaatgtcattttataaatggcagtttttggaattacttgataagaacttttgaaaatggaaggattagtatggcctatttttaaagctgctttgttaggttccttatgttttattaactgtcttttctcagtttccatttcatttttttttttctagttttggtgacttagtgattttgtcattttttacatcaacttcatggtcttgtttttacatggtaattgcatgtacttaggatctatctaataggggctttaaataaatttggtcatatttatgtgtaagcacattttactgtaaatgtttgggtttctgaatttaaacagatctgtttatttcagtatgtagtaaacaatatcttaaagtgtccgattcactacttgttaattaaaaaagttatgattaatgtg

SEQ ID NO: 36301 - DNA, 6595 bp, Homo sapiens
aaagcaaacctaggaagtagctttccaacataaagtggaggtttcaacacaggagactttaagcaagttccagtgtgtctatatttggtctggctgatcggctggactctggccttccccgctcacgttagcagacagctctgccctagtgggcgcttagcctgcgacggcagcccgagaggatgtctaacaagcttctttctccccacccccattcagttgttctcaggtctgaattcaaaatggcctcatctcctgctgtccttcgagcgtcccggctgtaccaatggagcctgaagagttcggcgcagttcctggggtctccacagctgaggcaggttggtcagatcattagggttcctgctcggatggcggcgacgctgatcctggagcctgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacactcttggcgagctggacctggagcgcgcgcccgcgctgggcggcagcttcgcggggcttgagcccatggggctgctctgggccttggagcccgagaaacctttggtgcggctggtgaagcgcgacgtgcgaacgcccttggccgtggagctggaggtgctggatggccacgaccccgaccccgggcggctgctgtgccagacgcggcacgagcgctacttcctcccgcccggggtgcggcgcgagccggtgcgcgtgggccgggtgcgaggcacgctcttcctgccgccaggtgactcacctccgctaattgttccgtgttcgttcgcctttcactttgtgtgtctcccccgccccacgcttttcgcttatgtgtatgcccccccgccgcgcccccgggctatattgcccaggcaggtttcgaattcctggtctccagctatcttcccgcctctgcctccctaagagctgggattacagggtgagccaccgcgcccggcactttgaggggagttacactttttttttttttccgtccctgcccttttcacacgaagaagggatgtagcttccaaccttccggaggttagtgtaaagaaacaggaatggaatggaaagctgattggggaagtgtccctgccgctccaaaactgagaggtccctcaaacctagtgctcagttaaaagacattgtaagggccaggcgcagtggctcacgcttgtaatcccagcactttgggaagtctcggcgggcagatcacgagatcaaaagattgaggccatcctgactaacacggtgaaaccccgtctctactaaaaatacaaaacagtagctgggcgtagtagcgggcgcctgtagtcccagctactcgggaggctgaggcaggagaatggtgtgaacccgggaggcagagtttgtagtgagctgagatcgcgccactgcactccagcctgggcgacagagcgagactccgtctcaaaaaaaagacattgtaaggaaaggaaaaagacacttatattaaaaacaaaacaggccgggcgcggtggctaacgcctgtaatcctagcgctttgggaggccgaggccggcggatcacctgaggtcaggagttcgagaccagcctggccaacatggtgaaaccccatctctactaaaaatagaaaaattagccaggcgtggtggtgcatgcctgtagtcccaactacttaggaggttgaggcaggagaatcgctggaacccgggaggcagaggttgcagtgagctgagatcatgccattgcactccagcctgggggacaagagtgactctatcttaaaaaaaaaaaaaaaaaattcaggtagtttcaattttttaatgttcttatttatgtattgactaggaagccacttttttttttttttaaataagaattccgactggttttctcactgtatttccatggcagctaggaggtgccaggtggctgggcctgtgacagtgcagaggttttggtgcctgcccgcccaccattgctccagctgcagctgctgccccctgcagggcctgttcgttcctgctgcctagctccccgctggctggctatgatctccctgttaccattccaggagagcagccgcgtccctatgcatggcaggaccaggtactattgtggcctctcctcttggcctcgaatggtatctttgtcatcagtgagcaagtccccaaagaccacggtcttgtccattgtcaggataattcactccacaagctggggctccaggtgctgccctacccagcggtgcttctcacccacacagtggtcatactttggcaggggctggtgcagtgtgaagacctcggtgttttgcatgtgcttcatctcttgcaaggtcctccggggttgggcttcaagactagggaaaagcctgggcttcacacccgtgggccactttatccaccaggtccggcagcagggtgaggtactgcttccagaccaggaagctgcggtgctgctgcagtgtcacatgcagctccctgagaaggggcggctgaagccccgcaggaggccgtctggaagctgccagcacgcggtccctgtccatcagcacacgcgtgggctgtgctcatcgctgccggggcactggggtttctcgggatcctaggggtatggggcccagaaatgttctttaaaagtttctcatttttgcaacttttctttgaattcgcacagtatgttaagatttatgtaaattagcatttacaataggaaaacctcttcctgtcaaatggaaatttgaggttactggatacttttatattacataaagagcaatcagccagtgtaaaaatgaaatgatgcttatccttattaataatcaaagaaatgcaaaataaaacaacagagtacatttcacaccctcagaagtggcccacttttagaagctagcattatcaattgctgaccagtatgtggaggaaatgaaactcactgctagaaggagcaacatattcatctgctctgggcaacaatttgtcttaacttacaaagttaaatatgttattctacttgtacatgtgcaccaggaggcatattccttataagaggccagatgagcagtctggattaatttaaaaaaagagcaaagtcaactggaaacagtccaaatgtccatcaacaatagaacagattaataaattgaggtatatttccagcagtcaaagtgattgaactacagctacaagaatcaacatctatcaagatatacaaaagaaaagaaaaaaaaagaatcaacatggatgaatctccaaaccactgttgagtgaaacagtcaaaccctaggagaacacattcagtatcattccatttagatacaattcaaaaactaggcaaaataaaatattaaggtacataatctaagtggtaatactatgaagaaaaccaagagtgatacacagaaagtccaggatactggaaagagaggaaagggcacaggggtctgtgggacgttgatggtttgcgggtatcagcactgaactatgtcttaaaagtgttgcctgtaaggtgtttgcattttttttttttttttttttttttttgagacagtgtctcgctctttcgcccaggctggagtagtggcacaatcttggctcactgcaacctccacctcccgggttcaagcgattctcctccctcagcctcccgagtagctgggattacaggtggccgccaccacacccagctaatttttgtatttttagtacagatggggtttcaccatgttggccaggctggtctcgaactcctgacctcaggtgatccacccgtctcagcctcccaaagtgctggggttacaggcgtgagccaccggacccagcctgcattattactatttaattttgtgtgaaacacaaaacctttaatgtaaatgataaaaatatcagtaagtggagtcattcagaatgagtagccttttgagtctgtctccgttgagtaagtgcattctgttgagtgcactggagaggaatttgtgctcttctatgtagcagtctttctttttgtttcttggtggtgcaccattaaatggattcattcaccagttaaaggacatttgggttgtttccagtctttggctacaacgagtaaagtcactataaacacttgccagaggtttctggacgaacaggttttcatttctcgtgggtagatacctaggagtgggattgctgggtcacatgtgtggtaagtatatgtttaacttaaaccatccaactgtttcaggaatagcttagttttgcattttgttttgtttcttcccaagaacctgggccctttcctgggattgtggacatgttcggaactggaggtggcctgctggagtatcgggctagtctgctggctgggaagggttttgctgtgatggctctggcttattataactatgaagacctccccaagaccatggagacgctccatctggagtactttgaagaagccatgaactacttgctcagtcatcccgaggttagttcttctttcagatttatgggctatgatgtatcaggtctcttcttaaatggtctgggttttcacagaagttagctcattcatgacagccattccctaccccaacacacactaccttttttagtcacttcttatagacagtttctttttttgagatggagtctcactctgttgccaggctggagtccagtggtgcgatcttggctcactgcaacctccacctcccaagttcaagtgattcttgtgccccaccctcccgagtagttgggattacaggcacctgccaccatgcttggctaatttttgtatttttagtggaggcggggtttcacaatattggtcaggctggtcttgaactcctgacctcaaatgatccacctgctttgacctacccaagtgctggattacaggcatgagccactatgcccagcctaatatttgtatttttttttttttaagtagagatggggtttcgccatgttggccaggctggtctcaaactcctgacctcaagtgatctgcccaccttggcctcccagagtgctggaattacaggcatgagccaccacacctggcctcttatagacagtttctattcaattctatattactatatttcctgctagtaaagagattcgtagttgttattatgcaattttaaattccagtatttttttttttttttttttgagatggagtcttgctgtgtcacccaggctggagtgcaatggcatgatctcggctcactgcaaactccacctcccaggttcaattgattcttctgcctcagcctcccacgtagctgtgactacaggcacgtgccactactgcccggctaattcttgtatttttagtagagatgtttcaccatgttggccagactgatctcaaactcctgacctcaaatgatccacccgcctcagcctcccaaactgttgggattacaggcgtcagccaccactcccggccatgagatgatgtacttgttgatgatgactcagtttagttatgacagtgggaatgggtggctcaggtgggagacagaaaaagatcatgggagatacgagattaaggaactgagaaaccagagaataattgatagatcttccacatggttatcaccaagagtggtgatggacaaattgtggaaaggaagagatagaggggaggtaaattctcaaagttgcaaatctgggtaaatggtagaacctagattcagactcaggttcaactaacttccagggtggacacaactcaccatattccactgtttgtggaatcattcttcttctttttcctttgtccctttctcaggtaaaaggtccaggagttgggctgcttggaatttccaaagggggtgagctctgcctttccatggcctctttcctgaagggcatcacggctgctgtcgtcatcaacggctctgtggccaatgttgggggaaccttacactacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattcttttgtttttaataactaaagttttttcccctcattattaaaatgaatttaccagt

SEQ ID NO: 36302 - DNA, 73441 bp, Homo sapiens
agggagaggcagagaggcaggcagcctgctgggctcttcctgctgttgaaaacttacccggcccttacagaggaaatcttcctcctctcttctgccctgaatgttttcccaaacatgaaggtaagacaataaattcattacttttgtaaatgaagctatcttttcaaatgaacgggggtaatataaatgtaatttaaacgaagaggtgtaatacctaactgaaagacatcaaataaatagaaggccagaggaaaatacagaagaaaaagacctgggggtgatgtttagaaatccttatttaaacatatttaacagttcagccaaagtgaattcctttttcttatcttgtggtgaaattataggtccagaggtctgggaatcaggaattggagacaatgtttatgaaagtcccgataaagtcataaagaaatacaatagtactattgttatttcttgggaaaaactttcctctggtgtattttttttttttttttttgcttgtttggattaggagccatgcagtagggtcctgcgatttatctaagagctaatagaaaagcaaatttgcaggcttggaacttgagaatttgaaatcctggatgaaagagtcagcattgtgagaatagaagatatgagtagatggaataaaactaaaggtctaccaagtatacatgttggcccaatgcaaaaaggccaaatattaaaaaacaaaacaaaacacaaccaaaaagctattcaacaaaagataagaccaaagatagaaatcgctatcatagactaaatctctggaatgcaaaaataagttgagattgctattcaaattttattattgtaaattttggtatttaaactttaaaaatgttgcattgtaagactgtaggaataatttcacagatctgtcagtggctagattgcttccatagtcactgtattgtccattggggcaccgaatccaagctcgctcattattggggttagaggaggagcaagatatggatcttgattaagccatgccttctgtgaaattaaataattaaaattaaacacaaataacaaagttaatttgtttaaagttatgatgggcagtcataaaaaagaatgaaatcatgtcctttgcagcaacatggaggcagatagaggtcattatcctaagaaaattaacgcaggaacagacaatcaaataccccatgttcttaatttttaagtgggagctaaatattgggtactcatgggcataaagatggcaacactagacactgcactccagcctgggcaataaggtgagactctctctcaaaaaaaaaaaaaacaaaaaaaaaacaagaaaagaaaatgatgctcttctgaaagttatctagccaaaatgttttttcctaatatttgtgttaactattaatcttttactttattttacaataagaaatcttaataattgctttgtgcttaaaaacatgtttacaatcattattataatattttactgctgtaataataaatatacttctatcctttaattagttgacaaaatatcaacaaataaagcaattaattttttaaaaattttacatataggggctttccagcaaaaattgggaagcctgatagacaagttctaaaacaactgtaacactaaagcaattatttcactccaagtcgcatgtagagttcttacctgtatttgaaagtggacattcatatttttacagtaaacctgaaggacatgctttggtgatatgtgacaaagaagggacacttgtgaaagccttgggctatcaagaagctagaaatggtttctatgtcagactttttaagaggaagcaatgttttggccccacagcccccacgtgaactaaattcagagagacagtcacaggattccctttggttctctctgtgttcttggataggaaataacttggatctgaggtgttggagaaggatgtcagggacaagggacttccctcggagctggctgtggcccagccatttgttccgtccctccaggagagagctgagcttggggcctgtgaatctagggaatggtcgtcacagtgcccaagcacagtgatggtcaagcacagtaatgtctcaaatcaggattgtagctgggacatactggaagaaggaggtagagctaatgctcattcattgatgataaagaggagaagataattcaggggaatgtagttccagcttagctacattgacacagaacaaaaataccacacactttttctttctttcttttttttttttttttgagacaaagtctcactctgttgcccaggctggagtgcagaggtacgatctctgctcactccaacttccgcctcctgggttcaagcgattcttctgcctcagcctcctgagtagctggggctacaggcgtgcgccaccatgccttgctaatttttgtattttttttttttttttagtaaagatggggtttcaccatattggccaggctggtcttgaactcctgacctcatgatccacctgccttggcctcccaaagtgctgggattacaggcatgaaccaccacgcccggccccacatacttcttcaaccaagcaattcttttatagagtcagttcagatgtatgtctatcactgtcattcacatgatttatttgtgtttgttctatctctcttgttcatttataaggtattttttccaaaggtaattatcctaaggctagccaaatttcaagaaatgcttttggttagtagattcactttgtataacatgaacagaactggtcttgtaataagcagaccttgatgggttataatgagtatgtatatgaagaaggtgatgacaaaggcatccatgatgataaaaagtatatttcctaaaatttcattgaaattctttattttaaaaaatgcttttaaatttgagacaagatcttgctctgttgccctggctggagtgtagtggtacaattatggctcactgcagctgctacatcctgggctcaagtgatcctcccaccttagtcttctgagtagctgggactacaggtgcccgccaccatgcctggctaatttttgtattttttgttgcaacaggctggcctcaaattcctgggctcaagtgatcctaccactttgtcctccccaaatgccaggattacaggcatgagccaccaaacctggctgaaattattttaaaacacctgtgacagaatgttagaaataattattttcattatccacattttggctgagagtcaaaggccaagaacaagtactcaagattttttgaaattttatggttttttttggaaattttattcatttagttattttatttgtatacatttaaggggtacaagtgcaattttgttacatggatatattgggtagtgttgaagtctgggctttcagtgtatctatcttccaaataatgtacattgtacccattaagtaatttctcatcactcttcccctttctatccccaactcttctgagtctccaatgtctattattccatactttttgtccatgtgtacacattatttagctcctacttgtaagtgagaatatgaggtacttgattttatgtttctaagttgtttcacttaatataatggcctctagttccatccatgctgctgcaaaagacatggtttcattcttttttaaaaaattgaacagtatttcattgtgtatatactgcattttctttatccaatcatctgttgttggacacttaggttgcttctatatctttgctattgtgaatagtgttgagataaacatacgagtacgggtatctttctgatataatgatttcttttcctttgggtagatacccagtagtgggattgatggatccgatggtagttcaatttttagttctttgagaaatctccatactgttttttatggaagttgtactaatttacattcccaccaatagtatatattggtgggaatatatactattccctattctcacttatctctgcattcctaccaacaactgttattttttgacatttttaaagagagatggtgtcttgctctgttatccaggctggagagtaatggtgcaatcatagctcactgcacctttgaattcctgggctcaagtgatcctcctgcttcagcctcctgagtagctggcactatctgggcatgtgccaccatgtgcaaatatatatatatgtatattttgtatatttatatattttaagatggagtcttgctctgtcacccaggctggagtgcagtggcatgatctcggctcactgtaatctccacctcctgggttcaagcgattctcctgcctcagcctcccaagtagctgagactacaggtgcgtgccaacatgcctggttaattttttgtatttttagtagagatggggttttaccgtgttagtcaggatggtcttgatctcctgacctcatgatttgcccgcctcagcctcccaaagtgttgggattacaggcgtgagtcactgcgtccgaccgccccaaataattttttaagaattattttttgtagagacagagtcttactatgttgcctaggctggtctcaaacttctggcttcaagcaatcctcctgccttgtcctctcaaagtgttgggattacaggtgtgagccatcacattcagccagtttttttactttttaatagtagccattctgactgtgtaagatgatatctccttgtggttttaatttaattctctgatgattagtgatgttgagcacattttcatatgcttgtgagccatttgtatgtctttgaaaaatgtctattcatgtcctttgcccactttttaatgtttttgttgttgttgtttttgttgttatcattgtttgagtttcttgtagattctggatattagttctctgtcagatgcataatttgcagatatttcctcccattctgtaggttgtctgttcacgctgttgattatttcttttgttgtagagaagcttttaattttaattaagttccatttgtctaatcttgtttttgttgcttgtgcttttgaggccttagttatgaattcttggcttagaccaatgtccagaagagttttccctaggttttcttctagtgtttttatagtttcaggtcttacatttaagttttcaatccatgttgagttgatttttgtataaggtgagagacaggaggaccttcacattttaaagtgagatgctagacattctatgcaatattacaaagagagtattcccaaatctgtttggtaacccttgggccatccctattctcaagagaatacaagattgtgcatcggagatataggaaatgctaccctatgcacatttgagaaaatgtaaaggtacagacctcctttagcagagtaaataaacccagcagtatcagttacagcgcggacattcagagtttggcaggacacggatgtgtgcagggatcccatggcccgcatatggatggttaaaagggaaccagatttggactgtcagagacactgcctgagagagtgcttgactgcaggatgaagcaaccccaagaaatagcatcagtttggaaaggacccccaggaagcaggcatgggtgagaatcgaaagtgattaacaaagggatgaatcatttgtgccagagtacagtggctacagagtagtaggaagacgtccaaagaaccacaaaaacactgggagagataaagaatcagcagtcaaacgtctaacacattgatttgccatcaccagactccaactggatcagtcaagcaagattctgttttactcttgtctctctcattcctgttgctctgattttggagaggaaagaggcagcttggggaggtggggaagaggagtcaggtggcgcaattttgaagtggacccactcctccctcattacaagcactcagaaactgaaagtaagagagacagatttaaaattggaggataaattgaagtttgaatattataatagattgttttctgaaaatgtgactagtggttaatgcctaaaaatgactagtaaagctgtgagataggctttcccagggacaagacaaaatgagctgacacagcacggaggaaagccacattattggaaaagaaaaaacacaccccacatagcttataatttaaaacaaaaacgtcttaaaaacttatacgatccacatgtttgttgaagtcagaaaagtattcatagtctcccccaaataacctcccccaacattgttcacagtttcccaactccttggcaccttttcaccctttcagatatgctaatcagcacaataggcttaaacatttttagaactctaacagccagaagcaggcaggcagaattttacaactgaaaaaaagatacctaataagagaatgggttatctaagaaggatagtggaaagatccagaaaataatgttaagaagacttttcataggtacattgagaaaaagagttttggggagttcaggaagaagagagaaaatattgggctattaaaatgtgagatgattttaaagtcctttatccagagttataaattggatgcatttgatattcttagagaatcagtaaagatttgaattgtatcttctccatcaccttcagctatcagttaaagtaggaaaatacatacagttaaagtaggaaaatatataatagaaactacctataatttgacaaccagaaataaactattatgctttattatatttctttctagattttgtttttcaatgcacatttgatttttcaaacaaaatgtaatcacattttatgtacaattttgtaacctatcagatcctctgtatttatttaggcttgtgctatcacataaagatgatcataaaaggcctcaggagtgttttaaacatcaaacggaccacccacagtactaaagaataagatgagagtcactgccccctgcctactgctgtgcttcaaccttgattaccaacttaggaagcttggtttctttttaaaatcagccatttgcactgctacttcattcaggttttctctcctcttggtatccctccggagtgctgtagtcagagagaaccggagtggaataagggattaaaagatgatgggaccttaaggaaatgctcgaaaccatttaagtctactgagtattttcaatttgtgtgtccatggcatcacccaacccttacttgtctttagagaattcagcggtaggagatagagtttgacaggattgtaccaaatttttattttttttttaaaaaagcatttatttatctttgtaatttatttcttttaactgacaaataaaaattgtgtctatttattgtgcacaacatgatgttataaaatatgtatatattgtagaatggctcaattgagctaattaaccatatgcattacctcccatacttttgtagggagaatacttaaaatctactctcttaggagtttttaagaatataatacattgttctagagcagcctggccaacatagtgaaacccagtctctactaaaaattcaaaaattagccaggcatgttggcgctcacctgtaatcccagctacttgggaggctgaggcaagagaatcacttgaatctgggaggcagaggttgcagtgagccaagactgtgccaatgcactccagcctgagtgacagagcgagactccatctcaaaaaaaaaaaaaagaaaaagaatataatatattggtattaagtaagtcaccattttgtatgatagatctcttgaacttattccttctatgtaactgaagttttgtaacctttgaccaacatctcttcaacaatccccaccctgcccccatggcccttggtaaccattttactctttacttattagacttcaacatttttagattccaaatataagtatttttctagaaagaaaaatactgaatgttttatttctgcttgttttatttcacttaacataatgttatctgggttaatccatgttgtcacaaatgacagaattttcttctttttttaaggccaagtactatttcattgtgtctctttaccacattttctttatccccttatcctttgatggacacttaggttggttctgtatcttggctattgtaaataatgcagcaatgaacatgggagtgcacatttctctttgatatactgatttcatttactttggctatataccctgtaggggattgctgaatcatatgcttgttctatttttaattttttgaagatccttcaaacttctatttaaaatagaaacttaaaaagataagcagagtcacttagccttctccatggttctttcactttttatactgccaagtcacaaatcttgacttgtacaaatgtaatagttttcaaatcatttaagaaatgtaagctagaactattaatgacaactatagtaacactaaaataacttttcaaaggatacacatgatgtaaattctgacatcaaaaaaatataaactgtttgacgggagagtaaaaatgtagagttgtatgcaaagttaagttgtaatcaccttgaaataagctgttgtgattataagatgttctctggaagcctcataataagcacaaagcaaaaatctttagtagaagcacaaaacagaaatagtattcaaagaataccactattgaaaactgcgaaaccacaaagacaacaagacagaaagaaagaaaaatgtatcttccagcctgggcaacatagggtggccctatctctacaataacttcaaaaaaaattagctggatgtggtggcacgtacctgtggtcccagctactcacaaaggctgaggtgggagcatcatttgagcctgggaggtcgagggtgcagtgagctgtgatcacactaccgcactccagcctgggcaagagaggccctatctccaaaaaaaaagtatctacaataccacaacaacaacaacaagaaaaacaacaacaacaacataacaaaatggcagtagtaagtccttatctatcaataattaccttgaatgtaaatgaattaagttctccagtaaaaagatatagagtaagtgaatgaataaaaaaacaagagccaactatacgttacctgcaggaaactcacctcacttttaagggcacacagattgaaaattaggcaatggaagaaagatattccacatcaatagaaaccaaaagaaagcagggataactatacttatataagacaaaatagacttaaagtcaaaaactgtaaaaaaaaaaagtaaggacattatatgatgataaaggagtcaactcatcaagagggtataacaattgtaaatatatatgcacccaacttcagagaacctaaatatataaaataaatattaaggatatgatggaagagacagattgcaatacaattatagtagggtatttcaatacgccactttcaacaatgaaagataatccagaaaattagtaagaaaacattggatttgaaaatcgctttagacctaatgaatctaacagacacacacacacacacacacacacacacacacacacacacacagaacattccatccaacagcaacagaatgcacattcttctcaagtgcacacagaactttctccaggacagataacattttagggggaaaaacaagcttcagcaaatttaagaagattgaaattatatcaagtatctttttttttttttttgagttggagtcttgctctgtcacccagcctgtagtgcagtggtctgatctcagctcactacaacctccacctcccaggctcaagtgattctcccacctcatcccttccgagcagctgggactacaggcgtgcaccaccacatccagttaatttttgtatttttagtagagacggggtttcaccatgttggccaggctggactcaaactcctaacctcaagtgatctgcccaccttggcctcccaaagtgctgggattacaggtgtgagccaccacaactggcctcaagtatcttttctgaccacagtgatatgacactagaaatcaattatgggaggaagctaggtgtcatgttatgcacctgtagtcccagctaattggaaagctgaggtgggaggattgcttaagtccaggagttcaaggctgcagtagctatgactgtgcgagtgcactccagcctgggtgacagaaaaagaccctgtctctaaaaataaataaataaaaataaatgaatgaatatagggggaattttgaaaaatccacaaatatatggaaattagcatgctcctcaacaaccaataggtcaatgaaattaaaagggaaattaaaaatctttagataacaagataaaaatcttgttatcttaagataaacaaaaatggaaacacaacatagcaaacatatgggatacagcaaaaacagttcaaagaggaacgtttataacaataaatgtctacatcaaagagaagaaagatttaaaataaataagctaatgtcatacctcaaggaaacagaaaaagaagaataaactaagccaaagttagcataagaaaggaaataataaaaatcagagcagaaataaatgaaatagagactagaaaaacaatacaaaagatagataaaataagttcttttttgaaaagatgaacaaatttgacaaactagattaatttaaaaaaaagaagattcataataccacaaaaatacaaaagatcatcagggactatcatcaacaattatacatcaacaaattggataactaagaagaagtggttaaattcttctgttcatttaggtcctgtaaagtgtttctgtaaagtgttgttcaagttgaatgttttcttattaattttctgtctggatgatcttccagcattgaaagtgaggtatggaagttttctactgttacattgcaatccatcagatcctgtggatctgaagaaagagatgggttgcaatacaatatttacatattgtataaatataaatatctgttttatatgtttaggtgctccaaagcatacaacatacaaagactgaatcataaagaaatggaaaatctgaacataccaataatgagtaaaaagattgaatctgtaataaaagttctcccattaaaaaaaaaaaaaaaaaagcagaggacttgatggcttcatggctgaattctaccaaacatttattttttatttttcctcactgtcaccatttttattcaatataatactgaaagtcctaacgatagcaattaggcaagacaacaaaataaatggcattcaaatttaaagggaagaggtcaagttattcttgcttttaaacaacatgaacttatatttagaaaaaaatgtaggctgggcatggtggctcatgcccataatcccagcactttgggaggccaaggagggtggatcacctgaggttaggagtttgagaccagcctgcccaacatggggaaaccccatctctactaaaaatacaaaacttcactgggcgtggtggtgcacgcctataatctcagctactcaggaggctgaggcaggagaattgcttgaacttgggaggctgaggttgcagttagccaaaatgatgccactgcacttcagcctgggcgacagagcaagactctgtctccaaaaaaaaaaaaaaatgaaagactacactaaataaatcttagcagtgataaattaattcagtaaatttgcaggctaccaaattaacatgcaaaaatcagcagcattcctacatgctaacagagatggttctgaaaagaaaatcaagaaataaattccatttataaaagctataaaataaaataccaaggaataaatttaatcaaagaagttaaagattctacaaaaaatactataaaacactgatgaacgtaatttaagagaacacaaaaaaggaaagatatcccatgctcatggattggaaaaattaataccattaaaatatctatactccccaaagtgatctacagattcaatgtaatctctatcaagataccaatgaaattattcacagacatagaaaaaattctaaaaatttatgaaacagcaaaagactccaagtagctaaagaaattctgaataataacagtgctggaggtatcacactacctgcttttaaattatactacaaagctacaacaaaagtagattattaaaaaaaacaaaagtagtttatacaaaaaaaaaaagtagtatgctaacaaaaatagcatactactgtcctaaaaacagacacatagatggctgaacaggatagagaaccaagaaataaattcacgtatttacaaccaactcatttctgacaaaagtggtaagaacatacattgggctgggcatggtggcttatgcctgtaatcccagcactttggaaggccgaggtgggtggatcacgaggttaggagttcgagaccagcctgaccaacatggtgaaaccccgtctctactaaaaaaaatacaataatcagccaggcgtggtggtgcgcaactgtaatcccagctactcaggagactgaggcaggagaatggcttgaacctgtgaggtggaagttgcagtgagctaagaacatgccattgcactccagcctgggtgacagagcaagactctgtctcaaaaacaaacaaacaaacaaacaaacaaacaaaaacaacaacaaaaaatacattggaggccatgtgcagtggctcatgcctgtaatcccagcactttgggaggctgaggtgggtagatcacaaggtcaggagttcaagaccagcctggccaacatagtgaaagcccatctctactaaaaatacgaaaattagccaggtatggtggcacacacctgtagtcccatctacttgggaggctgaggcagaagaaatgcttgaacccaggaggtggaggttgcagtgagcagagattgtgtcactgcactccatcctgggcaacagagtgagactctgtctcaaaaaaaaaaaaaaaaaaaaaaaaaaagaagaacatacactcggggcttgggcgcagtggctcagagctgtaatcccagcactttgggaggctgaggtgggcggatcatgaagttaggagtttgagaccagcctgaccaacatggtgaaaccccgtctctactaaaaatacagaaattttgctgggtgtggtggcacgtgcctgtaatttcaactactaaggaggctgaggcaggagaattgcttgaacccaggaggaggaggttgcagtgagccaagatcgcactactgcactccagcctgggtgacagagtgagactgtcaaaaaaaaaaaaagaagaacatacattggggaaaggacaatctctgtaagaaatggttttgggaaaactgggcatccatatttataagaataaaactagattcctatcttctgccatatacaaaaataactcaaaatgaattagacttaaatgtaaaatgtgaaattatgaaacaactagaagaaaacatagggaaacagcatagatcaatggtctaggcaacgttttttggggtaagatctcaaaaacacagaaaacaaaagtaaaaatgggcaaatgggattatatcaagctaaaaagcttctacaaagcaaacaatcaaaagagtaaagaggaacaacctatggaattagagaaaatatttgcaagctgttcatctgacaagggattaagaatcaaaatgtaaagggaagtaactcagtagcatatgttaataataatattaatctgattaacaatgggcaaatgctctgaatagacatttttcaaaagaagacatacaaatggctaacaggtatatgaaaaaatgctcaatatcactaattgtattaggccattatttgtgttgctataaagaaatacctgagactgggtaatttataaataaaagaggtttaattgccttgtggttctgcaggctgcataaacatggcatcaacatcagctcagcttctggtgacgccttcagggagattttactcatggtagaaggtgaagcaagagcagacatgtcacatggcaatagtgagagcaagaatgagtgaggggtccaggtgtggtggctcccgcctgtaatcctgacactttgggaggctgaggcaggcagatcacctgaggtcaggagttaaagaccagcctggccaacatggtgaaaccctgtctctactaaaaatacaaaatttagccaggcatggtagcaggtgcctgtaatcatagctactcaggaggctgaggcaggagaatcacttgaacccagggggtggaggttgcagtgagccgagattgtgccattgcactccagcctgagcgacagagcaagactctgtcttaaaaaaaaaaaaaagtatgcgagagggggaaaatgtcatgcactttaaaacaatcagatcttaatgagactcactattgcaaggatgacactgaggggatggtgctaaacaatttatgagaaatccaccccttccaacaggcccccacctccaacatggggattacatttcaacatgagatttgaaagggacatctaaactataccattccacccctggccccctgaatctcatggtcttctcacactataaaagacaatgatacctgcccaatagtcacccaaagtcttaactcattccagcattaactgaaaagtctcaagtctcaaggacaaggtccaatctggagataagtttcttctacctatgagtttgtaaaatcgaaacaaattacttacttccaagatagaattggggtacaggcattgggtaaactctcctttcccaaagaagagaaatcagctactagaaggaggctacaggccccatggaagtctgaaacacaacatggcagtcattaaatcctaaagcttcaaaataatctcccttggctccaggttccacatccaggacatactgctgtgaggggtgagctccactccacctcttgggcaactttacttctttggctttgcagggttcagccaccacagttgctctcatgggttggagttgagtgcctaaagcttttccaagctcaatatgcaagctactggtggatctgccattctggggtctggaggacagtgatcccctttccactaattcactaggcagtactccagtggggactgtgtgggggggttccaaccctgcatttccccctttacagcccttgtagaggttccctgtgagggctccacccctacagccagcttctgcctgggcaaccaggctttctcatacatctgaaatctagctggaagctgccaagcctccttcactcttgcactatgtgtgcctatgagcctaataccacatggaagctgccaaggcttacagtttgcacctgctgaagcagcagcccaagctgtatctggggctcactgagccaaggctggagctggagagtggcctgcatgcagggatcagtgtcttaaggctgtgcagggcagcaagaccctgggcctggcccatgaaaccattctttcctcccaaacctcctgacctgtgatgggaggggctgcctcaaagatctctaaagtgccttcggggcctcttctccattgtcttggctattaacacttggcttccttttagtcatgcaaatctctgtagcaagtgcttgctccacagccctccttgaattcctctcctgatgatcctttttctttctctgctgcgtggccaggctgcagatttttcaaacttttgtactctgcttccctttcatgtataaattccaactttaagtcatttctttgctcttaaatctgagtgtaggctgttagaagcagccagaccacatcttgaaatttgctgcttagaagtttgttctactagataccctaagttatcactcttaagttcaaacttctacagatccctagggcataaacagagtgcagccaagttctttgctaagacaaaaccaggtgacttttgctctaattcccaataagtttctcatttccatctgagacttcatcagcctggacttcactgtgcctatcactatcagcattttggtcacaatcatttaaccagtctgtaagaaatttcaagttttctttcatttttctatcttctttggagccctccaaacttttcaaacctctgctcattacccagttccaaagctgctttcacactgttaggtatctttatagcaatgccccaattctcagtaccaattttctgtgttagcctgttctttgtgttgctatagagaaatatctgaggctgggtaatttataaagaaaagaggtttaattgggtcttggttctgtaggctgtacaagcatggcatcaacatttgctcagtttctggtgaaacctgcagggagattttactcatggcggaaggcaaactgggaacaggcaggtcacatggcaacagtgggtgcaagagataacccaaacatttaaagtagagctaatactaatcattttcaaacccttccaaaaaattgaaaaggagggaatactttcaaattctttttacaaggccagtgttatcctgatatcaaagccaaagaagcacattacaaaaaaagaaaactacatgccaacattcttgatgaacatggtgaacatagatacaaaaatctcaacaaaatagttgcaaactgaacaacccattaaaagtatcatctaccacgatcaaatgggatttattcctgaaatgcaaggatggttcaacacaaatcaataaatatgttgtatgagattaacagaatgaatgacaaaaactatatgatcatcttgttagatgcagaaaaacatttgacaaagttcaacaacatttcaagataaagactctcaccaagttaggtacagaagaaaagtaacttgacacaataaatgccacatatgagaagcccacagctaacattacacccaccagtgaaaaattgaaagccttttatttaagctctggatcaagacaaaaatgcccacttttgccacttttgccacttttattcaacatagtattggaaattcttgccagagcaattaggcaagaaaaagaaatgaaaggcattaaaatagaaagggaagaagtgaaaatgcctgtgtttgctggtgacacaatcttatatgtagaaaaccctacagactccaccagaaaactgttagaactaataaatgaatactgtaaaattgtagaatataaaataaacactaaaaagtacatttccataaactaacaatgaactatgtgagaaagacattaagaaaacaatcacattttcaataactacaaaaatatttaggaataaatttaaccaagaaagttaaagacctgtacattgcaaattatgaaacattgatgagaaattgaagaagacataaacaaatggaaaggtatcccttgttcatggattagaagaaaatattgctaaaaagtccatactaccacagtgatctagagttttaatgcaatctttatcaaaattctaacatcatttttcaaagaaatagaaaaaaatcttaaagttcatatggaatcacaaaaaaacccaaatggctaaggcaatcatgggcaaaaagaacaaagctggaggtgttactctgcctgattttaaactatactacaaagctatagtaattaaaacatcatgatcctggcaaaacaatagacccatcaaccagtggaacagaatagagagcccagaaatgcaccccacatatatggtcgattggttatttttgcaaggttgccaagaatacacaatggggaaaggatagtctctttaataaatggtattgggaaaactggatatccacatgcaaaagaattaaataggacccttatctagcattgtatataaaaatctactcagaatgggatgaagccttaagcataagaccagaaactgaaaaattaattgaaaaaaatctaagggaaaaactgtatttttctaggtggggattttttggatctgactccaaaagtgcaggcaacaaatgcaaacatagacaaatgggattacaacaaactgaaaagtttctgcatggcaaaggagacaatgatcagttttcagagatgtacagattgggagaaaatatttataagtcatacattcaagaagaagctaatatcaaaaatatatatggagctcaaacaactcaatagcaagaagacaaaaaacccaataaaaaattggcaaaataccaggaaagggagttggaagtaaagtaaaaataaaaaatgggcaagagacctgagtaaacatttctgaagagaagacatgcaaatggccaatagatacgtaaaaaaagtgctcaacattgctaatcattagagaaatgcaaattaaaatcacattgagttatcatctcacacctgtcagaatggctattatcaaaaagacaaaaggtaacaagcattggtatggatgtggaaaaaagggaatccctgtacacttgtacacttggtaggaatgtaaattagtacagctcttatagaaaactgcatggaggtttgtcataaaacttaaaaaaattatcatatgatctagcaatcctacttttgggtatttacaaaagtaaatgttcattttagcactattcacaatagccaagttatagaatcaacctaagtgtccctcaacagatgaatggataaagaaaatgtggtgtgtgtacacaatggaatagtatttagccttaaaaaggaggaaattctgtcatttatgacaacatagatggaattggaaaacattatgttaagttaaataaaccaggcacaggaagacaaatagcacgtgttctcacttatatgatgtaaaacaatcgaacttgtagaagcaaagtagaatggtggttacagagactggggtaatagggaaataaaggtcaaagggtacacaatctcagttagcagaaatatattttgaattctattgtacagcgtggtgaatatagttaaattggggtatcatacatttcaaaattgccaaaagtaaatttcaaatttctttgccacaaaaaatgttaaatattttaggtgatagatatgttaactggcttgatgaaattatttcacattgtattgagaaataataacatcactttgtaccccataaatttatacaattataaattgtcaatttatagttataaaaagaaatgcaagctaaaataatactttattgtttttcttctccaggtgataagcttattcattttggtgggatttataggagagttccaaagtttttcaaggtgaggactttttgggttgtgtgtaaaaatcattaaatttaaaaaatgttttagtaattctttagtctaattttgacattgcactttgaatctgtgtatccctccaacatattttctctttccatatttttataaaagacaatgataacaaaagcatgtgtttttaattattattcttttacttaaagaagaataattctcttgtaaaattatttttaaaaattgaagactaaaagtataagttttttgtctcagtgccgtggttttatctgtaatgcagataatcacagtggacttatatatcttagagcaatatttgatctttaaatgtaatccttgcaaagcatcctctggattttaaaggttgagagttttttaagaaaatagtcttaccaagttcttgaggcctggaaaaaagccagcatcatttatccaaggctttgttatgctctcactgtgtcagattgatgagacagagccaggtcagttcattttatggaactatcagaaaatgtgtcaggggctgtgctaggtactggggataccacaaggagcaagaaggcactgggagcatgctgggtgattcgtatcttgagccagttcattgcaatatgaatgtgttaagggctctgacagaagcctgctcagggtgatgtgagagcacagcaggaaggtcaagcaaacttcctctcctaagtctccatgtttggggaagccctctccatttccccaggacagaggctagaaaaataacagtaagttcagattgttcaagggtcaaaagtatttaggtattttgatcattggtaccatacgaaaaccacaggttggcaagattggccctgtaaaagcagccaaggcacacactatagaatgagagtcattactttcagagtaacctgaccctcttaagacatgcaagaatcatcttgactcaagatattgcccagccgaggaatgtgctgggaatccagaaatcaggaatactagttcttttattcttcgtagagcatcattttaggcaagccttccttagtctcttaaagctgactcaggtagtcttttccatatgacatggccagaatgtgagcattttatgagagtcaactctccattttcacatgtactttattttagtggagctgtttaagctcagattgtcctccttggttgtgtgcttgaaaaatggcctaaatgaacaggggatgcatttaaataaattcctgtccattcagcctctgccaatttttagttttccacttctcatggggactttttatagtttcttgtctttcagttaagtgtttctggataacttttcaactcatcattcagaatcccttcaaaggccataaaaccttgctcctttcaaaggccataaaacatatttacatatgttttcacctaccctcttaactcaaactctcccttatctatattcccataacacattatattgaatgcatttctgttctgaaatccatcaaatgagatatattgtactatgattatttgtttacacatctgtgtctctgtccttccttctatcaatagtcaatgacctacctctttttttttttttttttttgagatggagtcgccctctgtcacccaggctggagtgcagtggtgcaatctcagctcactgcaacctctgcctcccaggttcaagcaattctcctgtctcagcctcccaagtagccgggattataggcatgcaccaccacgcctggctaatttttgtatttttagtagagacggggtttcaccatgatggccctgttggtctcaaactcctgatctcaagtgatctgcactcctcggactcccaaagtgctgagattacaggcataagcaaccatacccggccaatgacctacctcttttattatttctacaattctagtgtctttagaacctggtacataatagattttgtttttttgtgatggagactccctctgttgcccaggctggagtgcagtggtgcaatctccagtaactgcagcctccatctcctgggttccagtgattctcctgcctcagcctcccgggtagctgatattacaggcacgcgccaccctgcctggctaattttttttgtatttttagtagagacagggtttcaccatgtaggccagcctggtctcgaactcctgacctcaggtgatctgcccgcctcagcctcccaaagtgctaggattacaggtttgagccactgtgccagcataatagatgtttattaagtgttagtctctaagaaagtggggctccctccatttttatatattttaggatccttttagtgtctcttcggaaaaaatatttgaggcaacatttaactatttttgactgttttcactattctttgtgttcccttgcgtatctttccacctgctttatgatggacaatttgacactgtggcagtgcctcctctccagtcaactgccagtgggacttctatgccccttggtcagaatgcaatggctgtaccaagactcaggtaggaccatgcaaaactttgtatttgattatttattgcagaaatactttggcatggccaaaatggtattaacttttgaatgttcattaaatagtgtcaatattttttgaaaactatgtttgtaattttgaggggagaaaagtatgacttgtttaataattaatatggtaataaagtaacttgtaatattgtaataaagtaacttgtatattcatttttctagatcttatcttggagctagaaatgtatataggctaaaagttcaaggcaatttactaactctttaactatgagagaaataggaataacatagaatgacatttttagataatgtaaaatgttttatgttcactgagttcaacttttcttctcatctcaaacaaacactagcaaatagcaaaatggctgcttgattttacttcacaaatagcgaacaaccatgaaaaaaattttgcaaaatgtcttaaagtttaattgctaagtaacacaaatacaatgttggacttaatgtggatattataaaaagcttctaaaaatgtttgtattccttattataaaatgttcactggagagaatacagaaagttatgaagaaataaggcattattcacaattctgcctttttctttttttgtttttgagtcggagtctccctctgtcgccaggctggagtgcagtggcacgatcttggctcactgtaatctccgcctcccgggttcaagtgattctcctgcctcagcctcccaagtagctgggactacaggcacgtgccactacacccggctaattttttgtatttttagtagagatgaggtttaaccatcttggccaggatggtctcgatctcttgatctcgtgatccacctgcctcggccttccaaagtgctgggattacaggtgtgagccactgcacctggccaattctaccatttagaagaaacaaattatataacagcatttggtatttattccctcagctctgtctactttttctctgtgtgtgcttataattaaaaaaattgagattattttatcatagttttgtattctattttaatctaacattatactatcagcaaaataatttataacagcagtattatgttccatgatatgaatatagccttcttatttttccacttttttattgtttgatatttaagttgtttccatttttgttataaagaaaactttaataaacatttttgaatgtagatatctgtcctcttttcccataattttctgaggatagtcctagaaataaaatgtttatcttaaagtttctgaacatttcaagagttaaatattctagaaatagtccagtttgggtaaaattatatttaaaaatcacttttaattattaaaataacagaatcataccatagaagataattattattttgaagcatcatcattaagatcaggtatttatttagtacctacatgagtagtattttcaaaacaaattacatgaataaagaatttggcttctagcaagtataataaataacagctctgattacaggcaaccaggtacatgaataacaagcaaaggtcaaagaaacatcaaacacgttaaatatttttatcatttaaagagaagaaagaacactaaatagaagcagagagatagagggtgttttttatacaagcaatttttttctttgagtgaaggtcattatgcaatggatacatcctagattataaaaacaaaattttcattcagaaagagacaagtgaaaatgagaaaggggttgtagggtcagactttgacaggtgagaaggagactgtggagagtggctgccatcaagggctccctggtaatatggagaagaaaaacactttcttatgcaaacaacaccatctgggctctggaacttcacaaaaggacactgttaagtcacacatgagcggtatcttcatcacttacaaagggactaaaaatggtatcaagaaaccttaccgagttccattccccactcatattcctctgtggctcctttgcttaaacatgatgaaagacaccagagccatgctcaggctggtgcgtacctgctcagagttcaaattatggccactgtgacccctcatgccaaggaattcccacttctaacccaatttaggatggatgaataagttcgacattgatatgtacagcaactcttccctgttgatcttcactcaaggtttaaatcctcaggacgctcagttttggttccgttttgtttgttaatggagaagaggtgagtagaggaagaggcctggaagatgctcactgattgccaggggtagatctttctttttgtttgaatgttagatacatgtcttcatagtgaatgaggattaaataaactttagtatgaattagttgtaagtttctcatttagtttgataatttcttcagttttcctatattcttttccctcaagaggtttgtattttacgtattcctttgtagatgtagcttcacctttggattacttaggcttctgttttgtaaatttgacttccatattcatgtatttctctctgaattgtttttgcttgcctttcttcctgaagaaggcttacagtttagctgaaaggaatcaccatcactcttctgaaggtttccttaactctgcttcatcttaacccctttcccagtaccttatcctctctccagaaaaagtcatttcactttctctaatgagctcttggaacacagatttggtaaatatattaatcattctatgctctaatgtatttgcttatgtgtctaccctctaagctttactcaggttactttcttttttcttttctttttttttttttgagacggtgtctcactttattgcccaggctggagtgcagtggcatgatctcagctcactgcaatcaggttactttcttaaagattcactaacatcatttttttttttttgcatttaatcctgaaagtcaatatatgcctgggagctctctataaataatagccaacatgttgcttaactcaaggacaaataggtctgtgaattcattgattttgaggttttatttctgtagaacaccagaacaattttccagacgttgtttttctaattgtattactttttctcagattttattactcagataaaggaaactagagatttctttgaaaacaaacaaataaacaaacaaaccactgcctgctttgtgtttagactcgcaggcggtcagttgctgtgtatgggcagtatggaggccagccttgtgttggaaatgcttttgaaacacagtcctgtgaacctacaagaggatgtccaacagaggagggatgtggagagcgtttcaggtgcttttcaggtaacttgttttccataggctcagcatgcagattgtaaattcaaacgttatttggtgaacttgctcgttatatatttgttaaattttactgaatttatattggcctaaagttaattcccccaaatatcatcaggatttttgttggtatgttaatcatccactcagctatcattttttcaaatgcaaggggatgcatctggtaataaacataggaatgctctttgtctctttgaatggaactctagttactgacagacccaaaaagttcttgacagtgtattttgagtaaagatgcagagtgagtcttgtacatatattgagattagacgaaaacaatgttactgcctaaattattatatctacaagaaaagcaaccctaatgaactgattaaggagcaatacagttctctcctatgcatggggtgattgaaacaccagttttggcatagaatattatttgaccaatactctatgttgcatttatgcagtcagattaatgtaacaacatttagtaaacatttatgattcttgtttcaaatagtggtgagagttgtatatacaagtgaaacacatgcctcttccctcacaaatattaaagttttatgggcagaatagtacataaataatccctgtgttagaagtgctcctcagtgatacctgttgaacgcttattttactttcaaaatccaaattagataaccactccttcaggaagcctgccctaaatccccaactgatagaagtaattaagcaatcacttccatattttccttatgcatattgtaccatctgtcatttggatgattcgttggcctgaatgtctctcttggtgaactgtgaactccttgaagacatgaattatatttcttacatgttgacttctggagtccctggtacataataagttctcaacaaatgtttgctgcattggattgagtggcagtatagcagggtacatgtcctataaggacagctgtgcaccaaacatcctatgaggacatagaggaagaacatgcatcagagcctgtgaggcagcgatggttttcaagaggagataatgtttaatttgattcttgaaggacaagtaagagataggtagagaaaacccatctaggcagagagaactaaccaagcgcaagatcattggagatgacagaaagcttggccttttattcatgcaggtagtctggtatgactagggtataagaagctagtaggagaatggctggggatgatgctggggagataggcaggaactagatcatctggtactctccagtgcttccttggtactctagatttatggctatcataacaattatgatctatgtctttgtagtatttcctattagattgtaaagtatatgaaaagctggcaaaggccatttttattcatattcgtatcctagcccctattgtgctacggaaatgttgaattttaaccttttgataaaattgtccggctcttaaagcttacaaatttaaattaccaaaaaaagctcaactttgtcatcttagaatgacagaaaaaaagtgaaagttgaagggcaggaagtcagtctattttctcagtagtcggaattatataatttagacaagctgcttgatgattatgggtgagatcctgaaattctgaattcagatcctattttcaattttgtgtctgattgagttaagaaccatttccatgtgccataaaatggagacaaaatactcactagtcctttccgagacactctgaggatttatctcccatttacattggcgtatcagtgcagtgttacaggtagcaggaaaaccctttttggtcctgggtagtgtttctcctcttccctcttttacatttgcacgtggatttctctggtgttcaggtcagtgcatcagcaaatcattggtttgcaatggggattctgactgtgatgaagacagtgctgatgaagacagatgtgaggactcagaaaggagaccttcctgtgatatcgataaacctcctcctaacatagaacttactggaaatgggtaaggtgctgggcagcctcctgagtacatcagtgaattgtagttttaaattttgttttattttatagtttggtaagtctacgaacaagtcttctaataggcaagattattcattggctcagagctctttgccacatcctgagacagtatttttgttcacacatgtatacctgtagatacatgtggtagatgcagagtgaccccttgtcctgggatggtcctagttttagcgctgaaattctaattccaagaaacccctcaggcccagggaaacctggacagttggtcacttcatgggggttggaagggagggagagagagagaaaaaatactaattcaataatgtggggctattcaagagaatgaagagacaatagaatgagaacaggatgagaagagagacagaagcaagtgtgttgtaatatccaggctgaacagcaattgtctaaactagccaagaacctgtttccaagtgaaggttggaaaatactgtgtttacgttatcaaagagaattctgaagaatttttaagggtcatatgacttgttaaggtttcaagacctaaaaataacctattttagagtgaaagaagtaatttttctgaaatattttaaaatttattaacagagaaatagggtaaaattatttgaaagagtacaccattcagtatgctaagaggcaattagttaaaatttattatagagagctctctctcctcaagagtaaccttaattgtattggttttatctacagattcaattcaaaaccagctgttgccatagatacgaaagagccatgtgtttcccaaatatgttcttagatggaaagaatgttggattttctgagccattagttttagtgattataccaagcaggggaagctggataatgtatggtgtgtattaggatgctgtgctcttcatttgaactctctcaaagaagtgtttaagtgtaatgcattttaagaatttgtagagttctgtaataaacttttttccccaccaagtgctatttctggtttttaacggctttttatttcctccttctcctcctcctccttttaacagttacaatgaactcactggccagtttaggaacagagtcatcaataccaaaagttttggtggtcaatgtagaaaggtgtttagtggggatggaaaagatttctacaggctgagtggaaatgtcctgtcctatacattccaggtacttacgacgttattgatttccaatctggaattgtcagagagcattatttatatgatattgacttttacgtatttgttgagaatttacttatggcctaatgtgtggtcaatttttataaatgttttatgttgacttaaaaagtatacacagtgtttttgctttggggtacagggcaatgatacttttaacatgtgtcattcaagctgacatatccttatacctcatttgtaacttcatgttctatataggcccaagaccttattgtctgtgctggtgtaggcattaaactgaagaccctgtccatgactggtaatgatagtctcctgacactgctacagtgtcagctcacttaaaatgcttttattttaaaattgtgaactatttcatatatacaaaagggtgtggataacatatatgtgtaatttgaagaaaactgcccttatatgcccaccatctgccttaagaaatagaatattgccagtgacttaaaggctcctctatgcccctctctgatcacatccctctcactcctcaggcaactactattttatattttgtattaattatccttgttttttctataaatgcttattctttatatgtttttgtccctaaatataaatttgtgatttagttttgcctattttttccatttgtataaatagaatcatatctattcttctgttacttttttcactaaaagttatggatttgagatttactcatgctgttgcaggtggcatttttattgctgtttccaattttttcttatgaaaatgccttgaacattcttgtgcctgagtcccatacaaatgaactagagcttctccagggcatacacctggaactcaaattgctacctcataggatatgtatgtactaaattttactaggtaaagtatccaaaatggctggatcatttcataccccagcagtggggatgagtggcctccacttcacatgcttgccaacgttggtattgcttaactttttaattttgcttatgatctcagatctcctctgtctccaggcttctgtttctcaaaagctatttctgtcatacacacctaaactcacccgtgagtaggttttgatcaacacaatacgtactcatgcaaaacagttatggctttaggaaactttacggaagatttagaaggaagatagaggagagattttctgttgcagtaatgcaaacatgttgaagcaatagcggttggcatcttctatcttaaaacacttccacagcctcaacacaacgaaatttctggtctcatcgggtgttagcttctttcttgctctcgtctttcaagatcccctctctcactccttttcctccctttgtccccaaactccaaaaatgtctaattcagcttttaatattgattacttctaaatttgtaaacccaaactactgaaatgttcagacaaaagggccttttgcttacccaaattaaccttctccagaaagcagctttgattataaatagcaaacataccgtcttccaatttaccatagaataagttagttgcatttaagagttgttgagtaatataaatgagaagtaaaacagatctgaaaaataattgtagctaccagtttttgaatacctactgtggcatctacactattttaggtgattagcataggtttaattctcacagcagctttggaaagtaagcaatattttactattttatatatgtagaaactgaggcttaagaggacttcagctgacatactcaaagtcaccaaattaaaaagtagtagagcttagatctggtctgtcagatttcacagccttttatttttccattacattttactctccccatgtgtttcacttatttttcaattctaaattcaacgtggtgaataacatgtattacaatttaacctttggccagaaaggagaatgtaagacaggcatatacagataattttttttctccctctataccttagagaatatgttcctaattctttcataattataatgtggagacttgcatgtatatttttgaaagggtcaaatttagaaagttacagagcagagaaaataataagaaagagcgtttctgacttcgttggaaggtagacaggcaggaagtctgcatttctgaagaagagggataatttattaacaacgtgatcctgacattcattttcctcagcagggcttggtctttagattgacaactgaaatgccttccccatcactgaatgtgaaggtgtttgtcagagtagagggaaattatagcctgctatagaatgaggaacagagatgttttgaggagcagtctgagggaagtgaagtggaagccacaggcagtgagtcagccatgcaaatgctaaactcaggtgtggacgcggaggtggtgaatgtcctccatggttcaaataaattcatctcgggcccactgggtattcagctctctttgaggtggaaagtgacttttggcttattggaacataaatattagtagtaaatataaaacagaatcggccagtctctcttataatccctgtttcggtttttagcatcgcggtttatccagggcaaacccaatttcttgtcgagtaagctacttaactttgatgctgtgcacattctctgtctacttatacattttatacaacaaggaaggcatttatggcttgggaaggtgcccctctgccttgttcagcctgagagatagcagaggactattgtgtttattctcagtgtgtgatgaattgcagaagggaatgaattatgatcaaggtggaaaaacttcatggcttcttctgtgtttggtcttgaatatacttcattatatattttgaagagaaatcctaaatgcatatcaaattaaaaacaaaaacaaattctaaaggcaattttaatgaatgctgcattatctaagcctttgcttcctctgttggtatgaggactagatacctgagatttctaaatctaccttgttaaaggaataatttaaatgatggttaaaaatatctcacatataagaacgctttgtatactaagcactgttccaagagctttacatggacctattttccttataataacctaaggaggtaggtactggcatctcattttacaaatgataaaacagaggcaaaaaagctaaatagcttatccacagcatagaagatgacaaaggtgggatttgaactttagaagtctggctccaaaccccctcagagcagacactatacttacaagcattttatatagtatatatatgtatgtatatgcagtgaatatctctatatctatatgtatatcgtgtctcattctatatgtgggtgggagtgggagagagagagaaaatgaaaaaacaagagtgcaagaggaacacttctttttttttttttttgagagggagtctcattcacccatttgcccaggctggagtgcagtcgtgtgatctcggctcactgcaacctctgcctcctgtgttcaagcgattctcatgcctcggcctaccgagtagctgggattacaggcgtgtactaccatgcctggctaatttttgtatttttagtagatacagggtttcgccatgtcggtcaggctggtctcgaactcctgtcctcaagtgatccacccgcctcggcctcccaaagtgctgggattacaagcgtgagccactgaccctggcccgaggagcacttttgaataactgaatgaagttcaaactggctggattacacagtgaagtgtgaagagttgtaagaaatgaggttatgagtgatcgggaaagtaaataaaaaagacttttttctggttagttaaggagattggattaaaaaaaagagtcagagagtttaagaagggttgctactcttatgaacagtggagaatagattggagggtggccaactgggggaaagaaccttggttagaaaactgttgtaataatccctgagagacataagagcggcctgagaaaacttggtgagcggctgaatgcggggtatgatggagagtgagcagtctgggatatgaatgggtttctgacttggaccaatggccagatgaaaatacaaccctctgagatgggtaaagacccatttgcagggagaagacaaatccagtttaggtatctaaagtatgtccaagtgctcaggagaaagtgtttgagctggaaatagacatttggtgattattggtataagaatggtaattgaagccacagagtggagaacactgttcctcttggaattagcatagaggagtaatagaaggagatgcgtaaaggagtcttagaaggaacagccagagagaaaaaaagaaaactagaaagccaacagaagagagtatttccagtaggagagagtggtcaacagtgccgaatgatgttgagagaagtgttcactgtctggtgaaataagaaaggtgccagcagcattgctggaagtcagaccattgtaagcggaagagtgaatgggaggtgaggaatttaagataattaattatagtcaactcatttaaggtggtgagatgggaaagtaggaaagaaggaatatatagtaacaggtaaagcatttcttattttagttggttgtattagaacatgtatgttttgatagaaaggagccagtagagcaagaaaaatggaagctgtaggagagggaacaatcaatccatctaatccaccctttgaagaagtcagagagaatgcaatacagagaagagagagaaaatttatcctaagacaaagggagggacacctatagagaaaaagaaggaaagaaaagttaataagtttgtagatttgttagccagcagtttaagaggtctctgaagatgggagtttttgtaaagaaagaggtaagatcatcttctgagagtgaaggaagtgtctgtagaatcgaggaattgaattttgaaaaattttcaaaattttgcagaatttaaaaataggtactgtagagaatgggaggagggaactgactagagaaataaagtattgttggctggttttgaggattctactgaagttgaaaagcacgaatggatttgtagtggcaccaatccgtacagttgtgcgattttctttctttctttttttttttttttgagacagagtcttgctatgtcaccaggctggagtgcagtggcgtgatctcggctccctgcaacctccgcctcctgggttcaagcgattctcctggttcagcctcccgagtagctgggattacaggcacgcaccaccatgcccagctaatttttgtatttttagtagagatgggtttcaccatgttggccaggatggtctccatctcctgaccttgtgacccgcccaccttggcctcccaaagtgctgggattacaggcataagccgccacgcccatgcctggcctagcaagccctggctgggtttttgccaggaaaacatgatagcaggtcatctaggcaaggaagttaaatccattggcaagagaatgattgaagtcatgagccaagaagcctaagctgaaacaggaaggaagtgaaaaaactgaaagtattgatagggagaaagggggagaataagtggaagaacatgtttctataatgtgaaataatagatgtggcaataataaaaatgagagttaaaagaataagagatgttagaatataggatggttgaatttgggatttcagaggaagaatcagtcttggagaatccaggatctaagctggaagaaggagggtattaattaaagaaaatttaataagaccacaccactttgagaaagatgattcctgcagctatgtgtaggtagataggagtgagaagatgctgaactaaagcagctgagaggtttatttgtatttgaattgtggatataaagacaggcggaaataggctaattttttttttttttgcattgaaagggatgtgtataacttttctttctccaaagagataataaactaaatattttttaaatcaataatatatatgtgtgtatgtgtatatgtgtatatacatatatgtgtgtgtgtgtatatatatatacacacagacatatatatattctcccagcccaagctgaatttttgcatctgacttttaaacaaaccaatttcataatgtgatggaaataatgctctaataaaagatttgttgaaatccatcttcttatctttcttatctttttagcatgcatatctaatactcaatgggggtagtgataacagtcatattgtattttctggtattttggtgtatttctgtcttgtattttttgactgggcatatacttgcatgattgtggttaatagcatcttcacacttatacctgtcttcttatttaatgtgacaacatgaatattttgctttcacaagcatcatttagtatgactgtgtaatattgtcattttctttccttttagttttcaaaaaagtatatcatttccatcagttcaatttcctctgttccttatgcttggatctcaaacgcagatgtgtatgtatatataataaaaacacaaatgcttgtgaaaggagagctcccaatttgaatatttatatagaacaaacacagtgagagggagtcttcttgcctgatttgtttcattcccacagggactgacatttttagcaaattagttgtctataactttaacaaatcaagagagttttacatgaagagtcaaatttatcccttggaaaaaatcagacaatttgtcaataccagaacctgtagttacatctagtgactgtctagtggatttgagtgttgtgtgtcccttttagacagggtacgtgttcactttttcatcaccatgctgtccactggaggtttccaacattgacattacttgccagttccctgtgggcatttcattttgacacttgatctaaagcaaaataaaggataaatgaatgattgtctcttcaataaaagctgaagctgtcacttctcatttagctacatgtgactaacctattgtctactttaaaattcttttggggtgaccctttcttctatctagcaaagaaaaaaatgcaattttagcatttatccaagtgaaacagaattagaaaattaaatccactattggatcacatagaacattccaaaacaaagtccaaaagagctaattgtttcatatcacctatttgcatctctgttcctctttgttagatgaaaaatcaagaacgaaattctttctagttctctgtcagtgtagcttttgttaatttgctcgcttctgggccaaatgctgacattaaaggaacatggaagttgtttgtacctaaatgcattttgtgagtcacttgggattgccattgttggtaccatgtgtcctgcttaataaaaaaataatcgtagaatgaactctttccttataatcatactggcctggtcttaatgagagtcacagttgctttgtgccaatgaagagcttttctctttgggaagattgcatgaagaaagtatgcatgataaaggatccagcattaatttagtcatagcaaaatttttcattttctttgtaggtgaaaataaataatgattttaattatgaattttacaatagtacttggtcttatgtaaaacatacgtcgacagaacacacatcatctagtcggaagcgctccttttttagatcttcatcatcttcttcacgcagttatacttcacataccaatgaaatccataaaggaaaggttagtataaaatgtcagttaacttttccatgttttacttttttaagtattgcttacattaataaacttgtatttatcaaaaggatcagctttcatattaaaattagtaatagtaatagtacttcctttaagagtcaatgcaatatctttctctaaaaggtacaatattgtctcattaaatctctttgataatatatttatttatactggccaggcacagtggttcacgcctataatcccagcactttgggaggccaaggtgagtggattgcttgagcttgagctcaggaatttgggaccagcctgggcaacatagcaagaccctgtctctataaaaacacaaaaattagctgagcatggtggtgcatgcctatagtcccagctacttaggaggctaaggtggaaggatcacttgagccttggagggagaggatgcagtgagccaatatcatgtcactgcacttcagcctgggcaacagagtgagaccctgtctcaaaaaaaaatacatatatatatatatatatatatatatatatatatgtatatttagttatagttttaaacttctcattaaaaatatttgtttttatttgaagatgtttacaaagcccttattaccttgaaatcttctattttaaacgatcttaaatttcttaaatttgtgattactggtgatactattttaagtgtcatatacaattttaaaaaatctaattaatgcttatatatgcttcttaaatgcaaatgctagaggctttttagatggtgcatgaagataaaatactttaaaaacactttattacttttgagataccaacatttttatctaaggaagttaaaagacatttttaaatacttcattgttttgaaatactaaaaccttcctcttgagaaatctgaacagtagagatggattgtactaattgatatacagttatggctgaataatttttttaggctaattattattcacaatctgcacatttcatcacatcttaaagttagtaacttgattaataaatcacttaggaaaatataaggaatattgattttatttgttttatgactgagaaactgactatggagctatgagttgtaaaaacatttattgtctccacattatattgttcacaaagtggggatttggcaaaagtagatctgtgatctgtcttggacatcattaaaagatgcttaggaagtgtttaaaagacttcattataaagtagcttcacctgcaaataccctagcatgggagataaatcatacctacaagtcattgtcaagatgtggaccatagggacacattattttatatacttatatttatcagttgatagattaattctctttttctagttgaagatggcatagcaacttggtcttggggttttggagtttatataagaaattatcatataatttcttcacctgtaatctcagcactttgggaggctgaggcaagcagaccacttgaggtcaggagttcaagaccagcctggccaacatgatgaaaccctacctctactaaaaatacaaaaattatccaggcatggtggtgcatgcctgtaatcccagctactcaagtggctgaggcaggacaaagctgaattttcctgaattaatcctgaaccctgaattaatgctttgttgatttcatattgagagaagggtcctcactatctgtccagatgtgggaggggatggtggcttaacatagcattactcagattttttttttttttttttttgatattgggtctcactctgttacccaggctggagtgcagtggtgtgatcacggctcacttcaatcactgcctcctgggttcaagcgattcttctacctcagccacttgagtagctgggattacaggtgtgtaccaccatggcaggataatttttgtatttttagtagagacagggtttcatcatgttggccaggctggtctcaagtgctctgcctgcctcagcctcccaaagtgctgggattataggagtgagccaccttgcctggccattactcagatattattactatttgagactccaaatattcctgattgcgtccagtaagtgggcccataagagtgctcatcatgcgtcaaaaataaaaattcttgtagtcttggttgattggagatgagagctgatgaaggtattgaacagagaactatttccattgcctttttatcttccacctaaaactccttgtactctttcttctttccacagagttaccaactgctggttgttgagaacactgttgaagtggctcagttcattaataacaatccagaatttttacaacttgctgagccattctggaaggagctttcccacctcccctctctgtatgactacagtgcctaccgaagattaatcgaccagtacgggacacattatctgcaatctgggtcgttaggaggagaatacagagttctattttatgtggactcagaaaaattaaaacaaaatggtacagtattaaaaaattcgttgtctaaaggcatttctgggattttaatggggaaataacatgtagttaatgtaagcttttgagctttaaaatttgacaaacagaaatttaaattgcaaaggaatctaaaattgcaagaatgtattattgtctacttaaaatcttatatggtttaagaaaagcctgtctactgttttgcatagtaccttgagctaaatcattatcattattggctatctctagagggtattggctgggtttttagaatgctttttaaactttccactttctcaaactaaacagcatttctcaagaaaaactaaatgaggaatttagcaatatttcagaaatcaagatgtttaaataagtatttcatttacctttgttttttaccctctcattcttttaaaaaaatcctctctgaatatcataagtttgtttactacttaatacttgtaacaatagcttaaattgatgggataccttcctcatgacaagtgagttacatgtattagtaataatccttactactacccaatgagatgggcattataatctctgccccacagtgagaaatagagactcagtgctattatgagacttatccaaggtcatgaagattgcaaggagggtatttaaggctgggtctaactggcctcaaagtcagtttagcttattccttatgctatgtcactgctaaaattgcctgattttggttagaatcaggacatacccctgaattaatgctttgttgatttcatattgagagaagagtcctcactatctgtctagatatgggcagggatggtggtggcttaacaaccactcctcctcttcagagactagccttggcttactaatgttccaagtcaaaccttttttttcctaactttgtcttttagctgatgcccacatttccctctctattccaaatcccctcttcaaggtctttctcttcagaaaagattctgttacaaccttggagaagaataagatctcttacataagattcagaggaagtcttttagctttttaaatgggtaaactataatattttttcatttccactgagctatttttttttgaagttctctactacataaaatttaactagaacttgatcttttcaaatcttataggttagaaatgagtgcacaagtacaggtttttgtagcaacgacaaggacactatttctttggagaattaatccagcaagtagtttggtctaaattcagttttacttctttttattgcacttaaaagaaatggagaggattaaaaaaacattccaagctggtaaaattaaatttttcagtaaaaattttactcttgagcagtttatgtttttcctaaaatttttatttaaatataatcataacctctgggatatagtgtatgccccaaataattgttctttaagaaacattaaggttattgtaatatagttagtaaatgagaaaatatatttgcacattttagtatttttctatcctactttcaaaaaatgcattggcaaaaaaaaaaaaacacaaaaaactccccttgataatgagtagaaatgatcacattctaagggtataagtcatgggaaggagatgttggaagtcacagatgttaaagatggagagattgaaccagtagaacttgaattttaggagttaattcctgtggaaacagaagccagctttgggagccttaagtagatttgctggaagaagctgtcatgctcctacttttattgatttatcttatgcctaagaagctgactgtaaatgggtgaaagatatcactctttggggtgttcaatttctactccctgcacctttttatgtagaaatctcttctgcctcccctctgaagctgatagaaggaaaataacaaaagtcaattttttctgatctttgactcttctagagcacttgaaaatgttcatatcatgtcactcttgattagatggccatagtagcagcaaacaacctcttatccctactctcatatctgaagatcttcaaggaatgcagaaattaaacatgtctcttttacattttctcccctagattttaattcagtcgaagaaaagaaatgtaaatcctcaggttggcattttgtcgttaaattttcaagtcatggatgcaaggaactggaaaacgctttaaaagctgcttcaggtaaatggaaaaagagcagtttgcattgcaagcttaacttcttttttttttacttttaagttcaagggtacgcgtgaagttatgtaggtaaacttgtgtcatggggctttgttgtacagattattttgtcacccaagtattaagcctagtacccactagttattttttcctgatcttctccctcctcccactctccactctccaaaatgccccagtgtgtgttgctcctctgtctatttccatatattctcatcatttagctcctgcatatatgtgaaaatactcaatgtttagttttcttttcttgctttagtttgctaagaataatggcttccagctccatccatgtccctgcaaaggacatgatcttattctttttttatggctccatagtattctatggtgtatatgcaccacactttatccagtttatcattgatgggcatttaggttgattccgtgtcttcgctattgtgaataattacaagcctaacctctactccagtcttctattgttaattcttgatctccaaaggcttttgaggctttatcaggggttctgctttgtgttttaaaaaatctatttggtaatttttgtctctgctctctctttcatgtgtcaaggtagtgagacatcacacaggatagggagttcaccaggttatctcctctgtattataaatatgttatcagtgtgcagcacttttctcctttatgatgattggcaaacaagcctagacaagtgacaatatcaagagacagttcagtttcacttgctgacatggctactccgtggaggtcaggtttttggtgcatgctggttggcagtggagatggggggaaggtggtatgctagtctttgggtgattgaaggaggactgaaagggtaaactgatctagactgtgagggtaccatgttaaggagtttggatttcattctgatggctattgggttccattaaaagatttaatacatggagtgatgaaataaaagtttacctaagtaaagttgtagagaataaagaagaatggagaaggaaacatttggcaggattaaaaaacaagagatggaaagtaaaggaggagtgaggtcaacagagtgaagataaggaccaaaaaatgttcactggatttggtgattaagacttagttgctgcttttgagaagtgtccgttcatgtcttttgtccatttttaatggggttatttattttttacttgttaagttaagttccttatatattctgaatattagagttttatcagatgcatagtttgcaaatattttttcccattttgtgggttgtctgttacacattgatagtttcctttgctgtgcagatgcaggaacaggaaaccaaatactgcacattcttacttttaagtgggagttaaacactgggtacttatggacataaaaatggcaaaaatagtcactggggactgctagagaggggaggaagggaggaatcaagggttgaaaaactaactattgggtacttactctcactacctgggtgttgggatcaatcacactccaaagctcagtatcacataatccacccaggtaacaaacctgaacatgtaccccatgaatcgagaataaacgttgaagagaaagttgcttttaaaggaagagattccatagtatggtaggggtgtaagtgagactgcaatgcattgtgtgaggccatagactgagcagtatcagagtttaaatcctcttggggtaatggcaaaagtggacactgacccatgtgtcatggttctcagtgaagaagcagggattcttgggatattggtagatgagtgcaagaaggaggaagataagtagtaaaaccaggtttatgtactcattcacttgcttcattcatcaactatttatggagtctgtggtatgtgccaggaatcgttttagacactcaagatatagccgtgaatatgccagagaaagtgcttgtcttcgtgaagttgacatgtcagaggaggaaaagtttttgaatgaagtggaaaaagaatgatctgaacatagaaatggaagtgagagctttgagaagatgttgacatcagtcttcagttgggctggcagttggaagctgcttaccaattttattttatttcacatttaacaaacacagggcacctactgtgtgccagcacaattttaagtgatgtacaaaaataaaccagtgtagtcctcctacctatgtgttaagtattattcatattctcattttacagacagggacactgaggcccagaaatgttgcccaagattatcgttaataagaattagatatgaaatgcaaatgcataaaatttggcttaacagtctggggtcttgacttgcattgggctgccttttctaggggaaaagagttagctggaacagagagctcactggggtatggaaagggaggctaaagccttaaaaaaacatcatgatggtagaatctgtaattctttttatttatttatttatttatttatttttattatactttaagttctagggtacatgtgcacaacgtgcaggtttgttacatatgtatacatgtgccatgttggtgtgctacacccattaactcgtcatttacattaggtatatctcctaatgctatccctcccccctctccccaccccactacaggccccggtgtgtgatgttccccttcctgtgtccaagtgttctcattgttcagttcccacctgtgagtgagaacatgcggtgtttggttttttgtccttgcgaactggattaagaaaatgtggcacatatacaccatgaaatactatgcagccataaaaaatgatgagctcatgtcctttgtagggacatggatgaagctggaaaccatcattcttagcaaagaatctgcagttcttacataggtgtgctggctaaggcagtgattctcaaactttaatatgcatgacgcttacctgggggattctcttaaaatgctgattccaaaggttactcattctctcagatattctcctgtaggtcttggtggggactaagaaatctgcagttccctcagatgattgtgattcagtaatacagggatgggacgtgattcactgcattaaaaagtgttactgtatatattgaaaacacagctaacaatgaagacgaggaagcatcaggtgatttgttaaaactattaagatttacagtcacagaaagtcaaatattgcatgttctcatatgtgagggttaaaaaaattgatctcatggagatagaatagaatgataattatcagaagctggggaggaggaggggtcaatgaagagagattgcttaatgggtataaacctgtagttaggtaaaaggaataaattcgactaggcgtggtggctcaggcctgtaatcccagcactttggcaggctgaggtgggtggatcatgaggttaagagatcgagaccattctggccaacaaggtgaaaccctgtctctactataaatacaaaaattagctgggtgtggtggcgcacgcctgtagtcccagctacttgggaggctgaggcaggagaattgcttgaacctgagaggcagaggttgcagtgagctgagatagtgccactgcactgcagcctagcaacagagcaagactctgtctcaaaaaaaaaaaaaaaaaaggaataaattctagtgtttgatagcacagtcaggtggctatagttaacaataatttattgtatattttaaaatagctagaagacaagatttgaaatgttcccaacacaaacaaatggtaaggtgatggatatcctaaatatcctgatttgatcattacacattctatgcatgtatcaaaatatcacatgcaccccataaacatgtaccattattgtgtataaataaaaaataaaaaaacaaaaaaagaacctgtcaggctttaatgatttctgaatatgagtacaatatgcttattttatgaaattgcaaaatttggacagttacaaggaaatgaaaaccactcaaaatccgatctgcaaggttggaaatttcttgtcatgaccattacaaatggagataaagtatttctaaaattatgaggcacataaatggaaaagaagcttccattagcatttcacacttttcagaacacttttcatgcgttaagtaatagattcctgttaattaacagcttattttattcattgttagtataccagatgcaataaactgttttccttccaatattttattatgaaaattttaaaacatatagacaagaatgttgtaataaatacccatatacccatttcctatatacaattagtattttgtaatttcactacatatatgtacatataatattgataatattgactgattctttgaaatatatattatgtatttaaagtgtttataatatttgctgaactatttggaagtaagtttcagatatcataatacttcatcactaaatatatgcatgtaacatctaagaagaacattctcttgcataatgtgatactcacactaaaaatataaagaacatgaacaataattccctaatatcatctgctctcaggcaagagttgtttttcttttttaaaaaatataccttagttttggctaggtgcagtggttcacacctgtaatcccaacactttgggaggctgaggcaggcagatgacttgaggccaggagttcgagaccagtctggccaacatggtgaaaccccatctctactaaaaatacaaaaattagccaggtgtggtggcgtacacctgtagtcccagctactcaggaggctgaggcatgagaattgcttgaacctggggggcagagtttgcattgagtatgccactgcactccagcctgggctacagagtgagaatactgtctcaaaaaaaaaaaaaaaaaaaaaaaaaaaagaaaaccaccaaaaataaaataaatatagcttagtttttagaacagttttaggttcacagcacaattgagtgcaaaatacagagagttcctgtatatcccctgctcccacacaggcaaagccttccccactatcaacatctcctaacagagtggaacatttgttacaatggatgaacctacattgacacattgtcatccaaagtccataatttacattagggttcactcttgatattgaacatttaatgacttttgacaaatgtataacgacatgtgcccaccattgtagtattatacagaacagtgtcactgccctaaatatcctttgtgctctgcctattcatccctcccttctttctgaccacaatttatcttttgactgtttccatagtttggctttttccaggatgtcatacaatttgatagtttttttaaatacttgatagacttttcacttttcatttgctttcttctgtataggaacccagaacaatgtattgcgaggagaaccgttcatcagagggggaggtgcaggcttcatatctggccttagttacctagagctggacaatcctgctggaaacaaaaggcgatattctgcctgggcagaatctgtgactaatcttcctcaagtcataaaacaaaaggtatgtcaggctttgtttaaagcaataggaagcagtcatgtttatttgcatgaggaaaacgaaggtggttaaatcaagatggttaaacagacatggctgtaattagcattttccgtatcccaattatattttgtagagtaaaatgaatgcacacataataataagaaacagaaggtgtgttatactcatattttagttgcaaatgttaaatgtcttgcaatttccaagataaattaatgacaaaatttgcatttttaacttttgatctaagttcgattatgtcttccttggtccctaattcagaggagttataaattctagcaaggggaaggcatgaagttttgccttctgttatgttcctatcacctttctttgtgtggccatggcttgtgggctcctgaagtcatacaaagtaggatagtaacaagttggctggcagaattttaacatgttttattgttatcatcaattcttttataatgcaacaaatgtgtttctaaaaatcattgagctatgcaaaattgcacaataaagggcttaaggaaaaaaaatcaggttagagacacagcactcaaattttcatctgtcacactcatatgaaaaagacaggtgccaataaaaatacttgcatggttttatacatgttaaattattaaaaatgtatctatactacaataagtgtggtgcattacctagaaaaagacctgaagctttctgggttttggaaggtttacggcttgtgagttactgtgaagtgctagaaggacgccagtcagaaacccgacagacatttgtaacagcagacatgaacagtatagtttataatgcaggaaatgaactgacatagatgttgaggggtgtgtgagtgtgtgtgtgtgtcaacgcacatgcgtatgcatgagttttgtatattcctatgtggcttgtttccactgtgtgaagcattttgtgttcaccctgtgtttcatgtggacatagttgtacataagaaaatctcaaatctgtgctatactcaaaattttcagtatatcaatctcaatggaacaaattccccttatcaaaacaaacattatagcagaaccgattctatgatttattccctgcatgaaagtcaatgttccaggcaaagcctgattttcagagatacatttcataaactcaaaaattgcaataggtcctcaagtcccctcctaacacccataaattgcccattggcttccaaatatgggtgagggagggagggtgaaattttcctagaaagtcttatcttaaaggaccatctgttaatattcaaaatggcctgtattcattgtcagcatcccatacaaatctttagaaactcttgattacattaaattattgattagagaaagacacatgttctttaacagtctccatgtacttttccacataggactataaattatcatatttgtgctacctttttagcagggcaaaaaaggaacagagaaagaaaaggcactatgcaggtacaggtacatgactatgcaaagccatcgtgttcgcaacagcttgggctctcaggaaccaatggtgcatatctcttcccagttcaggcatcatggtggcagcctgaaattggctatggtgagagcagttacactgcagaaactggcaaatgctacaaagcagagacatttctgttcctgggagagcagactgttaaaactgagtcagcacatctgtgatttcaaggttgcttttcttctgaaatagccaacgcagagtaataatgtttacctgttttaaatttctccatgaggaaagaatccatgatttccactaagagatatgttaaatctctcagtcaggaaatttaattctaaatttaatttcacttgcttctttgctgtaactagaaaatgaatgtcctattttattttattttattttattttgagatggagtttcactcttgttgcccaggctggagtgcaatggcatcatcttggctcagcgcaacctccacctcccaggttcaagtgattctcctgcctcaacatcctaagtagctgggattacagacatgcgccaccacaccctgctaattttgtatttttagtagagacggggtttctccatgttggtcaggctggtcttgaactcctgacctcaggtgatcccccctgccgcagcctctcaaagtgctggcgttacaggcgtgagtcatcgcgcctgggctggtttttttttgttttttttttttttaaatcttacgcatgcacagaagatatataaaaaattcctcccccatgtgaccctaattttccctaagtttgtcttgattttgttgcaaagagagtgcactgttttcctttgtatttgcataagaaacaattgtaacaaacttgcccgtggcttttgattttgttttaatgagagtcgtgcctaaacatgaaaagcaaaatattcttgcctaaatccctgattactgactataatgtctttatctctatagctgacacctttatatgagctggtaaaggaagtaccttgtgcctctgtgaaaaaactatacctgaaatgggctcttgaagagtatctggatgaatttgacccctgtcattgccggccttgtcaaaatggtggtttggctactgttgaggggacccattgtctgtgccattgcaaaccgtacacatttggtgcggcgtgtgagcaaggagtcctcgtagggaatcaagcaggtcagtggggtgaattttctctagccaccctgtacacattgaaagggaattaccctgtttctctgctccttgagatgcttctttgtgtatgaagagatgaagtctcaaatgaatttagaatcctccttccctttcctacttccagattatagctactgtggttaaggctctttgctgttatctctatttatccatctgaagtaacagccccactgtgccctccacttcccattctctattagaatagagttatgattaaaacaccttcatcctctgtaattacctcaataaggttttgctgtagcaaaggtctgtggagcttgtatatttgcattgcctaatctttctgatggcatgctctttgaaacatttctatttctattctgtgtgatgtactatcaatcactcacaaatatttgttgaacatctgctgtgtgctctacggtgtatatggtgcttcaagcacttagtacagggctatgtgaaattgactttatgagtagtcaaagtatgactacaatctatatacttttgtttctatatttatgtacatgtctgtctcttctagaacgctcattacttaaggtcagggctgtttgattcctttctttattcccagagcttgacaaaaggcttgattcatagaagtcactaaatgaacgataaatgaataaatataagactaaactatagaggcttatatacaagcattacaaaggcatccttatccctaaatgtctctccaagtggcctgttctggtaattaaaattctacgactgtgattcattcctttgtggcttggatttccccttatctgttaaaatggaagcacactctcctgctgtctaattaaatagaatggtaacatttcctgcccacctccattcactgttgtgagaagtaaataaatgatacaacgtacgtaaaagtgctttgaaacagttgtaaaataatcaacaaattaaggatattattgcaagaggttcactaatgcaaccttaatatggacattcctagtctgtatgtagagccattctgaacattgtagaaaacctcaatgaagagtgaaggtaatcaatatccagaatgatctcttcctccaattaacttgttagcaggaagcatagcactaagttcccaagccctctttaagaacttattgatcaacctctttctcatcttgtaggaggggttgatggaggttggagttgctggtcctcttggagcccctgtgtccaagggaagaaaacaagaagccgtgaatgcaataacccacctcccagtgggggtgggagatcctgcgttggagaaacgacagaaagcacacaatgcgaagatgaggagctggagcacttgaggtaatggagacccgaccccctggcagttgcatagaacacagtaccctctgcagttagcatggaacacatgattgctgctgtcgagagatttagaagttaaatggctatttttaccagggactgctttgtcccttagcactagggtgagttgaaggagcttgctctgtgtgcttcaggttttcctgaaacaagtgttacaaaaggctgggtaactgggagtagtcctgctgagtggatacgatcattctcattcgttttggccacctacttgctgtgtgaccttgggcaagttactggccacatctctaaaattagcatgataatagcaggtaaactgatactaagattatctgtttattgttactgtcagaattaaatgagattaagcacccaaagtgattactaagcattcattaaagtttgtattacttttcagatacaccattcttactcatttattttttggattaagcatagagccagttgcttgagatggagaatatcttggtgggtaaacccagtagcctggcactaaacttcccatttgtcaggaccctgcaaaagccatctcaaaaatgctcagttgatgaatcatagccctgggtcagaattctttatgccacaccctactgttttacattgtccttagtaatttttgctgactggacttggcaaaatattctagtaagataatttgaaggtcatgtgagttgaagaaagagatgaggtgcttgggtatctggtagaagcgtagggtgaataaagaaaaaagaataagttgggaagccttattcctaaatctttggtgccttgtaatctggcattaatcagtatctcttgactgaggaagctggcaagcatgtgaactatggtgggaagaggatgctggctgctgtgcacatgtttctgggaggatgagggtctgggaggagatctctgagaggatgcatttttcctgctttttgacataaagctaggaggagaggtacatcctaagaaagtcattgaagagatttttcactcttggtgctcaggggaggggaagtatcatctttctcagtacaaataggaaaattaaacttgccacagtttcctcaaagtatggcaagattataaggaactcagatgagaaggaggccacactcccaggctatttgtactgctttctctcagattttgtgtctctagagtggagataatattagtgttattttgaccttagaggcagtcttgaaaaccattgtttaatgacagatgtcatcattatcattatctttattacaggctcccccaagagatagtcatagtgatggtaaagtgtcaggattggcacttgtgggatgatattaggacttctgttctcccatcttccttttaggcttaagattcttactccaagccttacttaaacttgctttcaccaaataatgtgctttcagttatacacgttcagaaaaaaatgtagacactaagacttcgtatttctctattgccttgtgagaggtagaaggtgcacaattgtaggagcctaattgactatacgtaaatccagctttggtatttattagttcataatcttggacaagttatttgaactttctgtgccattgttttttccatgtatctcatggtgttgctgtatgaattgagataatgcatatatgcagagcaactgccatggtgcctgacacatagtaaatgcttagtaaaaggtagttataattttgtgttacctctcttttggggtcactaactctaattaccttcttcttttttttttttgagatggggtctcactctgtcacccaggcaggagtacagtggtgggatctcagctcactgcaatctccgcctcccaagctcaggagattctcctgcctcagcctcctaagtggctgggattacagatgtgcaccactgtgcccagctaatttttgtagttttagtagagatggggtttcaccttgttggccaggctggtctcggaactcctgacctcaggctatctgcctgccctgtcctcccaaagtgctgggattacaggcgtgagctgtcgcatctcgtccaataccttattttcaatacagaattaattctgtattaaatgaatttcagaaccaaacggcaagaggaaaaataggttttgaaacaggtgacctctagaaagcagacagtagtatgttggccaaagactttctttttcttttcattctttctgtttgtttttcatactactgacctagcagctatttaaatcactgtcttttgttagcttgagtttatgtttgagttttctaccacaggatgtaagcagatatttggttctaagaatgataaaaatattacaccaatgtacttaaatgaatggagttccttcagatacaaaggagaaatccaacgtaatgcaaaataattattatactgtgcaaatcaatcacattaattacattttttttccttccaggttgcttgaaccacattgctttcctttgtctttggttccaacagaattctgtccatcacctcctgccttgaaagatggatttgttcaagttggttatgaaagatatttttttcctttataatgctctaacttctatctctctgctgagcccataacctattttcttcctccatggtgaagccgtgccaaaaatattttatatatgcattttagttttagtggtgagggttttagtgtgtgactttttttctttggcccaaggtgatgtgaattctgcagaaggcagtgtatcttctatggtgtgggaaatcaacactgccacccagtgaatcaaaaatgtaatcatgccagagggctactgaacactgccaccctaaacaccaaactgcgaatctacaagcttgctctttaactcacagagcttctcttatttttgccactgacttttttttttccccctcataactgtaggccctgggatgaagtattaggtttattccaggagtcaataagacagttagctagagtctagtgagatatggatcattctactttgagcaattgaaccttcctgttcaggaaagaagagtagtcatctgccatttgtcattctagggacttttgttgttcttggcttttgggacattttcgttaatgctgctctcagtctttatgacgaggctttggcctgaagccccagtggtgcctcttcatggctcacacaggatattgttcatgaggactctctccatgttaccagcactgctttcctcacaagggattttgcttttcaaaccccaggcccttgaacatgcattcactgaaaatttactgtttccccaaatgtaggcactattgggagatgaaagttgtgtgttcacgcaagtgtgtgtgtgtgtttgtgtagagagagagagagaaaatcaacctagcatctctaccacccattctgtcctaccacagccaccgtaattcatggagttcctgaatggaacatatgctcagagaataggccaagcaaactcatgcatgttagcaaaccatgaggctgctgtccccaactgcagtgtgtgtggtgttgttttaggagccaggagtcccaaatattgctctgtggactggctgcatccgaatgactcagggaacttaaaactagagatggctctttctcacttgtcctccacgttttctgatttgatagtttgggagtacagcctaagagtctattttgtaatttctacaagtgattatgatatacagccgcatttgtgcactgttgaatcagacttcctcatatgaaagtttttgttttgttttgtttttgcaaggtggaggaaggaataggatcatgagtcgaaacagaacatgtgctcctccccatttccctcaaacctcagcatcagcctggcccattctgttttctactaacttccatgatagagccagagtgggccaggaagcacatactgacaatgggaaggagatatcaggaaatcttgttctaatccctagagcagagctggtcaaggcctgagctccaagccctctcccaggcttgagtttttcaccatccccttgggtggaagacaatgagaagggtaaggaaagagagaccctaaatgagtgtgattacccttcatccatccccaggctcagacttcaaattccaccttgcttcgccatgaaagctcgcttcctgccattataggttagtgaaacgttcttgaatctgacccagccccagcagcattccatacatatagtgtggagtaggagggtaggatgggagaagatcaacattatgcttcccctaaaagttatcagcaagaaacttaaactttcatgaacatactaataggattggaaaatttctgggtgttcatactgacattttgtaggcagtatggcagtattgtcaatgaacagctcataatactttttttttttttttttttttttttttttttagagagagagagacagagtcttgctctgtcacacaggctggcatgcagtggcactatctcgcctcactgcaacctccgtcccccaggttcaggtgattctcatgtctcagcctcctgagtagctgggactacaggcatgcaccaccatgccctgctaatttttgtatttttattagatacagggtttcactatgttggccaggctggtctcgaactcctgatctcaggtgatccacctgccttggcctcccaaagggctagaattacaggcatgagacaccatgcccggcctggtaataccttaatatgaagagttgactgacaaagatgttctccaaatctaataaagaactgatttttcctaaaagttaaaggaaaagaaattatttggacagtgtccaaataattttaatagaatgtaattttagtagaatgcttagtatagtccttggtattttgggagcaatcaatacattatagacagtggtattaatagttttatttcaattaatggtggtgctagtgttactaactatataggggaaaatgtttttatagacacttttctgaatcaattaaatgtagcttgcctgatgattatgatttatagactgaatatatgtaaagaaacgttttgttaatgcaaaatagacaaactctttccttttccatcttttacttttgtttaggatgaaggtacaatgtttcctgtggggaaaaatgtagtgtacacttgcaatgaaggatactctcttattggaaacccagtggccagatgtggagaagatttacggtggcttgttggggaaatgcattgtcagagtgagtggcgtcagttgtatataatttaagatgagaaaattacgtggaagagaatgaatcaagataaataacactcaccatatggcccatgtgttggccttcctttcctgtaaggctgacatgatcctgttcaagttttaggagcgacttgaataagccctccgccttctctagttggtaatgttcccattcagtgaggtcaatttcattgcaatttaaaactttctggtgcaaattaaagtaggccagggaattctctttagatgaagaccattaggatattctttagagttcagttactcaggatgtaccacaatcaatcaactttcttaaatgctttgcctcctgttctgtttggatagaggcatctgaataacagcatctgcatgctgcaccaccctaaaactactctggcttccatctctcttgcaatataagtttgttcagcaaatgaataggccgagctgcagtgatacatttttcctaaatcagttgctctgtgctatatgaggaaagcgctagtgtacacacacacacatacatatatttctccctttgggaatatacctattgtgaaatttctgagtaattgggtattcatacattgggtatacatacatttagatttagtggaggctgccagccttccaagtggttgtactgatttacatctctagcataatctgataaatcaagcttgcttttgtccttactaacacttgatagcatcagacacagtggtgagtgtatagtgatatatatatatatatatatattttttttttggagacagagtctcactcttttgccaaggctggagtgcagtggtgccatcttggctcactgcaacctccacatcccaggttcatgtgattcttgtgcctcagcctcttgaatagatgggactacaggtgtgtgccaacacactctgctaattttttgtatttttagtagagacagggtttcactatgttggccaggctggtctcgaagtcctgaactcaggcaatccacccatcttggcctcttagggtgctaggattataggtgcgagctactgtgcccagcctatttttatattttttctaatgactaataatgttaagcttgttttcatatgttcgttagccattggttatattctttggagaaatggctgtctatgtcttttgtccattaaaaataatcggtttgtctgtctttttcttattttttaatttaatttaatttttaattttaatttttaaaaatttccataggtttttggggaacagatggtgttcggttacatgagtaagttctttagtggtgattgtgagattttggtgcacccgtcactcaggcagtacacactgcacccagtttgtagtcttttatcccttacccccttcccaccctttctctctgaatccccaaagtccattgcatcagtcttatgcctttgcatcctcatagcttagctcccacttgtgagtgagaacatgcaatgtttggttttctttctttttttttttttgagatggagtctctctctgttgcccaagctggagtgcagtggcacaatctcagctcactgcaacctctgcctcctgggttcaacattcaaacaattctcctgcctcagccttctgagtagctgggactacaggtgcacaccaccatgaccggctaatttttgtatttttagtagagatggggtttcactctgttggccaggatggtcttgaactcctgacctcgtgatctgcctgaatcggcctcccaaagtgctgggattacaggcatgagctaccatgcctggcacaatatttggtttttaattcctgagttacttcacttagaataatagtctccagtctcatccacgttgctgagaatgccattaattaattcctttttatggctgagtagtattctatcgtatatatataccacagtttctttatccactcattcattgactgatgggcattgtcttttacttattaatctctctctctctctttctcttggaatccttaagcagaaacaaatgaaatagaatatgaatatgaatatttgctagttgggagttaataaagccaaaagtttgttctttgaaaagattaataagaaacttctacttgaagggcttcttttcctttattgtgaaccgactgatgaaatgtctgtcttttaccttgacttttcaaaggattttttttttttctttgagatggagtcttgcttatcgccaggctggagtgcagtggcgtgatcttgcctcactgcaacctccgcctcctgggttcaagcgattctcctatctcagcctcctgagtagctgggacaacagccgtgcaccaccatgcccagctactttttgtatttttagtagagatgggttttcaccatgttggccaggatggtctccatctcttgacctcatgatttgtccgccttggcctcccaaagtgttgagattacaggcatgagccaccgcacctggccaggatatttttattaggtaagacattctaagctagcagttattttttattttatttatttatttatttatttgagacggagtttcattcttgtctcccaggctggattgcaatggagtgatcttggctccaatcttcacaccatattttggcagttcatgtgcatacactgcacagactatcacgttcccttctacacaggtctaagcaatctgacaaatgataactctgtttgttacataaaatatcatcctgtatttgggtgtgctgtatttatttttatcctgtatcaccaagcatttccgaacatagtgatcagttttaccctcttgtcatcttctaaatttcacttagtatcttttaaagtaggccttattattaacaactttaacaaaccccatcctgtgggacagagacctgcgtttgtggcttgacagagacctgcaggcccagtagtgctggggtgggaaaagggtattattaattgttttttgcttttggttttctccagcaactttactctgatgtctaggtataattttctttatatttttctgggcttttattgaacctgtgctttaagtcttttgtcagttttagaccatttcttgaccattatgtcctaaaacattgcttctgtcccattcttcctcacttgtccttatgggacacaaattatacattttttggaccattatattttttaacatcatttttttgtttgttttccatcttttccccctctgtttcattctaaatattttctttttctttttcttttttttatttgagatggtttgttttccaggctggagtgcagtggtgcgatctcggctcactgcaacctccgcttcccaggttcaaacaattctcctggctcagcctcctgagtagctggaattacatgcatgcagcactgcatctggctaatttttgtatttttagtaaagatgaggttttgccatgttggccaggctggtcttgaattcctgacctcaagtaatctgcctgtctgggcctcccaaagtgctgggactacaggcatgagccaccgcacctggcctcattctaaatattttcaactgacctatcttccaatttattaattctctgtatatttctgtataatctccttttaagaactctattatagagttttaaattttatcaattttatttttcaacttaaaacaattatatatattttatatatatatatatatatatatatatatatatttttttttttttttttttttttttttttgagacagattttactcctgtcacccatgctgaagtgcagtggtgcaatcttggctcactgtaatctctgcctcctgggctcaagcaattctcctgcctcagcctcctgagtagctgggattatagacgcttgccacagtgcccagctaattttgtactttttagtagagacggggtttcaccatgttgccgtggctgttctcaaactcctgagctcaagtgatctgcctgcttcagtctcccaaagtgctgggattataggtgtgagccatcgtgcctggctatttttcaattttagaggtttcatttgtctacttttttactgcatagtgaatttttaaattaataacttcatttttagagcagttttagcttacaaaaaactgactagaaagtacagagagcgcccatctacttccttacttcccgcccagtttccctattaggtattaacatcttccattaatgtggtatatttattataatgaatgagcctatattcttacattattatatttaaaaatattaaaatttttcacttaaaatatagtttttaagcgatgttttgatatgtgtaaacagtgtgtaataagcaaatcagagtaaataacatcaattacttcaaacatttatgtttactgttttatattttctaattctctgttgtaattctccatcttgtcatttaaaaaaatatattaatttcagttgtttcagggcctgtatctgttaatttcattctttaggtaagtctgttactgtaagtctgtttctattgttttttttggttggaatttggtcaattcttgtctttttgaatgttaaattagttttaattgaatgtcagactttacgtatgaaaatttaaaaattggatgatgctatcttcctctagagaagactaacttttgtttatggcaaccagtgaggctggcttatgtctgggttatctctattccaaggatgtggccattaagggattccaactgaaggtatgggctttctacctggccccttctttttgacaggactggactctagtttttaaaaccctggtcctgtgagactgctaaaagctgtttatctttttagcctctgagctatggttttctcttcagtttagcagcctttcagcatattttctttttttttttaatttacaaatacctcaaggaaaaatgtgttaccaaatgtaaatgtaatcaccacattagacttcccttctctctgaaatcttggactttcaaacttgcactgccttgttagtgctctgattctttcagaaatagttttccttttaattttgtacagtctttctattttttttgtcttggtaggagatttaatgtgaaaacagcaaacgcattagaaacaagcagattcaatactagattatgaagttttggaaggcataagatgtgacttgtactttgctgtgtcccaagcagtgcacaacatatttggcaaaatataggcattcaaaaagtgctgtggatttttgtatatattcatggagtattagctcaattttgctacactgatatatctcattgtgatgaagtcaaagctttcagtgcatccatcaaatgctgtttttgaatgaataaatgaatgaatgggttttctgatgacagtgctgtaaagatacagcaatactttgtagaatattgtccaaagtccattagggatattagcaagattttttttttaatcatgaattctgacttgctgtttatactatgtgtgttttttctttttctctgttcttttttgaagtaagctatttgagctaatgaatgtaattgagtaagaaagaatacagatgaaaagtcagggaacactgaacacttttatgtctgcaagtttaaaggtggtgctttagctgggtgtggtggcatgtgcctgtgatcccacctactcaggaggttgagtcaggaggattgcttgagcctaggagtttttaattttttttttaattttactttaagttctgggatacatgtgttgaatgtgcaggtttgttacataggtatatatgtgctatggtagtttgctgcatctatcaacccatcatctaggttttaagcctcgcatgcattaggtatttttcctaatgctttccctccccttgccccccatcccctgacaggccacagtgtgtgatgttccactccctgtgcccatgtgttctcattgttcaactcccacttatgagtgagaacatgcattttctgttcctgtgttagtttgctgaggatgatggtttccagcttcatccatgtctctgcaaaggacattaacccgttatagtattccatggtgtatatgtgccatattttctttatccagtctatcattgatgggcatttgggttggttccaagtctttgctattgtaagtagtgctgcaataaacatacgtgtgcatgtgtctttacagtagaatgatttataaccctttgggtatatacccagtaacgggattgctgggtcaaatggtatttctggttctagatccttgaggaattgccataccgtcttccacaatgattgaactagtttacactcctaccaatagtgtaaaagcgttcctatttctccacatccccaccagcatctgttctttccagactttttaatgatcaccattctaactggcgtgagatggtatctcattgtggttttgatttgcatttctctggtgaccagtgatgatgagcattttttcatatgtttgttggctgcataaatgtcttcttttgagaaatgtctgttcatatcctttgcccactttttgatggggttgcttgtttttctgttgtaaatttgtttaagttccctgtagattctggatattagccctttgtcagatagatagattacaaacattgtctcccattctgtaggttgcctgtttactctgatgatagtttcttttgctgagcagaagctctttagtttaattagatcccatttgtcaattttggtttttgttgcaattgtttttggtgttttagtcatgaagtctttgcccatgcttatgtcctgaatggtattgcataggttttcttctagggtttttatggttttaggttttacatttaagtctttaatccatcttgagttaatttttgtataaggtataaggaaggggtccagtttctgttttctgcatatggcttgccggttttcccatcaccatttattaaacaggaaatcctttccccattgcttttctgagcccaggaatttgaggctgtagtatacactgattagacctatgaataatcactgctctccagcctgggcaacaagacagaccctgtccctaaaaaataaaaataaataaataaataaaagtggtgttttaataatttcagacggcaaaatatccaactggatgaaagttaatgaaactctcctggtggaacatcactagagcacataaataagtgacagctgtgaaaagtttggtttcaacagtaggctgggcattaggactctattggggttgttcattttaagttgtcacattgttttgaggggaggggtgggagagggggagctgttttggtttttagatattcatgggtcaattacgtgccaggctctgtgtgacatgtctttcagtccaccctaacagtgaacttacgtcttcctccttgtcctctaatatgaaaaagcagaacaagtgtgtctgcatcacataagacttttttaaaaagatggtttaggagagcaacgacccttatattttgctctcttttatctttagaaattgcctgtgttctacctgtactgatggatggcatacagagtcacccccaaaaacctttctacacagttggtgagaaggtgactgtttcctgttcaggtggcatgtccttagaaggtccttcagcatttctctgtggctccagccttaagtggagtcctgagatgaagaatgcccgctgtgtacaaaaaggtgagtggcttccatgtctatccaaggacacttgtacccaggcaagtgagagtccttgtggcgaccttcatggtactgtatcaccatagctgtgagtcattccctccattcttgctccttaagatagggtcagtttgtagactgagtaacagattttcttcacatggcacagaaagactcatgaaagcaaggaaaggcaaggatagcctggtgattctgaaacttttaacttaaatcatccttgtgaaagattagctttatatctgttatggtgccaagacaataaaggatttttaaaatctgttttttgtttgtttgtttgtttcctctagatttttttcccctgcatttttcataagtacagagttgagatcataatttatttaaagttctgtatgtttcatttttgggctttcaaagagtttatcagtatttctgaaattgaaaatttagaaagcattttcatttaacactttaaagcagacattattgaaggaaaagtgttgtgattcatgaaattgttcttaatgtggaaacccaaaaatccagtattttaacaccaagaaaattaaaatggtcttttaagaacctaaggtagaaaggatttagaaagccaaattatttctttttagaggtaattttagatgagatagatttgtttgacaataaccccttatttattctttgtttacattttttaaataaatggaaaatattgtatttgtaacaaaaatgagaatgaagaaaaactcacttgcatactattttatgtgatattatctctctagtatgtgatttttaattaaacgctgaaatttatttttaatagtgaggatgaagtactagatttcacaggtgatggtgtgaggtgaattagatgtttctaactaagttctccatgcgacagggtatggagcactcagatactgatggtagatatgggctgtgatgtgaagtggatgagaggcagaacaataggcaagacacacgtccttggagtgccctccctgcctgtcctgatgtgctgttaagttatcaaagctccatctcagaggacagttgttttgtgttctgtaaacactgaagtataaacatgagtttacttggaatatttaaagtcatggaccagtacttacaattctaaaaatgaaagagaacaatatacagttgatgaggttgcacttttggttcaaatgagattgtagactagtctgtctaaaatgctacttcagctattttacagcacagtttggtatgaagtttcatttacccagtagaaaattctattaaagtgggttttaattaaggatgtttttcagatctgtgtgtttttctgaagatgtgaataacagtaactacttctaagcctataacaaacaaaaaaatccaagacttaccagcttccaaagttgatgttttaaaatgttggctgttctagtatttagtctttttttttattataataaagcatacataacataacatttaccattttatccatttttaaatgtatgttcagtggcattaagtaattcccattgttgtgcaaccatcaccacattttttttcatctttccaaactgaagctctatatccattaaacattaattcctcactttcccctactgtccccgtagttagtcttgatgggaataaatttgcttttaaaatagcaaaagcacatactttcggtgggccttaagagtgtgtttacttggttaaccaagctgtaaaggcaacaaagctatgttcttcttaaatgcaaaaattctttgggctaggtaattctatcgtttttttttttttccacaaagacattataatacattttttttttttgagatgcagtctcgttctgtcacccaggctggagtgcagcggcacaatctcagctcactgcaagttctgcctcccgggttcacaccattctcctgcctcagcctcctgagtagctgggactacaggtgctcgccaccatgcccggctaatttttttttgtatttttagcagagacggggtttcaccatgttagtcaggatggtcccgatctcctgacctcatgatccgcccgcctcggcctcccaaagtactgggattacaggcgtgagccactgcgcccggcttgacattataatagtttaagcaaacttttaaaatctaaaatttcaggatttgtcctaaagtaaatttttaaccacagtgcagaactaatttacatggcttgatcattgaccttaagttttggtacatctagattaaggcttctcaacctcaacgctattggaattttaggtctaataattctttgctatgggagcctcttctgtgcattgcagggtgcttagcagcatccctggtctctacccaacagtagcatcctcctatgtcaataacattctgcagttgtaaaaaccaaagatgtccctagtgatttccagatgtcccctgggggacaaaactgcccctggttgagaagcactgatgtagataataccatttttaaaaaatttcattttggaataattttagatttcagcaaagtcacagatataatttctacacacccttcacccatcttccttaatattaacatcttacataacacaacttggttaaaactaaaaaattaatattagtacaatgctattgactaaactatacactttattcaaatacctcatgttttaccactaatgtctcttttatgttctagggtccagttcagggtactacgttgcatttaggataataccattttaaagagaagtgtgctttttttttttttttgagacaaggtctcgcttgtccaggctggctggagtgcaacggcgcaatcttggttcactgcaacctccaccacccgggctcaagcaattctcctgcctcagcctcctgaggagctgagattacaggcatgtgccaccatgcccggctaatttttgtatttttagtagagacagggtttcaccatgttggctaggctggtcgtgaactcctgacctcaagtgatctgcctgcctcggcctcccaaagtgctgagattacgggcgtgagccaccgcgcccagccaagagaagtgttttaataatgaatcttgttattgagactgctgaccatggcaggcatacttcacattgccatcatttttacaggtttatgaatgctcacaagattgtaatgtcatgtccaaggctcttgaattttccaaagtaaggaagtatttcatagtttgtgtattcataaaaacatattctccagataaactacctttatagatatagtaaatgactatctagttttatgatgcaaaagtgtatggcaatgaatttcattgtaataaagctattacgaggtgaaaaaagtcaggatgtttttagatcattcccattgcaatcagggatagctgaggggatggcagtcacattatgctcttgtaagttggaccacggtgtttacctgtcaaaactgaaatgatgactgaattgtcagtttctataaaacacaaagttatagaaagaattttattaacgtaatgacctccagacatttattcactgttgagggagaccacttagacattcatatgtaagaggttattgtagatcttctcggcacaccagggagttctccatgtataaggcaagtgatgttgctgctttttgcctcattatgggcacagcaggcagaatgcagtccaaacaacaaacagtttataagcaccagcttcttgaaagggagccactttattgtccttggattcagaccaatgtagaattaaatgctgcctgggccagtttgttaaatgtgtgaagtagcaccaacttcctaactctttttactcttaattttctgatttcttaggtgggcatgtgttagggaggcatgaatatcccaatgtataaaaagtgcatgacaaatataaatgttcacgagatggtagctattactaccaatgcagttatttgtaatgtgactctagaaactctctatagcttgtaaaatgtatcacaccttgattattattactattgttactgtgcaaatgcattgcagttggagaatactacagaccctggtccagcaattcatataataccttgtttactatgaagaggcttttctcctaacgaccacatctcccttatccttttttagaaaatccgttaacacaggcagtgcctaaatgtcagcgctgggagaaactgcagaattcaagatgtgtttgtaaaatgccctacgaatgtgggtaagtgccgcctttgctcatttctctgttttattttattaatgataagggataatttcttagataatagtgtctgttggatggaaggtgtagcttaccaagagttaagggtctttgtttgcatttcgatgtagtccatctgctgcctgttatttgtctgggtcactagggctgacagccatggcattaagcagtgttctaatctggctagtggagaaggctgcaggactactcgagcactgcttgttttatatataaaatggagcaaaatggcaaaactgtcagctgaggatttagaactttagaggattagaggattaaaactgaaattcctttggcacataaactcttaaagcaatactgatagggaaacagcagctgcttttgttgattcttgaagcatcttctctagatttgcatggttaagaatgccaccaacttgaaatcattccattgtaggaggatatctctgaagtagttaatagatgtctgtgtcatggtcctagtaggatagagatggcacaattaaattaggacaagaaaagctttattagcagaaatatttacaaaaatgtgaacagaggaaaggaaactacaagtcccatggcagtattcctagactgctaacagcttgaccgtatagccatacccaggtccaaggagtaaggagaggggcattcaggaaaaactggagacagagagggctgtgtggagatggccctgaggaggagctgacactctcattttagggacttcagaggtcccacaggcgtgagccaggggcataaacacctcaactgcactgtccttcctgcctcgagtctcctgctagtcagtgctcaccactgatcaaaccaactgaagctagaggccgaggaagtccacgatgtggcccatacatgtcagcttcccaggcaggtggagaagagtggaaagtggatctggggaggaaataagaaatatccagcccctagacttagtggccatttttaaaattaaaaaccaacacatgacctggtgcggtggctcacgcctgcactcccagcactttgggaggccaaggtgggccaattgctcgagctcaggagttcaagaccagcctgggcaatatggtgaaaccccttctctacaaaaaatacaaaaattagctgggtgtggtgactcactcttgtagtcccagctactcaggagactgaggtgggaggattgcttgaagccagggaggttgaggcttcagtgagccacattcatgccaccgcactccagcttgggtgacagagccagaccctatctcaaaaagaaaaaaaaaaaaaaaaaaaagaaccaaaacactaattacttggttttcaatgattttggttatcaaaaccgatatccaacttcttgaagctacagtgggtaattgttattgtatatagcaatttctggtgtgaagaggaatataaataactaaatggcgtgatggaaatggtggtcagcctagatacattctcattctaatattctgactttgctgctaatctttaataattattgtttattttgagtcattttcatcctctttccaacttccccatttcatttagttgatctgcagctcgttgttaatagttatggtatacatttccatgtcattccatggtctcagatactggcaacaaggtggtattgtaaggtctttaccctttcagctgttataagtagttctatttaaagtttcaataaacagatgaaaagatagattcaaaacaacaggatttgtttctgttttataaataactccaagtaaatgtagcttttggtagaaaaggaaaatattagaactaaataaagtgtgtgaatatagactctttctgactccatctggtatacaaaaatgctgtgttgtctaaggtttcagtgacagtaatgccctccttgtctatcagcattcagaaatgtggagttttctgatagtgacatttctaaatagctatttttttccactattttagcaccaatgctaatgaggaaggtaacacattttatggaaattttttttttttttttttttttttgggacacagtttcattcagtcatccagactggaatgcagtagtgcaatcttggctcactgcaacctctgcctcctgggttcaagtgattctcatgcttcagcctcctgagtagctgggattacaggtgtgcgccaccacgcccagctaatttttatatgcttagtagagatggggtttcgccatgttagccatcctggtcttgaactcctgacctcaaatgatccacctgcgttggcctcccaaagcactgggattacaggctcccaaacttatggaaatatttctaaactattttgtaaacatagatacttttaaaagtagcattgaaaaatacagtttcatcttcccgtgatgatttagggtcatccatttttggacaatgcagttttatggacatgaactcttggctgttgggctgggatgagctcatttctcctgcaattaatggtcccatttgactatgatcacattgaatgcttggtctccactggctttctgtctcctttgtcagctgttgctagcagaccttttcttctcatctaatttgctgtacctggtctgttctagatagaactagatcaacactagatatctacacttagaaaaattgtgagcaaataatgagtaaatacaaatatcttcattttgaagacctaagtgagttggacctaggaatgaaggggatttgagtttccaccttttttttttttttactgtgggtgataacatctgggggcactaagctcagagcatcacttttcatttctccttctcagcttttacgaacaaaaatcttgtaaataatgtcattaaaaattcttttcagaccttccttggatgtatgtgctcaagatgagagaagcaaaaggatactgcctctgacagtttgcaagatgcatgttctccactgtcagggtagaaattacacccttactggtagggacagctgtactctgcctgcctcagctgagaaagcttgtggtgcctgcccactgtggggaaaatgtgatggtaaggggcctttcatatttgtaagtataagaatgctaaagtcacagtactgaggatttaaaaaatgtggtttctagtttagcagtgggccgaagaagatacttgaggatgttaaagactcagactgatttgacatgcactgacctctcctatacccctcactggagaagggcacagatcacagacctcagaggataagattcccacattcctgatgtggaaatgttctcccaaacaggggtgattccatgccaccttcatgatttttactctgtccttgtattatccatattgtgtactcattttttaaaagtctgacataaaaataacttaaaaatgaaaactttatatcatgtccttaaaaggaggtatcacttgccataaatactaggtaactataaaagttatatgtaatggaactaaataaagttgtggactctagccagatactggtccaacattgactatgctgtttctctgtgagtttagcaagtgttagaggggtgttaaaaacatactagcaccaagctgacactttcttctagaagtaatcagacggatttgaagagaataaaagaagaagttactttctcacgttgtgattcaatatttgctaacactatgtttaagtagtacttacagtgatcttgaactcccccaagagcacagcaaacctcccatgatttgggcagtactatgaaagtggaatggctgggtctccagagccaagtcactgtctgggcttccctatctgtaaatttaggagctggactctatgacttgtaaggtctctgtcgtctcttcactctctgccctcctggcctgtacccgctggcacctgtcccctcactccctcaaggtttgcagcacagactgatgacatacatatgtgactctagccatgtctgggtcacttttggttaggtggtcaccattgtctgctggctgaccttgttactcatctttggaagactcctggctggtgtattccaaccatggactttccatgcacagactccttgcctccttaactcatttctggtttgttttttgggatttgtagccttttgcatgccatgctctctctcaaagcaagttaagttctctttttttctctctctctttgtttgagtcttgacttggttctttgttgagggcttctcatttgacctcagttgctggcttatatggacagcagcatgtatgtaggagatagttgaagagctcttgacttggataaaaccaccccatgtggtctaaccaatataaagcctgctaccaacctcaaaacctatttctttggagtggagcaaaatgccccaatttcctggtcctactgcttttccaggggataatttattatgtcattccaggcaggagcttctacagctctgatcaccacattattactttggaggtgatgttctttgactccccgacctccacaatgtaccattaagcctctttcacttacttttccagctgagagcagcaaatgtgtctgccgagaagcatcggagtgcgaggaagaagggtttagcatttgtgtggaagtgaacggcaaggagcagacgatgtctgagtgtgaggcgggcgctctgagatgcagagggcagagcatctctgtcaccagcataaggccttgtgctgcggaaacccagtaggctcctggaggccctggtcagcttgcttggaatccagcaggcagctggggctgagtgaaaacatctgcacaactgggcactggacagcttttccttcttctccagtgtctaccttcctcctcaactcccagccatctgtataaacacaatcctttgttctcccaaatctgaatcgaattactcttttgcctcctttttaatgtcagtaaggatatgagcctttgcacaggctggctgcgtgttcttgaaataggtgttaccttctctgggccttggttttttaaaatctgtaaaattagaggattgcactagagaaacttgaatgctccattcaggcctatcattttattaagtatgattgacacagcccatgggccagaacacactctacaaaatgactaggataacagaaagaacgtgatctcctgattagagagggtggttttcctcaatggaaccaaatataaagaggacttgaacaaaaatgacagatacaaactatttctatcctgagtagtaatctcacacttcatcctatagagtcaaccaccacagataggaattccttattctttttttaatttttttaagacagagtctcactttgttgcccaggctggagcgcagtggggtgatctcatctccctgcaacctccgcctcctgggttcaagcgattcttgtgcctcagcttcccaagcagctgggattacaggtgcccgccaccacgcccagctaatttttgcatttttagtagagatggggtttcaccatgttggccacgctcgtctccaactcctgacctcaggtaatccgcctgccttggcctcccaaagtgctgggattacagacatgaaccaccacgcctggctggaatacttactcttgtcgggagattgaaccactaaaatgttagagcagaattcattatgctgtggtcacaggggtgtcttgtctgagaacaaatacaattcagtcttctctttggggttttagtatgtgtcaaacataggactggaagtttgcccctgttcttttttcttttgaaagaacatcagttcatgcctgaggcatgagtgactgtgcatttgagaatagttttccctattctgtggatacagtcccagagttttcagggagtacacaggtagattagtttgaagcattgaccttttatttattccttatttctctttcatcaaaacaaaacagcagctgtgggaggagaaatgagagggcttaaatgaaatttaaaataagctatattatacaaatactatctctgtattgttctgaccctggtaaatatatttcaaaacttcagatgacaaggattagaacactcattaaagatgctattcttcag

SEQ ID NO: 36303 - DNA, 10791 bp, Homo sapiens
cggggcgccgctgagccaagtgggccacccgggcacggccacgctcccgggtcacgtgacacggagggggccgaattctgctggaggcagcgccatatcctggaggtgaaggtgaatagcgtcgggggtcgagctggtgtgggagaaccacatcctgatgcgatgtgacctcgacccagcctggcccggggtcggggatcaggctcgggcccgtgcgctctttaagggagaggcgtgggttgcgtggagggtcgcgcccgctaacccgggggcgtgacctcgtgcctcttggtgacgtaacatggggcgggctcactactggggctgagatttggggtccggttgtggaaagagaggcggggcttccgcctgtccattgacaagtaggtaagtggaagataactgtgtggtgctgtcgtcgccaccttgacttgtggtggctagtttgggtgggagtggtggtgatgtaaaggactggggctagccccgcgaggggcgtgaccttgtcacggagaggcatggcttcaccccgagcctaggcgcacaaagggcgtggtctggcagggttgggggcgtggccgcacagaaactggcggcaagggtcgtggccctggatcctgctgcgagaaggggcgcgatttcttccggagaggttccctgtcgcgcccaagtctgggaagtgccctttctctcttaggtaccacctcatggagacccccgcggccgccgcccccgctgggagcttattcccctccttcctgctcctggcctgcgggacgctggtggccgccttgctgggcgccgctcaccgcctggggctcttctatcagctgctgcacaaggtgcggggcacagaatgggaggtgggctgggggcagtcaaagagggaggggcctcgtggtgctgcttccagctcactcattgtgcagggtgggaaagcgagccccgactagtccagagggactggtaagaggttctgtccagggccctgtctccattgccacgctgtgtatggaggcctggactttgccactggtaagagagaacacggaagctgccgctgccggggcactcgcaccccacctacctccttccccagtgactcttttcacagaacagatggacagcactctgtgctccctaacctggatgggataaatggggcagagggcaggctccagcgagggggtggcagtgacagtttcataacagttgccctctgctgagctcagtactgtagactttcttacctaccccttaccttttccttgaaagtaggtgctgttctttctgtcttcattttctgcaagaggaagctgaggctcagagagattgtgtggtggtttgccctaggtgacatgtttggagagagctgaccccacaggtgtccccctaaactccttgcacctctgtttgaaatttaccccttctccagaccccttcctcaaccctttctctcctagcagggaccaagcttgacctctccctccccaaacccttctctactgcttcctctgctagccaggagtgatgccactgaccttcaggacttaggagatttaaagcaagccttggatgtgtagggctgtgaggcagctggagttgggaggcctcggcacagtctgtgccagcagctcactcccgtgccaggcacatggtggctggcagcctgtcaactaagccctgggcctgtttagcgtccatcaggagggcatcagggaggctgggatcaggagcccagctgccaggctctgcaaggatactggagggcagggaggagtcacagcagatggctccctgccatctgctctgcgtgcgttgtgcccctggccaaaccccctgggttatataaccctctcctctctccctgattgccctgccatcctggagacaggcagtgtaacagtggggcacttaagagcgtgggttctattgaactttcagtcttacttgggcaagccttgatgtcctcagctgtaagagggatgtaatgacaagaggatctgataagatgttatgccttggtttgagcctggcatgtagtataatatatgcctaaccaagaccaagcttctcttgacctctcaccctgctcctgcccccttacctggggcagggggattgccccctttcccagctgccctctgccctggcctttaactttattgctccacctgtccttgggcccaggtggacaaggcaagcgtccggcatggcggagagaacgtggccgctgtgctgagggcccatggtgtgcggttcatcttcacgctggtcggtgggcacatttccccgctgctggtggcctgtgagaaactgggcatccgtgtggtggacacacgccatgaggtcacggccgtctttgctgctgatgctatggcccgcctgtccggtgagggcattgcagagagggctggggactggttggactgtgggctagagtgtctgtgagggtaggggtttttcagaggtggaagaatggccaagagagtgggcatggctgtgatgggctctgtgttccagggacggtgggcgtggcggcagtgacagcaggccctggcctcaccaacacggtgactgcggtgaagaatgctcagatggctcagtccccaatcctgcttctgggtggggctgccagcactctgctgcaggtacccagtccttgggggccagtgggggcctaggggggcttgaagggctcatgcgataaccctgccacacctctgtctttgccagaaccggggtgcgctccaggctgttgatcagctgtcccttttccggccactctgtaagttttgtgtgtctgtgcggagggtgcgggacattgtgcccaccctgagggccgcgatggctgccgcccagtcgggcaccccaggtaggtggaggatggtgatgctgagcagtgctggggccgaggggctggggacatgttatggactcagcgtcctccctgtccctgcaggtccggtgtttgtggagctgcccgttgacgtgctgtacccctacttcatggtccagaaggagatggtgccagccaagccacccaagggcctcgtgggccgagtggtctcctggtgaatagccccacccctgccattccctcctttatcccccgttctctcctgcagcttccagcccacacccatcctcctttgattcacatgtggactgggaggagacagctggggggagagcattccaggtagaaggaacagcatgtgcaaaggtcctgaggcaggaatgaactgggtgggtagggaaagcaaggcggccctcgtggaggcagcaaaggggagaggctcaggacagccctcctcctcctccttttccctttcttctcctcctccatcatctcttcttcctcctcttcctcctccctcttccttcctcttctcctccctttcccccaccacctttcccatcgtcctctccgttttcctcctcctaaaggatgatccttgaacctcggaagggaggttcattcttacatttacagaggaggaagctcagaaaggtgaagtcacttgcccaaagtcacacagctaagaagtggcagagcccaggccgggtgcggtggctctcacttgtaatcccagcacattgggaggccgaggtgggcagatcacgaggtcaggagatcgagaccatcctggctaacatggtgaaaccccatctctactaaaaatacaaaaaaaaaaaaaattagccgggcgtggtggcgggcgcctgtagtcccagctacttgggaggctgcggcaggagaatggcgtgaacccaggaggtggagcttgcagtgagccaagatcgtgctactgcactccagcctgggtgacagagcaagactccgtctcaaaaaaaaaaaaaaaagtggcagagcccagactcgagccctctccttcctcctcctttccttccctcacatctttgtccttttctttctttttttttttttttgaaacagattcttcgttctgttgcctaggcttgagtgcagtggcgtgatctcggctcactgcaacctccgcctccccctgggttcaagtgattttcctgcctcagccttctgagtagctgggactacaggcgcccgccaccacacctggctaatacttgtatttttagtagagacgaggtttcatcatgttggccaggctggtcttgaactcttaacctcaagtgatccaccctcctcggcctctcaaacattacagacatgagccactgcgcctggcctcttctcttcttcttcttcctttcctttcttctcctcctcctcttcctcttcttcctccttctctcccttcccctcagtcccttccctttgcctgtccttggcccttcctttccatacatttagcgagcggcagccatgtgccaggttccaggacaggcacggggcatcatcagtggacaaggtagtcaggctcctgtactccggatgtgtgtgaagcgcctgagggtcagctcaggcagtagtgattttgttctatggcctctttattttttttgagacggagtctcgctttgtcccccaggttggagcgcagtagtgcgatcttggctcactgcaacctccacctcccgggttcaagtgattctcctgcctcagcccccggagtagctgggaatacaggtgcagtccaccatacccagctaatttttgtatttttagtagagatgaggtttcaccattttggtcatatagcctcattcttaatgcactttgccccctggcttcccagtcagtccctccccttgttctccttgcccctctctcttgggctgcctctcacaaggctatctcttatcttgccttttttgttttgttttgttttgagacagggcctcactctatcacccaggctggagtgcagtggtatgatcatagctcaccacagccttgaactcctggcctcgagcaatcctcctgcctcagcctcccttgccttttctttacttgcggggcttcccacggttccatcctgggctgcttctgtgctgtcttggcctgtccttaacggtgaaagcagaggcttctgactctgagctccgactgtttcctgccaatgcccatgtgtctgtctttcgctggatagagcgccccctgaggggagggctgggcaggatctatctttgtgtctccagggccctgcacaggtccttcaggaaagttggggccctggggcccagtgagcaaggagaccgagaagaccctgtttgaagcaggagaggacagtgttcagaactcccatgcaaagcgcctcatgtcctaagtggacagatccttgaacctggggagggaggttcatatttacattgacagaggtggaagctcagaagggtgaagtcacttgccctaagttgcacagctaggaagtgacagagccaggacttgagctcacatctgttggacccacaggcttaatcctggcatgctgagcctgcgttccttgcttctggggggctacgtggagttggggtggaccccagaggctaccgagggcaaacaggcagttgaagacctggccactagggttcgtctgtccctgaggtgtcactcatccaccctgtccccatgccactttgctcctggcttttctcccggcccctttccttgctcagatcctggaatccttgtagttagttaattctggcaacttggtttcttccccctcccttttgcaggtatttagagaattacctggccaacctctttgcaggagcctgggagcctcagcccgagggaccgctgcccctggacatcccccaggcttccccgcagcaggtgaattgcctctcttttgtgtctgaggaccctaccctctccctgaggggagagggccccctgaccctctccctgagtcagtactggggccttaatcttgggtgctcatggcgactcaagggcggccctttggctggacgcggtggctcacagcagcaatcccaacacttagggaggccgaggcaggcggatcacttgaggccaggagttcaagactagcctggccaacatggtgaaaccctgtctctactgaaaatacaaaagttagccaggcatggtggcacgcgcctgtaatcccagctactctggaggctgaggcgggagaatcgtttgaacctgggaggtggaggctgcagtgagctgagatcatgccattacactctatcctgggcaacagagtgaaactgtgtctcaaaaaaataaataaataaaaagacagccctttgatccccacctctcgctccaggttcagcgctgtgtggagatcctgagccgggccaagaggcctctgatggtgctggggagtcaggccctgctcaccccaacgtctgccgacaagcttcggtgagaagcgccagccctgcccttgttttcacgttcccagtccccagtcctcgggtgctcttggggaggcgggaggccccggccacactgacctctgctctgcctggactcccagggctgccgtggagaccttgggtgttccctgcttccttggagggatggcacgggggctgttaggccgcaaccaccccctccacatccgggagaaccgcagtgcggccctgaagaaggcggatgtcattgtcctagcaggtgggcctgagcctcttcctttccctccttcccccaggaaccccctcaccctgttacccagcttcacacgaaggaggaggaaggtctagtgggcacctattgtacttgatacacattttcacataaagcgctttgaacccaaccagacgcataataggtgtatcagatagctactgccctgtaacaaccatccccaaactcaatggctaaaaatgcatttctgatttctcaagatccacctataaggtaggtggtagctgtggttttggctgggctcattcatgagtctgcacttgggttaggcaggaaggcagctgtgctgatccaggctgggcttgctcacctgtatggggattggctggccctgcagctcgtctgggatggcctcagctggggtcatagagttcttcacccctgtctccatggcccccttgtttctcatcctccagtaggctagcctgggctggccgacttggtgaaggatgagaaaactatggggctaggagagtgcggttattcaagagagtgagtggaggctgtgtggcttcttgaagtagagtctgcaggaatggggggtgggggtcctgaatcatctggaggtgtcttcactcagaggtcttgcaattgacgccagctgttggaggggctgtggactagggcaactacacaggtctctatgtgtggctccggtttcctcccagcatgatggcctcagggtagtcagacttcttagacagagagcacattccttggccccacccaggcctctaaaagtgaacaaggaagaaactgcatatcttccttgttgggtgtcatggtgtgtcactttcaaggaaaggggacctaggctgcacctctctccatgggaggcatgtcaaggtgaccttgtacaaatggatgtagggtgggagatattatggccatctgggaaaatataacctgcctctgccctatcctgttggccaaagcatgtcatgaggccagtcccgattcagggggtgtggggagctgcaaggtcactgtaggtggcacaggtgcagggagactcggtgaggaacagggactcatttgcatccagtccaccacagtggatcaagtaaggtagacgacatggggcctctgcctactgcattcctgtcccccacaccaggaactgtgtgtgacttccgcctatcctatggccgtgtcctcagccacagcagcaagatcatcatcgtcaatcgtaatcgggaagagatgttgctcaactcagacatcttctggaagccccaggaggctgtgcagggtgagccccttaatccccccgtacacatatgtgctcctcccagtccctctcctcctggtttctgctgcagctggcttgagcctggtacagtgattgaggcccagaccttgccctaggggtagccagtcaaccagagacaaatagttggctctcaaactgatgaatgcttctttctttaaattttttttatttttattttttagagacgaggtctcgctctgtcacccaggctggaatgcagtagtgcaatcacagctcactgcaccctcaaactcccaggctcaaaagcaatcctcccacctcagcctcctgagtagctgggactacaagtatgcaccaccatgccaggctaatttgttaatttttttttgtggaatcagcatctcactgtgttgcccaggttggcgtggaactcctggcctcaagtgatcctcctgcctcggcctctcaaaagtgctgggattacagaccagagctactgcgcccggcctgatagatgcttctgtaggaacaaatggtggggtggacacagagggaggcttgaaaacgtgcatgtgatcacgttccctcccacactgcccactgccctcaggacagagagcacactcgttggccccttagcctgtcttcctgccgtatctctcccctccccttattttagtccccttggacttgaacttggttcatcattctgaggatgttgactcccctgcagcctaggcgacaggacactcttgtattaagcagagaagtagcaccgttgcatctgtgttgggaaggtccactcagcagccatggacggcaggccggaagggggctgggtggaggccaggggggctgctcaaaatggccaggacagaagcgaggaggcctgaactggagatgaacagcggcagagcctcaccttctcagagcctccatttgatcatttgaaaaatggggtggtgaaagatacatcacggggctgtttgttagttcacttcagtaacgttcgctgtgcgcttccacgtgcctggatttgagagatgtgcttggtggatgtagctcttttcattgagtgtttcccaggcagaaggaggtggagggaggggacgaggccagcttgggtttgtcacctgccttgtgctccttaacccttgtttcttgggccttgtcttcccttttcacctgggctgccctcccctggttctggcaggttctggggtgtttcacctgttttttttctaggagcacccctggcctgcttcccgtctgcctgctcggatgctgctgctggcttcctgctgttttgaggcctctgatgctggaagaacaggaggaagccagctccccacagctgtgtcctcttccttccccaggagatgtgggttccttcgtgctgaagttagtggagggccttcagggccagacctgggccccagactgggtggaggagctgcgggaagccgaccggcagaaggagcagacctttcggtggggcctgggtggagtggatgtgggaagggggttcccggcagaccctgctgccaaccctggtgaccttcgctgtcctgtcgcagggagaaggcagcgatgcctgtggcccagcacctgaacccagtgcaggtgctgcagctggtggaggaaacgctacctgacaactcaattctggtggtggatggcggggacttcgtgggcactgctgcccatctggtacagccccgcggccccctgcgctggctcgatcctggtaaggaagggcccccgcctggggcagtgggcaccatccatcaggacgccttcacacccacctgctcttggtcctcttaggggcctttgggactctgggagttggtgcaggatttgcacttggggccaagctgtgccggccagatgctgaggtgaggcactggagttgggagacttgctgctctctaggtcctgatccaccctaaccatcctgggtcccctcccgactaggtctggtgcctgtttggggacggagcttttggctacagcctcatcgaatttgatacattcgtcagacacaaggtgactgggctggcctgagggaagcttagggcctggggttctgggagatgtcaccaggggtgggctgaggtggggagggagcctcctctctggcagaggccctatccctgtctctgtcctctggctggccaagccatggggctgaaggctgcggcctgccttcatcatcttcctgtagatcccagtgatggccttggtagggaatgatgctggctggacacagatttctcgggagcaggtgccctctctgggcagcaacgtggcctgtggcctggcctacactggtgagggggcctcagcgaggttgggaggacaggaggctgtttcagtcccagctgggcttgtgttcctctcctgggctggctgcatgtgcggtgggctgagtccttgccactatccgacttaatctcttcttttagattatcacaaggcagccatgggtctgggggcccggggcttgctgctctcacgggagaacgaggatcaggtggtcaaggtgctgcacgatgcccagcagcagtgccgagacggccacccggttgtggtcaacatcctcattgggaggacggacttccgcgatggctccattgctgtatagggccttgtgggtcaggacgcttggctgccttcctgcccctggactgtgtccagctggtttggagtctcatcattgcttgccctgggcctatcccatgaggcccagtgactccacaacctccctgaggaggggatggaggggtcaaatctcagagaggctctcttgtgagctcttggaccctcctcttcacggacccaactgtgccgtttgtcccctctcttatggagactgaataaaccacctctggcccatgtaggcccaagtactcagtctcag

SEQ ID NO: 36304 - DNA, 98296 bp, Homo sapiens; identical to SEQ ID NO: 35980

SEQ ID NO: 36305 - DNA, 98296 bp, Homo sapiens; identical to SEQ ID NO: 35980

SEQ ID NO: 36306 - DNA, 1997 bp, Homo sapiens
ctctctcggtttgtctgggtcatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggcacagcaagggggagctggcacccgagctaggtctctgaggtgtgagggaggcaggaggagtggacacggaggggcctagaggaggcccctagaggggcggaggggccgatggaaagggaaaggtggcctgtcctcccctcccgacaccaggtctagctgcggggtggcagaggcaaagcggtggtgaggaaggctgggaggtgaggggcaggagactgaagccaacctcgtactgaagagcagctgtcattgcaggggaggagccccagccccgcgacgaggaggaagcggagctggagctgctgaggcagtttgacctggcctggcagtacgggccctgcaccggtgagaacccacccagccccacggaggcgcctctcccagccagtcacccacacgtctctgaagtcacccaagcgcttgcgtgactctgaccctcaggaactgtctccccccaacacacacattctccagctcagactctaccccaccccccacaagtctccagagtcttcttcccaccctggcagggatcacacggctgcagcgctggtgtcgggccaagcagatgggcttggagcctcccccagaggtgtggcaggtgctgaagacccaccccggagacccccgcttccagtgcaggtcagagacaggccgggagggctttcaggggagccagggccttctccaggcactgtcaccctgctgtcctgacctgagggagaaatggatggagggttggaaggccttgctgaacaggcaagaagattctatgaggtgcctggctcaggaggacacgccactataataattctttttttttgagacagagtcttgctctgttgcccaggctggagtgcagtggcgcgatctcggctcactgcaaactccgcctctcgggttcacgccattctcctgtctcagcctcccaagtagctgggactacaggcgcccgccaacacgcccggctaattttttctatttttagtagagacagggtttcaccgtgttagccaggatggtcttgatctcctgacctcgtgatcccacccacctcagcctcccaaagtgctgggattacaggcgtgagccaccacacccggccaataattcttacctctacaagctagtggggggcaaaggtacacccaggacccaaggaactatctatttagaactgaggggtttcccaaggactatgggcatggccaagaataagctggtgaaatcagatccagggactcaacaactgattctctgtttctctctctctctctctggggtatccctccctcccaccccatcttccacagtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctgg

SEQ ID NO: 36307 - DNA, 55640 bp, Homo sapiens
cggcgggcgaggggcagggcagggcggaccctggacgcgcgggcgcgcgcggaaggtagcgcggggccgcgttggcgcgcacgcgcctgagcgtgcgcccggtggggccggccgggactcgccgctcgcacgcccttgggccgcggccgggcgcccgctcttccttccgcttgcgctgtgagctgaggcggtgtatgtgcggcaataacatgtcaaccccgctgcccgccatcgtgcccgccgcccggaaggccaccgctgcggtgagtggcgtaggcgtgggctcggaggggtccactgggccggccaccggtggttgcccctcgcgcggggtgggcgttgcgggcgcgtggcggcctgcggacgaggacgctcctcccggcccgggtggggtgcgaatggtccgcgcggccgggtccgcggggggcgggggcagccggggggtcacagccggcgcgagggccagtccccagctcctccctgcattgcggaggaagtgtggccccgggacccccgcgggccggcctagggcacggcgtcagcctctgcagcgtgtttctgcctggtgtgtgggtgagggaaacctaagtccgccaggaaatcgccttattgtcacctcgcactcttatcctcaatgaaagaagtttgaagattgagtgtcctacaaggtcagacgtactgttttttagaaaactcgtgtatgaaaagtcaaacttatttttgcctccggaagcttgcttttgcagtggaaaaattctacaggatatgtgagatgttcctgatttcacttgaaagagataaactgtttttcttagaatgtgatcatttgcactcaatgtctaactgggacctctcagtgctaccccccccccattcattatctcaggaaataaagggagaagttgatcagaatttttgccatttaaaagaggtcgataaagattaagtcgccgaagatagtgttgtgtaattctctcgtaggtttcgttccgttttccaccttaagcaaagctagtgtgtaacaatcctgtgtgggcttatttaggcattgcttattaattttcctcttctcttataggtgattttcctgcatggattgggagatactgggtaggtaccattattattaatagtaacagtaatgaaactgggtcatgcaacttttgtttacgcgttcaaaggtttaatgtttaagggcgctaaaatggtattttaagattgccagttaatgtatcttacagtgcggtgattttatgttttgaaaaccctcagaattttccccttatcatcgtgagtttattgattttttaactctggtttctggaacatattaaaatttcaaattcctcattagttgctttgggtattggataccagagatccgtggaatgttagtagggacggtgtgcaattgagagctttccagagcagttaaaatttcagagcagattgaagagaagaactagttgattttgataagagaactagtggcaacataaggcatgcagcattctgaatagagggattagatgttcactctaatgagttgaaaggcaggggaggcaactcaaagatttatttggaggcttatcaaacaatttgttgtactaactacttatttttattttattttttgtttgtttgcttttttcttttgttattatttttagagacaagggctctctctgtcgcccaggctggagtgcagttgcaggatcttagctcactgcagctttgaactcctgggctcaagtgatccttcagcctcagcctctcaaagcacagagattagaggtgggagctgcctgagcctggccttttgtactaactttagatacatgatttatcttttactcaagctttttctatattgagatgtttttgtttttatatttaaattggtgataatctgtgaaacttaagcaaaatatgaatgttgttgaaaaattgcagaaatagaggaaaactgaagataaataaattttgataaagtagccccagaacgactaaattttctttaaaatgaaccattggggccgggcgcggtggctcacacctgtaatcccagcactttgggaggccgaggtgggtagttcacttgatgtcaagagttcgacaccagcttggccaatatggtgaaaccccatctctactaaaaatataaaaattacccgggtgtggtggtgcatgcctgtaatcccagctgctagggaggctgagagaagagaatcacttgaacctgggaggcagaggcttcagtgagccaagattgcacgactgcactccagcctgggccacagagtgagactcaaaaaaaaaaaaaatgccattaggctagatttttgtttgtttgtttggagacagggtctgctgtgttgccctggctggagggcagtggcgtgatcttgactcactgcaacctccaccttctgggttcctgggtctcccgagtagctgggactacagttgcttgccaccatgccagctaatttttgtatttttagtagagacagagttttgccatgttggttacgctggtctcgaactcctgacctcaaatgatccacccacctgagcctcccaaagtgctgggattacaggcgtgagccaccacttaaaagtgattcctattttttgcctaataagtcgagttatgtaatacaaactttgtatggagttacagaaaaggttgcagcactctttctggcaatccagtggtcctgtgaaaatgatgaacttattttaccaaatgaaactcgaatagcagaatctctattttatggccaaacctttcttgatgttgcaagtcagggagaaggttgctatcctctaactttgccaataatgagcacttctatgcctgaatgattagttcaagcaaaaaaaaaaaaacttcagtctaggcagattccacagactgaagctaaaagtaaaaatggtgaagactattaggatcaaaaataccaagaacatccattacatcttgaccaaaagttaagtttatattaaaaaagtatccttctttttaacctgttgtgataaaagaaaaaacaaaggtctccagttctgaaattatttggtgggataatgctaaggaaaggctgactctagattggttccatgagtgcatgatgaaacttcgaacctgtcagcctgacaagtggcaatttaatacttaagatattgtagtctccccttacctgcagttttgcttcccatggtttcagttacccgtggttaactgtggtttgaaaatactaaatgaaaaattccagaaatactttataagtttaaaattgtacaccattcttttttatttattttattattattttttgagatggagtctcactctgtcacccaggctggagtgcagtggcacgatctcggctcccttcaacctctgccactcgggttcaagtgattcttgtgcctcggcctccggcgtagctgagattacaggcgcgtgctaccacgtccagctaatttttttgtatttttagtagagatggggttttgccatgttggccagggtggtcttgaactcctgacctctagtgatccacccacctcggcctcccgcagtgctgggattacaggcatgagccaccatgcctggcctgaattgtacaccattctgagtattgtgatgaaatctcattccgtctcacccaggacacgaatcattcctttacctagcgtatccatgctatatccattcaccatctgttagtcacttggtagccatctgggttatcaggtcaactgttttggtattgttttgcttttttttttgagacagagtcttgctctgtcacccaggctggaatgcagtgacacaatcatggctcactgcaacctccactctccaggttcaagcaactctcctgcctcagcctcctgagtagctgggactacaggcgtgcaccaccacacccggctaatttttgtatttttagtagagacggggtttcatcatgttggccaggccagtctggaactcttgacctcaagcgatctgcccgccttggcctcccaaagtgctgggaatacaggcatgagccacctcgcccagcctgtagtgcttttatccaaataagccttacattgcttaatgatggccccaaagtgcaagagaagtgatgttgtcatattgttataattgttttattattgttaatctcttcctatgtctaatttacacaataaactttatcacaagcattatgtataggaaaaaacatagtatatatagggtttggtgttatccatggattcaggcatccactaggggttttagagcatcccccactgtttatttctggaattttccatgtaatattttcgaaccacagttgactgtgggcagctgaaaccatggaaaacaaaactgtgggtgagaaggactagggtattttaaacattatataatcacagaaaagttatcccattaaatttaacatttagtattatctaatatattatgcattcaacctttgccagattgttccattaatatcctttatagctatctcctccctagtcatacattatatttagttatcacgtctctttagtctcttttgtctcttttaatctggaacaattccctagattttcttttgtctttcacgacattgacacttctgcagagaacaggctagtcctttaatttgggtttgtgtatttactcatgattagattcagtttatgcatttctggtataaataccatgtaaacaatatgtcctattcattgcgcgcatcagtagactaatgatgctgagtccttttattgttgtaacttcgatcttttgattaaggtggtatcttccaggtctcgactgcagttactttccttttgtaattaaaaagcaagttgcggggggatactttgtgactatgcaagttgttcatcaagctttcacccaatatttttatcatccattgataattgcttgagtcaatcatttctacagtgtgattttccaattctgtcattcctttttttttgtcattccattttgtttattaatctgctactccccatttagttagtatggactcagatttattttctatttatttatttatttgtttattttttgagacagaatctcgctctgtcacccagccaggctggagtgcagtggtgcaatctcggctcactgaacctccacctcccaggttcaagcagttctgctgcctcagcctcccaagtagctgggactataggtgcgtgccgccacacccggctaatttttttttttttttttgagaccttgtctcgccctgtcgtccaggctggagtgtagtggcgtgatcttggctcactgcaacctctgcctcctgagttcaagtgagtctcctgcctcagcctcatgagtagctgggattacaggcacgtgccaccacgcctggctaattttttttgtatttttagtagagacgggggggtttcaccatgttggtcaggctgatctcaaactcctgacctcgtaatctgccctcctcagcctcccaaagtgctgggattacaggcgtgagccatagtgtccagtcagatttttgtagttttagtagagacggggttttgccatgttggccaagctggtctcgaactcctgacctcaagtgatttgcccacttcggcctcccagtccctccctggaattacaggcatgaaccactgtgtcatgcctggactcagatttatttaataggttatgttctattctgttatgttttaaactttttaacttttcattttaaataacttgaaatttacataaaagttgcagaaataacatttatagctccttatacctttcacccaaattacccaattgttaatatttctgaactattaaagaataagttgcaggcgtgttgcctcattacagcttaattcttcagtgtacatttttaagtaccaggacactccagtataaccatcattaagaagttaacactgatggtatactacggtctaatccaccagctccattcacatttcattgatttgagccaataatgtcctttatcagtctaggatcacatattgcctctacttatcatttctctttagttttctttattctgaaacagtccttgtctttcatgaccttgacactttgtcaagaatacaggccgggtatggtaataccagtgctttgggaagctgagcatgagaatcgcttgagcccagctgtttgagaccagcctgggcaacagccagaccctgtgtctaccaaaaaaaaaaaaaaaaagtgtaagccagttactttgtagaatgtccctcagtttgggtttatctgatgttttgtgatttatacctttttgacagtaacactataggggtattgctgtgtccataacagtgcatcatattaggcagacctcatgatgattttgttgttactgatgtgttttatcacttggttaagatggtgtctgccaggtttctccacattaaaataataaatataacatatgaaatatttaaaatattgaatatgtaattaaaatattaaaaaatattttgtggggagataccttgatattataacatattcctgatccccaccatatgttcacccatggatttagcacccattaatgattattgccagaatctattgttgtggtagttgccgaatatcttatgatatttaaatatttaaagttaaaatatggtcttttaattaaatttcctttgttctggccgggtgcagtggctcatgcctgtaattccagcactttgggaggctgaggcaggaggatcatctgaggtcagtagttcagtaccagcctggccaacatgacgaaacctcgtctctactaaaaattaaaaaactagctggacaggatggtgcatgcctgttgtcccatctacttgggagctggaggttgcagtgagccaagatggtgccactgtactccagcctaggcgacagtgagactcagtctcaaaaaaaaaaaaaattcctttattctggatttattatttagcagtctactgtggggtagagctttcctttctcctttatttattacttatgtagatactcatttgtttcaaaattttaaatcagtacagactcttggattcctattgtattcagaggataacaatcaagttagttatttattttgatgctcaaattgtcctttagttggccacagtaaccctttcaagctggtacttggtgtcttttggacatatcctcattcttatttgatcacttcctcactttatggtacaagactttttctaggattgtcttatatgtttcctgctctagtcctggactcagccatttttccaagaaccctggttccttttagtagacagtgagatctggatgctatatgtgctcccagatctagacccttgcagtggacagagctaagaatatatggacatacatacatatgtacacacatatcagttttagtatttataagtattcaaaatcttgagtttataatgattcctccaattgcagcccagcaccacagggtttattatagccttctccctttccatatttgtaattccgtgaggaacctgacttctgttcttggggggttctggccaacagtgcaactgtggagtgtgcccctccagttgcaccagctcacagctatgcttcattcatgggacctctccccatctgctgaatatcacacctgaaagctcagttccaattaaggggaaacgaggaggaggaaaggcctggtggaaagcttggttctcttcatgtgtccccctccctgctactccccagccccgatgtattccaggaattacttatctgtattaccagtccctgtgacatttcctagaccaaggagattataaaagtatagagaagaatgtttgaaagataaaataagtggttgactggatcagattttactgagaggtcaaacaaggtgaggatttaaaataaattggcaacatggatatgttttgtgaccgtaataagtttgcaagtcttcctgtaatcaagaactattaataatagaattatagaatgtgatttggagatcatttaattacaaggaatagaaaactcttcaactagcttaaacaaaaattagaatttgtggaaggatagaagggcagcccactggcatataaagtccatgaaggcaaaggtttctttaataaactttcattaagataaaattcacataccataaaatatacctcagcacagggattttttgtgttttgtttaaattaatactgtattcccagtgctagaatagtataggacatgtaatagcactaagtatttgttggacaaataaatgaataaataaagaattaaagggtgagacatacgaggagcatcaatcaccacatgtattagtttcctaaggctgccattataaataaccacaaactagatggattaaaaacaacagaaattcattctcacagttaaacaggccaaaagtccaaaaccaagctgtcaacagggccacatacattctctttaacggaagatccgtccttgcctgttccgtttctgataactcccggctttccttggcctcaggcaccatacccccaacctctgcctctgtcttcatgtgacctttgctgtgtttctgttctctcctcctcttaggaggacaccagttattggatttagggctcaccctaatcaagtgtgatctcaactcttaactaaggaaatctgcaaagagcctatttttaaataaagtcacattccgaggtttcaggtggatgtgaatttggggggaacactgttcaactacaccattattctcactacctttccctggtcttatggtctctcacttgcttctttctgtagatttgcgtaattctcagtgtggacacactcgtgttatccacaagtgaacgatcctagctctgacttatatcaaccctacttctggtgttcagtcaagaatctgatctgtcttaggtcattttttttcttgtctagttagttggtaagactgattgggactgataggagagttcataagaataacgtgctacatgaatggggttggggatgagtggtgtttcttttacaaacccagacagaatctctgttctacacccatattactacaggataatgaacaaatggaaataatatgtgtgcgtgccaccacacaggtcctgattttgttttgttttgttttgtttttaagtagagacagggactcattatgttgcctaggctggtctcaaactcctgagctcaagcagtctgtccaccttggcttcccaaagtgctggcattacaggtgtgagccactacacccagccagaattcttaaatcttgagtttttcattgtcactgaaaattatcaaaagagttggctacagcttggccatcctttttatattaatatggttggagtcagagttttataacctgtatagaccttcgaatcatccagtacaactagctcctggttatggatgggaaaactgagaactagaaaggcatgattctcatactatagcatgcatcaaaatcacttgaaagacttgattcttgggccccactgccagtttctgattgagtgggtctggaatgagaccaaggaatttgtctgcatgcctcctcttcttctttcttctttcttcctcctcttccttctccttctcctcctcttcctccttctctctctgtctcctccttctcctcctcctccaccttctcttccccctccttctcttccttctttctccttctcctccttctccttctcttccttctttctccttctcctcctcctcctccttctcttccgtctttctcctcctcctcctccccctgacttcgacagggttctcctccgccgccgcctctgcctcttccatctcctctgccgccgctgcctccccctccccctcttccttctccttttcctcctcctcctccttgcttcgacagggtctctcactctgttgcccaggctggagtgcagtggcgtgaacacagctcactgcagccttgacctcctgggttcagcctcccaagtgactggaagtacagctgcatgccaccatgcctggctattttttaaagtttttgtagagatgagggtctcagtatgttgcccaggttagtctaactcctgggctcaaactgtcttcccatctgggcctcccaaagtgctgggattacaggcatgagccagtgtgcctggccagaatttgcatttctaacaagttctcattggatactgatagtacaggtctggggatcacacttctgagaaccaccagactgacggaactgtctgtgaccacacttttagatagtggctgagtggggactagaacccaagattcctatttctttttctcatataagggttcttagtatttctccttccttccttccttccttccttccttccttccttccttccttttctttctttctttccttccttcctttcttcttttcttttcttttcttttttcttttctttttctttcctttccttttcttttcttttctttttttgagacagttttgctcttgttgcccaggctagagtgcagtggcgtgatctcggctcactgcaacctctgcctcctgggttcaagcgattctctgcctcagtcttctgagtagctgggattacaggtgcccgccactgtgcccggctaatttttgtatttttagtagaaacagggtttcaccgtgttggccaggttggtcttgaactcctgacctcaggtgatccgcccacctcggcctcccaaagtgctgggattacaggcatgagccaccatgccctgcctggttcttagtatttcttatgtagaatggaggttggagccaggcatggtggctcacacctgtaatcctatcacttcgggaagctgaggtgggaggatggcttgagcctaggagtttgagatcagtctgggcaacatggcaaaaccctgtgtattagttctcttgctgctataaataattaccgaaactgggtaatttataaagaaaagaggtttaattcactcacagttctgcatggctggggaggcctcaggaaaggtggaaggcacctcttcacagggtggcaggagagagaaatgagagctgagcgaagggggaggccccttataaaactgtcagatcaaatgagaactcactgtcataagaacagcatgggggaaaccacccctgtgattcaattatctctacctggtcccacccttgacacatgggtattgtgggatctggccagcagcccgcaatgcaatggggctctctctttgttcccaggcggatcggcaggttgagaaataatagacacacacaagatagtgaaagctgggtccaggggggtcactgtcttctggtcccgcggtgccaacaatgcactggatataccagcatttattactaagtttagtgagggcgggggtaggttagtgagggatttagggtcatttgattatgaggtgagatggtcacatggggatgaaataattctttaacataacatttgtatgtagaagtatagtacatttgtatgtagaagtacagtatacagagataagaatttacaatatagtgtgtgcatcagtaatttctaatagagccttaaaacagaaacacagtctttccataacctatgattagcaagatattaatcagcagtaacagttgtagcaaaagctggttacaaacaatccatagaaacaggatgtgaagctagacaactggttagaccagaaattctcagaaggggagtatgtcttaaccctaaagaggcctagaagaaccgtggcaagatgagggcatttatagccctatcttatccatgtggacaggcgcccccaatgcgtccgtttataggctctccacaagggtcgcattctgttcccagagctatgaacatctgcttttctgggataggaatcttggtgatgtgaatcctccgtgattgcacatccattcataggctctttgcagggggaagcacatcacacgctgttggctcgttctggcagtccaacctggcattgtctttacacaatcctgcatgcaattttgtatttacaataatcaggagcatttcatcttttattccgtagcaatagtttcagggggtctccctacacatggggattattacaattcaaggtaagattttggcagggacacagccaaaccgtatcatccaccttctacaaagaatacaaaaaattggccagccatggtagagtgtgcctgtaatcccagctacttaggaggctgaggtgggaggatcgcctgagcctgggaggtcgaggctgcagtgagctgagatgatgccactgcacttccagcttgcgcaacagtgagaccctatctcaaaaaaaaaaaaaagaggttggcaaacaagggcccatggttcaattctggcctgccacttacttattattacagtgttagtatatacattctaatacatacatattagtgttagtattgtcacatatgttcaaagatcccgcccccccccagggatgtctgaaatcacagagagtaccaaaccctatgatactatgttttttcctatgcatgcatacctgtgataaagtttaatttataaattaggcaaagaggtgaacaacagcaatagaataattataacaacatactgtaataaaagttatgtgaatgtgatctctctctcaaaatatattcttgttctgtactcacctattttttgatggtggtaactgaatccacagaaagcaaaactgtggttgatggggaactactgtacttatagagatataattcacataccaaaaacttcactcttttaaagtatacagttcagtagttagtttatttacagagttgttcaactattaccactgtcttaattccagaatatgttcaacatccccaaaagaaacccaacattcatctgcagactacttattcccctccctggcaaccactatctttttctgtttctgtggatttgcttattctgcgtagaaatggaatcagataatatttggtcttttgcatctggcttctttcattttataacataatgtttttcaggctcatctattttgtaacatgtaccagtactgctttctttcattgccaagtaaataattagctgagcatggtgtcatgcacctgtagtctcagctacttgggaggctgagtcaggaggatcctttcaggccaggagttcaagtctagcctgggcaatatagtgagactctgtctcttaagaaaattcacataaaaataattcattcatcaattaatgaacatttggattgtttctacttttttactctaatgagtaatactactctgcacgtttgtgtacaagactttgtatggacatatgtttttagttctctggtgtatatacttgggagtcaaattgctaagtcaatggtagctctatgtttaacccttgaagaactccaggacagttttcatagtagctgcacttttttacacttctgccaagataaatggccagcagtgtgtgagtgctctgatttctcgccatcctcgttaacacttgttattgtctttttgattatagccatccatttctatgtgaagtggtgtcgcattgtgattttgatttgcatttcctaatggttaatgttgagcatcatctcatgtccttgaaaaaagtaaaatagaggtccctctttaaagattttcctctccatctaattaggaataaatagtaacttctcttaaaagcaaaatttattcgaagacaggtgctaacattcttaaatatctgctagccgtaataaagaaatcaatgtactttatgttcttagctccctcaatttagcctaaatatttgccctggcatgcttatactggtccaagcaagcattaggtcatagcctgttcctcttccttatttaaaagtgtttttatctttctcagcattccacaagttaacttcctccttcctttgttctcctctacctttgcctcttttaaaaagttctaagttgctagccagtcgggacaaataacagaatgtgaggtcccgttccagccaatggaaaccagacacagcagtagggtggacttgtcagattataaatgactctgtctcctttgttcggtgtactctcgtgacacagctactggcaagtgtaccctttctgcagaaagtaaaaatggccttactaaataaattaaatttatgttcaagtgctgtttctttacggcaccggagaacaagcatttcaaacatccttattggccatttgcatattttctttggagaaatatctgttcagatcctttgccgttttaaaaattgggttgcctttttgttgttgatttataagaattgtttatattgtctggacactagactcctatcagatacattatttgtaaatattgtctcccattgcgtggggtgtctttgcacccttttggtagtatgttttgcagcacaacagtttttcatcctgatgatttttatgtttgtttgtttgtttcagacagagtattgccctgtagcccaggctggaatatagtggcgtgatctcggctcagtgtagtctctgcctcccctgggttccagcgattcttctgcctcggcttcccgggtagctgggattacaggcatgccctgccatgccctgcccagttttcaagtccttcacttattttgttaaattattcctccaagtattttattctttgtatactatgacgaatggaattgttgactttattacatttttatattgttcattgctagtgtatagaaatatacctttttgataagttttttatatcctgggatcttgctgacctcaatagctcttaggatgtttttgtagatttcataggattttctgtatataagatcataagatactcagctcacaagatcatgagagggaattttactgattcctttcctatctggatgccatttatcttgccagtttccctggctacaatctctggtaaaatggtgtattgtatttattaaatttttatgttgaaccatccttgcattctagggaagatctctcctggtcatggtgtataatcctaattatatgtcgatagatttggtttggtagtttttaggattttgtatttatattcctatgggatagtctgtgattttcattttgagacagggtctcgctctgtcacccaggctagagtgcagtggagtgaacacagctcactgcagcctcaaccttccaggctcaaaccatactcccaagtatctgggaccacaggtgcacaccaccatgcctggctaattttcttattttttgtggagatggggtcttactatgctgcacaggctggtcttgaactcctgggctcaagcaatccccccactttgggctcttaaagtgttggattacgagtgtgagccatcacacctggctgtctttttttttttttttttttttttggtaccctttggttttgatgtcagagtaataatggccttctaaatgagtaactgttcctttttttgggcgggggggatgaggagaaggattctttttttttttttttttttttttttaatttttttagtatttattgatcattcttgggtgtttctcggagagggggatttggcagggtcataggacaatagtggagggaaggtcagcagataaacatgtgaacaaaggtctctggttttcctaggcagagggccctgccgccttcctcagtgtacagtccctgggtacttgagattagggagtggtgatgactcttaacgagtatgctgccttcaagcatctgtttaacaaagcacatcttgcaccgcccttaatccatttaacccttagtggacacagcacatgtttcagagagcacggggttgggggtaaggttatagattaacagcatcccaaggtggaagaatttttcttaatacagaacaaaatggagtctcctatgtctacttctttctacacagacagtaacaatctgatctctcttttccccacatttccccgttttctattcgacaaaaccgccatcgtcatcatggcccgttctcaatgagctgttgggtacacctcccagacagggtggaggccgggcagaggggctcctcacttcccagacggggcggctgggcagaggcgccccccccacctcgcggacggggcggctggccggccgggggctgccccccccccacctcgcggacggggcggctggccggggtgggggctgcccccccacctaactgacggggcggctggccgggcggaggggctcctcacttgtcagacagggcggctggtcagagatgctcctcacctcccggacggggtgacggcggggcagagacactcctcagttcccagacggggtcgcggccaggcagaggcgctcctcacatcccagacggggcggcagggcagaggcgctccccacatcccagacgatgggcggccgggcagagacgctcctcacttcctagacgggatgacggccgggaagaggtgctcctcacttcccagactgggcagaggggctcctcacatcccagacgatgggcggcggggcagagacacttctcacttcctagatggggtggcggccgtgcagaggctgcaatctcggcactttgggaggccaaggcaggcagctgggaggtggaggttatagtgagccgagatcacgccactgcactccagcctgggcaacattgagcactgagtgagcgagactccgtctgcaatcccggcacctcgggatgccgaggctggcagatcactcgcggtcaggagctggagaccagcccggccaacacggcgaaaccctgtctcaaccaaaaaatacaaaaaccagtcaggcgtggcagtgcgcgccttcggcaggctgaggcaggagaatcaggcagggaggttgcagtgagccgagatggcggcagtacagtccagcctcgtctcggcatcagagggagactgtgcaaagagggagagggagagggagaggaagaggagggagaggagggagagggagagggagaggaggattctttaaacattggattggtagacttcaccttgaagccatgtggtactgggcttttctctgtgagactttggattactgattcaattccttgttacaggcctgtatagattttgtttcttgaatccgtttttggtagtttgtgtcattctaggaatttgtctatttagtctaggttatctaatttattaccatgtaattgttcatactgttctcttataatcttttctatgtgtcaagttagtagtagtctgttctttgtttcctgattgtaataatttgagtcttctctgttttttttctttggttgatctagctaaaggtttgccatttttgttgatcttttcaaagaaccaacttttgctttagttgatagtctctctctttttttttgagatggactctcgttctttctcccaggctggagtgcagtggctcaatctcaactcactgctacctccgcctcccaggttcaagcaattctcttgtctcagcctcctgagtagctgggactacaggcacgtgccaccacacccagctagtttttgtattttgggtagagatggggtttcaccatgttagccaggctggtctctaactcctgacatcaagcgatccacccgcctcagcttcccaaagtgctgggaatacaggcgtgagccaccgcgccggcctctgttgcatttatttccactctagtttttattattttcttctttctgtttactgtggataaagttttttggttttggttttttttcaggtaaaagattaggttgttaatttgaggtctttattttatatatatatatatatatatatttatttattttttttttctttggtctcccaggctggagtgcagtggcgtgatctcaactcactgcaacctctgcttccgaggttcaagtgattcctctgcctcagcctcccaagtagctgggattacaggcattcactgccacaccgggctagtttttgtatttttagtagaaacagggtttcaccacattggccaggctagtcttgaactcctgacctcaggtgatctgcccacctcagcatcccaaagtgctgggattacaggcgtgagccaccgtgcccggcctgagatctttatttttaaacacagatgtctacagctatacatttccatttgagcattgcctttgctgcatcctatgcattttcgctgctgcgtgtttttactttttctaaatggttaggaaaaaacttaagacttagtgacacatgaaaagtatatgaaactcagattttattgtacataaataaggttttgttggaacagaaccacatccttttgtttacatgttgtctatagttaattttcatcctagagtggctgagttgagtagttgcaacagagaccttctggctggtaaagcctaaaatgttgactcttttggtcctttgcagaaaacaattattgacccctgttgtttaatatttcttgatatacagatgttttacatcatgataaattcatcataaaatcaaaaaatcataaatttagccattataagttgggaactgtttgtatattcatactatgaaaaattgagcttttcattgttatttttagcttgcatgagagttagagctgtatttgcttagagtaatattcctaagatgataatattcatcatttgatttttctgtgggttcttatgggctacctgttaacattcaaatatagagcacagcagtcatttcttcaccatgtggtcttaacctactttatctgaggtgtcttcaatttctgtctctgatttttaagtattcttctagactaatttaacagtatatgtgcaaaggcctaattttttaaaagatttttgtgacattaatgttttaaagaattttttctaaggaaaaaatgatgtctgcgaacattcattttataagactgtacaatgagaccgggtgcggtggctcatgtctgtgatcccagcactttgggaagccgaggcgggcggatcacgaggtcaggagatcgagaccatcctggctaacatggggaaaccccgtctctactaaaaatacaaaaaattagccaggcgtagtggcgggtacctgtagtcccagctacttgggaggctgaggcgggagaatggcgtgaacctgggaggcggggcttgcagtgagccgagatcgcgccactgcactctagcctgggcaagagagcgagactccgtctcagaaaaagaaagaaagactgtaccatgagaaatctgtgtgaaaaaaattgaaatgccaaaatgtttacaaagaagaatatttgataagttagaattccagcaatttaagtggaaaaagtgtatcctgggcaggtgcaatggctcacacctttaattcaaacactttggaaagccaaggcaggaggatcacttgaggccaggagtttgataccagcctgggcaacatagtgagatcctgtctctaccaaaaaaaaagtacattctaaaactgtagatacaatatagtctcataacaaataggagctaagctgttaatgattgtttctttttttaaaaaaaggattagttcttgatcgcaccagtccaaatgcttttcattttctacttttgtcttttctcccctaattgtaataaggaataaaacatactatggtgcgtatgtatgtgcgtgtgcgttgtggggaaaacctgtcctctgtcttactgctcctgctgtataaattctttttgattttcatagctgaaactaatcttttccttctcttccacattttgacattctttgtaacttgtttgtagggcttaacttttgatctgtgtggtggtatgtttatatcttgtttctcctacgggactgcagtttcgttgaggatacagtctgtatctcaatctttatctttcatgcatgtagaatgtttgttttttaaatttctctcctcagatgcggtggctcatgcctgtaatctcagcactttgggaggtggaggcgggcggatcacctgaggtcaggagttcaggaccagcctggccaacatggcgaaaccccatctctactaaaaatacaaaaattagccaggtgtggtggcacatgcctgtaatcgcagctacttgggaggctgaggcaggagaatcacttgaacctgggaggcggagattgcagtgagccaagatcgcaccattgcactccagcctgggcaacaagagcagaagagcagaactctgtctcaaaaaaaaaaaaaacgaaaagaaaggctgggcgcagtggtgcacgcctgtaatcccagcactttgggaggccaaggtgggcagatcacgaggtcaggagtttgagaccagcctgaccagcatggtgaaaccctgtcatggtggcgcgcttgtaatcccagctactcgggaggctgaggtaggagaatcgcttaaacccgggatgcgaaggttgcagtgaagagattacaggctgcactccatcctgggtgaccgagcaagactgtgtttcagaataaaataatcttccagttgttttttttttcttcaacatgtcttctgttatttaaaaaagacattttcttgagctctttcattggacgagagctgctggccaaaaactgtgtatatagtagggaaaacaagggtctatgtggttaagacataaacacagttaagagaagtagcacaaaatataaataaataatattaataattattgaattacaattttgagcacaaataggggcagagccacaaatagtcaaaatttactgtgaaatattgttgcattgtctgtatatttggggtgaataattgagaggcaactcttcaacagcctgttactccagacaggggtagaaactagtgagtacagcaaaaggcctttgaactataaagtccataccttaaagctgttgtacttttctgtgtgaactccagcatttttattctttggcaaatgtctaatacatacaaaagattgtaagtactcaaaaagccagtggtatagagttctttggtatggagaaaatagccaatgttttattgtattaataacaattctaaaattcatgttaaatttaaatttttggccaggcacagtggcttacgcctgtaatcccaacactttgggaggccaaggcaggcggatcacttgaggtcaggagtttgagaccagtctggccaacatggtgaaaccttgtctctactaaaaataaaaaaattagttgggtatggtggcacaggcctgtagtcccagctactcgagaggctgaggcaggagaatcacttttactcaggaggcggaggttgcagtgaaccgagatcaccccactgcactccagcctgggcaacagagagaggctccatctcaagaaacgtaataaataaataaatatatttacattttttattctgtttctatagtcaccatcaatttacatatttctcaatatacttcgtaagtgtaaacataaaggaatacggctgtcatctgccttggccagccatgatataggtcaagcttttattatatgtagtaatgttttgaggaacataattgaagctttattttattttggactctaataaataggtggaagattgttattactattttttgagacagagtcttgctttgttgcccaggctggagtgcagtggcatagtacgctcgtggctcagtacaactcccacctcagtctcccgagtagcttggactacaggtacgtgccaccacacttggctactttttgtagagacagggttttgccattgttgcccaggctggtcttgaactcctaaggtcaagtgatccacccacctcagcctcccaaagtggtgggattacaggtgtgagccaccacgcccagcctgaagattattttataagtgtgattttttttaagtggctgtgtagtcccaaaactataattagctgaaataatactgtaatgtttaaaacttatttagttatccctgaggtcatcagcacaaatcctgaaatagaaaatatagtaacgatatacttagaaattgaaatagaaatagaaaaagcttacagaaaatcagcattggcaataaccatggaaaacattttataatgtggttatactgttatcttttgcagagataacagacaggtttaaattttatttatttatttatttatttatttcagggggaaacgaggtctcagtctgttgcccaggctggagtgcagtggtgtgatctccgtttaccgcaccctccgcctcccaggctcaattgatcctcccacctcagtctcctgagtaactgagactgcaggagcgctcccagctaattttgtattctcagtagatatgggggattcgccacattgcccaggctggtctcaatctcctggactcaaatgatccgcccaactcagcctcccaaactgctggggtcaaaggcttgagccactgcacccagtctagttttttatcttatatgctgcttggatacctttgctggtcaaggctctgtgacaaagagtgccttaattgcttggtaatgtctactctgggcccacgatctaggaatggtagcccatatgccaggtatttattattgctgcaaaatattgcttattatacacattaaaatctatttgcaaagctaactatgcacgttaagtttattcctaattctactgaaattatcagacagaaaactggacgggcgtgatggcttaggtctgtaatcccagcacttttggaggctgatgtaggtggatcacttgaggtcaggagttcaagaccagcctcgccaacatggtgaatccccatctctgttgaaaatacaagaaaaattagccagccttggtggtgggcacctgtatcccaactactcaggaggctaaggcacgagaattgcttggactcaggagtcggaggttgcagtgagccatccctgcactccagcctggacgacagagcaaaactgtctcacaaaaaaagaagaaaacttagtggctgttaacactgaaaatacgtacattgaaatagtgtatcaaattcaagtgaatagcttgtaataaagtgttaaacataaaaagcaaaaaaaaagggggggggttgttgaacatagacttgcatagacctgtaatatgtacttgaatcaattgatatagctcataacttacatttgtcttagcagatggtagaaggtgtttctatctacagaatctataatcttgtctcaaaatgatttcccaaatgttttcagacttacctcagggcaaacagctcatttccctcaacttcatctctctcttcctgcttatcccaaagtcacaagtctagatcagcagtaagcagcaggtagcccagaaaaggccacactcagccaaatctggtgacctttagctgaatatagatgcgccttgacttacaatggggttacatctggcagagctgaaaagttgagcagcgtacggatgtgttttgcttttgtgccattgtaaagttggaaaatcttgagtctaaccgttgtaaattggggaccatgtatactttagtagttgagtctggtgggtagagaatttatcagttgctttgctttgcaactattatgcagttctaaactcagattggtttggtgtaagaacttttttgagttggatttgctatttttgaaaattattttgaaaattgtattggattatgatatagtcaagtattcagatcttaaatgttcagccaggctgggtgcggtggctcacgcttgtaatcctggcactttgggaggctgaggagggcagatcacttgaggtcaggagttggagaccagcctggccaacacagcaaaaccccgtctctactaaaaatacaaaaaattagcagggcgtggtggtgcacgcctgaaatcccagctactcaggaggctaaggcacgagaattgcttgaacctagaaggtaaaggttgcagtgagctgagattgtgtcactgcactccagcctgggtgacagagtaagactctgtctcaaaagaataaaaaataaatgtttagctggataaatttttacttacacccatgaaaccatcaacatgatgaagatagagaacatttccagctccccaggagtatttttcattctcctggagttagtaccctcccatcccagaggcgaccattattctgacttctattgctataccatacttttgcccgttctagaccgtcagataaatggtattatatgtatatcttctgtgtccagctctttttaaaagttggaacatacactttactatctcataaatctattccttttattttcagaagaataaactttttatttatttatttatttatttttagtagagacggggtttcgccatgttggccaggctggtctgtatctcctgacctcaagtgatccgtctgcctcagcctcccaaagtgctgggattacaggcgtgagccaccgtgcccagactacttttttattttttactttgtaacttgttatttagattcaggagtacatctgcaaggtaaactgcatgttctgagggtttgatgtacagataattttgtcacccaggtaataagcgtagtacctgataggtcttttttctgatcctttccctccttccaccctccaccatcaagtaggccccagtgtctgttgttcctctcctagtatccatgtgttcttgttatttagctcctacttacaagtgagaacatgtggtatttggttttcggttcctgtgatggtttgcttaggataatggcctccagttccatccatgttgctgcaaagtacatggtctcattctttttttaatggctgcataacaattcatggtgtatatgtacgatattttctttatcccgtttgccgctgatgggtatctagggtgatttaatgtctttgctgttgtgaatagcagtgcaatgaaagtaagtatgcatgtgtctttatgggagaactgccgagaccagctctgtcagggagaccctaacccagcggtgctagaggaattaaagacacacacacagaaatatagaggtgtgaagtgggaaatcaggggtctcacagccttcagagctgagagccccgaacagagatttgcccacatgtttattaacagcaagccagtcattagcattgtttctataggtattaaattaattaaaagtgtcccttatgggaaatgaagggatgggccaaattaaaggaattggttgggctagttaactgcagcaggagcatgtctttaaggcacagatcgctcatgctgttgtttgtggcttaagaatgcctttaagcggggccaggtgttccttgccctcattccggtaaacccacaaccttccagcgtgagcattagggccattatgaacatgttatagtgctgcagagattttgtttatagccagttttggggccagtttatagccagatttcgggggggcttgctcccaacatgtctcccttctttgatttgcaaagagatataaaagcaaaggcagctttgtcatggtgagctacttctcgcaggagtcaggatccgcatctgcagactatacaaagacaaataacatagattaaaagcacaatcatcattgaaatcacagagcttccaagtgtttttatccattttaatgggttactagctgctaatttgtctgcagctcctttaagcactccagttcctggcattaaggtcaggtgtgcctgggatgctttaaatatttgttcttttaattttgcaatatccaaagacaagtttgtagggtgtccttctagatgcttttttattctttcccaaattttgatcttattaagagcatttaatagtttccacaaatccttatgttaagctcctagagcaggccatatcatttgaggttgaggtgccactatactgctgtggttccagataataggagctcttgccatacttcttatcatttctaccatctgaccgttttgttcagatcacctgaacatagtgtgaccgtggcacacagactgagaggtgcagttcaagctaaacatccccttaggggaccaatcaataatgattccataggaatcattgtgccgcacctctgcctgttctgcagtgcaatcttcctaaacaaatatgttcattatttctggccaggtccagtccttcttagaaataggtttttgagggtagtatgcctcaataataggagcagatttattatggtaaatactgagatcagaaagcatatgtaactgtgtcagagtgattacatctaggcattattgccagccaagattgatgaatatgcctaataagtataattgttctctgtgtcagcccttattgaaggaatactcaaggcagtggtgataaccactatcatagctacctttaaattattcattgtgactggttgtcccgctttcctcaggttttcttctgccgtctgtgacagcttcttgatctgtccccaggtgggtggctctgttcgggtgttgctcatgacagttgggatcctcctcagcgtccgtctcgacatggctgcaatcagggggccctcgggatgctcccgggtctcttactcggcatctggctcatctgataaggtttcaggtgtcttgatggtatccaaatcggctgttgatttttgcctggagaaacacaagcataacctctaccccaaattattattttacctatttactaactttttgtaatcggatctctccaccaaatcagttgttctgcttctgtctttgcagctggtttctgtagatgctgttcagctgctgataacatctggcctttgggcaggctcaaaaaatttaaagttaataatgctaggttcagttgcatctgtggggttccatattctctgtctcctttctgcttttgcaactgctgttttagggagagattcattctttccactatggcttgtccttgagaattgtatgggataccagtaatgtgtttgatattccacatagagaaaaatgtagctagagcttggctagtatagcctggggcattacctaattgttttaatagaagttggaatgcccatcaccgcaaaacactgcacaagatgatgtttaacacaggcagaagactctcctgattggcatgtagcccagacaaagtgagaaaaggtgtccacacatacatgtacataagctagtctcccaaatgagggaatatgtgtgacatccatttgccaaagagagttaggttccaatccccgatgattaactcctcctgtaaaagatgaggactgtaccatttggtaagttgggcatcgctggataatagctttagcttctttccaggtaatgctgtatctgcgtttgagaccagaggcattaacatgggttaaatcatgaaagtgtctagcattaaataattgcattagcaactaggcgatcagccatttgattcctttcaaaggtcctggaaaaggtgtatgagccctaatgtgggtgatgtaaaaaggatgcattctattaactgctgtttgcagttgagtaaataaagtcatcagttgttcatctgcatgaaattgtaactgagcattttcaattaactgtgtggaatgaaccacgtatgaagaatgcttagcaggctgcaggttgtttactgcaggaattgtaaatgtaaaccgttcacagtcttgctcagctaaggggatggtaaagaaacagtctttttaatctatgactattaaaggctctgtcgcccaggctggagtgcagtggcacgatctcggctcactgcaagctctgcctcccgggttcccgccattctcctatctcagtctcccaagtagctgggactacaggctcccgccaccacacccagctaatttttgtatttttagtagagatggggtttcaccatgttagccaggatggtctcaatctcctgacctcgtgatccgcccacctcggcctccccaaagtgctgggattacaagcatgagtcaccacacctggctgctttctttccttttaaagagactattttaattgattttgatcacctctactcaaaactatcctaaggtccacattaggattagtctctaataatctgaagatataattcaattgtttaaaagaacatattaagaagactttggtagaattacatgtatcaagaaacactggacttgggcacaatggagatatggctgacttttgaaaaaagaagtagttttttgggggagggcagggcaaagaggtaggaagtagttggtactataaggaaatgttagagactattttggaaatgtattcattattttaaggcaactaacaaatggtcatctttctgttaggacattgtagcagcagcctttactggtcatgaaatttgcatgatatctaaaattatacttctgtaaataggtcagtgtcgattaatagtaactttgtatagaaaagcagatgccagctggcatagaagtggcagtgtagatgctggtagttctggagtcctggaagctatgagatgccatacatcacaaggccatcacagccaggtagataaatggctgaggaaagcagcggagctggccgtgccagcatttacaaatggaacacttcttgggcagccaggtgtcatggggcacagacccacagttctctttgcacacatcatgctcacagttccgtccatagaaggagagggggcaggcacagaaggaccccagcatgcaggttcccccattcagacagcaggttctgtttagttccttactgtcctgtatctccctgggcggcacaagttgggaagaccgaggatgaattgcaggctcctcctggggctgaatgctgtcatctctgaaggccaggtctccctgagatggacgcgcaagttcctgatggcccaacccttaacgaccttttttgactttttgatgatagccattctgcctgctgtgagatggtattttgttgtggttttgatttgcatttctctaatcattaatgatcttgagcatgttttcatatgcttgttggccacatgtatgtcttttttttttttttttttgattcagtcttgctctgtcgccaagctggagtgttcaagcaattctcctgcctcagcctcctgagtagctgggactacaggcacgcaccaccacgcctggctaattttttgtatttttagtagaggtagggtttcactatgttggctaggttggtctcgaactcctgacctcaagtgatccgcccgcctccgctacccaaagtgctgggattacaggcatgagccacgaccacgcccagcctgtcttttgaaaagtgtctgttcatgttttttgtctacttttcaatggggttgtttgatttttttttttttaacagtaaagtggaagcaagtttattaagaaagtaaaggaataaaagaatggctacaccacagaacagctaggtggtttgttttttacttgtaaatttaagttccttatagattctggatattagacctttgttgggtgcgcagtttgcatatattttcttccatctgcaggatgtttgtttactctgttgatagtttcttttgctgtgcaatagctccttagtttaattagatctcatttgtcaatttttgtttttgttgcagttgcttttggcgtcttcaccatgaaatcttagacaagtcctatgtctaaaatggtatttcctaggttgtctttcgagtttttatagttaggggttttacatttaagtcttgaatccatcttgagttgatttttgtatgtggtgttaggtgggggtccagtttctatcatctgcatatggtcacccagttatcctggcactttttattgactggggagtcctttttcccattgcttgtttttgtcagctttgttgagtatcaaatagttgtaggtgtgtgaccttacttctgtgctgtctattctgtttgattggtctatgtgtctgtttttgtaccagtaccatgctgttttggttattgtacccctgtagcatagtttgaagtccagtaacatgatgcctccagctttgttctttttgcttaggattgccttgtctgtttgggctctttttttggttccatgtgaattttaaaacattttttcctaattccgtgaagaatgtcattggtagtttgataggaatagcattgaatctgtagattgctttgggcagtatggccatttaacagtattgattcttcctatccatgagcatggaatgcatttccacttgtttgtgtcatctctgatttctttgagcagcgttttgtaattcttgttgtagagatctttcacctccctggttagctgtattcctaggtattttattctttttgtggcaattgtaactcacacttttaaaataaaatgtgtgctttttgtacaaaaaaatctcatatcgctgtcatggagcttccttggttcatcttttactgcgtgtgttccattgtgtgtgcactcagtcctgtgtgtgcttgtccacgcccccaccctgtatatatatgtacgtatatatagatgagtctttttttaactcttgagataaacctgcaaacatgttcctatcacctctaaatactctcatgtgtatttcccatgcacaaggatacttgtacataaccaacatacaacactccaaattaggagatgagcattgattaaacactatatccagtccacagactccattgaagttttgccagctttctcagctgtgtccgtttcctttctggcctgagatcctttccaggagtatgtgttcatttgagctgtcatgtcttgagtctgaaactgtttatcagttcttctttcatttcctttgcagttttaaagcatatagccacagccttcagttctgcatattctgcagagtgactcttcaacttgagtctgtctaatggttcctcatgactgggtccagtcatgcattcttcgtctttatttttggtaccagttttattgacatataattcatataccacacaattcactcatttaaagtgtgtaatttgatggttttagatgtattcaccgtaagttttgcaaccatcaccacagtcaattttagaacattttcattgcctcaaaaagaaaccctatactctttcatttgtgttctattgtaactggcttctttcacttaacattgttttcaaggctcatccgtgctatagcatgtcagtacttccttctcattgttgaatcatactccgttgtatggctgtgcctcattttattttattttattctttatttgagatggagtctcgctctgccgcccaggctggagtacagtggtgtgatctcagctcactgcaacctcctcctcccgggtttgagtgattcttctacctcagtctccccagtcgctggtactacaggcatgcgccatcaagcctggctaatttttgtatttttagtagagacaggtttcaccatgttgaccaggctggtctcgaacccctgacctcaggtgatctgccagccttggcctccccaaagtgctgggattaccgtatgagccaccacgcctggcctcattttgtttattcatccatcatttgatggacatttgggttgtttgcaccttgaagttgcgtaatactgctaaaaaagaacatttgtgtacaagttttttgttgttgtgtttttgtttttgttttgagatggagtttcactcttgttgcccaggctggactgcagtggcacgatctcggctcaccgcaacttccgcctcccgggttccagcaattctcctgcctcagcctcccgagtagctgggtttacaggcatgagccaccacatctgtactggacatattttttcactattcttcggtatagacctaggaatagaattgctggatatggtaacttcatatttatccttttgagaacctaaaggttatctaaagtcgctgcaccatttacatttctaccaacagtgtatgagggttctgatttctcaccataccctttaacacttggctattatttgtcatttttacgataaccattccggtaggtatgaagtggtatctcacagtggttttggtttgcattttctaatgactaatgatgttgagcatcttttcatggtgtattaaccattcatttgtctgagaaatgtctattcaagtcttttgcctatttttttattgagatgtcttttttgtttaattcgaggtaaaattcacatgacataaaactaacccttttaatgtgaacaattcatgacatttagtatattccttttttttttttttaaacgagacagagtctcactctgtcgcccaggctggagtggagtggcacaatctcagctcattgcaatctctgcctcccaggttcaaatgattctccagcctcagcttctgagtagctgggactacaggtgcgcaccacgcccagctaattttcatagatttagtagagacggggtttcaccatgttggccaagcaggtcttgaactcctggactcaagggatctgcccgccttggcctcccaaagtgctgggattacaggcatgagccaccatgcctggccaaagttttttttaaagtattttttcttttccttttacttttagttgatacataattgttcatatttatgggatactgagtgatatattttgatacatgtatacaacatgtaagaatcaaatcagggtaattagcatatccatcacctcaaacatttatcgtttctttgcattgtgaacattcaacaccctttcttctagcattttgaaaatatacactgaattgtagttaaccatattcactcaacagtgctacagaacaccagaatttattcctttcatcattatattgatagccatcctagtgagtatgaagtgatgtatcattggggctttgatttatgtttccttaatgactaatgatgttcagcatcttttcctgtgctttttggccatttgtatatcttctttggacaaacatctcatcaagtcttttgcatattttttaattgggttgtctttttgtttgtgagttgcaagttttttttattatggatactagacactttaattagatgtgatttgcaaacatttttcccactatgtaagttgtcttttcattttcttcatagtgtcctttgaaacacaacagttaattttgatgatttctaatttatctatttttttcttgtcggttgtgcttttgatgttatatctaagaaattgccagatctgaggtcacaaagatgtatgtgtgttttcttctagttttatagttttatctcttacatttaggtatttggtcagtgtttacatatggtatgaggtagcagtccaacttctttgtattacatgtggatatccacttgtcccagctacttttgttaaaaagactattccttccctgttgatttgtttcagaaataagtttgacagtaaatgtgaggttttatttctggattttcggttgatttatatgtctgtctgtactctagtactagtctttctgaatgttacttggtaggaatttttgagattaagaagtgtgagtcctctaattttgttctttttcaagatttttgttgttgttgttattctgggtctcttgagtttccatacaaattttagatcgggttctaatatgtgcaaagtcaggtggtattctgttaaagattgcattgactccatagatcaatttgagagtactgccgtctttaaaatattatatctcccagtccatgaaagtgggatatccttccatttatatagattttcttgtatttcttaatatgttttatagttttcagaaaaaagtctttaacatagctatttacacatatacacatgtgcatatacacaaaactcctatataatatcctggttatagttaatgttatgtaagtattgcagttaatactgttgttactaatctttttatatgtctttaacactttgggggaagtgggttgaaatagaaaaatagttaatagaaaagtatttaacagggggctgggcatggtggctcacgcctgtaattccagcactttgggaggctgaggcagacggatcatgaggtcaggagatcaagaccatcctggctaacacagtaaaaccccgtctctactaaaaatacaaaaaaaaaatttagctggtgtggtggcgggcgcctactcgggaggctgaggcaggagaatggtgtgagcccgggaggtggggcttgcagtgagccgagatcgcgccactgcactccagcctgggcaacagagcaagactctgtctcaaaaaaaaaaaaaaaaaaaattaacattcatcaagactctttgatgtaagaaaggctgaaattactggtactttattctttagtagagataatatgtaaaaagcatcaagtatatggccaaatgtaaataagcaggaaactatatgtataacatgatccctgttttgtaaaatgtgcatctattccttaattgacatgcatgggaaaaatcagaaggaaatgcatcagaaaattaactgtttattcctggctagaaggatttgattatttataatttttcaattattccatgttctgctttgaacgtgtatgtatgtgaacatgtacgcatgaagaaatattaaagttgctggattaaaaaatttttttttcttaagttttctgtagagtgggtcttactatattgtttaggctggtcttaaactcctggtctcaagctgtcctcctacctcagcctctcaaagtgctgggattatagacatgagccaccatgctcagcgaaagttgctgtttttattttatttactcacttatttatttattttgagatggagtctcactctgttgcccaggctggggtgcagtggtctagtcttggctcactgcaacctctgcctcctggttcaagcgattctcctgcctcagcctcctgagtagctgggattacaggcaatgcacaaaaacgcccagctagtttttgtatttttagtagagacagggtttcaccatgttggccaggctggtctcgaactctggactcaagtgatccgcatgcttcagtctcccaaagtgcttgtaagcatgagccactgtgcccaggtgaaagttactgtttttaaatagtgtagtaagcatgtagagatgttagacaactgatttagtttatttatctgaggcttttttctttttcttttttttcttttctttttttttgagatggagtctcgctctgttgcccaggctggagtgcagtggcgtgatctcggctcactgcagcctccacctcctgggttcaagcaattctcctgcctcagcctcctgagtagctgggactacaggtgcacaccaccatgcctggctaatttttgtatttttagtagagatggggtttcactatgttgggcaggcttgtcttgaactcctgacctcaggtgatcttcctgcctcaccctcccaaagtgctaggattacaggcgtgagccactgcacccggccaaggctttttttctttgtgtaaaatgttaattatttctcttgcctactttataaacacattgtataaagacattttaaaaatatatctatagtttggaagttgtgaagccctgtggaaatatctgaaggggcacacactgctgttcagaaatctgagaaatcatccttatccctaggtaaaacttaacagctgctgggttctttttagattcatggtgttgttttaatagtattgagggcccacattttaaagatatttttaggccgggtgtgatggctcacgcctgtattcccagcactttgggaggccgaggcgagcggatcacgaggtcaggagatcaagaccatcctggctaacatggtgaaaccccgtctctactaaaaattagaaaaaattagccgggcgtggtggcgggcacctgtagtcccggctacttgggaggctgaggcaggagaatggcgtgaactcgggagaggtagcttgcagtgagccgagatcgcgccactgtactccagcctgggcgacagagcgagacgccatctcaaaaaacaaacaaacaaaaaaaaaccatatttttaggatttaacatttatcttcacaattttttaaagctactcttctgctacttacttactgggatttaaaacagtgtctaatagcattattcaatgatttttccaccaggcacggatgggcagaagcctttgcaggtatcagaagttcacatatcaaatatatctgcccgcatgcgtgagtatttctgatcttcaggcttgtgattcagagtctggagaggagcaattgtgattgctttacccttccagaaaagtatttgaatacagttaatttttactttttaaatattgtttaaaaataaagattagtagaattccttaaaactaaaatggtttcttaggtaaattgatttttttctttttctctttcgttaagcaatttaaaatattgctgtcttggaggtcagctgaacttaagaccagaaaaattattttatttatttatttatttatttatttatttttgagacagagtctcactctgccacccaggctggagtgcagtggcgtgatctcggctcactgcaacctccacctcctgggttcaagcgattctcctgcctcagcctccagagtagctgggattacaggtacgtgccaccacgcccagctaatttttgtatgtttagtagaggcagggtttcaccatgttggccaggctattctcaaatgcctgacctcaagtgatcgacctgccttggcctcccagaaaaattatcttagatatacaaatatctataaagttctaggatatccctagggtatctctgaaggggatttacctgttagatttgtgagaactctttattacgttgaaaacactctttaattttatcgtttggggcaatgttgatgtactgtggaaagagcacagactttggaatatgataggtattgttttgaattctggctctgaaagttttgagcaaacttagaagatcaataagattggcacattaggtcaagcttgtccaacctgtggcccaggtcagtttgaatgcagcccaatgcaaattagtaaactttcttaaaacattatgagatttttttttttgcgatttttaaatattattttattttttacctcatcagctattgttagtgttaatgtatttttatgtgtggcccaagacaattcttcttccaatgtagcccagggaaaccaaatgattggacacccttgatttaggtcaaaaagttgctgagaagcaataaccatggagaagacaagaagggattggacatactcatgtcagttagtaattcatccccagaagtggtagtagcagtagagttgggacagatacataaacatgaaagagggaatgggaagaagaataacagctgagaagattggataagaaaacatttcttcctctttttatcctgaaatacagtctgtcttacctctaggctacagtgaatactgtggctagggttgctatgtcctctatcattctgctcaagcaagagacagaattctttttattctttttctttttttttgagatggagtctctctctgttgcccaagatggagtgcagtggcataatcctggtttactgcaacctctgcctcccgggttcatgcgtttctcctgcctcagcctcccaagtagctggaattacaggcgcctgccaccatgcctgggctaattttttgtatttttaatagagacatggtttcaccatgttggccgggctggtctcaaactcctgatctcaggtgatccgcccgcctcggcctcccaaagtgctgggattacaggcgtgacccaccccgcccggcccagaattcttaattacgttggaatggatattgatatttgccccaagttgaactgctttaaaaggctgttgcccaacctaggaagtttgtattttcaaagaaattttgatacagtttgtaacctctaaggtggacttacttcatgaatcaggaggaaagtggtgagatgtagttagagtgtgcttatttttctttcctttggatggagctgaattcagattatctagcatatttttaatcacagacttgaattggctataatggacacttaggcaaattttggatttcccttatttatttagaggtctcttaagcaagtacatagctaagaactagaaaattaggaaaagtgtaatctgagcatatgagaattgatgctacagtatcagtgtaataaatcactcattgtccttagccctataccggaatctcgtgttttatacatttccaactgtcttggtttctggtttctcttctcgtgtctgagaagtcaaaagtagtaagtaagggtgttgagaagggaaaatgtatctgtcaagcttcgtcctttgttgctgttgctctgtcttcagaacacatttggaggggcgtggaaagcagagttgtacaggtgtggatgaaataaaacagttcatatgttaaaactgtagcatatagttttgtgtaggtctcaagcaattatctgtttttgattaatggaatttatcagtttttatgctttgttattctgattttgttgttttttcttttccatgtaggcctgttaggcctgttacattaaatatgaacgtggctatgccttcatggtaagtaagaatttacttattgaataagaacattatattacttatttaatgttatcagaaatgcttttgtgtacagcagtttttatttagctgttttttaaattgcaaagttgcatagttaacctctatttacattttcatactctggatttaggggtaaacttaaggagctgtacatacaggtagaggaaataggagagagtgtttgaataaaaatcatgtgggagaatatcttctgctgcttgataaacctttgttggttttagtaacccaacattcgaatgacccctattaaaccacagcctcttcatctttccaatttcttgcctgtctgggttgtttttaaggaaaccgcttcccttccagccctctgaagatatcctcacattccctctgcactttactgtcagaaagtagggtcagttttttgttcctatgtgctacttccagactatgatttttcctaactgttctctgagactcctaacatcaggtctgttaaaaaacgatgactttagccgggcatggtggctcacacctataatcccaacactttgggaggcagaggcaggctgatcaactgaggtcaggagttcaggaccagcctggccaacacagtgaaaccccatgtctactaaaaatacaaaaattagccgggtgtggtggcatgcacctgtagtaccagctactcaggaggctgacacaggagaattgcttgaacctgggagggggaggctgcagtgagcagagatcatgccactgcacttcagcctgagcaacagagtgagacttcgtctcaaaaaataaataaataaataaataaataaataaataaatagtgagacttcgtctcaaaaaataaattaattaaatagataaattaaataaaataaaacatatttctggttagccttttaatccaagctaccatgaatgtagtaaaatatacttactacaataatagatttttcttagaatcaaaagattttgccttattttacaggtttgatattattgggctttcaccagattcacaggaggatgaatctgggattaaacaggcagcagaaaatagtaagtacagaaaatgtttataaagccaaaagtgttcttaaatgtttttagtagatttagtaatcatatcgctactggttaaaaattacacatttgggccgggcacggtggctcacgcctgtaatcccagtactttgggaagtagaggcgggtgggtcacctgaaggtcaggagttcaagaccagcttggccagcatggtgaaaccccatctctactgaaaatacaaaaaattagctggatatggtggtgggcgcctgtaatcccagccacttgagaggatgaagcaggatagttgcttgaacctgggaggtggaggttgcagtgagctgagatcgccccactgcgctccagcctgggcaaccagagcaaaacttcatctcagaaaaacaaaaacaaaaacaaaccaaaaaaaaccacatttatctaatctcaggaggtactgctgtttccttccttttaccccctgccccccagagagggtcttgctgtgtcacctagcctggaatgcagtggcgtgatcaaagctcactgcagccttgacctcctgaactcaagcgacccttccacctcatcctcctgagtaggctgggaccatggaggcgcacaccaccatgccccgccaggttttaattttttctttttgtagacacagggtctccctgtgttgcccaggcttgttttcctttctggtcactctgttacttgtttgccacagtgtccgcatggactcacttgagtataggcaatggagatgaggtggatggggacaaatggcatttatcaactttaaactctgtcagacgtataataatttttctttgatttacataggaaaatggagaaaacagcagaatgtttatatagttttggccggccgggcgtggtggctcacgcctttaatcccagcactttgggaagccgaggtgggcagatcatgtgaggtcaggagttcgagaccagcctggctaacctagtgaaaccccgtttctactaaaaattaaaaaattagctgggcgtggtcacgcacgcctgtaattccagctacttgggaggccgaggcaggagaatcgcttgaacccaggaggcagaggtttcagtgagccgagattgcgccattgcactcaggcttgggcaacaagaatgaaactctgtctcaaaaaaaaaaatagttttggccagttatcttcattaaagagacttggaataacagtgaaaataatgatataatgagtataatgataagaaacagtgaaaatgtggtcaagtgcggtggctcacgcctgtaaccccagcactttgagaggccgaggcaggcagatcacctgaggtcaggagtttgagaccagcctggccaacatggtgaaaccccgtctctactaaaaatacaaaaaaattagccaggcgtggtggcgggcacctgtaatcccagttactcaggaggctgaggcaggagaatcgcttgaacccagtaggtggaggttgcagtgagctgaggttgtgccattgcactccagcctgggtgacagagggagactgtgtctcaaaaaaaaaaaaaaaaaaaaaggaagaaaaaagttgttaatgttagtgcggtaataataacacgtgccactgattgagcacataactgtttacaagctaggtgtttcttacagggcacctcatttgacaccgctgtgaagtattagctctgctttacaaaacctcgaaagcctggtctctggttaggagtccatctcctttatgattatggtaattctagttgttcggagggagaaacagaatactaacttactgggacgtgtctatttttaacaaatgcacaggaggccgggcacggtggctcacacctgtaatcccagcactttgggaggctgaggcaggcggatcgcctgaggtcgagagttcgagatcaggctgaccaacatggagaaaccccgtctctattataaatacaaaattagccgggcatggtagcgcctgcccgtaatcccagctacttgggaggctgagccaggagaattgtttgaacctgggaggcagaggctacagtgagctgagatcccactgttgcactccagcctgggcaacaagagtgaaactccgtctcaggaaaaaaagaaagaaagaaatgcacaggtgcacaggaatgtgcttttcttttacatatgtgtactgaaatattgacaagtataataatgtgaggactgggattgccttcaggaaaatctggttggtgactcttgagtgtgggtgggtgtaggtgggtgtgggcagcaatggcaaggcaggctggctgtgaattgttttgctttttggtaattttttatttacatagttacttagagactgtcgcccaggttagagtacagttggtgatcatatctcactgcagcctcaaattcctggtctccagcaactctcccgcctcagcttctgagtagctgggactacaggcatgtgccaccatgcctggctaatttttaaactgttttgtagagatgaattctcattatgttgtccaggctggtgggaaactcttgccctcaggtgatcctccccaaaagtactgggattacaggcatgagccactgagcgcagcccttttgttttaaaagaactctttaaggtctttaaaacagggaaaatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcaacagagcgagactccgtctcaaaaaaaaaaaaaaaacagggaaaatacattcaaaagatgtgagatatttgggaatgtcaaaccaacaacactgacttatgggatcattaaaaagtagattagagttagaatcctagagttgggattttgtctgaaaataatagatgacaaaagtatgagggtaagtgttagatgctatggaaaacagggagggcctgggccctgtgaagaagatacgtgggcctcatgaggtccagaatgaaagattctgtcctaacaatagagttggcctatgaaatacttgttacttctttcctctctgaaaattcctctcagagaaaattagaatcagactcagccaggaaagaaaaaacaaaagagaatgtgctactgaacaaagaagacagtgctcaggttacatagttgggggtacatagtgcccttacccttaggtgaaaggtgattgaggccaagggatgttgctcatacctgtaatcctagcactttgagaggctgaggcaggaggatcacttgagcccaggggttcaaaaccagcctgggcaagagtcgctacaaaaaaaaaaacaaaattagctgggcgtggtggcgcatgtctgtggccccctcagctgcttgagagtctgaggtgggaggattgcttgagcctgagaggtcagcaacagagtgagaccctgttttgagagagagagagagagagacagagacagagacacagagagagagtgtgagcgagcaaaagagatttattctggtttttttttgtttgtttttgagatggagtcttgctctcttgctcaggctggagtgcagtggcgcaatctcagctcactgcaacctccacctcctgggttcaagttattctcctgtctcagcctcccaagtagctaggactacaggcctgtgccaccatgcccggctacgttttgtatttttagtacagacggtgtttcaccatgttggccaggctggtctcaaactcctggcctcaagttgatctgctggcctcagccttccaaagtgctgggattacaggcgtgagccactgtgcctggccaattctgtgattttttttaaaaaacaatagaatgaatggttttaaacactttttaaaccattaacttaactacgtacaacacttaactacgtacaattttaaacacttaactacgtacaattttaaaatgacaacttttaggtacaaatgcctatggttcattgaagagagaaacatggaatatatatgagcagaattaactattaattttttaaaaatccatctcttgatgagagaaagaactgttgttaacaaaatatttaatgggaaattattgaagttttaattaaaattttatttttttattttcaatttttgtgagtacataggtgtacatatttatatgtacgtgagatgttttgatacagggatgcaatgtgaaataagcacatcatggagaatggggtgtccatcccctcaagcgtttatcctttgagttacaaagaatccatttacactcttgtaagttattttaaaatgtacactaagttactattgactatagtcaccctattgtactgtcaaatggtaggtcttattctattttttttgtacccattaactagctacacctcacctccagcccccttctacccttccagcctctgataaccatacttctactactgtctgtgtctgttagttcagttagttttagatcccacaaaaaagtgagaacatgcaatgtttgtctttctgtgtctggcttatttcccttaacataatgatctccagttccacttgtgttgttgcaaatgactggatctcattctttttttatggctgaatagtacttcattgtgcatatgtaccacattttcttcatccagtcatctgttgatggacacataggttacttccaaatcttggctattgggaacagtgctacaacaaacatgggagtacagatatctcttcaatatactgatttcctttcttttgggtatatatcccaaaagatatatacccaaatatagttaaaagaaagatactttcttttgagtatatatccagtgggattgctggttcatatggtagctcaatttttagttatttgaggaacctccaaactgttccccatagtagttgtactaatttacattcccaccaacagtgtatgagggttctcttttctccacatccttgccagcatttgctattaactgtcttttgaataaaaaccattttaactggggtgagacgatatttcattgtagttttgatttgcattttgctggcgatcagtgatgttgggcaccttttcatatgcctgtttgccatttttatgtcatcttttcggaaatgtctattcagatctttggcccgttttttttgttcttgtttgttttgagacagagtcttgctctttcgccaggctggggtgcagtggtgcaatcttggctcactgcaacctccgtctcccgagttcaagtgattctcctgcctcagcctcccaagtagctgcgactacaggtgcgcaccaccatgcccagctaattttttaatctgtagtagatacggggtttcaccacgttgggcaggatggtcttgatcacttgacctcgtaacccaccctcctcggtctcccaaagtgctgggattgcaggcatgagccactgtgcccggcctggcccattttttgatcagattattagatttttttcctatagagttgttaaagctccttatatattctggttattaatcccttctcagatgggtagtttccaaatattttctcccattctgtgggttgtctcctcactttgttgattgtatcctttgctgtgcagaagctttttaacttgatgtgatcccatttgtccatttttgctttggttgatatgcttgtggggtatttctcaagaaatttttgcccagaccaatgtcctggagattttccccaattttttctcgtagtagtttcatagtttgagatcttagatttaagtgtttattgtgatttgatttttgtatacagcaagagatagggtctaattttattcttctgcatatggatatccagttttcccaggaccatttttattgaagagactgtcttttccccagtgtatgttcttgacacctttgtcaaaaatgaattcactgtaggtgtgtgtgtatagatttgtttctgggttctctattctgttcctttagtctgtgtgtctgtttttatgccagtaccatgcagttttggttactatagctctgtagtataatttgaagtaaagtaatgtgattcctctagttttattctttttgcttagggtagctttggctactctgagtctttcgtgattccatataaattttagggggctaggcacggtggctcacgcctgtaatcctagtactttgggaggccgaggcgggcggatctcgagttcaggagatcgaccatcctggctaacacggtgaaacctcgtctctactaaaaatacaaaaaattagccgggcatggtggtgggcacccgtagtcccagctacttgggaggctgaggcaggagaatggcatgaatccagtaggcggagcttgcagtgagccaagatcacgccactgcactccagcctgggtgacagagcgagactttgtctcaaaaaaaaaaaaaaaataattaggattgtttttctatttctgtgaagattgtcattggtattttcatagagattgcattgaatctgtagattgctttgggtgatttgggaaaaatattccatggtcatggattagaagaattcatgaacaataacaatcaatattgttattggttcttcttatccatgaccatggaatcttttttccattttttggtgtcctctttcatcagtgttttatagttttcattatagagaccgttcacttctttgtttaattcctaggtatttaattttatgtgtgactatcggaaatttgatttttttaaaatttccttttcacgttgttctccgttggcatatgaaaatacattctaattttgtattttaatgaagtgctttgaatttttcactcatttccaccttaaaagtaattgcgcttttctattactaattttttcctaatttaaattttatcagtgggcttaactctgaaagtattgctgactaactttcatgttgtttttagtaaaagctttgattgatcaagaagtgaagaatggcattccttctaacagaattattttgggagggttttctcaggtaagataaaatttgagtggaatgtcagtaccatcagtatacttatttagaagtctgtgcattaatcctttctatagagtagtcttttttgatgttatagaatcttgactgatacacttacctttgatgtttaattaagtttcagtgtactggaactaattaatttcttcttgaaagaactataatacacatgtacacatgtaattaaatttctaagttaacacagtttatccttttaattaattaaaactgataacacaggcatgagtcccctctataggaggagactactgataggaacagtaaagtggaagacaagagaatttcttccctttaccttcacgtattacaggttttaggtatgaatatgtggtgtttatttttggcatttttctttgtctctgtactttttcccctgctttctgtactccctccacagacgtagcttcctcatacggacctttctttcatggctactgcggcatataagctgtttgccatggaaccagtccccagatgctctaacttatcatctgtaaatcttctaagttagcaacttagtgtttggattaccttaattagggagatgtttggattaccttaattagggagatgtcagaattctgaaattatttagaagatagaattcagtagaaagatttgttgatacaatatagtgaaaaggtgttactgatttggtgtttgttgaaattcacagataatgtatattgtaatacacattgtgacataaacatagggacagaaattaatgatccaggccaggcacggtggctcacgcctgtaatcccagcactttgggaggccaaggtgggtggatcacttgaggtcaggagttcgagaccagcccagccaacatggtgaaaccctgtctctactaaaaatacaaaaattagccgggcatagtggtgcacgcctctgtaactccagctactccggaggctgaagcaggaaaatcacttgaacccaggagccagaggttgcagtgagccaagatcgcaccactatactccagcctgggcaacagagctgagactctgtctcaaaaataataataataatgatccagaataacaagttcatgtgggagtctgtatatttgatattcattcattacagtatatagaaaccaactcaatacctcaagcaaggagtaagcaatgagtctgtggcatcctatcaaggaaactgaggaggaaaatgaggcaaggcctcaggaagtagctagaaattgaaaagcagttgggccttgctcaccatctctcatctcttgtttctttgcttgtctgtttcatttacctttccataaacaattggccatcttggcttttgcagcctatagcttttccagctcttgaatttacatgttacaggtgtagccacacagagagtgactggtggtcatcgaatcccatttccacagtgccaggagaaaacatcactgcctgggatgtgaaaggctctcgtgtactcatgtgttgcagtaacccatgggcatggtcagagtgatggggcttctggatgctggcaggagtacagcttccagaatgtgggatgttgtgagctgggtaggcagatactctgaaggtgtctgctaaatagttattattatcttaaattctcatttagaaagtaataccaatttaagggccaggcacggtggctcacacctgtaatcccaacactttgggaggctgaggcgcgtggatcacctgaggtcgggagtttgagaccagcctaaccaacatggagaaaccccgtctctaccaaaaatacaaaattagccgggtgtggtggtgcatgcctgtaatcccagctactcgggaggctgaggcaggagaatcgcttgaactcaggaggcggaggttgtggtgagccaagattgcaccattactctccagcctgggcaacaagagtgaaactccatctcaaaaaaaaaaaaaaaagtaataccaatttaagagcagattggattttatgcctaaaattctgcaaaggagaaaatataaattcagaatattcgtaaggcatgttgtaagtgcagcagtttcccatggtacaaactatgtctcgtcggaaaggaagtctgtatgttctctggtgtagagaaccgcatcctttaggacacggtggggtgtgtttgtatttccgatatttgcctgatttgatttgacaccagccaccaagtttgatttttttatggatatcattagtaacaagatattccctaaattgctgtgggcaagcatgtgtgttccattgactttccctgcttgtcttttcagggaggagctttatctttatatactgcccttaccacacagcagaaactggcaggtgtcactgcactcagttgctggcttccacttcgggcttcctttccacaggtaacttggttgatgcactcaacatgagattactgagctaaaggtagctagtagatattgttggagataaagtcatcttatttttttttattaataaactttattttttggagaagttctaaattcacagcaaaactgagcagaaggtacagagttactatctacctcctgtccccacacatgcacagcctccccaccatcagcatccccacctccacagccatgtttttgctgcagtcagtaatgctgcactgacacatcaccatcaccaagtcctccacttacagcactcatccttttttaaaaataattttcttagacttttgtgatgtattactaggccttatttctgtacgctatactgtctgtattgtggagtacatagaatggaattagaaagaaaccttattgtcacaaatcttatattagaaggatttgatacattttaggatatatatgaaaattaggactttttttaacatatagaaatcatacttatttttagaccaggtgcggtggctcatgcctgtaatcccagcactttgggaggctgaggcgggtggattacctcaggtcaggagttcaagaccagcctggccaacatggtgaaaccccatggctactaaaaatacagaaattagctgggcgtcgtggtgcacacctataatcccagctactcaggaggctgaggcatgagaatcacttgaacccaggaggtggaagttgcagtgagccacgattgtgccacttcactccagcctgggtaacagagcaagactctgtctttgggggaaaaaaaaaaaaaaagatagctgaataaaacagcaactcaaaatactaaaacaaccaaccaaacaaacaaaaaaaagctgaaaatataaagatggattaaaatataatctgcttggctgggtgcagtggctcacgcctgtaatcccagcactttcggaggccaaggcaggtggatcacaaggtcaggagattgagaccatcctgggtaacacagtgaaaccctgtctctactaaaaaatacaaaaaaattagctgggcgtggtggcacgtgcctgtaatcccagctacttgggaggctgaggcaggagaattgcttgaacctgggaggcagaggttgcagtgagctgagatcacgccactgcactccagcctgggcaacagagcaagactccgtctcaaaaaaactaaacgaaacaaaaaaatgtatatataatctgcttcaaggaactcattcactgggaagatatatattataatatgaggcaaggtgatcatacatcctatagaagtcaaagggatgtggtgagtatatggatgaaggaattttatttttttggccaaatgtaacttctaatatgttatatatatgcatatttatgtacaattttaaatgcctggcatagtgtcctatacttttacaaaaataaaactatttcttcttttgctttttgcagggtcctatcggtggtgctaatagagatatttctattctccagtgccacggggattgtgaccctttggttcccctgatgtttggttctcttacggtggaaaaactaaaaacattggtgaatccagccaatgtgacctttaaaacctatgaaggtatgatgcacagttcgtgtcaacaggtaggtgtctagaagcagtgatcagcgccatatttgtaacttttttcatgtgatattttcaagaaaagtaacatttgaatgcttggggatttaaatgagttaattcatattgagtcataagttagcagtcattagatgagtgtgtattcaacttaattcaacaaatatttactgattggctattatacacagcattgtacataattcaaagatgaataataaacattccctttcattaaaatttaagataaaatttaatagaaagatgcatgtctaagtaactgtatggatagcagaatgtgatatacattgtattagaagctttaaaaagtgcccttggaaaataacaaaaggtgccctgaaaaactgagaagagattaattttatcttaggaggcactgagaccatgatgaaacagctagattttgaaaaacggtgggatttggatagcaaatgtgcagagaaagaactataggacaggaaaagcaagccattcagtcttaggaaaagctgggcatgataggacagaagacatagggaacagagactctttgtgctgagaagggacttactagacttactctctaggcagcaggaagctgtcagtgtttttggttgaagtgagatgtgatctgatctacattctagagacaggtgatccagcaggatttagagattaattatgtggggtgtagtaaccaaggaagtatcaaaagggcctgagatttctagttctgatgccatcataaaaagtaggtgcaagaaacagttttagagtaaaggaaggagataatactgagtttaatgtattgagatcaatgtgcccccacaatatcaaaataggatattggaaatacttgtctgaagttcaagcctggaaatggagatttgaaataattactaatataattgatcaacgaagaattatcttgagaaagcattataagaaaaaaagctcagggatagaactttgggggacacattacagtttagcctaatgagaaaaggagttaggtgttgagagtatgggtggagagaatttcagagtgggaaggagatgtgtaatgtgttccagagaaggattaaggagaaatagtttaggaagaaagtacccaatattaagccacctgtgaccttggatgtttgggtagataaagccaaaatgcaaaggattgtatgaagtggatagggaaatgaggaagcagaggcaacatgtatagaccttttaaaaaagttttggtaaacaggaagaagagtaggaaatctgttcttcagtgggatcagagaaagacctatgagtggaaggagggaggaagaagatgcagtaaagagaagataattgatagaggcattctcagagggatcatagaatagaattaagtcctgagatgtatagtgcttgccttaaaagaggagaaaaccattttcaatcaagatagaagaggacaggccgggtgaggtggcgggcacctgtggttccaattactctagaggctgaggcgagaggatcacttgatctccggaggttgctgctgcagtgagccatgttggcaccctgcactccagcctgagtgacagagtgagaccctaaaaaaaagaaagaaaggatggatgaatataaacaggagatggagagagaagagagtgcttgggagctcatattagatgtgcttatcttttcagtcaagtagaaggtgcgatcacttgatagaatgaaggaggccggaggcctggataggtctggaggcttgagaagacctagagtaaaaattgattcctagtgagatagtcatactgacagttttacaaccactcagcctgggttaaataatttagggacggagaaagaggtggtaatatgatttatccagaaagacaagggtgcctgggaacctgaacctagggtgttctcctactgatatagagtattacagtgttgaatccagaaaagagagggcaggggaagtcctggaacccttaatgtgtgcaagagggactgaaggtctctagagcagctgttttcttcatgggctttgtatcacaaataccttggagcttcataaaagctctatagatgagtctacaacaactctgggctgaatgaggaggagcagaaaatgaggagaagtaggatagtgggaggtgatctcacaggaaactctttgggacttcagagtattgtgaaatagaacactttcatgctggggctcttttctgagtgactaaattacaaggctgaaggttagctgcattgctactatttggcactgtgaggctaagtaaggccttgaaatataagagctgatagcaggaagtgagtttgagggaggtgagaaaactgagccaaatgcaagaggctaagaggagaaagtttcttctatgataaatctttggtatattaatgttcatatcttcccaggaacatcttaggtacatgctctctatcaaatggttagttgtatgtaattctttatgaaagacacagcatagttaatgctatggatttagcgcataattcagtttgaagaatggtagaagctctgctttgtcactcatacttagttgtcagtaattgttcacttactgagacttctcagtgtaggcaccatcgcttctaaacttccctgccccccagtgtcttatattgttccagtataggaagatgcagaactagatactggatgggagctgtcatttcagtgtacaataatcatgataggaaatgtcctgaaatttctgttggagcctcatttctcttttgtcttatttaattgtagtaaaaatgtgatttcgcctttatgcataccatagatttgattagtggcattttagtgggaatttaatttctgacttacataactacctacctattaaattactttattccaaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgttaaaatgttttgcaaatacatgccaataacacagatcaaataatatctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaaagtttgttttttctttattgtccttcatagcaggccaagtattgcctctctgcaatagacagctactgtcaatacatgctgtaatttgacattctgggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgctttattttcatctgccagtggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctga

SEQ ID NO: 36308 - DNA, 28365 bp, Homo sapiens
agcccctctacctccggaagagacgagtgcggtaacaccgttcacagagctagccggacgtcctccgactcaaggtgagaccgttattttcctcaccgcaccctccgggttcagcgggcgctgtgggtttccagggaggccccttccctcctcaggagcgggcgcgagcgccgtgcgcggtcggcgcctagggtggaggcagcctctgggtgacccctgcctgctgcgttatccggagctgccctgggcgaccgggaacagttccggcattggagtagcggttcgctcacgcgacctcacttaacctctgtggcggcttctgtggaataattgcccctttttatgtccccaactccgaaaagctcctagaaacttggtgcatccccaggcccaggtagtcactctaagtgatggggcagcgcccaggtcctgtgctgcccgcagtcgcggtgctgggacaggtggcaaaaaggaaggtggcctggctcctacgctggaaggctgtgaccaggacagaaacagcaggaaacagttcaggtgtttatggctttgggaaaatgaaagtgagtaaactacggaccctgcccatcaataaatgtactgtgatttatatatatataactattcatatattatatataactatatataaaaatatatataaaatgtacttatatactttatatatagtacataaatatacttatgtatagtatatatacttatatatagtacataaatatacttctgtatacttatatatagtacataaatatacttacgtatatatacttatatatagtacagaaatatacttacgtatatatacttatatatagtacagaaatatacttaggtatatatacttatatatagtacagaaatatacttaggtatacatacttatatatagtacctaaatatacttaggtatatatacttatatatagtacataaatatacttacatatatacttacatatagtatataaatatactatatgtatagtacataaatatactatgtatagtatatatactatatatactatatatagtatctatacttatgtatagtatatatagtatctaaatatacttatgtatagtatatatagtatctaaatatacttatgtatagtatatatagtatctaaatatacttatgtatagtatatatactatatatagtatctaaatatacttaatgtatactatatatagtatctaaatatacttatttatagtatatatatctaaatatacttatgtatagtatatatactatatatagtatctaaatatacttacgtatagtatatatagtatctaaatatacttatgtatagtatatatactatacatagtatctaaatatacttatgtatagtatatatactatacatagtatctaaatatacttatgtatagtatatatactatacatagtatctaaatatacttatgtatagtatatatactacacatagatactatgtatagtatatatactccacatagtatctaaatatacttatgtgtagtatatatactccacatagtatctaaatatacttatgtgtagtatatatactccacatagtatctaaatatacttatgtgtagtatttatactccacatagtatctaaatatacttatgtgtagtatatatacttatgtgtagtatatatacttatgtgtagtatatatatactagatatatatatctaaagatacttatgtgtagtatatatactacacattagtatctaaagatacttatgtgtagtatatatactacacatagtatctaaagatacttatgtgtagtatactgtagtatctaaagatactgtgtgtagtatactatatatagtatctaaatatacttatgtatagtatactatatatagtatctaaatatgtatggtatatatactatatatagtatctaaatatacttatgtatggtatatatactatatatagtatctaaatatacttatgtatggtatatatactatatatagtatctaaatatacttatgtatggtatactatatatagtatctaaatatacttatgtatggtatatatactatatatagtatctaaatatatagtatataaagtatatttactgtattatatatgtgtatgtgtgtgtatgtgtgtgtgtgtgtgtatgtgtgtatgtgtgtgtgtgtgtatatatatatatatatagtttgcatccaccattcctggctcataactcccatagcccttgacaggaatcttggcccacctttctgtcttagaactagccatgaagaaattctctgacctaccttgtctgactgtagatcgtaagacctccatttcacaaggggtcttgccccatatacaggagaaaggaatgctggacagagaggccaagatgaatccgaatggacagtccttgctgggtttccacagtcagtctgttccatttggatcatactgattttgtgggatcacatttctacacagttgtcaatcatgcctatccagtgattatccagactcaggacctcagttgctgtctactcaagtaacttacatgtttctacatggaggccatacctctcctgtgagctcaggatccatgattcagctgcctaactgacatcttttgattttacagaggcctctcatcttccgctaattaaactcctgatctctcaaactcctacctatatcccaaacttgactctttttttgttgctccctgtttcagtagactgtgacggttatccatacagttgccagagtgggaaatctggacatccagattcagaggaaatctgaactcttcctgtccctggtactctgtagccaatctgttagattccctcaaaacaggtatctctgactctcttaacttctctaccagcaaaacttccctcccaggtttcagccaatcatcaggtatcctcccactactgcatcctgaatgtaaatctgctgaccctctaccaacacccactttctacccttctgttgagtagccacaatgaagtgattcttgaagccccttcaatcaatgtcttatccctaaggcccccctgtagaggatgatccccactacctccccagctttatctctcctgtttcccttaatctgagctgtcactcttaggctgttcagttagtcttcatgtaccaggcatcctgcagttgattgagttcatgcctgttcacttgttctcatcttggtttaatcttgtcttcagggaaacctgatctgatgcctaagtccaggtgaaagctcccctgttagatgcttctcattgcacttcttctccttaacttatattattccagttgttattttgcatgtagtctttagtttttgattgatattgagtcccctcctagaaagtgtgaacaggacctgattttcctccccatggtgcagtgtatagcatacaataggtattcagtaaacatctattgaaggatgaaggacatagtgacttctgggtggagaatccctagaagtagcttttgaaatgggtcctgaagaatttgtagagttacattagtgctgttagaaggcgggggtgtgagtggcttgagctgtttctggcaggaaagcaggtacagcttgagaacatctagttctgttaagactagtggagcagaatgggagtaagagtgaaaaaaaaaagtttggaaacaattcttgaagagcttgaaggagttgcttatatgactcatagagtggcttcctttaaaacaaaattttaaaaaatgctttaatcaggaagaaaaagcatcaggaagaaatttagcgtgtgggtcttttgccctcctttccactcctgtcctctttcctataatgtgggccccaagataggagtttctgaatagtcttcaagatgtaactctgtgtctattattttctattggaaaggagacaaaattagggttgttttataaatggtgccacagtttttagtctgacagcttaaaaagctttactgtgctaggtacagacttcagagtgtgatcaagccagtggtgagttattttagtcttcagaagtcagtggaaaactggacagtttagaacacaaatatatgttgggtttttttttccctctgtgaaactcagggaaataaatttgcttttttcttattttttttggtcctggaattttcttttctcagaatgttataatagaaagaaaaatggactttaaaatcagaattgaattcaagttctgtgtcatttgtctgtaattttgggcaaattatttctcatctctgaaccttaagttcttcatctttacacataattttttcaagtaccttttgctgcttcccttcaagcttcttttatttcagtattcccagtgttctttctcgttttcactgtattctcctccaaaatattatcctaacttttaaagtatttcttgtgttgtttcttatctattctccaaacgaatgttttggttttttaaaaaaatgtaatatggtacagacacactgggaagcaatttcatagaatagtctttatgaaaataatttgatatagaaattaggtaatttaggtgagaaatgttttttactgggtataggcataaatcttgggaaaaactctagggcagggggtgaatcctgaaatgacagtctgtttctaattaagacgtttttgtgaactaactattctataattaagacttctaagacagttataactactttgtacagatatttgtcaaatattttcagaagatggctgatccttggcaggaatgcatggattatgcagtaactctagcaagacaagctggagaggtatgagctaagattttgtcaattataatcaattataatgtgattggtgggtatactgtgttgttgccttgttttgtttgtttcgatttggtttctttttttgaaacggtcttgcttgtcacccaagctggaatgtagtggcaggaacatggctcactccagcctcaacttcccaggctgggctcaagtaatcctcccacttcagcctcctgagtagctgggactacagcaggcatgagccaccatgtccagctacttttcattttttaaatttttgtgtggagatgagggtctcgctgtgttgtccaggctggtcttgaattcctggaccaccttggcctcccaaagtgctgggattacgtgcgtgaaccaccatacccagcctgccttgttaaataaaatatacactttgatcaatctacatttattttcattttactaaatactcttgcgtgtataccctaattttatatgataaaattttctgtgatgacagttgtgaatctaaaataagatgtaagattatataatttttgtttttagaaagacgtaactattaaaggcttattttatagatatatttgtaagacatttttaagaatgtctttaaagaatattatttaagacagattgaatgtcttaaaccatttatgtattttatctttttgtttaaaattatgccttttctatttgcttaccaaaacctctttttaggtagtttgtgaagctataaaaaatgaaatgaatgttatgctgaaaagttctccagttgatttggtaactgctacggaccaaaaagttgaaaaaatgcttatctcttccataaaggaaaagtatccatctcacaggtatttttatttactgtgtacaagaaatgtttattatctcaccatttcttggggttctgcatatgagagtagcttgactacacggttcttgccaaggtcttccatgaagttacagtcaaagtgttggtcaaggctgcagtcaactgaaggttggactggaactgaaggatccattcactcacgtgattgttggcagatgtcagttcctgggggagttgtctgctggtagcttctctcagttccttaccatgtagcctcttcacagagtagctcacgacatggaagctgacatctcctagtccagagcaggtggcacaggaagggagaaacagagtgaaccagatgcaaattagaggggcattttgtgaactagtctccaaagttttgtatactgtcacttacgctttattggttagaaacaagtatctgcatagctcacgctcaaggaaggaatattaggctccacctcttgaaggacggagagtattagagagtgacctttttttttttttttttagacggagacacgctctgtcaggcaggctggagtgcagtggcatgatctcacctcactgcaacctccacctcccaggttcaagtgattctcctgcctcagcctcctgagtagctgggattacaggtgcatgccaccacgcctggcttatttttgtatttttaatagagacggggtttcaccatgttggtcaggctggtgttgaactcctgacctcatggtccgcccgcctcagcctcccaaagtgttaggattacagacctgagccaccacacctggcccctatttttaaaatcattacatttccttaatgatttcttatctgccgcaaatgtgtgtgtgcacacaccttaccctagtataacatcttataatttgaattttgaaatttttcacatcgctttattcatggggaaataaattaaagcttccttacatttatcagtctttacctgaaggaagaagaagcaacaatagaaaagtgtagggtacagacttttgctattttttttttttttttcctgagacagagtctctctcagttacccaggctggagtgcagtggcacgatctcggctcactgcaacctccgcctaccaggctaaagccattctcctgcctcagccttccaagttgctgggattacaggcgcctgccaccatgcccggctaatttttgtatttttaatagagatggggtttcaccacattggccaggctggtcttgaactcctgactcaggtgatccgccctccctggcctcccaaagtgctgggattacaggcgtgaacctccacacctcgcctgctatgttttatagtactctgtgtagctaaggaaatgttatgatttggaaattgttgaaatcagtgtaaagattaagagtttgtcctacttggcttttagtttcattggtgaagaatctgtggcagctggggaaaaaagtatcttaaccgacaaccccacatggatcattgaccctattgatggaacaactaactttgtacataggtatgttttaaaatgtctaatataattactctttgcatattaactggattgacctatagatactctatttaggaacatgtacactttagaaaattgtatacttcgtttatgcttctttattctaataaagtatatataaaatgtaaaagtggagcaaaatgtattatgcagacttatcagatatggaggaggtaaagaaatactaatgtgatcttgtcctgtggtgccaagtgccccgttcaccattctttttcccactgttggcactatctaaaaagggaagcaaacaacattgctgctttgagagtgggaagggcactttgcactgcatgccattttctattctttgagtggcatgtaccatagatctatatggatctactaatatgcatctattagtagtaactatgtaaaaatatggttttttttttttaagatggagtttccctcttgttggccaggctgagatgcaatggcgcagtcttggctcactgcaacccccacctcccgggttcaagcgattcttctgcctcagcctgccaagtaggtgggattacaggcacctgccaccacacccgactaatttttgtatttttagtagaggcggggtttcaccatgttggccaggctggtcttgaactcctgacctcaggtgatcctcctgcctcagcctcccaaagtgctgggattacaggcgtgaaccactgcacctggccaaagatatgttttcaaagaataaaaataaatttaaaaaattataaactgactatgttaaaaagattgtattttagtaaaactaatgaagtcactcttggggagtgctgtcgatatagaatgagttcagtccaggagaaaaaacacggttaaaaagtgcagaggaggcccctctcctcagcccttagggtgacggggatggggatggggctggggctggggccggcaaaaaaaaaaaaattgcatgggtgttaggatgaatagacgtgcattctggtatttttttacggctttttcaccttaggcaagttagttaacttttctaggccacaatgttaaaaaacatttataaaaaggccgtattaatagcacttgcctcgtagaattgtaactcaactctatgagtagtacattaatgtaagaacttagtatagtgccgacacagagtaggtatatgatattactagaagaaagcctggtggaattgcccatgagagttaaaatcagtagccgcttctggtgggattacatatagatgtcatatttgaagttcccatgtagttgtacacatctgtactatatatacaatccttgaaatctacaaagctaaggtttagaatctatatgtgatagaatgttatatcttttaaatgtggaaagatgctaatatattttcacagaagagaagacagtacaatacagtgtgtatagtatcttatttttgttaaaataaaaactttcttacatatttaaaagtttttattttcaacagctttagcttcaatagttgaatgttgatcttgtctatttccttgatcttaattctcttgtgagtcagcagttacaacctgtgttcagactgtcatgcagctatggaaaaattttggctcaaagtctacttttcagaggccaagcctaaagtttgctgttggagtagagacaagtaacagccatttattttgtccagtgcagtatttgtgtttatcacggtgtaggacataggaaaaaaacatcacaggccaggcgcggtggctcatgcctgtaatcccagcactttgggaggccaaggtgggtggataacctgaggtcgggagttcgagactagcctgaccaacatggagaaaccccgtctctacgtaaaatacaaaattagccgggtatggtggcacatgcttgtaatcccagctacttgggaggctgaggcaggagaatcacttgaacccgggaagtggaggttgcagtgggctgagatcgtgccattgcactccagcctgggcaacaagagcttaacttcgtctccaaaaaaaaaaaaaatcactaaaatatatgctttttaaccaaatcgatttaaaagtttttacagttttcttttttaaccaaattgatttaaaagtttttacattttggctttttttttaaagggggacagcatctctgtcacccaggctggcatgcagtggcatgactatggctcactgcagccttgaccttctgggctcaagggatccttctgcctcagcctaccggggaagcttggactataggcgtgcaccgccacactcagataatttcgtgactttttttttgtagaaacaggatcttgccatgttgcccagccaggctggtctcgaactcctgggcccaagtgatcttcctgctttggcctgctaaattagtgctgggaggagtgagccgctgtgcgtggccatgaaaaaatatttttacatagctactatattcatagaatttgaccttcaaaagatagaaaacgcagtgcaaaatgcccttcacacttccatttctggtttcccaggatccatctctggagatgaccactgttacaagtttctcgtgaatcctttcagagatgtttcatgcctatagaagcatcctgtgtgaacgtgtgcctgtgtgttggggggagggtgtgtgtgtataatacctccactttatcctatttacaaagggttgtataccatacaaactgttttgcatcttagattttgtggggagtggagatgagactttttataggaaaaattttaagaacacttatattatgaaaagattaattttattaacaaaagttctatgttggttaatttgtattttgtccttttttttaaaaaaagatttccttttgtagctgtttcaattggctttgctgtaaataaaaaggtatgattttttaaacgtatagttgattatatgccttgctctcattttctgagaaaaagtaaatgtgttttcataataaattcaggtttgtctgtatatttgattatataactgcattattttgaatataagctacaggactgttaaaattttcatgatacatttgcattggataaaattttatgtattctgagaagcaggagttgtaagaagaaaatacacacaagtaactgaaatacaactcagtatttagtaaccattatatgtgtgatagagtcagatgggatagaagtttatatgtgatcttaaatgcttcgtggaagaggtgagatttgagctgggaatgctttagtaggtgttagtgaagaaatacatttagaaaccagcaagtagcaggggccaaagcatggttggaaaatacagactctctttaggaacctacacatagttcaggttgtcttatgtgtaaatacttacatctaaagcctagcagaataaaacatatagctatagcatttccttgctgtttggctccttagttggtcaaacagtaaaggatggttactaacattttacctacctatcttcaaggaacttttgatatgtaagatcaacatgtataacagcagttataacatttctgaatataaaacacatattggacaaatgacagcttagccccagggttgtattaattaatgagaatgtccagaagaagctacatgagctttcagtatataatcagctctgggctgtatgctggccctgccactgaactcaacagctcagcacaaagttagatgtgtgaacaggtaaagatgatatgtggtagaaccatgaaaaaaaatactatgggaacacaggatgtcaccagttctgctgagagtgggttgggaaaatcttcataacagcaggggtcttagaagttgatcatgtgttggcccttagaaaactaggggtttccagattggcgggggtgggggggtggtgggaagaggaaggcgttttaatcagaaagaacagcttggagaaattgaagaccattatacgtgtggggaatggtgagatgttcatggagagggaagcactgcaagtggccaggacaaaggttagtttggccttgctgtgaggcactgtggccagtccatgcaagaaaatttagtttgtgtttcaaggtagttgggaaccagtagaggttttgaagtggaaagtgacagataattctagcaatgtagagattatactggggtgtgggtgaactaagtagaggcagtgagaatagccaaggaaatgccaaaattggaaagtgtttttgagattaaatttgaaggagatttatggggaaggaatgggaggtgatcaggcaatgaatgattttgtctttgaaattctgcaagactaggtttggaaccgtaggttcttcccccgattatgaggttgatgggagccaaaatgaatttgtggactgtaaaaaaccaacctgtgtgaatatggagagctaaaagggaaatggaagcaatgggagaaggaagaaaaaagcctgaggtgcctaacttttcagggtgaggcagaaaagaatgttctaaaatcataactgaaacgaattagtaggtgaggtagaactaagagaataatggtgggagcatggaggtagtgaattaagtattgaataagtcttgagccagtagactccaattcttcagacaaggcatttgaggcaacaaagaaagtttgttgatactctctttgtgggactttcagaagaatgagtgatcagggcagaagccacattgtaatgtattaagaggagaataggagatgcaaagttactcattggcagtgaagggaaaaggatagaataacatttcaaaggttttgtaaggaggagagaaacttaatgagaaggtataagaagaaaaatccaagagactagggaatcagctgatggagcagtttttcagagaatgtatgtgagggtaggagtcctaacaccggagaagcgttcacttagaaaataggaaagccctgtcttccgaagcaggaggaagagaagtaaggtgggtgttcttagatctggacttggatgggaggagagtcaaggatatcagttctggtgacctctttctcttgattagtctggaaattaacattttaagtatcccacagtttagccatttcagtccattgttactagtcagtataccagattgtcttgttattttcttagaaaaaagtggatgaaacatacttaggtttggtaaaggaaacttgttttcctctgcagatagaatttggagttgtgtacagttgtgtggaaggcaagatgtacactgccagaaaaggaaaaggtgccttttgtaatggtcaaaaactacaagtttcacaacaagaaggtaggattaattccaatttttgatgctattcatattgtgtgctcaatattttattgttttttaatattcacctatggaattctccaggtgttaactgattcataaattgtgtttattatctctttattctttttgacttcagctttgaatgtggaatggaagtagggaaagaaatgtaattgagcaaacacttcaggctcagcattgtattttgtgatagagataggaagatgattaagactggcttcctattgtgaacccaaaatatctgagacaggtctcaatcagtttagaagtttattttgccgaagttaaggagttaaggtgacacagcctcaggaggtcctgacgacatgtgcccgaggtggttggggtacggcttccttttatacattttagggagtcgtgaaacatcaatatgtgtaagatgtacataaaggcaggacaactagaagtggggaagggggcggtgttcaggttataggtagataaaagacaaatgattatattcttttaagtccgtaatcagcctttaaatacacaattgagtctggctcagtgaatctgcatttttacataaacaatagggcagatgaagcaatcagatatgaatttgtctcaggcgagcagagggatgactttctctcccacacctgtgaagataagctatcagtctacattgccagggcaaaattcagccagaactgttttagggtaaagatcttgaggtccacaaggaatttccttgtgggcaaattgtaagggaggtatgtagctcttttgtctttgtaggtgtcttatttaggaattaaatgggaggcaggtttgcctgacatagttcccagcttgacttttcccttggcttagtgttttttgggtcctcagatttattttcctttcacactgtccttgtggaattcatggtttatgttttatctactgcttctaaaattctttatagaattcctctgatctgatgccccaggaccaattactacaaagtaaatgggtggaaaaaaagcccgttaaagctgggaatcactgaaaatgagacatatatattttataagctgaatggcaatttaagttctttcttctctattacatctgttggcctcaaaaaaggaagtgcaggcaaaattaatgtagagagtttatttgggccaaagttgaggactgcagcccaggacacacttctagattaccttggagagtgctccagagaacttagcagaggctcaggtttttaaagaaaaagggacacactgggagaggggatgatgagaaaagttgtactcaggaattctcatttgtttacagaaataacattgcttagtgattggctatacactgttgaattatagggtgcatggcattttatggctgcttggcatcagtgagtctagagccccctgtagcaagcggcttcaagtggcaattatttaactccaggggagtgagactgtctgctggtatattttaaatgcctcttcaggcttgataatttaaaggtactggcattctgcagattaaaacttttctttttctttctcacagcttattgaggttttgagttactgttcttccataaaccacaccaaacattttccacagtttgcacattgaaattcttttcagtgcagcaagaacttagaggtacttgcaaaacaatttgagtttagaatctttctagacttttatacctttttccctcaaacacttaatttaagagcagatttttaggctatttccttttcattaaaatctaagaccccatgaaatggaggatgcattcttatttttctagatgtcatcatgtgagaaaatacaaatcttggaccgaaggaatatggtagctttgatagaaacaactcttttcctttgcatagtcattcttcactttacaaagtattaaattatgtaacttttattttttttcctcccgagacagagtcttgctctgttgcccaggctggagtgcagtggcgtgatctcggatcactgcaacctccgcctcccgggtttaagctattctcctgcctcagcctccggagtagctgggattacaggtgcgcaccaccatgcccaactaattttttgtatttttagtagagatggggtttcaccatgttggccaggctggtctcgaactcctgacctcgtgatctgcctgcctccgcctcccaaagtgctgggattacaggtgtgagccaccatgcccagccctaaattacgtaactattaaatgtagtacaacagttacagaaatgctcagatcaaacacagctggtgaacatacatctccattggtgggaggaggtgagatctagggtgttgggtgtgtcctgagcttcaaatggaaaaccttggataacctgtcagccttgtaaatggatgtcagagaattttacttttgttgtaaaagtaaaatttttacttttactgtaattttactgtaatttgttttcttccaaatctatacataaatcccttattgaatttagtctctcctttttaaatatttaagacatttgctgtttcccactaagtattatgtatgcaggcaaattggttacattatgtactttttcaggaagggcctaagcagctggactctgatgcttataaaaaggatcacatagggataattaatttatcagtattttattatttaaatgcttataaagaaacacgataaaacaaggaagagggatacaaatgccctcttctgaattacaagtgtcaggtattttctagaagtctaaatattgaaacctaacactttctttttagatattaccaaatctctcttggtgactgagttgggctcttccagaacaccagagactgtgagaatggttctttctaatatggaaaagcttttttgcattcctgttcatgggtaagctctttaccattattctatctctctctttgtatacgtgtgtgtgtgcacacaccttttttttttcctgtaccattttagagtaaattatatacatcatggtttctaaagaatagggagattctgttccataaccatgaaaccactgatttcataaatacactttttatctaatttgtcatccatattcagttttgtcagttaatctgctaatgtcctttatagcatttgccttccaataaagtaggattcagtctagagtcagcattatttttaggtgtcatgtctccttagccttctttgatctggaacatttccacagcctatgaaattacttcctttaagttttcaaattatttgcatagaagtctgtaagatagactcttataattaatttctggcttctctatatcagtggttatttccaccttgtcacttattttgtctatttgtgctttttttcttgttcttttttctcaaagaaccaggattttaatttaagctggttttttcttttctgcactattattttcatcttcgtgctttcttttggtttgtttccttttttttcctttttgattagaaaatttattataattcctttatgtttattgatgtagatatttaggctatgaatttcatctgatcattgttttcattgtatcccataaatactgatacttactgttttcattatttttttcataaattctgtaatttgcttgtatttcctcttttactgagagttatattcttaaattttcacaaggagagtctgtcttagtccattttctgttgcttataatacctgaaacttggtaatgtgtatgtataaagaaaaggaatttatttctttcagttatagaggctcagaagcccaaggctgaggagctgcatctgatgagggccttcttgctggattctttgtagagtcctgaggcagcacagaatgtgacatggtggggctgagcatgctagctcaggtctctgttcttctctttataaagccaccagtcctagtcctatgatgactcattaatctattaacccatgagtggattaatccattcatgagggcatagccctcttagagaccccacctttcagtactgctagattggagattaagtttccatatgagttttggagggaacaaacattcaaaccacagcattccacccctgacactccccagatttgtctttttccatacaaatacactcattccatccccagggtcccaaagtcttcacttgttctatcatgaacttaaaagtttaaagtccacagtctcatttgtgagcctgtgaaatcaaaacaagctatctgcttcaaagatacaatagtgacacaggcataagacaggcattcccattccaaaacggaaaattaggcaaaaagaaagaacaggcgctaggcaagtccagaattccagcagggcagacatgaaatcttaaagctcaagaataatcacttttgactgcatgtaccacctcatggagacactgggggttgagggctgggtaaaggcctctggcagccctgcccctgtggctttgcagggtacagcccatatggctactggcatgggttggagtccagtgcctgaagctttccaaggtgtaccttgcatgctgctggtgactccacagttctgaggcccaggtagtggtcctgctttcatggctccactagttaggcattaccctagtggggactctctgtggtggccttacttcctgggctctactaggctttaccttggtggagattctcagctaccactaaccccacagttccactgtggctctgcccttgagacaagtctgttccctggctcccaggcttctgaggacaatctttgaggccaagtggaggctggaaagcctctacagctcttcctttatgcaagcttgcagaattagtatcatactgctaacatttacaacttataccttgtagagatgtggtataagccacacctagggtcacttgaccttggctgggatgtagggagcacagtctagggtggccctgggcagccagcattggagagtatcccaggcctgttccatgaaaccattctaccctcctttgggcctgtaaagggaggggcagccttgaagatctcttaaatgccttcgggttctttctttcattgtctttagaagtaacacctggctcccttgtagctgtgctaatctatttagcaaatggttcctggctaaccctcggtttcctcctttgaacacaccttttcactcttggccaggctgagttttccaaatttttttgctctgcttcctttctttttggttgtttgtttgtttgttttgttttttggagatgggttctcactctcttgcccaggctggattgcagtggtgcaattatagctcagtgcagcctcaacctcctgggctcaagcagtcctcctacttcagcctcccaagtagctgtgaccacaggtttgcatcaccacatccagttaatttttatatttgtggtattttgtataaaaatggggttcgccgtgcagcccaggctgatctccaactcctgggctcaagcgatctgcccaagttggcttcccaaaatgctggcattataggtgtgagccactgcatctggccactctgcttcccctttaattattcatttgtctttaaattacttctttgcttgcaaatctcagcataaatggtcaaaagtaaccatgcagctacttctataatttgtttagaaatttttttctgccagataccctaattcattactctcaagtttaggctttcaggaaaccctgtcaagttggctggccatggtggctcacgcctgtaatcccagcactttgagaggctgaggcaggtggatcacgaggtcaggagatcgagaccatcctggctaacacggtgaaaccctgtctctactaaaaatacaaaaaattagccaggcgtggtggcgggcgcttgtagtcccagctactccggaggctgaggcaggagaatggcgtgaaactgggaggcggagcttgcagtgagccgagatcgtgtcactgcactccagcctgggtaacagagtgagactccatctcaaaaaaaaaaaaaaagaaacccttagtcatagacacagttcagacaagttctttgccagtttataaccaggatggcctttcctccaggatccgataccttgttcctcagttttatctgagaccacatcagaatactgttcctatttttattagcattctggtcagagctacttaactcaatctctaaggcattccaaactttccctggccttgtcttctaagccctcaccaaaatctcccttaatgcttcattcacggaaatgcaggcattttctagcctgctcctctgaattcttctgtcttctacctattacccatttcaaagccgcttctgtttgttaatcagcatcaccccacccttaacctataagccatgaacctagaaggcaaagccctcatgacctaatacctcttaaaaggaccccacaccagtactgccacattggggattaagtttcaacatgcgttttggaggggacaaacattcaaccatagcagacacctttttggatttttaaaaatttcatctttaatctccagttttattacattttaacagttctactttctgaaacctactgatggtttccttgtgccctgttctgtgatcaatttttgtaagtttcatatgcactgaaaaatagtataattccctatttccagggtatgacattcagtatatagccaaaagatttacctaattaattttttttgtctatttgccctgtcttatactgagagtctctgatgtatcagtcttttattattagtgtgtttctctgtatttctccttgcaactcttttatgtaggtggaagctgtgttatttgatgtttattcataatagttacatacgtagttcattgtgtaatttttacgtattctttgtcttgtttcatgtttttgtgcttgaaatttactttgacatcagaattgcaattcctgctttttttttttttttttttttttttttgagacagagtctccctctgtcacccaggctggagtgcagtggcacaatctcggttcactgcaacctgcgcctcccaggttcaagcagttctcctgcctcagcctcctgagtagctgggattacagctacgcaccaccatgcccggcttttgtatttttagtagagacagggtttcgccatgttggccaggctggtctggaactcctgacctcaagtgatccacccacctctgcctcccaaagttctgggattacaggcgtgagccactgtgcctggcccctgctttcttatttttcctgtttgcctgataaatctttgtccacccttttatttttagtcctttgaaccactgcatttgaagtgtgcctgtcatatacagcattgcatggaatttcactttataagtcaatttgaaaatctttttcttttaacagataggttaggcctattgatttattgatatgactgtttttgtctcaattctgttgtattattgtgtggtataattactgtctgtatgatgttatagttactgcgttcatttgatgtgccttctctgcctcttttaaaatttatttttgtatttataaagattacattttattccagcaggtttcttttgtaatacaacttttatagtacctttaatattattttcttacttaactatttactatctagaatgttttggcttcgcctattgcctatgtaagtctcccattccccttttctctctctttatcccatttttaaagttgcattctgtctactttgccagaacatattatatttacatattcttcaacccatgaccccgctttttgatcctagttcttcatttaacattataaaatgctcacagtccttttgtgaagtgttgcaggcacctttttaattggttgaagttcgtcctctagtagattccttgggggagggcacatgtgcacagttttccctgagtttgggtattttccaaaatgcttttctgtggccttgagacttgaaggacagcttggctggatatagtatccttaatgaaagtataaatttcttgaaaatgttctttcactgttgccttgctttgtatattgtttttgagaaatctgatgcaaatctaatttttcttggcttttacattattttatcttttaactggaggctgttttttttcccctgaatttttggctaacagtttttaaaggatatatcttagaattgctcattctgggtcagtcgtgtgtttcagtatataggttcatgtctttttaatttctgggaagtttccttaagatatagtttaagtactagtgcacttctgttatttttttctttaaagacaccagtgggaatgctccatctcctttgtgtcttcatttcagccattttctctctgtctctttttacttctttcttttattgcttttcctaatttctctttattaagttttcttatcatctgttcttttattggcaccttgtaatttattcttcgttcctgacataattttgtcttttatttcccccccatttctttcctgagttcagtcatcttgttttatgtacgtattttggtccatttgtgctcttagtttctatatcgctgatgtaacatttttttcagtattcacaagtttttgtttgaaaatatttaattcggattcgattgatattcattttattccccttcattgttggttttgggggagagactttacagcaaaaagaaaaaacaaaaccattttattaacagcgttcgatgttttgcagtagttttgtgtgaatgtggtctacttttttctattttcacttcgttttgtgatcagggttcctgctttctgaatttcttattttgccagttgtgcctttctgtgcattttcttttatgaatacctgctggttgtagatagagttggcttgtcttgtttatcattcatttctgcagggtccttaagttttcactctttttttttttctttttttcctttttcttttttttgttattattatactttaagttttagggtacatgtgcacaatgtgcaggttagttacatatgtatacatgtgccatgctggtgtgctgcacgcattaactcgtcatttagcattaggtatatctcctaatgctatccctcccccgtccccgcaccccttagttcctacttttccttcacttgtttccaaggagtaccatctctgctatcttatttgattctccttcagaatcacagcttctctgaggctgcctggtcaggttctgagtgttttctagccccttacctctagccaagactatgaattaccaagtgctgatctgtgctcagtgtttttgtttttgtgtttattgtctcagtgactcttttctgagggtggttttgtctttgttccctgtgggtcctctgctcctccttgttctttctcacaaagtcttttctgccttctctgccctactctgtgtatctacgggcttccggtgctctgttagaatttatttatttgtttttcttctacttagaggtagtttgagagtttgcatttcctgatttctatctgaaagaatgggtcctatgggttttatttgtcctcctggttgatttcattttattattttccaggagggtatacagggagtttcaaaatcgtcatgctattattattctccaaatctcagagtccctctgtaatgacagtttaataaatgaagaaattaaaaggaaatatttatccttacttttatccttaaatcttcaagaaaagctaaaggtttgaggtccttaactttaatatagttaatgctatatattattttattttttatgtatttatttttttttctgagacggagtctctgtcgccaggctggagtccaatggtgcaatcttggctcactgcaacctccgcctccggggttcaagtgattctcctgcctttgtctctggagtagctgggactacaggtgcccgccaccacgcctggctaattttttgtatttttagtagagatggggtttcaccatgttagccaggatggtcttgatctcttgacctcgtgattcacctgccttggcctcccaaagtgctgggattacaggcctgagccactgcgccccgccattaaatagtatttctttgaccatagttgtttatatgaaaaatcataataaaaatcctttattgaacaaaatctggtgaatgtaaataacaacataatattttcaccacctactatttctgtctttttctttgtgaaaatattatcaatgagttataagagtcctagaactgatcaaagatcatctaataatccagccttattttgtaggtgagttgactgagattcaagtaggtgatgtggctgcttgagatcgcacagctggatagaaatagggctagaatcctggctcccagatcatttctgtttcttcaatattggacttctcttagaagtcagacccttcaaaatataggttgaccatgtacaaactaattatgtactatgcatatgtggtctatatagtaatgagtaaagtaaaagagagcctctgtcaatagctacagaacctcccagaatgatgcccttgagagaagggcaataaacttgctgctacagtgtgctgtcttgaagcaaggactttaaccatgggctataaaatggttatgttactcataaacgagttgcaagaggtttacaactttaacctttaattttgctgttggctgaaataaaaactaatttttacttcagatttttttcaaaagtataaccaggaaaatattactaagaagtactgacttactgattgcttttatgatcttttgcattcagctgattcttcagctttgcagtgggatttcagaatcacttatacaaaacaatgaaactaaagagagttataatctgaatgaatgctttaaataagcagaaatagtctaataggttcctaagaaccaacatttatgaggcaaagtacgttattctggatcaatttcctttgtttaattttcaggaattcatgtagatgaaattcactatgtatggtatatgatattttctgacatcatggtttagagaacaattttatcataaaaaaagctatttttattatggacattttatatgctaggcactctgctaggtgctttacaaatattagctgtagtcattagtacatttgtctaaagtaaattggaatccttatttgatgacatgacatgggagcaaactcaaatctttgtgacatcaaacataatcctttttacaatgtgccatgttagctgcataggcggaccacagctgtataggaggaccacataagataggattcagaacacatagtgcagaatctacaccatagtcttaattatctggtagttaagtaatctgtttggtaatcctttcatagtattttccataaaagaatattctcttgctgattgtaagaccatttgcttgagatcccatggtgctcattagaagtgacggaagcaccgctagtagatatcactgttgtttggctagcctaggattctatatctgaatagagtaccagggaattaattatgaaagaccttggtatttgcattctatgatatgagatatcaaatatcacatatctcatgggagaagtggggaaatgcacttttctttataactaaaaaactgccactaaagttaatttgattttatttatctgggaaacaaacatctgtggaaatttggtgcacttactactactttctcaaatttaatgtgcttcaaaaacatatgatggaaaacatgccaaatcaatgacatcatgttattctaatcctttttaaaatttatttggcataaaggatgtacttaggtgcaatttttttatttttatttttgagatataaaacaaatgccacattagtcatcagttttccatgtttttaaataaataaactgtgaaagatctcattgaacagaactcactcccttattaccatcgctttaaacagttggagaaggaatttgtgtaaaaaccacttgaaagtaacttgtagacatgatgacgtttgtcttctaaatacacatttcagcgtgtgtgtctttaataaaagggacattgtctaacatagccacagtacaatgataaaagtaagggaattaacatggatacataatctaatataagactttattcaaattttgaaaattttaatccaacatccagtctagagtcatgtattgcatttagttgtcatttctcatcaatttcctttaatttagaacttgcttagtctttgtcttttatcaccttgacatttttcagaagtataggccaattattttgtagtctgtctcttgaatttgaatttgtctggtttcctcatgattatatttggatcatggatttttggcaggaatgccgcaaaagtaatgttctgtccttctcagtgcattttatcaggcacatttctttttgtcccattatgagtgatattaacttggataacttggtaatggtagaccattgtaaagatgctatttttccattgtacttattatgtatcttgtggagagacactttgacactctgtaaattatcagactcacccattaattttaacattgattctttactgaataaattattactataattgctatcaagtgtatttatattcaacttaacttgtattcaaggaagaggtgctatgagagggcaaacctgcagtaattttccaaggcaggcttaggtctttgcagagcctggcatgctgttgttgctttaggcacatgtatgacgcacacccagttgaaaatgacccataccatgatattttacacctcctagagactatttgcattgtgggtatgtgtatatgtgtgtaaaataatataagctttagtagctggatttagacaaatattaatatacttgcatttcattattgtagaattaagcattgtctttattttttatgaaaaattattgttttaatgtttatcttattaaattattgctttgtgagggttttgtgatttatataatatacgatgataattagatttatacatatttttattttacaattagatatcacctcttaaaatctttatcctctagatcgttccaagtttcttcaatcgacacttaaagtgaagttaaggaggaatatcttacttgaaaggattattttttccaattttatttctaaattctatttgttaggatccggagtgttggaacagcagctgttaatatgtgccttgtggcaactggcggagcagatgcatattatgaaatgggaattcactgctgggatgttgcaggagctggcattattgttactgaagctggtggcgtgctaatggatgttacaggtaaaattatggagagtgaagcagatctccacacatctgttggacttttgtccatatgtagaatttaaaaaactttttgatatatgttatactgcagtttttgaagcagaaacaagctatataattgtgtgcaaaatcaaaataagctttaggagatagaggtaaggataagaggtaatggtaatgtgagacttacaatgataaatggctaatccttttctagtgtgagtttcaggtactcctgaaaggctgtagaaaaagcctagaccaagtttgtccaacctgcagtccatgggccacatgtggctcaggatggctttgaatgtggcccaacacaactttgtaaactttcttaaaacataatgagttttttgcgattaaaaaaattttttttagctcatcagccgtcattagtgctagtgtattttatgtgtggcccaagacaattcttattcttccagtgtggcccagggaagccaaaatattcgacacccttggcctagacagtcaccgagtctgaggcttatacccagagctctttgaatggtgacaatggtgatagttgatgatggacttcctccaccatcactttctgtgttgagactagagaagttaaataattgctttcaactgatggtgaaaattttaaaccgaagggtgaatctgtgctgaaagaattcaccagtgatctgggagaaaggcaacaaagaaataaggaaatgggaaggacagtggtatgaaaatgcattggattcacattttctgtccatagattcttaaacaataaagaggtaataagaatgcacaaaaatagagaaaatatgacattttctaactggtatgacttcattatttactcaaaaattatgcttagaaacagttatatattgtctaagcttatacattgtagaaatgtaacagtagatttttgtttaagaaaactgaaagtattaaaatgttatgtgaccatagtacatattgctatacttgttttatatgaattatttttgtaccagataaaattatttttcatacttgtttgcttttaggtggaccatttgatttgatgtcacgaagagtaattgctgcaaataatagaatattagcagaaaggatagctaaagaaattcaggttatacctttgcaacgagacgacgaagattaattaaggcagcctcatagtcaatcccagttgcttttccccagatttggtgactcatcaatggatatgtgttttggatgtatgatatgcttggtttaaattctctttgtccaggtcaaaaatttggaacttgtttcttattttactatgtctaggtttgcaagaattgacataatgtttgtttcactgatttaaaaaattttgcatgtaagaatgtactttaggaaacatacccaggaagtacagttgataaatataacatcaactgaaatagtcaattagcaattttgtgtttctaaatatctatggtcccctgaaattttgacttagtatataggtgcagagacacccacttagaaagttaactgtttggaaaaacatttctctttagtttcaaaaaccatatataattaaatttgtaaggatatactgagtaccctaggccaacttttttttctttgcagagaaccttttttgttttattcttcagtgttcatatagcacctggcccattacatatctaggcaactaaaaacaaacattgtaagaatgaatatttttaatgtagtaattcctagttacaatagatacataaagtaatgaactcagcattctgtacttttgcttcaggtttgaagtaaaaattatctagttaaattttttttatttcacgttaccatgccatttcacattaccataccatcagatagcatggcttattgtgggcatttctgcagtgaatacattttccaaaacagttaaattgtctgtttggatttgctttaaagtcttgtgtaagagagaagaaactatttctataataaaaagcactctcatcagatatctgacataattagatacaatataacattttactaagttcagtattcatgttttaaaggtgtttatactgatttgattgtgctggcaaatatactgtattgttaatattgaactgtttatttttctcttagtcttcttatttaattaacttcattgccgctggattctgttcagcctttaaaaatatttcttagtggtcattgctctgcagaactcaaaaagaaaattgtacttgttcatagacatttttaaagggttaatttattgttcagccttatcccttggcacgtaaacagactactagacttattgtaggttcgtttgagctttgtgttgtaaaattaaaaatgcttctgtaaagttttcaaggtagggagtgattttattattgtgtatatctaatatattaagtatgtgtgatactaaggtttgactgctataattatttgtactgttgatcacatgtacttaaaacatctgatactgtattctaagacaggttgtttttgcaattaaatttattttaataagacgatcatgaataaaactt

SEQ ID NO: 36309 - DNA, 33535 bp, Homo sapiens
caaggtttcggggactgagtgggtttcagactttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccgtaagagaaattggcttcattttgttagatggcaggagggagcctagactggggaaagagcactagactccaagtcaagcccctgctgcttggtcgcttctttttctgtactctgggttttctcatatgtacagtgaggtattagcctgagtgatcatagagtcccttccagttctgacaccaaattctgcatgatgacgtgtgtttggcgttatggggtggatgggtaaaattactgtctgtccctctgggttgaaaggcaaaatgatgatttggttagactgtggtgagtgggtgtctggataagaagaagcaggttccttacgagtctcttagaaagctgagtaagattggaatcatggagttagggtggtccatccaccgccatttctttctttaccaagcatcacctggcagcaagaataaactagtactcttatttaggaaaacccttagaaaattaagagataaggaaaacccttagaaaattaagaggtatcaatgcaacctccatcaaaataccagtgacattcttcacagtcatagaaaaaagatcctaaaatttatatggaaccacaaaagagccagaatagccaaagctatcctgagcaaaaagaacaaaactggaagcatcacattacccgacttcagattatacaacagagttatagtaaccaaaacagcatggcactggcataaaaacaggaacagaatagagaacccagaaacaaatccatatgtctgcagtgaattcattttcagcaaaggtaccaaaaacatacattggggaaaagacagtctcttcaataaatgatactgggaaaactgatacccgtatgcagaagaatgaaaccagacccactacctcccaccatatacaaaaatcaagtcaaaatggattagagacttaaatctaagccctcaaactatgaaactactaaaaggaaatattggggaaactctctaggacattagagtgggcaaagatttcctgagtaatacctcacaaacagaggcagccaaaacaaaaatggacaaatgggagcacatcaagttaaaaagcttctgcacagcaaaggaaacaatcaacaaagtggagagagaacccacagaatgggagaaaatatttgcaaactacccatctgacaagggattaataaccaaaatatataaggagttcaaacaactctctaggaagcagtctaataattgattaagaattggataaaaactctgaatagacatttctcaaagaagacataaaaatggcaaacaggtttatgaaaaggtgctcaatatcattgattatcagagaaatgcaaatcaaaactacaataagatagcatctcaccccagttaaaatggctgttatccataagacaggcaataacaaatgctggcaaggatttggataaaacactgttggtgagaatgtaaattagtgcagtcactatggagaacagttttggagattcctcaagaaactaaaaatagagctactatatgatccagcagtcccactgttgggtatttacccaaaagaaaggaaatcagtatatcaaagagatatctgcactcccatgtttatcgcagcactattctcagtagccaagatttggaagcaacctaagtgtccatcaacagataatgaagaaaatgtggcacatacacacaatggagtgcttttcagccataaaaaaaaaaatgagattctgttatttgtaacaacatggatggaactgaagatcaagtggaactggatggaagtgaaataaggatggcacagaaagataaacttcaaatgttctcactaatttgtaggagctaaaaattaaaacagttgaactcatggagatagcaagtagaaggatggtttaccagaagctgggaagggttgcagagggtttgtgggggagtatggttaaagggtacaaaaaaaatagagtgaatgaaaactagtatttggtagcacaacagggtgactatagtaaataataatttaattgtacatttaaaaataacgaagttcagatgagagcatgtcctggctataaaaatttttttaataaaaataactaaaagagtataattagagtgtttgtaacacaaaggataaatgcttaaggcaatggatatctcatttaccctgaggtgcttattatgcattgtatacctgtatcaaaatatctcatgtaccccataaatatatacacctactatttacccttaaaaattaaaaaaaaaaaacagcactttgggaggccgaggcaggtggatcatgaggtcaggagtttgagaccagcctggccaatatggtaaaaccccgtctctactaaaaatacaaaaattagccaggtgtggtggcgtgcgcctatagtcccagctactcgggaggctgaggcaaaagaatcgcttgaacctgggaggcagaggttgcagtgagctgcgatcactccactgcactccagcctgggcgacagagcgagactccatctcaaaaaaaaaagaaaagaaaaagaaaagaaaaaaagaaaagaaagatatacctaccatcccatgagacttgaaaaaggggcaaatttaggacagaggtaaaatgacaggacatgaatgttttgtagttctgaattcctctacgccatacaatgttcataaaagagagagatgtacattctgtagagcaagacagattgtactttagagtttaaataacaaaattttaaagcagggagagattttagagatggtagataacttatcctaaattaaagaaaaaaacccagaaagagaaagtgaaatgtccatagtggcacaactaattagtggcagaactggggtttttgatagtatgtaaacagtaggtgttagtgcagtgtttctcgaaatatattacacataccactgctagtacaagggcaaacattaaaaatttcattcttcacttccaaaataggaaaaatataaaaagtaaagattttattcttacatacttactaattggggaatgtgatactagatttctattcactgtattatatcaaggtttccttttaacgtaattttaaagataaagttttaagtgtaaagggtcattaaaaataatattaggccagatgcctataaccccagcactttgggagaccaaggtggaagaactgcttgagctcagaagttctaggccagcctgggcaatatggcaaaaccttgcctctactaaaaatacaaaaaaagttagctgggcatggtggcatgcacctgtggtcccagctacttgggaggctgaggtgggaggatggcttgagcccaagaggtggaggttgcaatgagctgtgatcatgccgctgcactccagcctgggcaacaagagtgaaactccatctcaaataaataaataaagtttaaaaaaattaaataaatattactgtaggtggtgtatggttaaggccaaaaccatggtgatggtatgtgactaaattttatttttttattttttatttttatttatttttttttttagttggagtcttgctctgtcacccaagctggagtgcagtggcatgatctcggctcattgcaacctctgcctcctaggttcaagtgattctcctgctttagcctcccaagtagctaggatcacaggtgcatgccaccacacccagctaatttttgtatttttagtattttgtatttttagtagagacggggtttcaccatgttggccaggctggtctcaaactcctgacctccagtgatctgcctgtctcggcctcccaaagtgataggattacatgcatgaaccactgtgcccggcctaactaaattttagaaaacagtgttcatagaaccatctaaaagagttcagatgttacttctgcattgttctatgtggtttatattttggaactttaaacatagttttcaaagaagaatggaagaaaccatgaagcttgctacgatggaagacacagtggagtactgcctgttcctgataccagatgagtcaagggactcagataaacataaagagattcttcagaagtacattgagagaataatcactcggtttgcacctatgctggtcccctacatctggcagaatcagcctttcaatcttaaatataaacctgggaaaggtaaggctcttttacttgtttggattagtgtgacttttaatgttatcctgacaacagtgatgtgtaatagtccacgcttcattcagtgttgccaggaagagattaatacactaaactttttagatgagtaatacttgtctatattcagttagccttaaagcttttttttaaaaaaaatcatattaatgaaaactttctaaatttgccttaggaattagcatatactaaacattattaaactcatggctattcttttgaactttagttactacactatgccataatgtatctaagtatctatactaaatagtttcaggcatctggctttaatcatggttccttttgctgttactcaggattccttattttggtgatgtgtttggtaggctgccttgtttcatatagccattttggtgaggatctgagtggctctgcccagcttataaagataaataattgggctttatgactaatatttgccacttacaagcattttgaggtttcttcattgcttccctgtgttgttggtgcttgagatctgacctctggcaaaatatggcactctgtcctgttatgagaaaaacccaggattaaactaggagggagcggagagaccaaagaatgactcggacaggtctatcttggcaagtagatgagtttattaggacttacagacaagacactcctgggcagcatcaggacagctctagaaatccaccccacctcccatatttaagttgctagtaagctaattttttggctctttgcctactgcgtatatgcaatgacactgttttccttggtatgttcccagctatgccctgcaatgtttgggttctcaggacctgctcctctgctaggcatgatggctttggcttgccagctggcctttgaagtttaagcagcagacatatacccttaagtagtctggtggggaactggtcacattacagttctatcatttcttatagttttatgaaaataaatcatgggtaggtgaccaagtctctccttacacagtgacttatgtgaggtcttatttgggatcaggagcctggcatcttgtgataccatcacaagatataccccccatgtatacatcacaagtatacatcactgtgatactctcagtttagtgcgtatctgttatcttttggcaacaattgctacatatcttactgttaattttattgaactcttattcattgaaatacatatgatatttattggcaagaacactgtcacattggtgtagcacatctaaaaccaaccctttatccatcctctagaaaaccatttttactgttttcttatcttgtttaatggcattgccatccacccagttatccaagctagtcagtaattcaaaatcataatcagttcctcacttcaccatgttcagtcagatgctaaatcctgaatgcttctaaaatatgaccccttctctacatctatttggcttcagtgtagaccctctttatctctacatctggaaaacaacaacagcctcctaacttacctctctggttcctgtctttctagttcctaacactgttgctggttatgtttgtaaaacacaaatttgattgtgtcactctcctgcttaatatccttcagtagttcccattgcttcaagatgaaatttaaatcaaagtctaatatagacaaaaatagttactttaattggagttctctagttgaagaaacttgagatctggggtggggagaagaagagttggttgggctgttcttctacctattgtttgccatggcagctcttgagacactctgtaatgcacttgtttgaccttcattctgttaatgtgggatattaactgtacattgattttcgtgtgttgaaccatccttgcatcccaggaataaatctcgcttggtcgtggtgaataatctatttaatgtgttgttgaattcagattgctgatattttgttaaggatttctgcattgatactcatcagggatattgatctacagctttctcatattgtctttgtctggctttggtattagggtaatgctggcctcagaaggaatttgggaattccctcccttttatttttttggaagattttgaggaggattggtgtcaaattctttaaatgtttggaagaattccccggtgaagccagcttttctttgttaggagcttttggattattgattcaatctccttactagttatagatctgttcagatttttgtatttctcatgatccagtcttgacaggttgtgtttctaggaatttgtcaatttcttataggttatccaacttactggtataccattgttcatagaattctcttatccttcttatttctatgacataagttgtactgtcccctctttcatttccgattttagttatttgagtatttgctcttattcctggttaatcaagttaatagtttgtcaatcttttaaaaaaaacccaactcagctgttttgtttttctattattttttctggtctctatatttctctctgctgtaatgtttattatttccttccttatgctaggtttgggtttagtttttgttttttttttttgaggtataggttgttgatttgagatctttcacaactacaaacttcctttttagcactgctttcactgaattccttaagttttggtatgatgtgcattcattttcatttgtcccaagatattttctaatttccctgtgatttattccaagagtgtgttgttgtttagtttccatgtgtttgtgaatagtgcacatgtttgaaaacttctgctccatccaaatctagcgtcctggtattcccagaatactctatacatacatactctatacatcatgcctctgtgcctttgcacatacttttccatttttctggaaagctcacctcttgtcattcctccaggcaagcatagcacagatatcccctcctttatactcacatagccgttactgcacactcctgttctagagttcattatcttgttttgagatcatttggttgtcttgttttaccctgagctcctcaggagtaggcttcttcttcaggattgcaacccctgctccccagtacttagagcaatcagtcaatgaatgtgtattcagttgaatgattatgtgcattttatttgcagtaacaaatttatctggttacatggttgcttttctcttgtttttaggaggtgttcctgctcatatgtttggcgtgacaaagtttggggataacattgaggatgaatggtttattgtttatgtaataaagcagatcacaaaggaatttccagagttagtagcaaggtattgtagttattttaattattctaaaggaattctattactgaaacaaagtgactacatttttatctatttagtaatttatttttctcctgtagtctgctggaaattgtacagattttaatagtatctgtgctctttttttttttttttgagacagtcttgctttgtcacccaggctggagtgcagtggtgtgatcttggctcactgcaatcttcaccttccgggttcaagcgattctcctgcctcagcctcccaagtagctgggattacaggcgtgcaccaccacgcctggctaattttgtatttttagtagagacaagggttcaccatgttggctaggctagtctctggagctcctgacctcaggtgatccacccaccttggcctcccaaagtgctgggaatacaggcgtaagccaccgcgcccagccatatctgtgttttctttctcttctcttgtggcttccttttcttgagaaagaattaaagtacacggccaggcgcggtggctcacacctgtaatcccagcactttgggaggccgaggcaggcggatcatttgaggtcaggagttcgagaccagcctcaacatggagaaaccctgtctctactaaaaatacaaaattagccaggcatggtggtacatgcctgtaatcacagctactcgggaggctgaggcaggagaattgcttgaacctgggaggcggaggttgcggtgagccgagatcgcgccattgcactccagcctgggcaacaagagtgaaactgtctcaaaaaaaaaaaaaaaaaaaattaaagtactgtcaaagagttcaacttccaaaagatttcaaataaaacctacttattttaggttttctttttaaagttctaattatgaaaaaacaaatacatgtggtaaacaaaattcaaaagatacaaaggtttctactgctcttgcttcccagaagtaatcaccattaaattccttgtggatctttgaaaaataaaattccattcatacacatacacacatatttcacgtatttttaaatatgtattcctgtactagaccatagctatattttttgagaaatcatacacagaaacaatttaaagagaagtcagtgaacacaattgtataggaagcaaagtaggtaacattacgttaaaaatgggacctgggttttctgtaattaaccacgtattgccagcagagggcgttccgcccacttatattttgtcctagttttcctagtcagcacccaaattctgatctttttttacccactcaacctctttcccaacagaacaaaatagaagggagaaaaaaacctttgaaaacttattatttaaattttaaacatacattaaagtagaaagaatgaacccacatgttcccattatccagcttcaacaattaccaactcatggtcattattatttcatctgtagctgtcatttgatccttaaatatttcaggatgtaaatctaagcgataactcattttatttttatctttaaataaatttatttaaaatttttaaatgttttaaatttatttattatttatttagttttttaaagacggggtcttactattttgcccaggcgggacttgaactcctgggctcaagccatcctcctgcctcagtctcccaagcagctggtactacaggcacatgccactgtgctctattttattttattttatttttttgagacaggctctcactctcttgcccagactggactgcagtggaacaatctcggctcactgcaacctctgcctcccgggctcaagcaattctcttacctcatcctcctgagtagctggggctatgggcgtgcaccaccacacctggctaatttttgtattttttgtagagacaaggtttcaccatgttggccaggctggtctcaaactcctgacctcaagtgatccacctgcctcagcctcccaaagtgctgggattacaggtgtgagccactgcgcccagcctatttttaaaattgataaataaaaattttatatatttattatgtataacatgttgtcttgaaatacatatatattgtaggatggctgaattgagctcataacgtacattacttcacatacttatttttttgtgtgtggtgcgaacatttaaaatctactgccttagcaagtttcaagaacacaatacattgtaggcctggggcggtggctcacatctgtaatcccaacgctttgggaagtcgaagcggaagcatcacatgaggtcagaagttcgagacgagcctggccaacatggtgaaaccccatctctactaaaaatacaaaaattagccatgtgtggtggcccatgcctgtggtcccagctactcgggaggctgaggcaggagaatcacttgagcccaggaggtagaggttgcagtgagtgtgattgcaccactacattccagcctgtgcgacagagtgagactctgtctcaaaaataaaataaaataaaataaaataaaataataaaaatagaagtatagagctagaacgatatataacagtatataaaatatgccatgtcttgtgtaaaaaagggagaaaatacaagtatatatttctatagttagattatgtgtaagcaaactctagaaggatatacaagaaacagcagtgatgcatgtagggttgagcagatagggacaaaagtaggagggagacttttttattttgtaactttttttttttttgagatggagtttcgctcttgttgcccaggctggaatgcaatggtgcgatctcggctcaccgcaacctctgcctcccaggttcaagcaattctcctacctcagcctcccgagtagctgggattacaggcatgggccaccacgcctggctgattttttttgtatttttagtagagacggggtttctccatgttggtcaggctggtcttgagctcctgacctcaggtgatccgcccacctcggcctcccaaagtgctgggattacaggcgtgagccactgcacctggccatgtaacttttaatacatttttttaaaaaatgtaaccatgtgaatgtataacctattttaaaaaattaaatttaaaaaagtgatacgggccgggcgtggtggctcacacctgtaatcctagcactttgggaggctgaggtgagcggatcacttgaggtcaggagttcgagaccagcctgggcaacatggcgaaaccctgtctctactaaaaatacaaaaattagctgggcatgatggcgggcacttgtaatcccaactactcaggaggctgaggcaggataattgcctgaaaacaagaggtggaggttgcagtgagccgagatcataccactgcactctagcctgagtgacagagcgagactccgtctccaaaataaaaaaaaaaaaagtgatgcaaatgaggcagaaataattatcttttcaggcccaaataacacctcctacatgaaggcttttctaatctcagctatgtgtttcttttttttcttttggaaccctatagtactttcgtatattttcatatttttgtctaatatttctttatgtaaattgcttatcttctctccttatcatatctaccttcaactcctccttacaatcttacagtctccttcagtgcttaatgttatcttaaatattttgctttcttatagccatctgcacatagtacatactcaaatatttactaagatgaagaggaaaatgtattagaatgaaactgttttggttactagcagatatatgctttttgaatgcaaaattggaaattttcttgcattaggattgaagacaatgatggtgaattcttgttaatagaagctgctgactttctccctaaatggctggatcctgaaaatagcaccaatagggtaagtatacccaagtttagaaaatttatagagatgaaatcatgctgcattacattcatatgtacctgcagtttgccagtgcccactgtgaaaattgaaatgtaccgtttgcaggtatttttctgccatggggaattgtgtattatccctgcaccaagaaaatctggagcagaatcttggttacccaccacacccccaacaattccacaagcattgaatataatcacagcacattcagaaaaaatacttgcttcagaatctatacgagctgctgtgaataggcgcatcagagggtaagaaaaatatcactttcattgctaattaaggaaccttttggtttcgtgtagttcagtctttctttgatttttgtttgttttccttaaagctctgttggagttgatcagtctttctttgactataaaatacctttcacctagattaatgctaattttcattttgtcttcattcctctttatgaaatagactagtaaattaaacttacagattttaaaatcaggaaacagatacatctttaaattcccattcagaagtgttacaatcttgtcccaatatttttgcatttatttaccttagatattgtggctaagtattagctatatccatgggtaaaaaatttgagacctttaaaaatagaaacttcatgggcctggagcgatggctcacacctgtaatcccagcactttgggaggctgagcagggggcggatcatgaggtcaggagttcaagaccagcctggccaacatagtgaaatcccatctctactaaaaatacaaaaacaaaatagcagggcgtggtggcaggtgcctgtaatctcagctactttggaggctgaggcaaggagaatcgcttgaacccgggaggcggaggttgcagtgagctgagatcacgccactgcactccagcctgggcgacagtaggaaactccatctcaaaaaaaaaaaaaaaaaaaaaagtagaaacctaatggagcacaaacaaggtgctcaggttttttctgttgttctgggtctgtatatgggattctttgacctatgtcagaattcagtttctgaataaaactttagcttttattcagaaaagaaaggtcttagcctaattacatattcgttcatccattcaaatttgggtgcctattaaatattaagcaccattcaggtattaacaatattaaaaatatttttggccgggcgcggtggctcacgcctgtaatcccagcactttgggaggccagggcgggtggatcacaaggtcaagagatcgagaccatcctgaccaacatggtgaaaccccgtctctactgaaaatacaaaaaattagccgggcgtggtggcaggcccctgtagtcccagctgcttgggagactgagcgcaggaaaatcacttgaacctgggaggtggaggttgcagggaggtggaggttacagtgagccgaggttgcaccactgcactccagcctggcgacagagcgagactccgtctcaaaaataataataaataaaaaataaaaatctcttttagcttcagcatactttgtaccattcttttagaagaataaactctgattttatctttattccaaagtataataggtatttttgttttgttttgtttttgagatggagttttgctcttgtcgcccaggctggagtgcagtggcgtgatctcggctcactgcaacctctgcctcccgggttcaagcgattctcctatgtcagcctcccgagtagctgggactacaggcgtatgccaccacgcccagctaattttttgtatttttagtagagatggggttttaccgtgttagccaggatggcctcaatctcctgacctcgtgatccacccgcctcagcctcccaaagttgttttgtttttatagagctacaataatcccttttctttattttccatttcttcctacttttttctttccctctctcgtatattcttaagtgtatatacagtatcttttttcatctctcttgtcactctctacgtactgctcttgatgaacaaagagatgtcaaaaagaatgtgaatggtataagaattataggtatttatatactgtaaaatgaaagtaattatgttacctgtcccaggtacccagaaaaaattcaggcctcacttcatcgagcacactgcttccttccagctggcattgtggcagtgctaaagcagcgccccagattggtggctgcagcagtccaggcattttacctacgagaccctattgacctgcgagcttgtcgtgttttcaagacattcttgcctgaaacacgaataatgacatcggtgagatttctatcttggtcatttagtttctcttactggaaaccgagttgaaacattattatttttttctttttacatttctcagtgctcagtgaatgaaacattattttaattgttctctagaaaaaaaaggaaatattctgtttcttcatagcatgttaatatagattgaatattccttatctgaaatgcttgggactagaagtatttcagatttcagatttatttggattttggaatatttgcattaaacttactacttgagcatcccaaatctgaaaattctgaaatctcaaaactttgagcatatcgttgggactcaaaaagttttggattttggaacattttagatttcagatatttacatttgggatgctcaaactatacacgttttttcttttcttgcacccagtgaaggaaattttcaagagacctgcctccccattttatactcaatgttttatagctatttttgaccatatgtttctatttctataattatttccttttttttttttttttttttttttgagacagagtctcactctctcacccaggctggagtgtagtggagccatctcagctcactgcaacctctgcttcctgggctcaagcgattctcctgcctcccgagtagctgggattacagtcacctcccaacacgcccagctgatttttttatttttagatggtgtttcgccatgttggccagactggtctcgaactcctgacctcaagtgattcacccacctcagcctcccaaagtgctgggattacaggtgtgagccaccgcacccagcctaattatttccttcttaacaataaaacatttcatctcttccagagaattaagaattattcttggccgggcatggtggctcacacctgtaatcccagcactttgggtggccaaggcaggtggatcacttgaacccacgtgtttgagaccagactgggcaacatggtgaaccccatcgctacaaaaaataaaaaaattagctaggtgtggtggtgggcgcctgtaatccccgctacttcggaggctgaggtaggaggattgcttgaccccaggaggtttgggaggccaaggtgggcagatcacctgaggtcaggagtttgagaccagcctggccagcatggtgaaaccctatccctgaggcttcagtgagccatgattgctcactgcactccagtctctgcaacagagcaagaccctgtctcagaaatagaaaaaatgaattatctttatcttccagccatttaattgctgtataatgtaactaatgataagagttttactagcgattactaaaaagtaggcagtagggtaaaattttttttgcaacagtgtcttgctctgttgcccaggccggagtgcagtggagcaatctcagctcactgcaacttcctccacctcccgggttcaagcaattctcctgcttcagcctcccgagtagctgggattagaggcgtgcgccaccatgcctggcttatttttgtatttttagtagagatggggtttcaccatgttggccaggctggtctcaaactcctgacctcagatgatctgcccaccttggcctcccaaagtgttgggattacaggcatgaaccaccatgcctggccagcagtagggtaaattttatggtatgtgagttgtatctcaataaagctgttactaaaaacaagtaggcaatgaataggttgaatcttctttgcatttcatatgaatatgaagcttataaatggacttctcattatatttaactgtgaagtgttattcacaatcttaatttcaggaaaagactcatgtattttgtgtcttgatgcccaggtcacattcactaaatgtctatatgcacaattggtgcaacaaaggtttgtgccagaccggcggagtggatacaggctgcctcctccatctgatccccagtaccgagcccatgaattgggcatgaaattggtaatgttgaaccagaaaatgttgtttcctttctttatgtaaatggactcttaatagaatagtggcacaatatacaaagtccagaaatacaccctgtttatgtaagaatgcagtaaaatgtggcatttcaaattagaatgaaaaaaatggattacttagtaagtgatgatgggacaagtctgaagtcatctgaaaaattgaagttgattccctaatacctataccaaaataaattccaattggatcaaatatttgaacataaaaattgaaactatacaatttgaaaaaaaaccaagaaccttttataatttgaataggaaaggcctttctatgcatgacttgaaaccagaagctataaagggaagactgatgaatttgattatgcaaaaattaagcatttctgcacgggaaagaaaaactccataaataaagtcaaaagcaaatctggaaaaagtgttatatttgcaatctaaatgaaaaagagctgacttctctaatacataaagtgttcctttaagtcaatatgaaaatgataatactagccaattaattttaaaatgttcagaactatgaacatagtccacagaaaaggaaatacaggtgacctttaatttaaacatatgaaaaatattgaatcttaactcataataaaagaaatgcactttaaagctacaaaatagtgtttttcttttttttttgtttgctttcaaaaatgttacaatctagacattgataggaatgtctagattttctttttttttttattattatgctttaagttttagggtacatgtgcacaacgtgcaggtttgttacatacgtatacacgcgccatgttggtgtgctgcacccattaactcgtcatttatattagatatatctcctaatgctgtccctcccccctccccccaccccacaacaggccccggtgtgtgatgttcgccttcctgtgtccgtgtgttctcattgttcaattccccacctatgagtgagaacatgcggtgtttggttttttgtccttgcaatagtttgctgagagtgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacagtgaacatacgtgtgcatgtgtctttatagcagcatgatttataatcctttgggcatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgttctctgactttttaatgatcgccattctaactggtgtgagattaccatctcattgtggttttgatttgcatttctctgatggcgagtgatgatgagcattttttcatgtgtcttttggctgcataaatgtcttcttttgagaagtgtctgttcatgtcctttgcccacttgttgatggggttgtttgtttttttcttgtaaatttgtttaagttctttgtagattctggatattagccctttgttagataagtagattgcaaaaattttctcccattctgtaggttgcctgttcaccctgatggtagtttcttttgctgtgcagaagctcttgagtttaattagatcccatttgtcaattttggcttttgttgccattgcttttggtgttttagacatgaagtccttgcccatgcctatgtcctgaatggtactgcctaggttttcttctagggtttttatggttttaggtctaacatttaagtcttcaatccatcttgaattaatttttgtataaggtataaggaagggatccagtttcagctttctacatatggctagccagttttcccagcaccatttattaaatagggaatcgtttccccatttcttgtttttgtcaggtttgtcaaagaccagatagttgtagatatgtggcattatttctgagggctctgttctgttccattagtctatatctctgttttggtaccagtaccttgctgttttggttactgtagccttgcagtatagtttgaagtcaggtagcatgatgcctccagctttgttcttttggcttaggattgacttggcaatgcaggctctttttttgttctatatgaactttaaagtagtttttttccaattctgtgaagaaagtcattggtagcttgatggggatggcattgaatctataaattaccttgggcagaatggccatttttacgatattgattcttcctcaaaatagtgtttttcatcatttattagcaagtatcaaacggcttgataatacatactgggttgttgagaatatatacagaaaaacattctcagacattgttgataggaatataaattgattgtatcccttaggagaacattttggcaaaacagatgttccttgacttacagtggggtaacttcctgataaacctgtcaaaaattgaaaatatcataagtcaaaaatatatttaatacagctaaccaaccaaacatcatagcttagcctagcctaccttaaatgggctcagaatacttacattagcatacagttgggcaaaatcatctaacacaaaggctattttataataaactgttgaatatgtcatgtaatttattgaatacagtatactatagagtacagtattggttgattgcctttgtgatcacattgccaactgcagcttgctgccactgtgtatccagcatcatgagacagtatgcatattgctagcctgcaaaaagataaaaattgtaagtaaggtttctactgaatgcatattgctttcacaccatcataaagtcaaaaaatgttaagtcaaaccatcataagttggggaccatctgtattcatcaacatttaaaatgcacaaacctttttagtcagcattttcacttctagaaaatgattctttatgtattttacctatatacaaggacatatatggagcatagtcatgacagcattgttcatagtagcaggagactggaaactacttaaatgtccattagtaggggaatagttagataaattgtgctctagccatgaagtaagatggatgaatttgtgtgtgctcatgtaagtgatctccaaggtatatggttaagtgtaaaaagcaaggtgtagagtagtgtgtatgcgtccattgagcaacaaaaggggtggagtagaaagctatgcatacagagaggcacacacataatacttcagtgtgtaggttacttctgaaaggatgtgcaagaagttggtaatggtgttctctagcttgatcagggaagctccctgtttgaattatttagccatgtgcatctattattttttttaatcaaaggacttttaaaatgaagtgatttcctctctttactatgtctgagatcatgttcaatatatgtataatttctgttggacaagaaaccttttgtaaccctgttcataatcaaacaaaaaataaatgtaaatttctggttttgtaatcagcaggaaaaggaatctctttgaagagaacaggaatctttattgtatattattttctttccttttatgtttttagtaatctataatgattgagaaacttgggaataagtttatatttttcataaaattcaaaaagtgttataattgtccaaatgcccatgtatccagtcatctagttctagagtgtggctcaatggaaaaaaagtaatgtgttataataagatacgggaaaaaaggaacttagtaacaaaaattctacctatctcatctaggctcatggatttgagatcttatgctccaaatgtagcccacatttttctgactgcaagaaatcccttgtgactgcctcaccactctgggccagtttccttgaaagtctgaaaaagaatgattactttaaggtaggacttgcaatatatttgcttttaagtattcaatccagggaaaatcaagccagcgacttaaagtcctatagtccatatttaaatgtatgacataattatggaagctagacttaaaggagacctttctagttcagtggtactcaggtgctaatgaaggaggtatctatgaactgtttccagtattagagaaaaactaacactgttggtattaaatgatgaaagtgattatctgtaccagataaaacaacttgcaaaaacttgataatgcaaacatgaaaacaccagataggaaaattagcaaagatgtggattttaaaaattattaaaagatacctagtaaatttctcttaaaatattcaacttcacaagtagtaaagatatatatatatatatatgaacacagtaatgaagaatgtctttcatgtatgtacaaaaggatatgaatgatattctgtgctgtcgagagtatggtaaaaataacactcctataccttgctggtaacattgcaaactggtagaatcttaactggaaagtaatttggtagtgtcttccaagaggtatagaaaggttcaaacttggaaccttcactttgaataatctttttaaaggaaatatccaagaagtggaaaagtcccgaagaatatgatgatgataaagatggcacagcaatacgaaaagtactaatgatattatagtatatatatggtatttttttttttttgagatggagttttgctcttgtcgcctaggctggagtgcaatggcacaatcttggctcactacaacctctacctcctaggttcaagcgattctcctcagcctcagcctcctgagtaactgggattacaggcccacactaccacacccagccgatttttgtatttttagtagaaatggggtttcaccatgttggccaggctggtctcggactcctgacctcaggtgatccatccgccttggcctcccaaagtgctgggattacaggcgtgagccaccgtgcccagctattactgttgttgttattgttgttgtatagggtcttgctttgtcacgcaagccagtgttgtggtaggatcatagctcactgcagcctcgatctcctaggctcaagtgatcctcctgcctcagcctttcaaatagctgagactaggcatgtgccaccattgcctggctaaagattgtttttttttctttttagtagagtcgaagtcttgctatgttgcccaggctggtctcaaactcatgtcctcaagtgaccctcccacctctgcttcccaaagtactgagattataggcatgagccacagtgcccagctagtatattcttaaaaaatgtaaaatactaagtatgactatcactataaatatgcatttagaaaacacaaatgatagtaatggtgggattttgccattttttattctacttggcaaactttctgtactttgttttgtgaattactagttaatcagctatatctttaatttaattttttttttcatagaggcagggtctcaccatgttgcccaggctggtcctgaactcctgagctcaagcagtctgcccatctcatcctcccaaagtgttgggattataggcgtgagccatcgcacccagccaattatatcttaataagtaattaagtaaaagaaaatggtggaaaactttccaaactggaaataggcccttaatggtggaaaagattaggaatcactacatctagccgcgtcccctcatttgaagaaactggagctcaaacaggcccattaatgataaaacagggcctaggacttggggcacgtgattcctgagtagtagattatttgctgcctccctgaaagttgctggtgaacacatttttttcatgacaacttgtgagtaatgttctgatagacctttttttttttttaagggactgatagaaggttctgctcagtaccgggaaaggctagaaatggcagagaattacttccagctctcagtagactggccagaaaggtgagttattgttaagactcctactacaaagattggtatttaggtagttctttttattttttatttattatttattattcttatttatttatttttttgagacggagtctcactctgtcacccaggctggcaacctccgcctcctgggctcaagcgatcacaccactgcactccagcctggatgacagagtgagactctgcctcaaaaaagaaaaaaaaaacaacgaaagaaattttgcatcctcctctatgtaattttactcatcatgatatcacattttccatggcattatgaagtctttataaacataatttttaaaagctgcacaatatggccaggcgcggtggctcacgcctgtaatcccagcactttgggaggccgaggcaggcggatcacgaggtcaaaagatcaagaccatcctggtcaacatggtgaaaccccgtatctactaaaaatacaaaaattagctgggcatgatggtgcgtgcctgtagtcccagctactagggaggctgaggcaggagaatcgcttgaactcaggaggcggaggttgccgtgagctgagattgcacctggggacagagcgagactccatctcaaaaaaaaaaaaaaaaaaaagctgcacaatatttcagcaaatggatgtacccccataatttactcaactattttttactgttggggaaaaaattacaagtagcttaaatgtccaacattttaatttatgttgcaggagaggctcccattctgcacaccaggataatttttaaacagtttaaaaccaaacttccatctccctccagacctgttgttgaattcccaaagtttgtggtttttttaaaatagctgaattaatatcgtagacttttattttagatttacctttcattttcactttttttcatttattgttattattatttatttatttattttagacagagactcgcttagtcacccaggctggagtgcagtgctctgcctcccgggttcaagtgattcttctgcctcagcctcccaagtagctaggactataggcatgcaccaccaggtctggctaatttttgtatttttagtagagatggggtttcaccatgttggccagactggtctcaaactcctgacctcaggtgatccacccaccttggcctcccaaagtgctgagattacaggcgtgagccaatgcacccagccattaattttttatttttaattattgtggatacatactagttgtacatatttatggggtacatgtgattacatgtataatgtccatgtggcatacaatgtataatgatcaaatcagggtaattaagctttccatcacctcaagcatttatcatttctttgtgttgggaatatttttagttattccatttttttaaggtatttggaactatataataaattattattaactgtagtcaccctgttgtgctaccaaacactagctctttttaattttttaaaaaatattttttgggatttgccaggaagatgttactaaaaagcattccagatccagaccccaagagaggggtcttggatctcatgcaagaaagaattttgggcaagtccatagagtaaagtgaaagtatgtttattaagaaagtaaaggaataaagaatggctactccataggcagagcagcaaacactagctcttattccttctatttaactaatttttgtaaccattaactatcccctcttttccccccgctctctgctacccttcccagcctctggtaaccatcattctacttttattattattattatttgagatagagtctcactctgttgcctagactggagtgcagtggtacagtcatagctcattgcaatcttgacctcctgggtttaagagatccccctaccttggcttctcaaagttctgggattacaagtgtgagccactgcacccagccagccattattctgctctctgtctctcagtttagaattgtttttagctcctacgtataatatcatagactttcccctaatttatcagagattgtaatagtgaaaaattataagcaaccaaagtatccatcaataatggataaatgaattgcagtgtacttatatgatagcctgctatctagtagttaaccagagatgaactatatttacatatatctgatttaggatttttcaacctcagtgctactgacattttggatctgataatttattgtgagggactggcttgcacttcataggacatttaacagcatccctggcctctatccagtaaatatcaatagcacttctccctcatcccccaatcatgacaaccaaaaatgtctccagacattgccagaggtacctgggcggcaaaatcgtccctggttgggaaccactgatctaaatgggaaccactgatctaaatgaatagatttcaaaaacataatgcagtgaaaaaaaaaaaaaaagcaagttataaatacgtacagtaatgggtaccaaaaaaaaaaaaaaatagaacgaatgagtaagacctactatttgatagtacaacagggtgactatagtcaatgataacttaattatacatttaacatagagtgtaattggattgtttgtaactcgaaggataaatgcttgagaggatggataccccattctccatgatgtacttatttcacattacatgcctgtatcaaaacatctcatataccctataaatatatacacctactatgtacccacaaaaattaaaaatgaaaatgaaaaagaataaaatatataccgtgtggatgttacacatataaaaattttaaatatacaaaatactatacaggctgggcgcagtggctcacacctgtaatgccagcattttgggaggccaaggcgggtggatcacgaggtcaggagttcaagaccagcctggccaatatgggaaaccctgtctctactaaaaattcaaaaattagctgggcgtgttggcacgcccctgtaatcccagctgctcgggaggctgaggcaggagaatcgcatgaaccctggaggtggaggttgcagtgagccgacatcgcaccactgcactccagcctaggtgacagagcaagactccgtctcaaaacaaaacaatacattatttatagatacatatatattcatttattcaacaaatatttattgaatgcctcctatgtgccaggccctattccaggtactggggatataataaatgaacccaaagtgtccttgtccttatagagcttacatgctaatgtaggagaaagaccgcaagccattatgtaatattagggggtggtaagtgctatgaagaaaaagcagtgtgtggggtagaggggtagagactgctcttctagatagattagtcaaggaaggcctttctaaggaagttttctttgaaaagagacctgaatgaagtgaaggagtgagacattcagttatttaggggaataacattccagcaaaaggacagacagcaaatacaagaaatagaaacagaaatatatatacatacagagagagagaaaagtgccgaagtatacttgagaaagcagtcacctctggggagcaagacaatggattgggatgggtggcagtggtcatcaaaggaaacattagctttctctacaatttttttttttttttttttttttgagatggagtctctctctgtcaccaggctggagtgtagtggcacgatctcagctcaccgcagcctccacctcccgggttcaagcgatgcccctgcctcagcctcctgagtagctgggactacaggcgcgtgccatcatacctggctaatcttttcgtattttagcacagacagggtttcaccatgttggccaggatggtctcgatctcctgacctgtgatctgccctcctcagcctcccaaagtgctgggattacatctctacaatatttttaaggtacatgataaacctatacacttttttgtcaattaaaaataaacaaataggccgggcacagtggctcacacctgtaatcccagcactttgggagaccgagatgggtgaatcacctgaggtcaggagtttgagaccaacctggccaacatggtgaaaccccatctctactacaaatacaaaaaattagccggatgaggtggtgggcacctgtaatcccagctactcaaattaaaaataaataaatagccaggcacagtggctaatgcctgtaatcccagctacttgctgagataggaagattgcttgatcccaagagtcaaggctgcagtgagctgtgatcatgccacgcactctagcctaggcgacagagtgagaccctgtcttagaaaaagaaaaaaaagaaactatgcacagagatacttatgtgttgagtgagtgacataatggtgacatgatttgttacataaattgatggcaccctgtctgaactattaagaatggatcaaatcaagttgtataaaggacttgctttaattggataaacatttgcataccttgcaaaatcacgtaggtgatggggaactgtctctactctgtattattaatatgtaaacgttactaggagagagaataaaccaaataatcataacaaaaggcaaaataaaaatcattctggaatatcaaatgctaaagagagtcatagtgagaaggtaataaactttcactaaggttgaagcagagatgttaaaaaaagaaagataatggaaggcttcagggaggaggtatttgagttaagtcttaaagaatgaggattttttttctttttatggagtctcttttttttttgagacggagtcttgctctgtgcccaggttggaggtgcagtggcgcgatcctggcttactgcaagctccacctcctgggttcacgccattcatctgcctcagcctcctgagtacctgggacaacaggtacccaccaccacgcccagctaatttttttttttttttttttttttagtagagacggggtttcactgtgttagccaggatggtctcgatctcctgacctcgtgatccgcccgccttggcctcccaaagtgctgggattacaggcgtgagccaccgcacccggccaacggagtctcgctcttgtcgcccagcctggagtgcaatggcacaatcctggctcactgcaacctccgcctcctgggtaatacagactttgcaaaagttaaagaacttccctgggttctggttttctcatctgtaaaacaggattattaccttctataatagtaacaaaaggactcaataagaaaatgtatttaaagtgttagcatagcatttaatacatgctagataaattttaattgatgctttccttctggatcttcttttcctcgtatataaaatatatattatatgtatatttttatgtatttttagtacgtgttttatatgtatatgtactattaacataatacaactgtatgtacatatatatacatatatagagagagaccctgtctctgcatgtatgtatagaaagaattatacgagatcagtggcttcataatgatgttccatggagcctgcttcagagccaaaaaggaaggccaattgtgtagatctctgagcttctatcctccaatttatttatttttattttattttattttatttatttattgagatggagtcttgctcagtcgcccatgctggggcagctcactgcaacctccacctcccgggttcaagcaattctcctgcctcagcctcccgagtagctgggattacaggcacgtgccacaatgcccagctaatttttgtatttttagtagagacggggtttcaccatgttggccaagtgaactcctgacctcaagtgatctccccgccttggcctcccaaagtgctgggattacaggcatgagccactgtgcctggcctatcctccactttaatgaaggccatttttctttgaccccttctgtattttagagttcctggtaaaagttttgtttgagaaaaagggatctgcaacctaaaaatatgcttaaaaacaaattagaaggctgggtgcggtggctcatgtctgtaatcccagcactttgggaggccaaggcagggggattatgaggtcaggagttcgagaccaacctggccaatatggtgaaaccccatctttactaaaaatacaaaaattagctgggtgtggtggcgcatgcctgtagtctcagctacttgggaggttgaggcaggagaatctcttcaacctgggaggcggaggttgtggtgagccgaggtcgcgccactgcacaccagcctgggcgacagagtgaaactctgttaaaaacaaacaaacaaattagagccaggtgttttggcatgtacttgtagtgctggctacttgggaggatgaagtgggaggatcatttgaacccaggagttcgagtccattctgggcaacaatgaaaccccatctcttaaaaaaaaaaaaaaaaaacactccccaaattagactagctaatcccttccaaccttaaaatactatgtatttatgattactattctatgttctcttatgaagaaatactcatgttttttatttttcatagttctcttgctatgagccctggtgaagaaatcttaaccttattacagacaataccatttgatatagaagaccttaagaaagaagcagctaatcttcccccagaggatggtaagtgatggaccaggatacagtggaagggttaaaaaaaaaaaattaaaatgttctactcagtctcacaggatcctctcctaagaggacttatgtgaatgtagaatggcagtattatgctttcttctttttcagatgaccagtggttagatctctcaccagatcagctggaccagctgctgcaggaagctgttggcaaaaaagaatccgagtctgtttccaaggaggagaaggagcagaactatgacttaactgaagtctcagagagcatgaaagctttcatatccaaagtctcaacccacaagggagcagagctgcctcggtaatttgtgttaaagtataaatatataaatagctagaacccaaatgttgaagtcatagtcattgccatttccactttttttttttttttttgagtaaatgagttgtactgcttgctttcttttttgtgcctagtatagtgataacttacttatttgaagtcagatttctagaagcctcatcctttgcaatccttgaaataagccagaaagatcaccctaaaaaccatcatccagaaccacacagggaaaccatatactttactctttagtagctttatgggctcaacatttaactttcaacaagttcagacctctgatctcccaccctgcaagcagattggatactgaaaaaggaattcatcagaggcagaaataataacagaaatatgaaactacatttggcaaataacaggaaaaacaggtagatagaattattacttgtaggctgggcgcggtggctcatgcctgtaatcccagtactttgggagaccgaggcaggcagatcacgaagtcaggagttcaaaaccagcctggccagcatggtgaaaccctatctctactaaaaatacaaaaattagccgggtatggtggcgcacgcctataatcccagctacttgaaaggctgaggcaggagaatcgcttgaccccggaaggcagaggttgcagtgagctgggatcgtgccactgcaccgcagcctgggtgacagagcaagactccgtctcaaaaaaaaaacaaaacaaaaaaaactgttacttgtgtatcaaatatatcattattagtgttgatgctcttgaacctgatgaaagatataaatttatatttggtattctctctttaagaaagcagggataagggaagatatgttcttgtttattttttaagctttagttcttaaaagaacaggctttatttaaattaactcaaataaataatggttttgctaatgctagatatcttattggggctagagagtgggtaggtccctaaatcagcataagctaaatgtacataaacaagatgcaatttttacttttcatttatcagactttcccatttctgttgtcctgcaaggccagtaaactcaaggatttttaaaacttaaactacaacttttcttgctgtgcctccttagaaattctatctttggtagctttcctaagaatggcaccactttagaaaagtttcaaagagttgtatttagaataaattaattgtctttgtcctttaatattgcagagaaccttctgaggctccaatcacttttgatgcagattcttttcttaattattttgataagattttaggtaagtagtggtgtgatgttgactttcattttgaaactgttagtagtatggctgttgctagagcattggtttatgagatatctcagaagccaaaatgtttgctttctcttcctggtttgagttgctttcaaccatgaattactacccatgaataattttgtagaggctgcctagcttagtgtttgacatatatagtagctgctcattaattttttttttttttttttgagacagtgtctcgctctgttgcccaggctggagtgcagtggcacgatctcggctcactgcaagctccgcctcctgggttcatgccattcttctgcctcagcctcctgagtaactgggactacaggcgcctgccaccacacccagctaatttttttgtatttttagtagagacggggtttcaccgtgttagccaggatggtctcgatctcctgacctcatgatccgcccatctcagcctaccaaagtgctgggattacaggcgtgagccaccgtgcccggcctcattaaatatttgagagtgactgaatgctgtgtgtttaaatagggttttaccttggctcccatattatattgttcttttttggaattactgtacttacaaatcagtaataaaaagataactcaaaaaataattataatatgtatatatgtacagaactgcagagagaaagattgggatacccggaaactgctaaaagatgcttacctctggggagagagtgagattggagacaatacttgtatggcttgaatgtttacatcaaaatgtattcatttattaggtatttttaaaaattttttaagaaaaatattttaattaattgaattcacttttttttaagctaaatcttttgattcagcttgtacgcttttccacaacattaaatgcacacatatctgccagcattaccatttgtagaagggatttttgtgaagtagactgactgtgtgtattagtctttttctgtgggtaacattctaattattttgagatgtgtagtaactaaataataataataataataataataataataattactaagtggctctttctttcttgggatctgtgtagggccaaggcctaatgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggtatgtgtgtttttaacctctttctctttctgagtctagtatgtcagatagctaaaaccatattttatcatagtttttctttttttggtgtgtgagatttgaaataaataagaatgttaattgttttcctaactctggtaggataaaggatcatagacttaattttccaaaacataagcttcattatattacttattctacgttatctatcaggatttaaaataaaaagtcatataatatgctcaaattagaatgcgattgtacactactacttcttaaatacattttttttcaaaagtagtttaaaaaaactacagcttaaatggattttaaaaaagagagggcacatgttctcaagaccttttgagactatgccttgggccacagtggattaaaacaaaataacataagtaaataaacaggatcttaaacattcaaataactttccagttttaacagtttattttgtatttttccctaatttagagccaaatttaggattcaccttccgtttatgttttcatcctagtttttaatgccaccactgtctaatcctaaacagaggtattatggaaagagcaagaaccctggagtcttatgggttagggtttgaagtctagctcagctgtccactgtgaatgtatctataaaccagtaatcctcatatcataaaattaacatgagaaccaaattagacagcagtaaaacctacaataggcctttaattaatgttaattctccttgctttgatcatctaaaccacttttaaaactatagtcacttccagaattgtcaaaatctagtagaaaccatacattagatttatctaaagcagtatttcttaaattttaatgcgaatataaaccaaaagatcatgttacaacatagattctgattaagtaggcctgggatgaagcttgagattttccttttttttattattattttgttttattttattattattattattattttatttgagatggaagtctccctctgtcacccaggctggagtacagtggcacgatcttggctcactgcaccctctgcctcctgggtttaagcaattctcctgcctcagcctcccaagtagctgggactacaggtgcgcaccaccgtgcctggctaatttttgtatatttagtagagacagggtttcaccatgttggccaggctagtctctggagctcctgacctcaagtgatccacccacctcagcctcccaaagtgctgggattacaggcatgagcgaccactcccagctgagtttttccatttctaataagccccaagcgatggagactctgctgctccatggacaatgctttgggtagcaaggacataaaagtctatcgagctgtaatctttcaaatcctttccccagcttgtggaatcagaggcccaactaacaatttagaatctttgtggttggaaccacaaagccttgtgtttttacttttaagctttttcactggggggaaagaaaggaacactcgcttctttcattttgaagaaaatttacattattatttcatttaatattcacttttatgtttgtttcttttaagactcttagacaagttataaatgtaccttcttaattctattagcccttgagctatttcaaaatagacatgcaatttattcgatttgcaggaatctttcctggagagaaatgtgttataacctttagaaccaagttttattatgtgtgctaggccatataacttgtagacttcattttcagtttatatcaccaaggataagaagtttcctttttaatttggaatgcaaatttacattgtggcttagttatctttttattgtaaccaccatgcaacctaatgatacattagcccataattttcttttccctctatgaataaggaacctgtatcccagactaccgataacaattcagatgaggaagattctggtacgggagaatctgttatggcaccagtagatgtagacctgaacctggtttcaaatatattggaatcctatagctcccaagctggactggcaggacctgcttccaatcttttacaaagcatgggagtgcagctgcctgacaacaccgatcacagaccaacaagtaagccaacaaaaaattaaccagcacatttagcttctcttttttctttttaaataaatattgaatatgattctgttc

SEQ ID NO: 36310 - DNA, 46791 bp, Homo sapiens
gcgggagcccgcagcggaggaggggccgcgggcgggaggcgctgcgaggcgctgctggccctcgggctgcgggagccgggctaggacgccgagcggtgactccccgccgctcccgggggccgtgacggtgagcagcagcgcctcgcgtcggggattgtgacgcgccccgccagggaggggcgggcgggggtgggcgccggcaaggggcgggcgcgcgcggaggtgagagccggcacctggctcagcgccccgttgttcggcgggaggctccgcgcggctgttggggccgttgcagggtgcgggcgagcgtcgacccgggccgctcctggaggaggaggtgggaggtaggtgctggccccgggaccgctctcgctggcgttcgcggagctgcgcctgcggagcgctctgacccggggagccccaaaccctctctgggatggagcaaggttggcgcccggcgttgggggacgagcagcgcggggacgtgggggaggaggggatggccgatttggggctgcagagtctcagcagcggccgtggggcatgcggggtttggcgatttgctagtgcagccgcaagaggcagtctttaaaacgagttattgggtggccgctgcagtggaagagaaccccgatagtggtctagtaaaaagtctaggggaagaatttacatcatccaagaggcaggcatgtgtgaaaatactttggtttataattttatcatgaaaatactttggtttagaattttatagtcaacgacagtaaactgaattgtgagctccctgcacattttttgagcctatgctgattgcccagttaggcatatcgcttgggcccaggacatagaatatactaatttgctgtctgcacgtataatgtaggaatttttagattattacccagtttcaggacccatagttgtaaatgccaaactgcgattactagcaacgctgataaagttcttgaatctgagagaattgagatttctcttttctggacgctgtaataggttgaggattagaaaagaaggtgatttagaagtgtaagggtggaggcttcttgaacttcctgggctttctaacaattcagattagagtcaaggtgtagagttagctgtgggtgatggatgtcatggaccttttcatggttcatgggggtttggcttactgtggggtagaagaaaattctggtgatcctacagtttgatcctgaactagaaaggttggtatgagttgactcatttaggagagtgaataaaatttgtaaagaattagaaatttggagaggaaagaaatgcctttaaagttcacgtcaagctattttgaaatttagaagttagaggtagatttatgaatttggatccagtcggcaaaacttgatccatcagatctcttatcctaaaactatcaacctacaggcttaggaagcttaggttattcattcacactaaacaagtaaggaaagctaatagctaatttaacactctgttctgcctgctgttaatgaaggtttctcaaacaaaacggttctttgagaagagggttaggaactgataattaaaacgaaggctcttttagtgactggctgaacctcttaggccaagtcattttgtactcttccttcccttctctttccccaactgtacagggaagataaaaagctcatggattacgtaacatgggtgaggcagcttgaagataactgtgaagacttagttattctaggatgaaatgtggagatctcataacacattgtgccttgtgacaagacttgttaaagcacattatgttctaaacataatgaggcagatatatgagaaaactaaaatgttacgctgaaattgtttgctaaagacctcaagtccagcacagtgtccaattgtatacttgggatctcctagtacttgacagtctgctttttggccaaagcaggccgtgacaccggttttataaagtaggcgtttgagtgccttttatgtagtatacccctagagaaattaggtgcatgaaaagacaccgcccccaaattgtgtgattttaattcatttaacatgcttaaattggatcgatttcaaagatttttaagttattttttccatatcttttacaatagctgtgaatatgccttactggtttcaccatttgctcatgacgcaaagaggttttgatacgatgtgggtttgttttgtggctttggtaatggtgatatggttagctagtagtgaaggtacaagttatcttgaattcacgagtttatgggatgagatagaatagagaaatgcaccattcattagtagtaatgaaaaacatcctagaattgtgccttttgattgtgggccaatgttttatgtagtaccagcagatttactgaattattctttagtaattctttcaataaacattcattaaacgcttagtaagctgctacttgcctgacctgaggataaaaagatgagtgttgccttgaggaatttgtattttagaaattatcagcatagtgaggcaggaagcaaaaaaacctcacaaaaaacaaatataggaaggctttcaaaaagaaggagaatttcagctgtgtctggtagaggcagtggagttcatcaagcagctggtgcattctgcagcagtgtacagttgagttacaggtggcttggtagagttggaccagggtggggttgccatattaataaggctgtagaacagtgctgtgaacattgaccagtaggttacagggaaccttcagaaggttttatgaaggggaattatattttatttttactttagaaggatatttccaccaaaatcagtaatttgagtgatccaaaatgtattgagtatagtgcaaataatatctgaaagacagtcccacacagcagttagacttgaagtatattttgctgaagccctcagaaactccagaaaagcagaaataattatacaacaaacctttcttaagtatcttctactttgaagactggaagaatagggatacaaattaaataagatacttccccattttcaagcaacctgcagttcagtaggagaaataacacagttataatgcagtacagaatctgggtgtcagacataaaaatgtcagactctagcaatgtaggattctgagatgagagaagaaatagtctttcaaattagcaaaaataagtttttaaatagaaatgaaactacaagcagttaaacattcagaacaatcttaactccagttgttctcatcttttaactcttgcttcacacatatccttttctcatattctcttgagtcacattttcggtttgatctaccacactactagctatgtgatcttgtgccctggttgtcgcatttatgaaggataataacaatacctgcttcgtaggggtgtgattagaaaaataggttagtatccagaacaatgcctggaaaaatagctcatacttactgagcacttaatatttctacttgatataaaaatgctgtaattgagtaagaacagactttaaagacaggattttttttttgtcatgctagatctatccatgagcgtctaataaagcctctacattcagagaaactaacattcttttaaactgagattcttgaacaagtgattttccttttcttatttggtgatcatctttctgaagtctgattttcatttttacccctcagctttgtcattaagtcactaatcaccgaattcaacactttttaaaattcaaaacctgcccattctatggcatttgctgctgtgtatcaccctttctctttaaaagtcttctcccttggctttcctgaagtccgttcccctgtctctttgtatctcttgtgtctgggtctgcttcactcgcttatgttgatgttctttggggtttgttctcctgccccttttttctttatgaattcatctatctaaatgtgctcggatgtcttgtgagttctaggcctagagtttatccccatgtgaatgtctcataagggcatctccaaacccagtaagctacacaaagctcattatctccacacatttgcccaaacccagttttactaactttactcctctgttccctttatctaaatgacactattatctgtcaagtgccaaagacaggtttttatgtgagagagtagatgcctcccttttgtgtacttgtcaccatgtcctgaattatttcttacctgttcttcactatcctcagtcactgactaagtcagccagctggtccctgaccattaattgcccagtttactataatatctgtctcaaagatttttttttcagattataaaagtattgtatgctttttgtaaaaaaattttaaaaattaagataaaaagcaaaaaagtatttaagttacttcatgtgtagttcttggcatacagtcagcactgagaatatatttttgtgccacggtgctacaaatagaacttattttgcaagcattaagtttggaggagatttgtagagaaatattgttctaaaagaattgtaggactaaataattttgaaatcgtatatagagcctaaatagtgtaaagtagatacttaaaattcaagatgggttccagccactgcctatacttttcatttgcctgttaattgtaatctggttgtgctttcctatctattttattctctattctatagccttcgattttattttctattctatagccaaatttcaggaatatccccctgcataggatctagactataaaagcaagccaacatcatagaaataatctgtaagtacaacccatcattagccatgttgttttataatgaggcgataggctcagagaattgatatcatttgctcagcatatttgttgaatgtcaggaggaaaccaggcctgtgaggctttggaatcataaatagctagtttttagtctttccaggttaaatagctggattttatttctgtcttccaggtttgtaactgtaagttacctaatctgttgcctcagtttcttccatcaataaaccagtgctatctttactccttcctagggctagcgtgaggattaagtgataacagctaatggagccccatctggcatgcattaggtgctcttgagttcatcatcagcttctctcctaccagtttcacataattagctagtacaggagttattaacttgccatccatggatcctttgcaaatggatggcttcatagatcctctgaaactctagcccaaattgcctgttcttgtacttttaaaggaagagggtcattggctttgggttttgggacccaaaacattttaacccctgagttggcagtaaggccaaggacccagggctcttggtgcctccacagccaaactgactgggtagaatttagaattgtttgaaatattggaggaacattttatatatatgtatttaaagcattttaaaggacttcaggtgtaaagaattagtttatattccttggctcatgacacgtttgtttaattggtccatttatagttttaataatacagtaagtaccacctaaccctgtgcataaccctgtgggcccctccattcctttttcctctgtccctcacctgaggcagctatttactgaatcctatattcatcattctctcggtgtcttttatagttttattgcatcacataatttaaaactgtatatattacatgccctatcttctgaaaattttttcattttataatactgaaatttatattatgtgtcactgaagttttctgattactgcataatattccattttgtgcatatggcataatttatccattctcctgttggtggtatatgggttgtttccagggtgatactcttgtgctactcgctattgtgaagaatgctgctgtataggtgcacacctcctggcatacgtaggcaagagtttcgattgggtttcactaggagtggacttgctgggctgtagagtatgtgaataggataaatgaatattcagctgatgaactgtttatttttcagagtttccccccatcctctaaggtttaataagctgcttagccaggcattccctaggactgttattttcagcctccatttagtgctttggaacacttttacatcattcttggaatccattttgtaggacccttagataagaattcctttttggtgttctctaattgaaagtgcatataaatagaatactaatttatactgaaccacattctatagaacacagcagtgattctcaaactttgtcagaattacgtggaggttctcccaccactaaagtttctgaatctgtaggtctgtagtggcacttgataatttgcatttttattgagtcaggtgatgttgatgctgctggtcccaggaccacacgttgacaactataaccaatgattgaatttgggctaaatcattgaaaaaacgatgagtagatttattaattatgtttggtttctttgttatttccaatgcctttagtagatgctattaccatttcattatttgaggagtgaaataccaataaatagtaattttaaaatttgatttggacttcttagctgacttttaaccttaaaagttgatagacttctaaaagtgcctcttttttttcttgtttcttaataatcttctaagaatatgattgctgctattcctgtgtgtacattggaagaatttgaaactgatacactgtttgtaaattgccatgctcttgattcataccctgaatcacctttctccttctctgagctgttaccaatcaagattacgttgaaagcccttccaaattgcagcatggccaaagtgttgacttgtctatcatactaaaacagcagcaaaccttacactaatacatccttgaacttggacattcattcagcaatcttgactgggctccaaccttggagtgagtgatgatgcctgttaccgaagtggggtacaaagaatatgctgacaagcctgccaaatgagaactcagttgtggtgggagagaaattttattcctgttagatctgtgctgtaatacagttcatgttaagtgttctagaagcacagagagaagggatggcagtgcagggaaagcctggcaatatatttgctaggtttttcaaaatttttttgaattgctacatccagaatttaatattttgtctgcttttgtgtagttcccattccagttattcaattggcataattatttgattataatttagtttcaggtgaggtggtaaagaagagaatacttgttcggtttgaaaaagcagcttgaggggaggaagagcattaggacaaataactaatgcatgcggggcttaaaacctagatgacggattgataggtgcagcaaacctgcacgttctgcacatgtatcccaaaacttaaaaaaaaaaaaagcagcttgaatattgtatccttccccctctcctgtactaaagatagtagggtgtaatgttaaatgtgctagactaccagggtttgaattttggctttgtcatgttccagctctgtatcctaggtcaagaaaactccaggcttcagtttccttatctgtaatgggggaaagtatttggatcattgtaagattgaataagttcgtacacataaaatgcttagaattgttccaagtaattgctacatgcttaataaattattttattgttattaaaattaggtagaatctcatttgctaaacattgggttgtaaagacaatgtgtgcacattgttataaaaatgtgaagaaaaggcagtgcgtgatggctcacacctgtaatcccagcattttggaggccaaggtgggaggatcacgaggtcaggaattcgagaccagtctggccaacatggtgaaaccccatctctactaaaaatacaaaaattagcaggtgcggtggcatgcgcctgtagtcccagctactcgggaggtcaaggcaggagaattgcttgaacccaggaagcagaggttgcagtgagctgagatcacaccccactgcactccagcctgggcaacagagcaagactccgtctcaaaaaaaaaaaaaaaagtgaagacaaaataattttgatataaatagctgtactcagttccatattgggtcctatgagaaatgtaaaaatcaaaagataatagaacttgaaattctttaaaggtcatctagtttgacttcataattgaaacccaaagaaattatgaccggttcaaggtttctcagtacataacagaagtgttgctgagaaccatggcctctgatgctactcagtccagcgctctctcagtaccctgtgcagcttccctgaagtgacagcgccctggaaaactaacagtttaattggcagccaagtccaaaacaggtgaaaacattagcaataaaaagtcagtatataatggaatatcagatggtgtacatagattaagtccctaccgtatttaactttgtgagctgctctcttgaagcggaaatgcaccttcttagtaatttcattcattgaaggttgaaagatgaagagcatttgtttttgaagagggtgttaataaagtcaatttccctctttcctcctaccaaggttggattgttcattaagccagggggagagtccacttttgccaggtctgccagtactccatggctttgcccttgatgatagttggggaaaagtctggcctctgtatttctgttccctgtcttcctgatgggccagattcccacagacattccctcaggtatgaagactgcattacccttgctcatgggtatgcgtacatatgtggaacaggtgctagaagtgtacctgattggtgggatttgtctaagtcgagatttccactcaaggacagggctgctactttttgggattgagctaagagtactttcacacattatctcatttaattgtgcttgaatactctgctgctaaaaattttacagaataatacatgctcctataacattcaagctatataaagatatgctatggaagaggtgaaagccctgctcttctacccctccctgtacccaaattattccatcccaagaagtgtcatttgtgacattttgtaacttttccagaactttcccctaaatatatataggtagtttgagttaacaaaaaatggtgatcatactgttctaattaacctgtaacttctttttttgtgctatacatgcatatgtgctttaatctttaataatcccagaatagcctggctgtaccatatgtgttggtttttaacagtttgtccatgatggatattaagattgtctctagttttttgccatttcaaataatactgcaattcaacaatgtcctcaatatatattatgcttgctctcttatatgcctagaagtatgattgtttagtggaaagatttacacatttcaaatatttgtatactgttggaattgccctttaaaacaacaaactactgatctctggtaaagtgctatttcccttacataattgactatcttaaaaaactgtaggacatttgtataattttctaaccagtttttgcccaacaagactgcttgctgttttattttatgcattttttatcactcatgccattctaccattggttttggtggttcagaatggtgctgtttatccccatttcctgtgcttatcatcaccataattgccttttaaaaacataaattttttttcttaatatgaaaaacactttcatttatagaaaatttggaagacacaataaaataaaagttatatttttgtgcatgaaagtacataaagaaaggaatgaaagtcctgcccttgccttttccctattttttaagttggtttttccttgcaattttttctgtccttataccaacttttgtgtttatagagcagaatttatgcctgtacatatctactgatatttgtttttttttcctgaggactaaataagctcatattagatatggttttgtaacttttttacattacttaacaaaatatcatggaagtctttccaagagtaaaatagctaataatagctagcatttattgagcacttaccatgtacccatgacctttttttaagccctctacatgcataagtttatttaataaaattattaaagaaatttggtaactaaatttactgtttaaccacataattttttgaggtaaactgcttttactctccttttgcagatgaggaaagtgaggcccaaagaagatttatgttcaggaccatttagtctgtaagtggagaagccggggtttggaaccagatggtctggctttggattttaactcttttactgtactgtttctcatactgcagcaatgatcagttcaaagatatataaggaatttaaagaacagcatgtagctccctgctttctaagctgaggatggctttctaatggcagattttggccaggagcttcattgagattatatccctcaacccagagatacacatgaattattgtaccataatttatgtgttcacactattttatgcagtctgagcccaactgggagatagattgagttctgttttttctggttcttaaaggagtagtcgtaggagatgctgcttcctgagcccctcacccactgaagcaacaatatgtgatggttaagagaatgggctctgcagtccaatgtggggttggggggttggaatcctgcctctgccacttgctagctctgtgaccttgggcaaattacctaacctctctgcctcaatttccttacctgtaaaaaggaaaaaataacagtgttgttgtgaagattgacttaattacatacgtaaagcatttagaatagctcctggcacatgtgttattaaaccagtaccctatgtcctagttatagtgtacttagttttccacctcttactctgttaaatatccacaaccttaagaagtagattatcatcaccccattttaaggtgaggaaaccatcttgaagagagcatcttggaaataagtgtcttcgtcaagatatgaatcagtctgttgacccgggcctctgaggctggcattgtttgcactgtactttccaactataaatcctctattggccacaaaacatcaggaaggcacattattaatatcagtttttgagtttgcaccattcatgtgtatttaaatttatgaggaagagtttatttctgtggaaaatatctggaaaatggcaccactcagaagaaataatttagattttaaattcataaagagtagattttctaagaggttggacttaatgtgtttctgtactgatgtgcgcatctgaacaattttaaggtgcagagatatttctaatggaattcaaagctacggtctcctttataacaaaatcatagttgaaggtggtattacagttttaaataattgtaatatatctagtttttaagagtcaatactgatgactaaattgttaagttttaggactgaatttgtaaaataggactaatgttaagtgacttagttttatcttcttaacccaacacttagttttatcttcttaacccaacagtgtggtaactctaactttgtgagattttagcaaagacttcagttagctctatttgtgaaaaattctgtgcaatatttagaagcccagatggtgtaaagttaccatgtccctctataatggaaagctattattttctgtcgactgaaattgttttagaattctgagtaggtaggcaattgtaccttctcaagtttgactttcaagtgaccttgaaaagaacacttaaagtactgtactttgtgagggaaatcttgtaatcagaatactgtgtttctgcagagctctctttcagtttgtagttgcagagatttgggggtgaagaggacaagacaaatgggaattgagagtaattcttttctgtaaaggattgactcttcttttgctacttttccattgctcttttcctttctccacctctacctgccagaatgaacatgttaatttgttatcagttatttgagtattcattgattatgccatcctttaagcttagtgggagggaggggatacagaaatgtaaaatgtgtggtacttgagagtgtggttgggaaagatgaaacaaaccaataagtatatggagggcttagagattgagctttgtgggctggagtagttggagaaggttatgtgatggggatggcggttgtgcactgttttgtaaaagcattagttttgaaatacgtgcaagaaggaagcacaggtggaggcacagaggctgaagtgagtgtgccacaagtgggactcggttcatattgtaaacatttactgagcacctgctatgtttcaggtactgttggctgcaaagatgcagacattccctgccctctagaagttcataaactagtcgggaagacatctaaccataatactatagaatgattaattgtaatactggatgatatcattgttaaaaacctgatcagtggcatttgtagtgtatggcatcatttttagttatgtttcagtaaattatggtttaagttttagaagggactccgaaatttctcaagaaatttatgtatatttaatatacatacttaaaaacttgtatgagttatctgttgcttcataacaaattactccgaaatttagcagctttaacagccagcttagaacagatgagtcaggaatctgagcacagcttagctgggtgctctggctcagggtgtctgactaggctgtcaaggtgttggacagggctgcagtcatctcagggtttgaatgaggtaaaatctagttctaaactcacttgtatggcttttggcaggcctcagatcctgctgacctcagacgtcagttccttgccacacggacctctcatagagttgcttacaacgtgatggcttgttttccccaggaggagggatttaagagggcaacaagtaaaaaaacaaccttaaatggaagccacagcctttttataacctaattttggaagtgaaatcccttcacttctgctatattctgtttgttggaagctagtcaataaatctagcccatactcaaggaacagaataacccaagagcgtgtccaccagaaggcagaaataactgagagccatcctagagactgcttacctaaagttctacaaggtattgttgtgtattgagaacctcttcgtctttggggtagaaggaaaaagatgagctagccaacgaactttactgatggaaaaaacagatgtgattaaccagaaaaaacaagatgtttttgctaaaggtctataaagttagtttcaatattgtgttgatatttacgatagagaagtataaacaagaacaaagctattgtttgtggccaagcagagaccaattttacaagtatgcctcaacttaattagtatataagttccagtgagaattgtatgctctgaatggactcattttaagtggattataagaacacaatcttctaaataaacagtggaaatcattttgattatattctattttcagttggatgtgcatgcacgatagagatttatgtgtacaaagttgaaaggttgaatagtgatagaatgaaaagagcacagagttgactgggcatggtggctcacgcctataatcccagcactttggaagtccgaggcgggcagatgacttgaagtcaggagttcaagaccagcctggccaacatggtgaaacaccatctctactaaaaatacaaaaattagctaggcatccgcctgtaatcccagctactcagaaggctgaggcaggagaatcgcttgaacccgggaggctgagatagcattgagctgagattgcgccactgtactccagcctgggtgacagagcgagactccgtttcaaaaaaaaaaaaaaaaaaaaaggaaaagagcacagagtcttgaaatcagatttgtttcctggcttcacaaccaattagaaatgtgaccttgggcaaacctgttgatctctctgagcactagttcctgtctataatacagaaagcaaaagagaaaacacttggacatgaggaatgatagatttaagctctgcatgattttacccagaaaagaccagagttccctttcttattttatacctgaagtgtatggcattggtactttgcaacccatagtgacatatagggaagacagtgtactaatacttaaaaagtacttactacttcaaaagtagtaaggtaaagcttttactaaaagtattataagattttctattacagtataaagacattgattggaatctatgttgagaagtactttgaacaaggaagtttattagatggctatatacgtgttacctaccgctaatgaacaaaactatgtctcttatttatggattactttatacttttgctttgatgtatttcaggtttgttccctgacaatcttaaatgaatgaaatgccttttacaagatattttaattatttaatgttcaaggtttgctcataaaattcactcatgaatttgatccatcttggaatttgggtagctgtatcttggaatttagaaagcttattttgccaaggttaaagacacatctgtgacacagcctcaggaggacctgacgacatgtgtccaaggtggttggggcacagcttggttttatacattttagggagacatgagacatcagtcagtatgtgtaagatgtacattaattggttcagtctggaaaggcgggacaacttgaagtggaagggaaaggggggcaggggcttccaggacccaggtagatgagttgaaaggttgcattcttttgggtctttgatcagcctttcactgaatacgcaatttacatgtgagagggaagtagaggaatagccacttagaccttagtctggttcattgaatctgcatttttacgtaaataatagggcataggaagcaatcagatgtgcatttgtctcaggtaagcagagggataactttgagttctgtcctttgtcccacacgttggaaaataagctatcagcttacactgcaagagtgaaatccaacagaactgttttagggtaaaaaccttgaggcccacaaggaattttggacaaatgtagctttttaatctttgtagctattttatttaggaataaaatgggaggctggtttgcctgatgcagttcccagcttgacttttccctttggcttagtgatttcagggtcccaagacttacttgcctttcacatactctaaccaatcatattaatagatagaattttaggttacacattacttgaactaaaacatgaatcactgcttacttttttctcctaaggtaactatggtaacagtgctagaaaactaagtttgttctcatccagttgtgaggaataatcatgtccactatacaatggcttactattatttgattaatctataatatgaacgtgtgttcctgcactgactttgtaatggagtccttcttggttgcatttgatgctttcaaattgaaatgggcttgtgatggtattatatttatgcaaaacagatatggttctgttacctttttcttttgcttttgaaattaacattgaattagcttaacatcttcataaaaaatgctttgcaaccttcagcaaggcagttttagctatatttgagctgaaatacaataatatgcttaaattcactgcttagtttagggtatgtattgataaagagtcgtaagtcccctttcttggaaaaactggtcgggtaacttttcttatatcgcaagtctcctagcatgtaattggtacatcattgaacagaagagcattcatggaagcttttagattgtgtgaaatcatatactgttagttaagttttttgtttcataggacttcaaaatggggttttggttttcattgtaaacattttacaaagtttgttggtattaatagggcagggaacaattcactgtctaatctatagacaggagagccaaattcgcagagagaataactgacttacagttttaaagaatggatatataatagacacattttggtgttctttctgtataaggagaaaagacacttaaggcactattgtcttacttacaaataccttaacaagaacacaaattggaaaggtgcctattactgttttcttctgaccttgttttttccccccaaccagttgattatgaaattagctcactgcttactgtgtttttataaagatatctgtctctagatcatttaagaatatgtgttcaacctttattaagagcagcggtacattttgttataggttttagaagcctgtcatttataccaaatagccctgtgtctagataataatgatgatgatgattaatattagcttatgtgtgtcttctatgccaagcagtgtgctaaatactttatgacttatctcttgggataagtacattataccttatctcttgggaaacttaggaggtatgcttcattgttacggtaatttatcagagaggtatggctcagagaggttaaggaatttacccaaagcagagttctattagaataggtttattgtcccttggattctgttttacttatagtgattatctcagaaagctagaagtaaaatcagtgtctttcttagttggtacagtctttatccttctcatcctgttgctaatacccatttaaggacagtgggaagaacaaaatagttcaaggtgcccttccttaccaagcacatgagtagaaaagtggcaaaagaccattgccagactgaattacctcctgtgtctgtgtgtgtgtgtaacatcataacatgtaatatgacatgtaacatcatctgtcttagtatatattatatgcttctctacaacttagaaatcatccttgatttcttttttgcccacatttcaatccatctttgagttctgaaggttctgtctccagaacacatccctaattcatctgcctgtttctgcttccactgttagaactgtagtttaacactggtcatcttgcctgaactattgtagtagcctcctgatttcttccagcttctacaattgcctacctatagtctactcacagagtagccacagtaatctttcttaaagcataaaagagaacatgctactttcctacctacaagaaacacatcaatagattttcattgcagtttagaggaaatccgacttcctacgctgtagccttgcttactgtgcttcaaatatactggccttctctctgtttttcatcgttaacacattaatatccatcataagtctttgtatctgctgtttcctttacctgggctgctctggtcattgattttcttgcggctgactccgtatcatttaggtttcacttcagatgtcaccgtttcagtggaggttttctcactgatctagatgctccctaccttaatactctctcatattaccatgttttattttctttttagttatcactctgttaagttgttgctcatttgtttagtatttatttctatctccatcagaatatgaacttcacttcttgagaacatggcctcccctgtgcctaggaaaacgtagtagcacatagtaggagctcaattagtatttattggatgaatataaatttcttttttctttttgagatggggtctctgtcgcccaggctggagtgcagtggcacgatctcagctcagtgtaaccttgcctcccgggttcaagggattcttctgcctcagcctcttgagtagctgggattacaggcgcatgccaccacgccggctaagttttgtattttcagtagagacgggggtttcgccatgttggccagactggtctcaaactcctgacctcaagtgatccacccacctcagccacccaaagtgctgtgattacaggcatgagccactgcagccagactaaattttcatttaacactatattttgaatattttaccacagtcttaaatattcagaactgtggttgtgaactcttgatccacagtccagatctggcctaaagacacattttatttggcttattacatagtgctgttgtttgaggtataacttacagtcaagtgcacagatcttaagtgtacaacttgatgaactgatcttgtgtgtaccagtataaccacatctcagatcaagatgtaaaaagttttggcaccccagactcactcatttccttctctagccactcccctttcccacaggataacttaatacatagagttttttttttttttaattagctactagcattttaaaattgggagacttcacataaaaattcagagttccagtatctcataaaaacatcaaagatcaacacaaccgctttccccttgaccacaatttattgtagccgagaagcagctgtccacagtattgacatgtgttccccaggctgcctgcagtcttcacccttcctcctcttccccctgaccttgaaatcaattgccagttgccacttacaatttcatttgaattgtttttcttatgatggagaaatatttatctcttccattgtctctataaaaaagtgaaaacataaatgaaaacagaaaaggtgtcttatacttagtccataccattcatttgtagttttggctgtttgtttgccatcctaattccacacagttacgtttaaatgctgtataaatatattgtttatttactcattcttctatggaaacataaacacattatttttgttcttttgatattgtaaataacattttagattatctttgtacacagcattttattaggataatatttttgaagtagattttctggatcaaaatatattttaagacttgaaacatattgtcagctttcttggtagtagtgtaaattgctataatctggagggagtatatggaagtttcatttctctacatctttgccaacactgggaattgtaatttacaagttttgccaatatagttggtaaaaacaaacaaaaatgaaaatgctggccaagaagaagtttttcatcatcttatctatataattgtattttattttagaggatataatatagaaatattacttagtacaatgctataccttagatgtatgttgagtcaaatcgtgtaccatgtatcttgtatataaagtaatatgaatacctcagtagaacttgggaagcctttaaccttgatccttacatattatttatatttctatgtatatacacacaccatgttctatatctgtgcatgggaataggtattgcaaaatccttctgttttgaagcacatacaactaattcttaagcattgggtttatattggctttcatattttaaattagatgctattattctataatctgctttttaaggagatgcctacatagaagagtgacagcagctagactaaatgtttaactgctgaactagttcctcaggtatcctggctctagagattgctatgggagattggatgactgttacagatccaggtctgtcttcaggtaattaagtctaaataattgtaaacaaaagcagaaactgtaaaggtgaatttttcaatgaaaatataaaataattactgcagatgttgaagatgtgactaaagagagacaaatcgttgtaaaatacttattttcatgtctactgagaacaccactgtatttgtatctttttggaaaaaaaagtatatcattttcataaagaggctttgccctaatttgaaaataccttaaaatatgtatgtatatattatatctatgtttatatgtatatatgtaattcaaagtctttagtaatggcgattatgttagctttacatacgtttttctaaattatttatatagatgccttttattctttcagaaagcaaaactatctctcaatatacctcagaaacaaagatgtctccatcaagtttatactcacagcaagtgctatgttcttcaatacctttatcgaaaaatgtgcacagttttttcagtgccttctgcacagaagataatattgaacagagtatctcatatcttgatcaggtaacatgtttttgtaaaaaacagtagcataaatcatgttatataatagaatgtatcaaaattatgagaaaaacatttgtcaaacacaagtttgttgtttatgtagtgcccctgagacttagattttcagagaaccttggtgattatctcatctagagatagcaagtctaacttttttgtgtggagcaccttggcctcctcattgtcccaggggctcctccactgagagtccagccatcactttatggatgcagaaacccaagtgccttgctccatgtcacagatttatagcagagactaaaagagccccgtcctcttaactctttgtcctttgggatattgaccattttcttaactatttcaagatagttttctatttttctaagaaaagatttctatcttttgattttttttttactaagttgcccagtaaccaaccttttaaaataattcacatttatttttaatttttgacaaaaattatatatatttgtcatgttcaacatgatgtttcataatacacattgtgaaatggctcagtgtgcatacctcccatacttatatcattttttgtggtgagaatttacttgctcagcaatttcaggaatatagtacgtagttattagctgaggtcaccgtgttgtacaatagatctattaaacttattcttcctatctaactgaaagtttgtatcctctgaccagtatctcctcaactgtaaccaactttaagaaaacattttctcctaccaggaattgactacttttggttttccttcattatatgaagaatccaaaggtaaagagacaaagagagagttaaatatagtagctgtactaaattgtatgaatgagctgcttgtgcttcagcggaagaaccttctagctcaggaaaatgtggagacacagaatttgaagctgggaagtgatatggaccatctacagagctgctactcaaaacttaaggtagaaattgcagatccatattttaatgccataattatataattgagtactataaatttttactgactttattaaatatttcagggttttcttaagctttagggttttctttttaaacaggtaagtaaaagtgaacttataatttacacacatctgcttcctaatacctacagtatattgaaggcattaattttttgagctgtttaatgacttgccgaatctgtaaaaagttagattaggaaatatttatgctctgggaaaataaaataacaattctgtcaccccatccaatcttggttaagaaagtatatgcttcatttaaaagtcttattgtaagaggctgcacaggttaattccaagaaaaatattattgaggcatctgtgatgccaaatgagctaaggctcaataattaaatcagactagataacttcccttagaagccctgggtctctggaaaagactatagaaaaatgctttagtaaacttgcttttctcttaaaaaaaaaaaggaagtatttttcacaggaccattgaacctactaactttaaaatgtagaatatttgatgctggtttctattttgatttctttctttttcttccttttatgttttcatttttatttttaaaatgtttatccaaggagaagggaacaaggtgttcaaaatcgtggggtggttgggacttatagttgtatattattaagggtataatataaatcaatccaagtcaaattttttcctaaatatacaattctatattgggttttgttatttgtgaaaatcaaagcctttgcatttgcatactgtcagatgatcagctttcttttagtttttcatctgttggtccatgcccgtttacttttccttatttttctttgtgtacatcctcccccaccccacgccatctaagaaaacaataaaaaaaacccactcagaatcttgaatctttgagctctgtgagggaataataggacctgtctatagaatatttaaaaaccccctagcaggaaatgtgctgtaatgatgtggcatagagttggcctacatgggaacactagaaacacttggggattggtttagagacatctttgctctttacgagcacctgtgcctaccatcctgtcattgataatgctgtcttatgttgtcttcttggttcatacacaatgataaaagtgtgttttctcttaataatgtttttaggcttttgtgcatcttatattcctaagggataaagatgatccagctatgtgtcttggctgactggggaactgtggtagattggagagggtatttggtgccccctaggcttgtgaaaaggttatgagttatggatgctactttaatccagatcagagagacctatggaaggtcttattaagtactgggctgatgcagagttgtaacccttggccacatgtcttataagtagctagtaaatcattatgatatgttggtgatctgaggctattgagcctttacttcaaggagtggtcccatttattaggactacccagagcagagactgtttcttcaggatgtcttctaatatgggatttgacctgggccagaatcttgttattttgggtcaactatggacagaaatgtgtattcagtggggaaagttgccaatctatctggaaaagtttctagatctagcatatgattaatccaacttgttgaacaaaatttattgagtatatgctaggcactgagtttcaaagatgagtgaaaccccagtcctaggtcacgaggagattgcagtccagggaagggagacatattgaaacataactgtttgcttcattaattgttcttggggtaggacgcaagggaaggcttcatggagaggtaacacctgatctgagattggaagaatgagtagaaatttgctagtgtttggaaatgtcattctaggcagagtatatgacttgtgtaaatgcgtagcagcataagagatcactgcactttagaggaaccacaaatatctctgttggggctgcgatgggtatgtgatggtatgaagagtggtatgaggtaaggctggagcctcatctcctgatggtgtaaaaggaattgtacaaaaacagggaagcactgaggagttgtaaacaggaggaagacaatgtgtaaatattctggcagtggggtggagaaattataggggaattgcagacttgtatttgggatggagttagggggctcagaaagccctggtgataaagatgcctgttagcgaccctttgctgaggttttggacttgaactaaggtagtgctaatgggaatagtaagtaagattgagatctgacgaacacttaagaagtagaatgggtaggattttatgaaaaattgaatttggagactaggggtcatggattcaagaccccattcaggtttctgccttgagttactgaggatggcgatgtgattcactaagaaaggaaggaggggtgtgtgcagatgttcaggggtggtgctgagttcaggtaaagtgttgataatcatgctgagtgaatttctgatttgacatatatgctacatatcacctggcctagtgcctgtaagttatgtcatgccaactgatctaccctagtagtaagttttacacattcaaaaaaaaaggttgccaaaaactgacaaccttagagttatccaggttatactcctacattttctgtaccttcttgagatctgttcttacagaaattgtgcaagttattatttatggtcggttaagacataatttgattggcttttgaattttataaaaatattagtacaattttaaaaatattccatatgggtggcctcatgcagaactcggcacagttcctcagatgcgataagttgaaaaggagcatcttgtttcatactaattctggctttgctgccattccgctctgggaagtaccttcagagactttaccacttgcagggagaagtggtgtcacacagaagtcccatttctgtgacttgatgtgttgccactttgcttggtcacccatctttttcttcagacttagctccaaatcacttttgcttctttttcaaagccaagtatactctcgaaggatgatgacattgctgtacttgaggagatcttcaaaagtgtggtatagaagtgttaaaaagtattaaaaataaactttaaaaatattcaggggcagcatcatggagtgatgctctttccagggatccattttgaagcacttttgtatatgtgtacaaaatttgatatgtagattaaaatttgatgtgtaagtttaaatgttattttatagtgtgctttgtaataattcctttaaataaacatttcatgtgccactaacatttgattttgactaataaacactaggatgtataacttcttgttactgatattttaaggattcagttattctaaatcctttattaattttaagcaaaattgcttataaatgttttaggaacaactggaaacctccaggagggaaatgattgggcttcaggaaagagacagacagttacaatgtaagaacaggaatttgcatcagctactaaagaatgagaaagatgaggtgagttgtcagttattgcagatgaagtttaagtgaatttttgttttctttgtaatatgagatgaccataagagccactttacttgaaaaaagaaagaaccatttattcatctttccccaaattgatatggtggacctttgtgtaatagtatttaactggaagctcaggaaccctctccactacagaccccgcccccagtggatccatttggcttagatattagttcatagctggtaacagccagtgtcctggactgcccttcctggactcatgttcactgtcactttttcttaggcacaagagtgctttaaatgcagatcttttattctctgctgtacctgtacgtgatagctgaggtgccccttcttgcatgcactgtcttaaatattgacattgttcgtctagtcaaccagtttcttcattaaatgggcacagaagcagttcacattaaaaatctaatttctgacacaaaagatacaattctgatttctgctttagtggttacttagcagaattctaatttctactttagtggttacttggacctatagcactaatgcatttcaaaatatattttttaatttgtgtagaaagaaactattatgtttttattgctctaaagtatgacccctgaccatgtaataactataaaaatataatacttagtttcagtgttttatatgttgttttaactacaattaaagacttctgaggagtgtatttctttaaagcgccctggagtggtttagatagatttgttttaccatatttgtttatttagtagtatatttagtaagtagtaggtaattagtatttaaactgtaaggttgcttgtacgtgtttccttgagttcacagacaattttgactagatctgttgattatatttaaacggtttgaatacagctcatcttcggtagggattaagttaatcatgttgatccctagcagggactgggaatggctttataaaagaataggacatactctgtcaggagttgcctgagaaactataatagatctaaattttgaacagcagtgtctggcacctagtagatactcagcaaatatttggactggattattctgctgtttggacttactcttactcgagaattgtttttaattagaaaaacgagcctgcttacctgctgccatgtgtcacaggcttaattcactttgtcacagattaataaaaagtataagtgattgtaagtcagtaatacaaggagttcactaaaaatgatcagatgaattctgtttatctcagatgaagttttaatcgttttaatacttccataagaatatctggtttttaaatgatcagagtctatatgtaaggtaaaaggtataggagataatttagaaaattagcgcttctggaaatttcagaattaaaaaaactttatgtgattcatataatatttaaaaaagtggtttctactggttacaaataaggaagaatcatcctaggattttaaaacctatatggggagatgaattttaggatttttctctttcaaatttgtgaatcgttactgggcttataatagcaaatgcctttttcaggtgcaaaaattacaaaatatcattgcaagtcgagctactcagtataatcatgatatgaagagaaaagagcgtgaatataataaactgaaggaacgtctacatcaacttgttatgaacaagaaagataagaaaataggtaaacagctggcaaagatcagctaagagaataaataagctaatactatgcttagaaataattgtaaaaggattgaacacagtaactcacgaaatgttattttcatgctttatacaattgattttcagtggtgtttgtttatataaaaaatgtagacaactggttagtggaaagtaagtcattctgccttgctttatttaattgcatgtattttttaacatgaccagtgtagaattaatccatagaggaaaactaagccagaggacattctaattttccatagcaaagaactgataatattaaaaatcagtgtcagtttctgagtatcaaaagaagtattttagagtaaacctcataaaatttttcatcagaccaaatcgttcatgtcagtttgagttcctttaaataagtttagctgtacatttttggagcagctagtcaaaaggatggactataaaagttaggcgtgtgtgtgtctaaggtatacttttttcctaatagtagtctttttcaaaactttaagccatttcatccaaatatgtggataatttcaagtagatagtgtaaattaaaaagcaaagaaacacgaaagtagagctttacaatacagttttgctggcctggtataaatacgaggcacaagaagtgtgtgtatttatttattgaagagtggtttcctagtgactataggtagtcctctaacatacattataccgtgacacccctaaactgtcttaccttagatttgaaaaacaggcgatgagcgtacgtttcaggctgtcatgtggtagactctgcctgctgtcagcaagcagtttagtgttgactacatcactgtcattctgcagcagagctgttggaggtatctgaatactttattttttaaattgttgaaaaatagaaatgaagattcagtaatgcgccgttaagattggaaatctttaggtatcctgagttaatcttactcatttggagaatcattggtttttaagtttagttagcctcatattcattcatgaaggaaaaaaattaaaaagcaggatgaaatgctgaaagtataaagtgtaacacagagaagtttattaaggatttagttctggaaacagagctcttccattatagcggtctggctgtttcctggtccaatcggaagtgacagtttcataatgattttattaactctaagattataataatttactctttttcctttttacgccaaatgtttccatgtccacctgcagcagaagatattactactatcaggggctttgactcctttgatgaaaatgatgatgttaatgttaacaggacatggcaaactttttctgtatagatccatatagtaaacattttcagctttatgggatctacaacttatttgttgcacctacttatctctgccattgtaacaagaaaagtagccataggcagtatataaacaagtagatgtggctgtgttcccataaagctttatttacaaaatcaggcagccagcctgtgggccattatcaggcaaccctgataatgaaattaataatgataaggtaacatttattaagtacttactgtgcgccagatactgtgttcactctactgtgttgggtgctttaatagttatttctttgtcttctcaacaactctttggtagatacttttgttattcccagtgtccaagaagaaacaggctaagcagttaaataatgtgccgagatctcattgcttacaagtggtggaactagaaactcgaaaattaggctgtttaagcccaaatcctaacctatataccaggttcactttcaccacttacgtgtatagaatgcattagagttttagatgcttaagcatgtatggtaagaattaattttatgtgttcatgtttgtagctatggacattttgaattatgtcgggagagctgatggaaaaagaggctcctggaggactggtaaaactgaagccaggtaaagtccagtttaaattgataaatgtaatcagacttccttctatcctgcattttcatactgacagtttctttctcaggaatgaagatgaaatgtataaaattctcttgaatgattatgaatatcgtcagaaacaaatcctaatggaaaatgcagaacttaagaaggttcttcaacaaatgaaaaaggaaatgatttctcttctttctccccaaaagaagaaacctagagaaagagtagatgatagtacaggaactgtaagtggctctttcctctctaatacagtcttcagattgctaataagaataattaaaatatgtggtaggcattctcaatggggacactattggtattttgaataggacactcaactgctatgctactttcaattactgtgacaactgaaaagactgttcctatgtgttttcagacatttcctgaaaaatgctggagatgattttccggggaattaatacatgtcaagcactgttaagaagtgctttataagcattgtctcattttataatattcctcataacatatgagattatttcatatattataatttgatgatttagatactataaatatccccattttatagataaggaaactaaggcataatatttagtagcccagtatcacacatgacagtgctaggatttgaatccaagtttctcactccagagctcacaatcataaccactatgtcaaatatcctttcagttgttttagtattatgtactctacttttcacagagtgaaacttctgttaactttgggaaacaaatataaatttattgggtgttctttatgttctagtctctggaaaggaaaggctaaaaagattttgactttttccctcaagaagctctttttgggaaagacagacgtggagaagtgattattacatgtgttaggtgctgtaataaggtggtacaatgtgcagaacagaatagttatggcaatcaaggcatcacagagaaagtgacattttcactgcttcttagaaaataagtatttttgaggttaaaaaaaaaaacatggagaaagcattccagagaatgggagtaatatatgcagagatctgaaaaaaaaatcacataatggtgaaaagttcattttacttaattgctttacgtataagttaaaatcgtaggtttcagcaagttcacattagtgataaaaatctgaaaataatgttgatggaaaatgctagttaacagcaagataccagaacttgttttttaaacctgtatttgaggattatttattttgtggtatcacaaatcagtccagctgataagcccatcccagcacttacctttttttctccttaacatttaaaaaaaaaaattacctaaattttttttttttttttttttttaagagacggagtcttgctctgttgccaggctggagcgcagtggcacaatctcgactcgctgcaacctctgcctcccgagttcaagtgattcctctgcctcaacctcctgagtagctgggactataggcagccgccaccatgcccggctaattttttttttttttttttttttgtattttagtagagacggggttttaccatgttagccaggatggtctcaatctcctgacctcgtgatccgcctgcctcagcctcccaaagtgctaggattacaggcgtcagccactgcgtctggcctttttgagagagagttttgctcttgttgcccaggctggagtccagtggcaccatctcacctcactgcaatctctgcctctcgggttcaagcaattctcctgcctcagcctccagagtagctgggattacaggcatgcaccaccacccacggccaattttgtatttttagtagagacggggtttctccatgttggtcaggctggtctcaaattcccgaatatcttttacattctccattttgaggcctgcttgacctcttatatgtagttaacctcttatctcaaactctgtcacttctagtcagttcttagcattcactaatacttcttcaaggttagcatagtgtccattactactgcagcatcttcagtttttggtccaaccttaacgtctcatcatcagatttcagttagcaaaagtatgtggtaagtcagggagatctttcttcagtgattaaaccctcctcacccccattactcagccagtgggtagtatcctgtataattcttcataattcacatgtttaagtggatgaacaatgacctcttaaatatatattctagttttaaaagatccatttttctagctcccttttctctttaatttttgtagggaaagatttttgaagcattatagcaagagaaataagatgtaatgttggaatgcctaggtagcatccacatttcatttattatttgacctacttacttgtaaaacatataccgaaaattcaggtaaaatgagtttgttgttttgttttttggttttttagaggcagggtcttgttgcccaggctggtctcgaactcctgggcttaaacagtcatcccaccttggcctcacaaagtgttgggattacagacatgagccactgtgcccagccgaattttttattttcattttgtggttagagagttctgttcaatctgagaaatgtgcaataattattcatttttctttcttttttttttttttgagatggagtctcactctgtcgccaggctagagtgctgtggtgacatctcagctcactgcaacctctgcctcccgggttcaagtgattctcctgcctcagcctcctgagtagctggaagtacaggcatgcaccaccacgcccaactaatttttgtatttttagtagagacagggtttcaccatgttggacaggatggtttcgatctcttgacctcatgatccacccacctctgcctcccaaagtgctgggattacatacaggcatgagccaccgcgcccggccaataatttttctaacagattggtagtattctaataggctttaaaatgttcagaagagaagctgtgcttccttggaagagttactggcaagtagcttttgagtattggcaggggctagaatcaccatgagccggatcctgggccattcccctgtctgctccgcctcagagaccctgacctctgctagcccattgctgacctcaactactgatagagttcttcagactcagttgctccctcatcctgctgatctccatgtgcgagcagtcgaatcagcccttctttcttttcatcttttatctttcttttttccccagcaagatttttattgttcaaattagtgaagtatatctctctgccttcctgaatattaatgacaaattagaactactttatgtagatgtgggttattatgacatatatcccttttagtattgtttccccatgttctttatcctgctttgattctgtgtgatcatatatcagtaaagtttgctacttctttatgatttcatgtttggcagaatacaaagaaaagtatctcccgttatataaaaaagtatatgaggaaaatagaattaacagttgcttttattaaatacttcagagattatttcacaagtgcatttctttaagcagcctaggattagaaacaagttgatctaatgtcaaatatcagttctgcctcttagttgtaatgctgcttctctaaacctcggttttcccacattgtaatgagctgagggttaaataacgtgaaaacatccaacacattagacaggtagtgatatctccttctcagacagcttcatgactcttgtcattaactgtatttggattcaaattcaggtttagagagagctgaatttaggagtctcattttttttctcaagacatttaaatactgggccatatatgcataagacacagcacagaaatgattttgatgtggcttcctctggtaatcaaactgaagactacttgcctgagcatctaaagccattgtaaggtactagcctttcctcttcatctctctccgcttgtaggttatttccgatgttgaagaagatgccggggaactaagcagagagagtatgtgggacctttcctgtgaaactgtgagagagcagcttacaaacagcatcagaaaacagtggagaattttgaaaagtcatgtagaaaagcttgataaccaaggtaaccactgcttctatgcatgtaaagtgagttgtgacatttggtaaggtgttgatttttagtcacttagaaagccgcattataggctcagagctaaagtactatacttcagtttggtggtttgaaagcaagattttgcatacatttattttttcattttattttattttattttactttttgagacagaaccttgctcggtcacccaggctagagtgtagtggtgccatctcggctcactgtaacctccgcctcccaggttcaagttatttctcctgcctcagcctgctgagcagctaggactataggcgcacatcatagccagctaattttttggtgtgtttttagtagagatggggttttgctgtgttggccaggcttatcttgaactcctggcctcaagtgattcacctgccttggcctccccagagtgtctggattacacgtgtgagccactgtgcacagccgacattttacatacatttagatgtgaggtttgaacctcactgagaaaaatacactttggtctcagagtgaatgtttgaaaagaggacatcatggatccatctgctctggatgcagtatacaatcaaataaagataactgagttgggataaaagactacacattgggtgtagtgtacactgcttgggtgatgggtgcaccaaaatctcagaaatcaccactaaagatcttattcatgtaaccaaacaccacctgttcccccccaaaaagagaaaactgagtctcttttactgactctcaaaaatcaagaaatatttatcgtagtatagataggaacattttgcttatttctagatgcttgcagattactatgttcctagtaattcacttaaaattatttttaaaataatagatgtttaatgcaaaatattaatttggaagtatataaagtagaatatcctggtctctattccatacatataacacttaacagtttggtgcatatttttctatactttcctctatggatttgaaagatacttacttttttttaaattttaaaaattgaatattacctatatttttctttagtgtgcttttttcacttaactattatccttatacatagctctacattgatgaatatattcttaatattttctgcttggtaaagtttgaatgcttttaaactaggaaaatgaagatttctgctcagtaaatgaagcctatttaaagaaaaatttaaattgtcaaaatatgaactcagtgccattgtgttaagtattagtaaagagcaatcagcaaaattattattacagcaccaaaatgaatctacatgagattttgttcatttgagtcaatgctgtttattatcaaatagcaagtatgtttggacttcgtatttgttgaatttaatatttgagagcaagatttgtgacacttcattgatctttgaagcagtgtcaacaaaaacatgattttatttttctcttctctgaatatggccattttgtctgtttttaattaggacataatcatgaataaatatggattacaaattgttggcaatagagctctgtttgtaagcatatcatttagtcttaaaattgcacaaatgtgtaattgtcgtcatgaactcctgtagttgctttgcttaaacattttttataatgttaaaataatataaatttaattttgttatagcttatgaaattttaaaaagtcaaaggacgtaactactttttagaaaacctataaaattctagaaagataaaagttctgagagcccttgttttaaagatatgtgcaaaacactgtaaactaagtggtggctataagacctatgtcaacttactgattttgtcttagtttcaaaggtacacctggaaggttttaatgatgaagatgtaatctcacgacaagaccatgaacaagaaactgaaaaactcgagttagaaattcagcagtgtaaagaaatgattaaaactcagcaacagcttttacaggtgaatatgaattaccttttaaagctgttctccatgaaaagccagaattgtgctgaaccttaccagatttgtattcctttatttcataaggccctggtatttgacagatttctagtctgtgttccctgctaacagatacattgtgtaccactccttaaatagtccatactttgctagttggggtagtaggtttcgggaaatgagaattctcatttgactttttgattcttaataatttctattcctgccctgaagtttgactggccttcccttgctttcatttcaactcgttggagtgtcgcaaggtccctcaggaacttactatgttttaaattttaatagcagcagctcgctactgcatatgatgatgataccacttcactattacgagactgttatttgttggaagaaaaggaacgtctcaaagaagaatggtccctttttaaagagcagaaaaagaattttgagagggagagacgaagctttacagaagccgctattcgcctgggattggaggtattttaaacaattgtagtgcttttgaaaatactgggggtgggtgggcctcagtagaatgcttctaaggtctcctttttttcttgctatttacttattttctaaaatatttactggtgatctcacaaataatttgaaatgagagggaggctgagcatatagaatgggatcatttccccttaccagatttgagaattgaacttaagaaaaaaaaacgctataagcatttattactgctttcagattggctttctcctgctaagtgttttacacaagaaatctcttttgggtatccatcattcatccacggtcagtaggtgtggtgtcagaagacagtgcaaccaagactatatttgctgtttaaaaaggaagtataataaaaaattaagttctcttctccccagtccatcattgttatatatacgctctacagcttgctttttttacttagcaatgtgtcatctacatattcccccttcaaaaattgtagcagtaatgtctgaataaggttaaaaaaaaaaaatcaacaaaactcattaaaaaaagctacaaagtaagaaagtatcctcctttctcatcctcagtttcattccttagaggtaactgctgttaaaaagtatctgttggaaattcttctaggaagtactattttaacttttaatgtatttcaagttttcttgtttatcagttcattgattccctgctatgaaagataaggaattctgtgtccttattgtacctcctacctacacccttcctcattcacatctcatgtcttcataatattgttcctcttgttcgtctgcttgccttttttttgctttaaggaaataataaaaagcttccatttcatgtttgttcaacttcagtcagtatcagttcatccctgcagtgaaagctgaggactttcttgttgttactcttgttctacctctcttgctgtactactttgcaatttttgtgatattatttttcattgttatcacattcatagtttgtcctctaatacaatccaggtataagtactttgtctaaacttgagacttaaaagttggaaaaccaggaaagaaaattgataatactacaattatgtaaatgttattctataaccaaatatgtttggacacagaaaatattctgtattattaagactttgccacccagagagatatatcactatctagtgaattctttttctctgtagcttcctttgtgatttcctgaatcagatttcagctgccatgttgctcatatctcatgttactgtctttcttgggtttctgttcaattcgctatattagtaattgagtaattactaattcttgagtaattttttttttataaatagtgcatgagctgtaaacattctgaattctggaatagtcaaaaatatattcatacttgattggtttggctgtgtatagaatttagattccagttttttttccttcaaaactttgaattattccatttctcctagtgtttagttttactgatgagaagcctgattgtaatatacctgtgttactttgtagataactgtgttttgttttctatctccctctgtggaagctttggtattttcttaaagtttggaaattttaccaggatacttctagagagttcctttcatcctaaagattctgtatttctttaatttagggaaattttcttctttattttttccttctttgacttctctgtgttctggaacttttgttagacacacatttggccttctgaatatatatctacaggttgacttttgttctcaattctgggatattctcttacctttatcttagagatcacgaaactggcctttcagggtcagttttattatttgctttagccactgagtctttgcttcagaatttatctttaaatttttctaatgtccttaatttttgcttttctttatatagcatgatggtattttacagatgtttattaatctgataatatttgttacatttttaaaaaagatttctttcatctgttgaattatctcttatccatggtcagttttctatttatcttgaccttttttctatattagttttctcaatgtttggtgatgcgtgattctgtatcaatatttatgaatgaaagactgtgtgttgcttgttttcagtagctgacgtggatttcctcagttcacagtgtgaacgtctgtttcatcagtagctatcttcagggaacaacacttgaccagcattgtctcctacctgtttccaagcccttattccccacattactccaagagagtaattactcttgctactttgcatattgctcccagttgccaggtgcctttccctgcaagagaatttttctccgtctggtcactgggacagtgggcatagtgagggatgggagggaggcatgcaagacctgagggctgatggagaatttagtttaggattcatcagctattcagaagggggaggtttgacataatttgcctatgccctcttgtggtttagtggtggtggctaccagtactggtagatggctagaggatgagagaaatgcttgatgaagtcataggtcctgtttttcaagtgactaatttacaatatagattatttttcttttgtttgtaactttataatgttttgtatgttcaaaagttatgctaatattctgttccattttttgcattgtttatttgaacttaaaattgatatgaagacagtgatggttggtttattaggtgaaacagatgaatttctattttttaaacataattttttcgtaagtgaaatttttcttagtttttttgtttttgtttttttttgagatggagtctcactctgttgcccaggctagagtgcagtggcgtgatcttggctcactgcaggctctgcctcctgggttcatgccattctcctgcctcagcctcctgagtagctgggactacaggcacccgccaccacacccggctaattttttttgttttgtatttttagtagagacggggtttcaccatgttagccaggatggtctcgatctcctgacctcgtgatccacccgccttggcctcccgaagtgctgggattacaggcgtgagccaccgtgcccggccgtgttttgctttttgagatggagccttgctttgttgcccaggcaggagtgcaggggtgcgatctcagctcactgcaacccctgcctcctgggttcatgtgattctcctgcctcagcctcctgagtagctgggactacaggcgcacgccaccatgcccggctaaattttgtatttttagtagagatggggtttcaccatgttggccagactggtctcaaactcctgaccttgtgatccgcccaccttgtcctcccaaagtgctgggattacaggcatgagccactgcgcccggctttttttttttttttttttttttttttggagatacggtcttgccgtgtcacctaggctagagtgcagtggtgctatctcggctcacttcagcgtcaacttcccagcctctagccatcctccctcctcagcctccaaagtagctgagactgtagtcctgtgccaccatgcccagctgatgtttgtatttcgtgtagagacagggttttgccgtgttgcctaggctggtttggaactcctcagttcaagtgctccaccaaccctcagcctcccaaaatactgggattacagacgagtgctgaaattatttttagttttttaggttaactcatttgacataagaagtacgaatagatagccagagagcaaacaaagatagctagagcaatcatgtgaaatggcaactgtgtggatgttgaaatattgatcattatttctttggctgtttatggtagagaaaggcatttgaagaagaaagagccagttggttaaagcagcagtttctaaatatgactacctttgaccaccagaactcagaaaatgtgaaacttttcagtgccttctcaggaagtgagtactttataaactctttaatttgaacatgcatataaataaaattatttacatattacaaaatactacatattattaatacaaaactttggaaatcaccaattagagctctctaattataactaaaagtcaacttttttttgtttgtttttgagacggagtcttgctctgtcgcccaggttggagtgcagtgacgtgaccttggctgactgcaacctctgcctcccagcttcacgcgattatcttgtctcagcctcctgagtagctgggattacaggcatgtgccaccacgcctggctaatttttgtatttttagtagagacgggtttttaccatattggccaggctgttcttgaactcctgacctcaggtgatccacccatctcagcctcccaaagtgctgggattaggcatgagccactgcgcctggcctaaaaatcaactttaatattttatttactgtagtgaaagtgaggatgagagggggactgtgcatgcccaaagtaacttttgttgtgagtttgtaataatgcgaagtttttgaaaatttacattgagaatttcttttttcaagatgtagtcttgctctgtcacccaggctggagtgcatctcggctctctgcagcctcagcgtcctgggctcaggcaatcctccttgcctcagcctcctgagtagctgagactataggcacacaccaccatacccagataattttaaaaacttttttgtagagacaagccctcgctatactacccaggctggtctcaaactcctggcttaagcagtcattccgcctcaccttcccaaagtgctaggattacaggtgtgagccaccccacccagcctagaaatatttttaaaactagatccttttggctgggcacggtggctcacgcctgtaatcccagcactttgggaggccgaggcaggtggatcacgaagtcaggagatcgagaccatcctggctaacacagtgaaaccccgtctgtactaaaaatacaaaaaaattagccaggcatggtggcgggcccctgtagtcccagctactcgggaggctgaggaaggagaatggcgtgaacccaggaggtggagcttgcagtgaggcaagatcgcatcactgcactccagcctgggtgacagagcaagactccatctcaaaaaaaaaaaagatccttttaaacatgggtggactatgcaacaaagataagcaagattaatgataattaatttgaatttgttccatctctttcctcactcagaaccgcagatgaatcatcctgatgatttaccttcactatatttaatgcctcaccatatgtactgcctttttctcttacttgttttacaacaggttctgattgggacaatcttatagtgcactcgaggcagccgcaaaagaagcctcacagtgtgtctaatgggtctccagtttgcatgtctaaacttactaaatctcttcctgcttcaccttccacttcagacttttgccagacacgttcctgcatatctgaacataggtatttgtctataggtgatcttttcacgtgtttctaaaaattgctaaagttgcactgctaagggaaaggtggcatgtctgtagtattagcaacaatagagattttggagaggaatttagtagatgatttattcattctacaaatattgagtgtccagtatatatagacactgtgctagatgctggaaatacactagtgaacaggtagatctgttgtcttcttggaggtaaatcatatgatgtgtgtctttttatttcacatttaagatacaatttagaatgtagtcttaattataggagttaatattttaagcactttaattgtattaaatggaaggatattgttttgacagtttttgtagagtacatatcttaacacttttttccggcatgcccattttattgttgttgaagggcaaagaactgagaaaagcctgttcctgttgagtgaaaaagatttgtgcccaaggatgacagtgtaaaaaaacatggctctccaccctgggaaacccatatgttgctcttaattgctacattttggtgttttcctgtatctcaagttattatatcattttctaagataagatcaatactctgcttcagtgccaattccaagattagttttaaacgaagaagaggaagcaggtagaacattcctagtaagacagagaggaatagaaaagatcagaggggtaagttggaaagtatggtggtaatctctttgctcttaattaaaagtaggagataatggccttggaaaacagtcagagctgaagcaaactcggcctgtgttagagactggagtggaactaagtgtcgaagaagccagctggcccttgggccaagaattatgaaatagatggagtttaaaacaagaaaggaagcttttaaaagaaggaggagaacacactataagttgtagttgacttttaagaggtggggggattaggactccaagtaaatgttagaggggatgaaaaagagctaggtaagagcactctagccaagtgtaggaaccctgagggtgggacacacctcatacatttgcaatggtgaccaagacctagaggtgtgagatgaggatggagagatgtaaaagttcaaatatacagagaggataagatcgtgaacccacgtgtacctatgactcaggttcagcaattattaactctgatcaatattgttcatatataatcccactctgcttgctctctccaccccagccccaacacatctgggatttcatttacagaatattttagtgtgcatttgcaggtcaaatattgttctaaggggaatagaaaaaacactagttttaagcaagagagtgaaaaaaagtcttaagttttaaaaagattactgttttataatattgaaaacagattgtaggagtctgtaatataaaccaggaaatccagttaggaggcactattggagtggaaacgaaagacaatggtaattggactagggtcataatatgaaggaagaaatgcttggatttgggatctattttgaagttagaccagtagatgagttgaatatgggaagtgaaagtttatttattttacaatcaaaagataatgtgtaagcttatagtattttcttacatagaatgttattcaaacttctaaatttgaccagtcagaactatctgtatagatatagacacaaattctagccaccattcacaaataatgcattttatatctaagagatagcataacatagttgtctcaattgtttttatatattttaaatatttagctttttacatcatttttagttgtgaaatatttgacataaacatttcttgaagacattgttttatgtttaataaagttcagcatttagtacctaaatcatagggtgttgcaagttaaatgttaatgtatgtaaagcacttaaaaacatttagtgacagactataaaaataaaaatatatgtaaacaaatataaacatgctttttttgtttctgagtgctccactaaacaacatccgtggcatagaaacaattttggagcttaaagaaattcaaggtattcattgttaactagcctctaagaataaaacaaacagaaaaaagttttataactaatagagaagctgtgcagcctgacttggttcttcacattttaaattatttgataaacttggttctcttgctcctgaagcattttggatctcggtttatattaatattgcaacaaaataattaggagtatttgtagctaatttctacaacatcctcattgttccttcactgtagaatggaattttatataaaggctgtgccttagattccaggcaaggagacttgtgcgtaagttacctaaaaaacttagtttgatcatttgtacagggattctgatgaccgaattactataagtattggtaaataaatttatagtaatttggtcatcagaatcccttgtacaaatgattaaactaggcatgcactactactcccagctaattttttgtagagacagggtttcaccatgttactcaggctagtcctgaattcctgggctcaagcagttcggctgcctcagcctcccaaagtgctaggattacaagtgtgagctactgctcccagccgttttttttttccaagtaaaattttaaattatatttttggcctagatttttagaattaaaaggaacttattttttttgaagagtgccacattatgaggttaaagtacaaaagaaggagaggatagtcactaagatctgcctttcttttcccaacagttcaatcaatgtactgaatataactgctgaagaaattaaaccaaatcaggttggaggagaatgtacaaatcaaaaatggagtgtggcatcaagacctggatcacaggaaggttgctatagtggatgctccttgagctacacaaattctcatgtagaaaaagatgacttaccttagacatgtggactggaatttttttcattaatgtgttcatcaagtttcacatctaagttgaaacagggtgtgtcataaagtcagttatctctaataacttaagatggtctgagttgtttgtttggacttccctgtcttcccccaaagagttgaaatcttaaatctatttaaaaggatataaaagctttggatatgtatttttagtaacagaagcatctggttctgtgaataaaggaatgtatagatgtttggatggaaacaaaagcactagactgagtttcctcttataggtattaaaaatagcacttttaggaaactgattattgtaaatgtttaattttgtctcaaatatagttggcattggaagtttagcctttacttgaatgtatactgtagatttttaacaaagcgagttctatatttattatgtttagtgtggtttgaaattacctctttcatatgttttaaataaagtgaaatttatgtatgttttgtacatagatacacatgattatgttaagaggctttaagatttaaaagtttcacacaaccataagtatagtatttcatgccagtaaaatttttttagtggtattctgtttacagatgtattaggaccattgatgcattacatttaagaattctctttaatacatctgggcaataaatattgaaaggtattccatgaagctgagttctttagataatcaacactactaacattacatttttgagatttttatgacattagatttttattttgtatatgtagaatattataatttttaaaaggactattgatgatagaagaataggggcaagacgacaaaagtacctttgaataaaacaatttaagaaattggtttaagatattggatgatagaagatatttaagatatctagatggtgatattttccttacaagatgggtaccagtatagtaatatctgtatactaactagggctttgtattgtcaataattttttaataattttttaatgaggtatttaccactgaagaaatatgataatataaaaccatcaaattttataattgagatgatactctggaaaaacatgtcatttcattttcagaaaactcttaagctctcttcagtctctgtaatgtttctgattgcatgtttcttcatgaaaagtatgttgttgttttgatagtaataataataaatgtaggctcagctctttcccaggattttcatcaaaaagctttaagtgcctaaccctgcttgtctctgtacatagaagcctgcacagatccaacccttgctaggtatcatagtttaggcccatttaccttcccctgtactggcagttcagccgcttacatgcactcaccctgtttgtggctattttaaattcatattattaaaaaacaaaaaaaacccacctatttgtgttgtccattcactatacgtaactatgtaactctttggagttgcatagcagcagccattttttcagggctgataggatatcattaagagtgtcttatgagacattagtggatatactcatagtaaccatatttatagttttaaagagctagctcttgagcattagtcactaccttcagcttgatgcatggtcacttctttactatttaaaatactacacattgtacaaaatatcgaagacactaccatatgctaaaggaagaaatctagctgggatataggatttttgttgtttttgtttttgtttgttttgctatttagcaataacatggtcaaaaaggcaatcagaaattttaaatacagttaatggatacatttggcaacaattttcccccgagggttttccatggtgtactttgcaagaaataagcactctaatttttaaagtaaatctcttattttagcaaatattatatttcatgacaatggagttctagaaagcagcatctgttttttgttgcgtgtttccattttaaagtgagttgagttctcaaattggaaagaaagattccttgagacgtacttttaaaatctaaagtgtgaaagaaacagcagagtaaaagccagactcattgcaccttcaatgtctgcatagatccagaagttgtacattttacctaacaacatcacttttgttgaacattccaactccagaatgatccccaatcaccctaatctcagaatgctggaatgatgtctgttggaaaacccaggactccacacacaaaactcctgggattttgtttcccatctctttctaggtgtttgcaatgtacaaataatacagctgtgctaatctcacatttagccatgatagatgatggttctagagtgtacttccatttgtaagtcctcctgataagtgctttcttgtttatcactatgtaaatctgaaatattttgtacttcatttgtttttatccattctgaattttcaaagcataaaaatgtcaaagaaaaattgagataaacattttgttcaccattaaatgtttgcatctgcagtctatgatgagaaacaatgaaattatgactaaaatttaacaaatagtattttcttatagaagcaatgtattaaatgattagatacacaggacagttcacagcaaattgtttacttacatggcataattgaaatactgttatttgtaaagagttctatactgcctaccttagctaaccagaattgttcatagacttgtgataatatggtgttatgggaaaacacattttgtgcgcatgatgaagagagcaccgtgaatctagtcttgactgcccctggtggaacatttgaaagcccttgggactccaggagagaggtttttgcagcatgtatgctaaatttgtgagttagcaagaccctgctgtgattactatgttgtacagatcttcaaagtatattgcctaatatgagtcatgttatttctagattgaatttaaagtaagtatggattatggaagtctagtaaatatacttttccctatttttgtcctttttcagtcttttggtaagcatttattaagtacctgctgtatgtcaaggcttactactgctttccaatccttggtgatatgaagacagataagcacgctgcctgctattaggaatctgagctgagtggaaggccaactattaaacctacattgtaataaacaatggtggatgctacggacacattcagtctgttcataaaacatggactgatgggtctgctccaggccacatttgttttttaacagtaacgtggctaggcttccatttataagtcttagcattatttcctttgtgaagtactatgtaacagatgattgtttgctagattttgttttctacaatcaaaatgttgacctgcaaagcagtgtaggattttctctcctcaagagcgtgtattattatctagtagaaaaagcattcccaaagacttggtccatgcagataaggataatgaaattgctcactctaatcctttttctaaatacagtgtttttcaagctggatgtaaattagagtgggtggatattgattaaattatttgatttatatgaaatcaaatgactggttgaggtttttttgaacatttacaaataatggattcctgagagctcaggaagtactgtaatgtcagtgacatatgaagctcctgataaagatccacctcattcatatatttgagcttcagaaatacatgtacctagtataatgcttaacagcacataatatttgttgatgagaaatacactgatgaaacaacac

SEQ ID NO: 36311 - DNA, 46791 bp, Homo sapiens; identical to SEQ ID NO: 36310

SEQ ID NO: 36312 - DNA, 13277 bp, Homo sapiens
atccgcagccaactgtgtggcggtccccactttcgcctagcggcaactccctcctccctgcaatccttccttcttattccggtttccagagcacgtctccaggcttcgacgtcaccacgctgggacgtatgtgccgagggccgcggcgtctgacctcatggcgtagagcctagcaacagcgcaggctcccagccgagtccgttatggccgctgccgtcccgaagaggatgagggggccagcacaagcgaaactgctgcccgggtcggccatccaagcccttgtggggttggcgcggccgctggtcttggcgctcctgcttgtgtccgccgctctatccagtggtaaaggggggcggcagtgtgggcttaggaaggctaggagggctcgggcgcagggcaggagacaggccgggccagggaaagggcgcttccaagtgtcaggagcagacggcggtgtctggttgggtcagggtctccgcgggcctgaggacggagggtatggtgtctgaaggggtccaaggtggtagggtctccaaggggcctgagaagcggggtccctgagagatgcaggaacccagggagcaggcagcagggtgtgtagatgggcggggagggaggagtggtgttagcgcctagagatcgttgaagaatgggctgccgcaaggaatggcggtggtggggtctccaaaatttcttggatcggaaagttaggagactctggaagagagggtggcgacaggggctgaggaggtggccggggctgggggtgtggtgtctggaaagggtcctgagtttgggggactcaggaatcttgcaggaccaaggaaaggtgggggttttccagaatgggagaggtcagtggtaaagaccgaggcgggcaggggcagtaatccagtgactggactgaaccaatggaatatttccgagagggaaagtgaaagggaaagagctgtcttagggtactggtgcatatttgaagactgggaggttctggtgtttgataaagattcagagtactggggcgttgggcccctgaaggcttgggaggcagagaggagtttggagacaagggagatcatgattcctcttccctgtgttccgagttaaccaggataaccctgcctcgttttaatgcatctgtaggatttgattgataaaatatttcatttcttgcaaatgttgcatggtgaaatcaagagattgaaggcttttattgagaaattaggaaatctgtaaaccagtgcctgatacttggtgggaaaaatccactattaagaacttgtaaggattaaacggtattttgtttagtagtcccatttttctttcaggccaagacacagtcctgcgtttctccctaaatttgaattttcagctgcaaaacagtgtgacctggtatagtgttttctttcttgccagcagggcctgtccagccctacattcctctgcgacagtactgtgggtacatacttatgtttcctcagcaacatttcagtgttgctaactggacgccctcccagaagtctttgcagtccctgaggaaggactgctgtccatttcctaaggcccttttatcattagtgaaatgtaatgaggatttccctggttgatgcagatattcccgttcctaaagtacttaagtagcttaattgttttggccatttaatcatctaagaaaaataaaacacaaacatttatatttcctgctggaatgcttaagggatatatatctggcaactgtagtttcagaaacagcttttttcccctaagagatggttgaaaattgggcaagaagtgaggcagaatgtggactgttaagtgtcctttagtctctgcttttatttgttagagccctataaatatttttctaactatactgagacattttagagaatctttatcttttaaattaagtctttacatacaccagtttaaaatgtcataaattcagattattctgtcctgaaaagaagctaaatgaaaacgaacatacatgtctttaataggcgagcagctccactgcactacagtgtagcttgggatataagtattttttgtaagcataccttataatttcaaagtagtcactcctgtaataagaaaattagtctagaatgtgttgagttccaaatttcaagtgagtttacaaaggtagaaggttaccacattagatttatttaaatttgttccatattaggttttaaaaactgtcaatgcttggttatatgctcgtcagtctgtaagaatttttgttttatgtttttgttttgatcaagtctaaaaaattaacataagcagtttggatcactgggtgactaattcttggtcatgccatttcaaaaatgcctggttctctacatttgccattatattgtccccaaatgatcacctaaacttaatgtataatgcatttcatttttaaggcattgtttctcaaaccagtgtgtgaatgagttctcggggtcctctgcattcttaagtttaagaaatgctgatatagttttattttagggcagtttttaaaaagggaccagtagaaggggagaattaaatttataaagttttgttttttgttttttttttgagtctgtcgcgaggctggagtgcagtggcgtgatctcggctcattgcaacctccgcctcccggtttcaagtgattcttctgcctcagcctcccgagtatgctgggactacaggcgcgcaccacacctggctagtttttgtatttttagtagagacggggtttcaccgtgttatccaggatggtctcaatctcctgacctcgtgatccgcccgccttggcctcccaaagtgctgggattacaggcctgagccactgtgcccagccttttttgtttgtttgtttgagacagggttttgctctgtcgcccaggctggagtgcagtagcacaaacttggcccattgcaacttccgcctcctgggctcaagcagtcctcccacttcagccccctgaatagctgggaccacaggtgcctgccaccgtgctcagctgatttttgtatttttgtagagatggggttttgccatgttggccaggctggtcttgaattcctgtgcttaagcgatccacttgccctggcctcccaaagtgctagggttacaggcgtgagccaccgtgtccggcctaagctttatttttaaaatgttaagcttcaagtagagaggtaatatcaattaggaaagggaagatttagaagtcttatttatatgctcatagaaggtcaacagttaaatccgtaaagtcagagttgtacctttgttctgaatactcttcatatctgacttaatcaacttctctgatttgaaggagtttgagtaagttgatagcctttgtattacatgtttcaggtcaattatttgttttttcttgtgctgtatttgtgtattacttccaagattttactgcttgactaagacattctgctcctacttggtgctaggtattggagttaaacaatgaatagggtgatactgggggtatccttagaagaatgagtggcgttttgctgagaaccatggcatgggctcttgagggagtgcagtaggtgcatagatgctatgtgggatgtggtgtgggatttgtggtgagagttgaatcgagagcatattcaataaatatttattgagtgcctgctatctattaagtaggtaatggggatagagctgttagggagattagtaagataatgagagtgaggtaatgggggccagatcatgtaggatcttgaaggctattataaaaattttcacttttgtgagaaatggatggccctagagggtcttaagtagaggagtaacatttgatttaagttttgacagaatgactctggctgctgtgttgagtatagacagtagaagttagggtggaagcaggcagattaattaggaggctattgtaataatccatgtgagataatggttacttggatgaggcaggagcagtggagggtgaaaagccctcaaatgctgcatatgtcagaataacagattggatgtgggatgttaaaaaaaatgacaactccaaggtttttagttttagtaactacaaagatgtagttgccattaattgagatggagactaagtagaacaagtttttttgttttttgagtggggcataggaatttatttaaacttattttgagataattatagattcacttggcagttgtaagaaataatatagagatcctgcatatcccctacccagttttcctaatagtaacgtctttcaaaacaatagtgcaatatcacgaccaggatattaacattggtacagtcaaaatacggggcattaccatcaccacaaggatatctcatattgcccttataaagccaccccacttccctcctacctcacccctcctgaactcctggtaaccacaaattatccatttgtataagttggtaattttgagaatcttacataaatggaataatacagtatgtaacttttgggattgactttttttcacttagcataattctctgaagattcacctaggttgttacatgtgtcaatagtttgttcctttttaaattttaacttttattttttcgagagtaagtcttgcactccaggctggagtgcaatggcacgatctcggctcactgcaacctccgcctcccaggttcaagcagttctcctgtctcagcctccagagtagctgggattgtaggtgcacaccaccacacccagctaatttttgtatttttggtagagatggggtttcaccattttggccaggctggtctcgaactcctgaccttgtgatccacctgccttggcctcccaaagtgcccagattacaggtgtgagccaccagtcctggttgtttgttcctttaaattgctgagtaatattctatggtataggtagactacactttatttatctgttgaaggatgcctgattgtttccagtttttggctattatgaataaagctgctatgaatgtgtttgtgcagcactccagcctaagtgacaaagcgagaccctgtctcaaaaagaaaaaaataaaatgagctttctatggacatcatgtagttgagtctgccagtctctgttttttaattgatgtatttaggtcatttacatttactgcactatggatatgttagagctgaagtctgccatttttattttttgtctttagcctgggatatatgaggtaaaaagaaaaacctaaggaagtcaccaccatgttgtttcacatatcctgaggtctctaactgttctacccagttctttccacctttcagagtgttcttgtgttattttatacataatgttcagagcttttagttgtttttagtgggagaaacagggaagagtgtgtttgtcttcctgaaagccagccagaattcattttgaacatattaatgtgaatgtcagacatctaagaggagatgtcaagtaggtggttggatttatgagtctagaattctggtcgttcttggaagttcttttaatttttctcagaaaagttaggaagtgatgtcatcagttgaaaatgaggataacagagaagacatttgaagtttgtggttagaggaaaatgtgattggtgtcctaagagagtagaagggtaaatggactaggaaaatatgattgccaacaattttaattgccaacagctttaaacatacacctgaatctttggcattgaatttaaaatgaaatgaaaacagtggcatggttgtatattttttctagccatgttcagctgctgggtgcagatgtgagtagtcagagagcttgatttattaataactagggatgagtgtagtctcaccaagtgaatgggtcaaagtggacaagggggaagggaattgaagatggatgtaagagagtgattataagcaattataatagctgacacagaattgaatctgaataaagagagaagagagtgtattgggcaagttttgatggtgaccgtaagggaatgaaaaggattagagggttgtaggtgtttatggattgagaataccagggaatgaactggaaggataggaggtcttgccagcaagtagaatgcatgaaattgagattatggaagaattgtgataataaataatgactctgggagtgagtggctgaggtaaagaggagggctagctcatgagaagagaggaggtcaaagattttgaaatcaaggcaggagtacttgtcttagatggagtgaactctagagccaggagctaaagatcattaagaattagggggcatgactttggagttggatgaaagtaagttagtgcattatagcttaagataagagaatcaaagctagaggcatttagggagaagaacgggagaatggtctgaaaagggcaatgaggaggagaactgtgcctccttgagattcagtggttcaaggatgtgggagaaaaaacagctattacttaaacaggctgaaaggaaaatgtgtccttaagggagagtcaggtttcagtaataacaagaaagcaaagggtgaaagaagggatttgctgatgactgtgaattctatactgcgtggtggaaatttctttataattattcccaccctatcagcttgtgtcctttaaaggtacttacccatggaaaaattgttcttttaaaagttaagtttagttagttggctcccacttatttcaattttaaattttattttaaaacatgttttttgtactttggcaggaaaattaaatgtatcagaaaataataatttttaaattcttgaattataactaagttgaagtgataaatgcaaaaattattttcagaaattcctgttagtagttttctgagtaatgtactgagttgtaggtcctgtttatttctcttttcttccagtaaaaaatttcaaggaactcaattattgaaaatgttttaagagttttactgtaatcccagtactttgggaggccaaggtgggaggatttcttgaaccctggaatatgagagcagcctgggcaacatggcaagatgctgtctcaaaaaaaaaaaaaaattgcatatggcattggacaaatatatgaaaaataaaaaaagccaggcagggtagcatgtgcctgtggtcccagctacatggggggcttgaaaccaggaggtcgaggctacagtgagctatgtttgtgctactgcatttcagcctgggcaacagagtgagaccctgtcaaaaaaaaaaaagggaaaaagagagttttactaatttattggttttttttttttttttttgagatgtggtcttgctctgtcggccaggctagagtgcagtggcgccatctcggctcactgcaacctccacctcccaggttcacgccattgtcctgcctcagcctcccgagtagctgggactacaggtgcctgccaccatgcctggctaattttttgtattttttagtagagaccgggtttcatcatgttagccaggatggtctcgagctcctgacctcatgttcagcctgcctcggcctcccaaagtgctgggattacaggcgtgagccacagggcctggcctttttttttttttttttttttttttttttttactaactgactacattatttttctgagatcctctgttcattctaattgacaccagctatttctttttttttctacacaaaatggatgtcaactgtggtacacaaaccagagtgtattcacatgaagaaagggttgtctgttggattgttaacttgtgtgaatgcacatgtttgtgaaagcactagaatgacttggtttaatcttacccctataaaatattttactttaatgtgatagactttaaaatattgtctgaatatgtttagatctacatgacagaggttttttttttttatttttttagtgtagtagaggtccttgaagttcttcaacagatactacattagattataaattagagatggttaaatttcggcagggattcctctggaatcttcctctattcattcttcttggtaaaagaatagtaagaattcttatgtaaagaattttacctttagtaaactatgctgagtaggtagcagcacagggaaataagaatgtgtgtgtatttggtgtcatttgctatacctagatgccttccctcatcttcaaaatagtctagttgtcacttagctctcaggttcccgtttcggatgcttctcctttagaagttttttcttctttgtaaggatccttctttttttttgaatttaggagagggagtcctctagttcaagtatcacttagaattactatctacagcatgcctatagcttcccctgaatttgttatgttgtgttgaaagtatttaggtccaaactccatatcttttttgggacctacttgagtgagaatcagccactttttggtctgttctagggatcaggtaaagtctggacaaggtaactgaaatccacaccctttatgaaatgaaaacagaggggatgggtgagggctgtatgtgaactttgccatcgtgacttaaagtcagccctttttcttttcttttggtggcaggctgtatgatgcagtaggtcttttatgctgcttaaattgttagtatctagcaaagcaattattatctgaagaataactgactaagaagaaatgtaactgaatgctggctattgagacttaataactagttttcgagaaagttataggaatgtagcagagagaaatgcttagtgtaaaatttgggtaaatatgcttttagcttggtggagataaagttggagatttcagtttgatattctttgtttgtttcagttgtatcacggactgattcaccgagcccaaccgtactcaactcacatatttctaccccaaatgtgaatgctttaacacatgaaaaccaaaccaaaccttctatttcccaaatcagcaccaccctccctcccacgacgagtaccaagaaaagtggaggagcatctgtggtccctcatccctcgcctactcctctgtctcaagaggaagctgataacaatgaagatcctagtatagaggaggaggatcttctcatgctgaacagttctccatccacagccaaagacactctagacaatggcgattatggagaaccagactatgactggaccacgggccccagggacgacgacgagtctgatgacaccttggaagaaaacaggggttacatggaaattgaacagtcagtgaaatcttttaagatgccatcctcaaatatagaagaggaagacagccatttcttttttcatcttattatttttgctttttgcattgctgttgtttacattacatatcacaacaaaaggaaggtaggtttgggatttttttagccctttattatttcagtcataatgcttttgatgattcatggttcttttttttttttttttttttttttgcaaaaaaaagtgtagtgggtttcactctgtcaaccaagctggagtacagtggcacaatcacagctcactggagcctcgacctcctaggcttaagtgattctcttgcctcagcctgtcgagttggtgggactacagattcacactaccacacctggctaatttttaaaaattattaaattaaaattttaaaaattattgtttgtagagacgaggtgtcgctattttgcccaggctgttcttgaactcccaggctcaagcagtcctcccgcctcggcctcccaaagtgttgggattacagacatgagccaccatgcccagccctctttcctttttttcagtgaagtttaaattcatagtaaaatattgagatgtctaatcagcatgtaaatctattgtgtattttaacacactgcagacagaatgcttgaatgtatgtacttctaaaaaaagaaatagtcctatttcttaatgagtaataccaaagcccagtgattttttttttaagagtttatgtcttaatttggcatcattacttcagtaggaatacttgtggagaaaatgttaatttaatatttgtcttttaatttattaacattgaacttaatcttttgattttttttctggttataaagtgttacacatttattttagggaattcagaaaacagaagagtttagaaaagaaaatttaaactacttctcagcattaacgttttggtgtatttctggtctataaatgtgcatataatttatacatataggtgtatgtaatgatttttaaggaattttatctcacagagttttttttttttttttttttttttttttgagacagagcttcactttgtctcccaggctggagagcagtggtgcgatctcggctcactgcaacctccacctcccaggttcaagcgattttcatggctcagcctcttgagtaactgggactacaggcgcaggccaccacgcctggctaattttcgtatttttagtagagacggggttttgccatgttggccaggctggtctcaaactcctggcctcaagtgatccacccacttcagcctcccaaaacgctgggattacaggcatgagccactgcacccagctatctcatagagttttatgtcctgaccaatcatgagcattttccatatccttaatattctttaaaaacattatttttttttgagacaggatcttgctatgttgtccacgctggtgaactcctggcctcaagtaatcctcccacttcagcctcccaagtaattgagattataggcgtgagccactgtgcctggctaaaaacatactagattcatggtttacaatttttggttcagaaataatattgtgatgaacatttctgtgctgttaccagtttgctggattacatgaggcacaagagacatctgtaggacaggatacatcacatttagtgtgagggtacatgttggcactctacagtcccaaagctgaatagttaagccttttaaaatccttaaagggagatcaaacacacagttcctttttaatacttactggtcaggaagtctcagttcttgactttattgtaacttgctttgtaacactgtaagccaccttccccttcggggccttgatttccttacctgacaaatagtgaaactggacctgataatttcaaaatgccttcctgctttgagaatcagtgactctaataatagttcaaaaaaaagcaaaccaaccaactcttctggttatttgtatttagtgctatattgctagctttgtaagtgtttatgggtagacagaaccttgagtgctgctgatattatatcccactgtttagtgtttggccatctctattatgaacatcaaagggacttgttaaacaagtaggttcctgggctctacctcaagtactaactcagtctctgaagatagagcctaggaatctgagtctttaacaaacattcctatatatattgaaatttgagaagcactgtttagccttctttacaagatggaaagcaaaatagcttttgtttttttttttttttgagacagggtcttgctttgtcacccaggctgaagtgttgtggtgctgtcatggcttactgtgatctctgcctcctgggctcgagtgatcctccaccttagcctcctgagtagctgggactacaggcaagcgcctccatgcctggctaattttgtattttttgtagagatggtgtttcaccatgttgcttaggctggtctcggactcctgggctcaagtgatctgcctgcctcggcctaaaatagcttttttgttgttgatattttgtgttttatatttagaaacctagaagagagatattttacttgttataaaaatgtttaccatattctctgttttctcttttgcctatttaatgacttctgttttccagatttttcttctggttcaaagcaggaaatggcgtgatggcctttgttccaaaacagtggaataccatcgcctagatcagaatgttaatgaggcaatgccttctttgaagattaccaatgattatattttttaaagcactgtgatttgaatttgcttatgtaattttatttgcttgactttttatatgatattgtgcaaatgtttgccataggcaattggtacttaaatgagaggtgagtctctcttttgccttggtgctttggaaattaaatgtcacaaacgagtatataattttttatctgtacttttagagctgagtttaatcaggtgtccaaaatgtgagttaaacattaccttatatttacactgttagtttttattgttttagatttattatgcttcttctggaagtattagtgatgctacttttaaaagatcccaaacttgtaactaaattctgacatatctgttactgctgactcacattcattctccgccattcaaatactattttttatccacatttttttttgttcccaaactgtaatgtacaaggatatgtgtgataatgctttggatttgagtaatatttttttttcttccaagaaaactgctttggatatttttagataatttaaacataatttaggataatgatattgctcaatctgaccacaattttaggtaaaacattaaatgtgtcaagaaatcttggcaacagagactctgcagcttgcagtggacatagataaaatgttacagagatactatttttttggttggaattactatattaaatttagaagcagaaactggtaaaatgttaaatacatgtacaattgcttttagttagcaattgattgtagcatgggttcctccaaggtttcaagcaatgggcagagtttaaaattatatcagattcgtttacttcgtttattattttacagtaaatttgaataaatcttaggggtcattatcacttaaataatactgtacctaggtctttcaaattaaaattatacctgaatgaagttgtttgtatacataaaggatatttgtgtacaattaccttttttcccccacacttgttttctttgtttttgttttttatggcaactggaaagtatttactatgggattcatttatgtctgtctttctatcataaagaattgatcaatatgtaaatatgtgatttgaaccatggttgacttacaagtgtcactacagctttttagaaaacatagccctaatatatgttaagcaggacccgggtgagccagtgggcttgcgctttatgtagagctggaagaaggccgtccatcctgtctcttgggcggacagtgtactttcctaatagggaagggaagcacaatggaaatacccctgaaccgttttattgcagtaatttttttcatatctgaaactattatttaatattttgaataagattttaaaaaataaatggcaaagatataaatct

SEQ ID NO: 36313 - DNA, 5092 bp, Homo sapiens
agcgagcccagctccggtcccagccccggccgtcccggcgtcgcttcggagcgcggcggcagctgactgcgccttcacgatccgctgggacccgcgagccccgccgccgttatgaacatccgcaatgcgagggtgagcgcccggggcgggaggctgtccgcgccgcgtgggcgccgggccgggtggctgccgcgcatgctcccgagggccccggccgagcccggcccggtggccctgagtgtgcctgcggccgctggacctatggggctggcccagcccgccgaagaggccggggcgcggggccggggctgcgattccctcctgtttgcgtgatgtcgggcctccgttgggtgggctccggggacctccggggcgcccactcctgttcctgtgctccgggcgttgtgcaaagtcagatcgtcacagtgcctgcccagccccgagggagcggggccgagcagaccgacggggagcaggcttctcacccgtggtcaccgccgccttagactgagcgcgttccactgccctccttccctgcagccagaggacctaatgaacatgcagcactgcaacctcctctgcctgcccgagaactaccagatgaaatactacttctaccatggcctttcctggccccaggtgggcagcttctgaatttgggcatgggggaaagcaggccgaggaaaatcccatctggccatcttggagggagtggacaagtctgtcagagcccagggggctgtatggtcggtggcgtcctgggtgttttcagctggcagacaggggcaaaggaaaagaaggcgcccgaagggagcagagaataggggcaggatccccactttgcgtcttctttctgggtatgggcagggcacagtgtggcgagggggagaccaagccactcagcccggaggtcatgagccatcacacaactcgccactcgtccagtttgtgtccctctaaagggctcttctagctccgacaagaagttttctcactctgttttcctgtcaccagctctcttacattgctgaggacgagaatgggaagattgtggggtatgtcctggccaaaatgtgagtcaccaaggaggaagacagaagctacacgtgtctggtggatgcctctgtgggctttaaaaaaaatgaataggcttcttcttttcagtacagttgaaagtttatagaaaaattgaacagaaaggacatggagttcttatagcacccctcagcatcccctccctgccagcttcctctgttagtagcatgttggatttgtgtggtccacttgtgacaagtgataaatgaatgtgatatgttactattattattattactattattatttgagacggagtcttgccctgtcgcccaggctggagtgcagtcgcgtgatcttggctcactgcaacctccaccccctgggttcaagcgattctcctgcctcagcctccttagtagctgggattacaggcacatgccaccacacctggctaatttttgtatatttcagtagcaatggggtttcactacgttggccaggctggtctcgaattcctgacctcaggtgtttccacccacctctgtctcccaaagtgctaggattacaggcgtgagccactgcgcctggccgatatattattattaactaaacccatagtttacattactgcacttctctttgtgttgtaagccccatggttttgaccaaatgacatgtgtccaccttcatattatcgcaggatagtttcactgtgttccacgcattcatccctccctctccttaacccgtggcaaccactgattttttactgtttgcatggttttgccttttccaggatgtcacagagttggaatcatactatatacagctttttcaggctggctttttttcacttagtaatacacatttaagcttctgccttgtctttgcgtgggttgacagctcatttctttttttattttttgagacagggtctcgctctgttgcccaggctggagtgcagtggcatgatcatggctcactgcagcctcaacctcccaggctcaagtgatcctctcatgtctgcctcccaagtagctgggaccacaggcatgcgccaccacatccagctaattttttgattttttttttgtagagacaaaaaaaagtgttgtccaggctggtctcgaactcctgggctcaagcagtcctcttgccccggcctgccaagtagctggaactataggcgtgtgccccacacccggcaggcttggggttttcaggcagcagagggtggcaggatcggctgctctgatccaagaggctcccggctctcccccagctggggtcttagggggctgtagtgcatgtccactctacaaatggcaggggggctggaggtggctgtgcctacactgagctcctttgcagcctctcctttctccctctccagggaagaggacccagatgatgtgccccatggacatatcacctcattggtatgtaaggtccacccaggctctctggtgggggtggaagtgggggttagttggggcagccctcaaggtcccagtccctcaccccatctctgctcttctcccaccaggctgtgaagcgttcccaccggcgcctcggtctggctcagaaactgatggaccaggcctctcgagccatgatagagaacttcaatgccaaatatgtctccctgcatgtcaggaagaggtggaagccgggctgagggaagggggattgagggggagagatactgccttgacgggggtcctggggtacctcagcttttggtgaagatccaggaagtgggattggggggaaggagggaccaggaggaggggcaagacctggacgtgctacccctccctggccaaatccgtgcagctcagcagtgccttgttcccctgcagtaaccgggccgccctgcacctctattccaacaccctcaactttcagtaagtagatctcgatttttctaatgggctggggttgatcccaggtctggcccatcagggcacctgagaccggctgagttgccttccaggtcgggggtgggccggctgtggggaagaggctgtggaccccagcactgccaggatacctccacattcactcggcggctgatggttgaaaagccggcatggagacagcacctgcctgctgaaacgtgctccatgtgttgtgatggaggagctctggcccatgatggctgaggctggcgaagggcacacgggctgtttagtaatgtttgggaatagagaggtgtgggtccctggcgtgagcagatgctgaggagcaggactcaagcatgaccaagcacctagaagaatccaagagagagcagaatcgaggagaatgcacattcaggaaggaagggccagtggccaggcagcctagtggatgggggaggtctgcctgaggaccaggaggccccgtgtgcctagcacactagagagaacctggcagttggcatgcccagtagacagtggaaaaaagtgcttgcaagtgaagctggggtgggctgcctgtggagggacactaactgcactcagcccgtttggtaggggatgaagaagagggactgttgggaagggcggtggcctctgggctggatgctggcaagagggatctgtgacccagatgacgatgtctggtgggaattgctttatagctaagtcagcaatcctcatgtcttaggcctggcagggccagcctaggccattgagtccagctccccttccagggacatggccacgcgagtctgcacacacacctgcccagtgtagtcacggccccagagctgctcaggcagggctcaccgtctttcctgggttctgatggctgttgtgaggcagctcagtaagggacagggcgcagggcagggagggaaggggaaggctgaattcagggcttcagctcacaagaaaccgcagaaatggatccttagtatccaggctaaggacacagaacgggggcaggacgggtggggcgggccgctgtgtcctggagcctttgctggagagaacagagggcaggtcacactggacttgttgtctcaggatggagccttcagggagaaaacatggcaccttgctccagtagccacgataccaggagtggaggagggtgtccccgggatacaggtcttcctccttgctctctaaccctctgcccccaggatcagtgaagtggagcccaaatactatgcagatggggaggacgcctatgccatgaagcgggacctcactcagatggccgacgaggtaagcgcctgcatgaagccaagcaaggcgagcgggggcggcactcaggagccccaagacagtggctgcaggcgagaccgactttggatgccagctcttgtggctacgttgccaggagtcacgacctcagtttcctaggctgggctttagaggaggccatctgcctagcagcctggagggtgatgggagaggcagagggaggaggcttttagaagggaagtggggaggtctagggaccagtgggtggcctgcctgctcaaaggtagttctgagtcagggttctgcccaaggctcatcgggtggcagggctggtcaaggggcagcgctctgtcgtgggggcctccatggtagtcggtaagcccaggtagcggtggactggggctccagccaggtgtccccactcagtcccgcgtgtcctgcctagccctgctgcctcactatgcccctctcctcagccagcgacagggccaggctccctttgtctggaaacttaggccctgtctctttgcccccgcttctccctgggttcctggtggcagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactggg
